United States Patent 11,583,558 (METHODS AND COMPOSITIONS FOR TREATMENT OF MICROBIOME-ASSOCIATED DISORDERS) - sequence listing, part 2

SEQ ID NO: 4 - DNA, 2858892 bp, Bifidobacterium infantis WBS-01 (residues 1-1,429,446 of 2,858,892)
agccagccagtttggcgttgccgagtactttgtcggtgaacagcgtggagaaaatggcgattggagacaacgcgcaaatcaccatcacggcgcgaatcgaagccgagaacggcagcaggaaccacgagatcaacgcgaaggcgacgctgaacggtatacgccaagcgatgacggccatgacttccttcacgtcatgcttggattgaggcaggtccatgagcatacccaccatcagcatcgacaccagcgcgttggcaccgctcaacggttgggtcatagaggcgatccaattgggaatcttcacgttggcgacggtcaacgcaatcatgagcagatacgtgtcgaacggcaccgagccgaagaagctcttgccgatggtgcgcagcaatgcgcggcgggcaggccgtttggcgtcgcgatccttgggcttttcgtacggcaaggtgggcgccgaaccggcgtgttgctcggcaagtgttttgccgggctgaatatgcagcagttgctgggtgagcacattggtgccggcggccaccatcacgcagttgccgatatcgaacatcgcagccggcaccaccgcgcccgcaccccagaatgactggacgaccggaaaagaaaaacagccgagattgaagccggcgccgttgagcatcaggaaggcgcggtcggtcacattgcgcttgcgggtggccagaaagatgaacacgatcgggataaaggcaaacaggaatgcgaataccgaaataagcagcagtgagatgtcatgaggattggtggcgaacgagtatacgatggcaccgggcagcacgatattgaattccgcggtctgcaacacacgataatccttctgcccgaacaggccaaaccgcttgaacagataaccggcgagaacgatcagcaacagaccaaccggcgtaagaatggcggacatacacttctctccttggctcacacaggctcatggcgcacaggctcagacccacaatgctgtgaccattatatttgccgccttggcattgccgtgtgtagaggcgtccgcaagggcttgcaattgtctcacgcatatacgaagagcctcccggaatcgttggcgattcaatgcttccaggaggctcaagccggtgcgcgagatgggacttgaacccacacgtcaaagacacaggaacctaaatcctgcgcgtctaccaattccgccactcgcgcgtgcatatccgcgtttccacaggtgtggaagatatgcaaaaccctaggccggacagccattacagaccagtcagcctagggtatccgagccacttgtcagaatcgaactgacgacctgctcattacgagtgagccgctctaccgactgagctaaagtggcttggctcgcggaaggcatttcgccagccgcgcacaagaaattaagtataagacatctccgcgaaaagtccaatcggcggcttggcggttgtgtcgcgaccgctcggttgaagatgacggttgcgccgcgccatgaactgttcgataatgcaaacgatggcaatccgacatcgctgactgatttttgttctgttcatgtccgaatttgtgagtattctgtttggtgatacggagcgcatccgagccgtgagcgaaggcgctccagtcactgatgaaaggaatggaatcctatggccatcaatccgcccgttgacgccacccagacccctgagtgggctgccctgcagaagcactatgacgagcttcaggccgaaggcgtgagcctcaagaagtggttcgccgaggacgccgagcgcgtcgagaagctgtccttcgacgccggcgacctgcacttcgatctgtccaagaacctgatcaagccggaaaccctccagctgttcgccgaccttgccaaggccgtcaagctcgatgagcgcaccaaggctatgtacaccggtgtgcacatcaacaacaccgaagatcgcgccgtgctgcacaccgcgctgcgccgcccggtcgaggatgaaggcaagtacatcgtcgacggccaggacaccgtcaaggacgtgcgcgaggtgctcgaccgcatctacgccttcgccgacaaggtccgttccggcgagtggaccggtgtgaccggcaagaagatcgagaccgtggtcaacatcggcatcggcggctccgacctgggccccgtcatggtgtacgaagccctcaagccgtacgccgacgccggcatctccgcccgctacatctccaacatcgacccgaacgacctggccgagaagaccaagggcctcgacccggagaccaccctgttcatcatcgtttccaagaccttcaccaccctggagaccctgaccaacgcccgtgaagcccgcacctggctgctcgaagagctcaaggccaagggcgccatcgacggctccgacgagaagaacgccgaagccatcaagaagcacttcgtcgccgtctccaccaacctggagaaggtcgccgaattcggcatcgacccgaacaacgcgttcggcttctggaactgggtcggcggccgttactccgtcgactccgccgtcggcacctccctggccgtggtcttcggcccggctcgtttcgaggagttcctgcacggcttccacgagatcgatgagtacttcgccaacaccccgttcgagaagaacgtcgtggtgctgctcggtatgctgaacgtctggtaccgcaacttcttcaaggtcgcctcccacgccgtgctgccgtacgaccagtatctgcaccgcttcccggcctacctgcagcagctgaccatggaatccaacggcaagtccgtgcgttgggacggcacccccgtcacctccgagaccggcgagatcttctggggcgagcctggcaccaacggccagcacgccttctaccagctgatccaccagggcacccagctcatcccggccgacttcatcgcgttcgtcaacaccccgaacccgaccaaggacggcgaccaggacgtgcacgagctgttcctgggcaactacttcgctcagaccaaggccctggcgttcggcaagaccgctgacgaagtgcgcgccgaggtactccggaggagatcgtcccggcccgcgtgttcaccggcaaccgtccgaccacctccatcttcggcgtggccctgaccccgttcgcagtcggcgagctcatcgccctgtacgagcacatcaccttcgtggaaggcaccgtgtggggcctcgactcctacgatcagtggggcgtcgagctcggcaagcagcttgccaagcagatcaccccggccatctcccaggacgacgacgccctcgccgcccaggacgcctccacccagagcctgatcaagttctaccgcgccaaccgcgagttctgatctccgctcctgcgtcgcttcaatcagaactcgcggttggcgcgccgcgctgtgttgtttgatggtcggtctggcgaccgtccatggcgcgagttctgattcgttcctctggctcccctcgggtgagaggagctgtcagtgtagctgactgaggggagtctctctcacgactagtgcccgacatcttcggatgccgggcactttgcatatacggattgctgtcggtcagatgagtcgaatggtcatattccgcttcggcatctgtttgcagacataaaggcactgtctagccaactcacgtggctgattcgcttattcgcccttattcgcctcatccaagctcagcagatcgtcatcggcatcgtaatcgaagagttcgccgtaacggccccactccacggcgatggcgaactgctgatgcgcctcgtcgttggcgtaacgggcgcgcagcaggtccagcatgagctcgccgcggagcttgccttccgcagacttccgcagtgcatgctcaatgttgtgcaccagcggcgcgtgttccattgccagtgaggcgaacacctgcttggcgcgcagaatgtccgccttatgccaggagtcgcccgcctcggtgatctgcacatggccgtcgcgtaccacgatgacgcgcagcatcgtaccggcatccaccagcgggaacaggtcgtccacctcgaacgaaagagccgaggccaaatctgccaagtcgatgccgtgaggatgctcggcaaccacatccagcagaccggcaagcccgcccggcgtggcgttgggcagcggatgctccttgattttctcgatggtcttggcgggctgaaggtctgatgcgtccgtgacggatgcgtccgtgacgggtgcgttcgtgagcgatgccgatggcgataaagcctcggcttgttgcgtaggctgcgaggcctgtccggtcaaaatcgcgtacagtcggtccaccatcgcctcgaattcgacactgtgacggtcgcgcgggcgcggcagatcaacccgcacatcggcaatcagatgccccgggtgcgagcccaacaccaccactcggtcggccatctccacggcttcctcgatgttatgcgtgaccataagcaccgacttgatgctgcgctgttcgctcgaccacagcttgagcacttcctgacgcaggttttcggcggtcagcacgtccagggcggagaacggttcatccatgaacagcgcgtccggccgcagcaccaaggcgcgtgcaatgcccacgcgctgcctcatgccgccagacagttccttcggatacgccgattcgaagccgtccaggccgatcatgtcgatggcatccagagccagtttggtgcgttccgcacgtggtacgccgcgcgccttcagaccgagttccacattgtcttgcacggtgagccacggcatcagcgcgaaggtctggaacacgagtgcgatgccgggattcggaccggtcagggcctcgccgcgatacttgaccgtgccgctggtcggcttgacaagtccggccagcgcacgcaggaatgtggacttgccggcacccgaacggcccagaatggccacgatctcgccctcgtacaggttgaacgagatgttgtcgaacacggtgagttcggtgccgttgtcggccgtgaagcgctggccgacgtgctgggcttcgatgatggtgttctgcggggtcaccgcccgcagcgaacgaatggtttccattgcaacagtcatattattctccttaagtctttagttcagtgcgaaacggcgctcggccatgcgctgcagcgggttccagaacaggcggttgacggccaccacgaacacgctcatcacggtcacgccgatgatggtcctcacggtgttgccgctttcggtggcctcggcgatatacgcgcccaagccggaggcggtcagcgtatgccgtccataacttacgatttccgagacaatcgaggcattccacgccccaccggccgccgtaatgccgcccgtgacccacgagccgaataccgccggcaaaatcaaatcgcgccaccgctgccagcgccccagctggaagctgcgcgtcatctcacgcagatcgtcgggaatctggctggccccggcgatcacattgaacaggatgtaccactgtgtgcccaacgccatcagcagaatactgccccagttgatatccacgctgcatgccacgaaccagagcgtgacgaacgggaacgtgaagttcgaggggaagctggccagcacctgcacaatcggctgcataaaccgcgaaacgcgcggattcatgccgatcatcgcgccaatcggcacccaaatcgccgagcagacgagcgtaagcagcgccacgcgcaggaacgtcaccatgcccaacacgaacgcctgcccgagctcgccgaatcccgcatcgcgatgaatcaccagcataagctgcaccagtccgaacgcacacgctgccaacaccagtactgtgaataccacgtcaagcgcgcggctgcgtgcggacttcacgtccgccgcccaacgtccaccggtccgacccaacgggcgggtcagcgtgtcgaacaggtcgccgacaggcctgaacagccaggccaccatctcatcgatatgtgactgacgaatgatggtcagcaccacactggtcttgcgcaccgccgactcgctttgcgtaatgcggaacttctccgcccacgcggtcaacggcttccacagcagtacgtcgataagcagcaccaccagcaccatcgtcacgatggcccagcagatggccgcgagattctcctcggccgccgcctgtgccacgaagctgccgatgccgggcaacgcataggtgcgattgttcaccgagatcatctcggaggcggtcaggaagaaccatccgccgcctacgctcatcatgcagttccacagcagcggaatcatcgcgttcggcacgtccagtgtccagaatcgttgccagcgtgtgagctgtagtgagcgggccgcctcgtcgagttcagttggttcgctggtcagggaccgggtgaacgagaacgccatgttccaggcctgactggtgaagattgcgaaaatcgacgcggcctccacgcccagcatcgagccggggaacagcaccatccagatggtgatggtggccgaaagaaagcccagaatcggtaccgactgcagaatatccaacagaggaatcagcacgcggctcaggcggcggcagcgcgcggccgccgtgccgtagatgaacgtgaacaccagtgagaagaacagtgccacgagcatgcggaacaccgagcgcagcgcgtaatacggcaggtcggcgagattcgtactgacttgtgacggcacgcctttcgggccgatcggttcgccgatcgccggcagaatccaagcgatcagaccgaacagcgccagaataccggacgcgaccagtacgtcggaggccaggcgtacggcgaatggttggcggtcggacgcggcggtggaagggttgcgggccgacgcatctggacgcgcgtcgacgcgattgaatgaaaacatggtcatgaaaagacctccctatgcataggaaagacgaattatgcaagggttatccaaggagcactacaggcgagagcccgacttccggataacggaatataagaaaacatggtcctcaccaccgcaactatgactgttgccggcggcggaactactggaataatcaccgtccatcggactctcacctccttcaagccgtgcgctgaaacgccagatcaataccatcgtcggtatccatgcgaccagcaggaggggcggaaagtattcgaatccgccgattcggccatcgttcaagcttcagcatcgcagggcggtggaattgcgttagttcatgccttgatccgacaagaactgctgacctgcgtgcagtgtctccactgttagcggcagcaacccatatccctgcggtagcctcgcctaccgacgctcccaagataaagcccgcccgcaggtctgtcaactacgtcgcagtgccttggtgttggaatgcaatcaggcagccattctgtccgcaataatccgtacaattgacgattgctgtgtcgagaagtgggccgccgcataagcccacgtctccatgggtccagtccgaacggccgcaaggcctgactttcggcggatcggcaggcttcccaagggcaaacccgagggataacgagaacaggccaacgcacgcgatgcgcaatcgcgtggatggccccagatctgtggctgatatgcggcagcactgaaggaaaacaatggttaacgctgttgaggcttttgacgccaagcacatgaagccggccgaggaaatcccggccttccgtcccggcgacaccgtcgacgtgaacgtgaagatccaggaaggcaacaactcccgtatccagaccttcaccggcgtggtgatcgctcgtaagggcgctggcgtgcgtgagaccttcgtggtccgcaagattagcttcggcactggtgtggagcgtcgcttcccggtgcactccccgtccatcgactccatcaagctcgtgcgtaagggccgtgtgcgccgcgccaagctgtactacctgcgcgctctgcgcggtaaggccgctcgtattgccgagcgccgcgacaactccgctaagtgagtcgattcgcgggtgcaatcgtgggcctgatgatgcaggtgcgcgaataaaccgtgaaattcagcccggaaccgtttcggtttcgggctgtttccgtattttccacgtatgatggacgggcgccggcacccctcatatccggcagcatgaatcgcgaggagatggtatgcaggacgatcaggataacggcgaattcccggtttccgacaatccggagagcaaccagacctcgtatgatgacgaggccgatgcccgcgattcccgcacgttccaagtcgccgaccacggcatcgccctgtccccggttcccccggcaccggcgcgccctgcgcacgccgcttcttccgctggcgcgaatgccgcggcagcatcatcgatggatgatgaccacttcaccctacgcgactttttcctgtggtgcggcgttcccgtgcttatcgtgctgctgattcgcattttcgccgtcggcttttacgagattccttcgcgctcgatgatggacaccatggtgcccggcgatcgcgtggcgaccagcaagctcacccccaagatcttcgatctgcagcgcggcgacgtcgtggtattcaaagatcccaacaactggttgaacgaggagcagagcagcgctctcggtggcgggtacctcatcaagcgactgatcggactgcccggtgacgtggtcgaatgcaagggcgcgggccagccggtgaccatcaacggcgtggccatcaatgagacctcctacattcgccccggcgtggatccgagcgccttcccgttctcggtaaccgtgaccgaggaccacgtgttcgtcatgggcgacaatcgcgccaattccgccgactcccgctatcatcaggatgacggcgatcgcggcttggttcccatctccgatgtggtcggagtcggaatcgcgagatactggccgcttgaccggcttggtgcgattgatgactaccacgaagtcttcaaggacgtgcctgacgcttccggctcaaattcctgagtcttcgttgaaccgtgtgagtctttgaactgattgagttccgggccgtctgaatcctgagccatatgaatcctaaccattgtgagacgatgggagccgcgcatgattaccccgacacttgacttggaacgcagccttgcggcccagggctatgaccttattactggattcgatgaagtcggccgcggcgcgctcgccggcccggtgatggtcgggtgcgccgccatctgggcccgtgatttggagccgttggatggcgatgatgccgtcgaactgtccgggcggacctacctcggcgtgccggacggcgtggccgactccaaaatgctcaccgaacataggcgcgaggcgattttcgacgaactgcgcgactggtgcgcggcctacgccgtaggccaggccagcaacaccgagatcgacgaatggggcatcacctacgcgcttggcgtggccgccctgcgcgcgctcagccaagtcgaacgcgaacttggcttacggcttggagggagattggcggcaagaaaggcttcgatggagtctgcgggggagattgtggaaggtcatccgggagactccgtaggggaatccattggaaattgtagggaaagcgttcgcgccctgcccaaagtcgccggaattctcgacgggccgagcgattacatcaccaaggcgctcaacacgttcgacgcgccggacgtgccgattccagccgatataacgaccaaagtcaaaggcgaccagcattgcgccaccgtcgccaccgcggcggtcatcgccaaagtgacccgagaccggctgatggtcgacctcgcgcaaagcaacccatgttacgccgcctacgaatgggctcataacaagggctatggttccgccgcacaccgtaccgccatcgccgaacacgggccgactccgctccaccgtgtctcatggcacctgacctgagccgcctgcgacacgacagtgtgagcgctaacgcaaaactgttgtggacgcgctaaagtcagtattgattaaggtacaagactggccgcgcatgggtgccggccgccagcggggaggttaggcagcatggtgaccggccgcaagccaagcaaacgtccgtccatgttcgaagtggccaagctcgccggagtcagccaccaaaccgtctcccgtgtgatcaatgactcgccggacgtttccgacgccacccgtgcgcgagtccaggccgccattgaccaactcggctaccgcccatccaattccgcgcgcgcactggcttcccgccgttcgcgcaccataggcctgatcgccggaggcctcaaattcttcggcccgatttcctccatctcctccatcgaatccatggcccgcgagcacggtctgttcatgagcgtgatgatggtccacgaggctttgtgcacacaggtcgacttcgacaacctgtgctacaccttcaacgagcagaacgtcgacgccttcatcttcctgactccgaccgacgtgatgttcgccgccgcctgccgtgcgcgagtcactcagccgcgcgtcatcgtcaccgccacccacggccaaatgaccgtgcgtgagggattgggccttatctccaccgaaaacaagcgtcgcactgcgctggtcggtatcgaccagtggggtgcaatggccaaagtggtggccttgctgggcgaatacgggcacaaatcggctctgtattttgccggtcccaacgaatggcgcgacgcccacacccgactggatgcgtggcgcaagctcgccgcctcccgatccatcgattcacagatcgtgcgctgccatacgtgggatgcctctgaggcatatgcgcacatgaatcatctcattgatgagtatgggcgtcggggcatggcgttacccactgcggtcgtcgccgcgaacgacaatcaggccgtcggcgtcatgcgcgcgttgcatgagcatgggcttcggattccgcaagacatcagcgtggtcggattcgacgacatgtctggcgtggataacatgtacccaccgctgaccaccgtgcatcccgatttcgaggggcttggcgtggccgccatgcgcgagacgctgcgtttgctgggggagggcggcgagccgaccttcctgaccacccagcacggcgtgggcctgatccccgccgaagtgcgtgctcggcggtccttgggaccggctccccggcggtaaggctgggcttagcggggcgcttcttcggatgattcgagggtttgcttcgctccccggtcaagattggcatggacgtgatgaccaagcaggagcacgtgcaggtcgactctctcgtgggccatggcggcatcttcaccactccgaaggtggcgcttggggtatggccgtgctcgccaactacctgtggaacaccaacgaggatcacagcaacctcgctgataagtaagcctttctgacctccctttattgagggaagtccttgagattttggaaaaacgtccatccatcacagtggaaaggtcaaaaatttctaacacgggtttgcatatttcttattccggtgtttataatgcagtcaacgtccattacattaaagaactgaggcgatggggaacgtcaccgcagacgtgcaccggttgttgttgccacgggcaacaaccatagtgactcggtccttgtccttcgtccacgttccaaccgaccctatacgcccatagaggagtgaattcccgctgcccgcgtaatcgataacgattgcgcgttgtatggcgaaagacgacgccgtcttccgccgaatagaaaatagaaagaaacgagtctgacaatggcattagatgttggcaaagcgttgaaatccaagaccttggtggtcggcgtcttgtcgatgtcgttgctgatgtccgccagcaatgcagtcagcggcaccataccggcgatgaaggaggcgttctccgactattccgcggcgaacgtcgaactgctgaccacggtgccgacgatcggctcgatggtcggcacggcattgaccggcctattcgccaatgccatcggcaggaagaaaatcgcgatggcgggattcctcatatccgccgtcacaggcgtgattccggcgttcttcccgtactattggccgattctcatatcgcgtatgttcttcggcttcgggtcggcgctgttcgtcaccttgagtgtgtcgtacatcaccgacctgtatgacggcgatatgcaacgcaagctgcttgggtggagacaggcggtcggcaatcttggcgacgtcgtgctgctgttcgtcgccagtctgctgatcaccatcaactggcaatccacgtacctcatcttcttcctgttgttcgtccccatggtgctcgtgggcatgttcattccgaaggagttcgataacttcagcattcgcagcgcgctcgtcgacgatgagggccacgtcgtcgacaagagcgcctcgcagaagcagacgacgaactggcaggtgctgtggctggcgttcatcttcctggtggtctccatgctttacaacgtcatgtccatcaagctcgccagctatgtggtcgatgaaggcatcggttccgcatcgctcgccacattgatcttcagcttcctcgtcgtcgccaccatcctctccggcgtgttgttcgacaaggtcgccaaggtcaccaagcgcctgacggtgaccatctccgaagtggtcatcggcatctgtttcatcgccactgcgctgacgaagaacgtgccgctgatgttcgccctggtgctgattgccggcttcgcatggggcatcatcaaccccgcgctgaccgcacgattcgtggactactcgcccgcgcactcgatgaacctgaccacgtccatcgtgattatcggcatcaacatcggctgtctgatctccccgtacttcttcgcgctgacggcaagcatcttcggcaattcctcggccggattcgccatcatcgtcggtggtgcgctctacctcgtgatggtggtcatcgagctgatcaccctcaaggtggacaagaagctcacggtgtgattcccgcggcgacggagccgtaccggaaccggacgacggcaatcaacgaccagcaaccaacaaccagcaaccaatcagacacacagacaacgaacaaaggagtttcaacatggtgttgttcatggccaatccacagcgtcccaagatgtatgagaagttcgtgcacgatacacccgaatggttcaagggcgccggtctcggcatcttcgcccactggggttcgtattcggtgccggcatgggcggagccgatcggtgcgcttggcacctttgacgatccggtgtactggaacacccactgcccgtatgcggaatggtattggaacacgatgagcatcaagggctcgccggcggccgagcatcagaaggaagtctacggtgacatgccgtatgaggacttcatcgacatgtggaaggccgaggcgttcgaccccgcggacatggccgacctgttcgcacgcgccggtgcccggtacttcgtgccgaccacgaagcatcacgaaggcatcacgctgtggaaggcccccgacaacgatgggtggaataccgtggaccgtggtccgcatcgcgatctggtcaaggaattcgccgacgccatgcgcgacaagggactgaagttcggcgtgtactactcctcgggcctcgactggcacaaggagcccaacatgccgattctcggcgacggggaatacgggccgcagagcgaggactacgcccgctatatgtactcgcatgtgatggacctcatcgacgaataccagccgtccatcctgtggggagatatcgacgtgccgaagatctcggaggaggacaacgatttcagcgtggcccgactgttcgagcattactacgacgtggtgccggatggtgtggtcaacgaccgctggggcctgacccattgggacttccgcaccgtcgaatacgaacagggcaaggagctcatgggcaagggcatgtgggagatgacccgaggcatcggctactccttcggctacaaccagatggaggacgccgactcctacatgaccggtccggaggcggtgaagttgctcgccgacgtggtctccatgggcggcaacctgctgctcgacatcggccccgacgccgccggacgcatccccgaactgcagcgtcagtgcctcgagggcatggccgactggatggacgtgaactcgccgagtatccatgatgtcgaaccggtgccggaagcctcgccttccggagagggggacggcgagccatgggttcgttggaccggagacggcaagagcgtctatgccgtcgtcgatgctgcgggcagggttccgctgcgcatagatgcgggtgcggtcgatgtggattccgcaaccattcttggcggtggcaacgttgtcgtggaggcggacggcgatatgctgaccgtggagattcccgcgacagacgtcgccggccctcaggtcgtgcgttttgctcgacactaatcagctcttatccatgaaggcggtcgcagtccggccggcgcggccgcctcgctcatgagtggaaaaattctaaaacaatattgaataatttccttaccgtacattatcccttactgtaagaacctattgcaaggcgaaggagcctatcatgagtcgttttaccaagtgatcccttcctgcgacgaagtgctcgtgtattacggcgaatagtgcatgaccaaaagcgtcagtcaaaaaagagagggcccgcaaaaaggccctctcttcatgccggatcacaaggaaccgcgcgtctcaccgcttgccgttgtagatctcgttgtcgatcacatcggcgaacacgtgattaacggccgggcgcaccactttcagcgacggcgtcaggcacttgttctcctgcgtgaactgcgtgtccagcacggcgaacttgcgtacggattcggcgcgcgagaccgtcgcattcgccttgtccacgtactgctggatctcctcgcgcaccgccgcgttcgtggcgagccggtccaccggcgtctccgtggacagtccatgcgcgggcagccacaatgccagcgactccggatcgagcgtcaccagcgcgccgatgaacgggcgctggtcgcccaccaccacacagtgctccacgatcgggcatttggcgatctcttcctccagcggaatgggggagacgttcttgcctccggcggtgatgatgatgtccttgatgcgtccggtgatggtgatgcggccttcgtcgtcgatggacgcgaggtcgccggtcctgagccagccgtcggcggtgaacgcctcggccgtcttctccggcagattgtggtagccgcggaacacgttcgggcccttgacctgcagttcgccttcgtcggagatgcgaatcgaggagccgggcgcgggctggcctacggtgccgatcacattgtcggtcacgcgcgtggcggcgaacggggcggcggtctcggtcatgccataaccctgaatcatcggcagtccgatgccgttgtagaaatgcgccagatcaagcgacagtggtgcgccgccgcaggccacgtacttgatcttcgggcccagagcaccgcgcaccgtgcggtagacgagcgtttcatacttggcgcgctcggcgatttcggcaaacgtgtgctgctcgccggcctgctccttgcggctccagacgcgcgcggcctcggcggccttgacaaacaggcggcccttccagccggcaccggccttgtgcgaggcggcgttgtacaccttctcgaacacgcgcggcacgcccagcaggtaggtcggttcaaacgaacgcaggtccggcagcagggacttggtatccggcagataaccgaccacgccgtcatcggaggcgatggaggcgtactggataaatcgtgcgaagcagtgggccagcggcaggaagagcagcaggcgtggatggtcgtcaagcaccacttcatgaagcgcctgcgaagcggtgatggtgatggacacgaagttcttatgggtcagttcggcacccttcgggttgccggtggagcccgaggtgtagacgatggtggccagatcgtcggcgcgcacggtggccacgcgctcgttcagttcctcgtccgaaacagacacgcccagaccttcgagcgcgcccagtgcgttgccctcgagcatgagaatctgcttcaaggcagggcagtggtccttgaccgagtcgagccggtcgaagcgctcgcggttgtcggcaaaggccagcttgaccgccgaatcgttcatgatgcgctgggcttgcggggcggagtcggtgtcgtagatcggcacgcttaccgcgcccactgcggccagtgcgaaatcgagaatgccccattcgagacgggtggaggagaagatggttaccgcgtcgcccttggcgatgccgagcgcgatcaggcctttggcggctgagaccacgcgctcgtggaattcgccggtggtgacgttctgccagtggccggggccgattttcttggcggcgattaccgtgtccgcgccggtgcgggcaaggcgatcggtgagcagtgaatagatagtttggtcatcgcggatctcgatggattcgccgggcatggtgtagtggtcaagcataagcgggccgtgtccttacgtgcgttgcgtgatggctgttgacaaatcgagccatcctgacaagttaggctacgctggcgtaaggttgcgcgcgttgtgggcaatggagaagttgtctgtctggttttgtggattgtatacaacgccgtgtctaaccggtttgctctacggttatgaccgtgtccatttcgggagccatcgacttcctgcaggacaagtacgcgctgagcccggccctgcagggtctggtcatcagctccatcatgatcggcggcgtgatcggcgccggcttctccggcttcctgtccgataagtacggccgccgccgaagcactggtcgccgcgcagaagcagcactaggccgcgtttgctgcgtctattggcgaattgatcatatgggtcgtctgcgtgcagacgacccttttgcgttccgaaggcttctgacaccgtagaaacgtgctttctcggcttcgaggggctgattttgccttatccggaagtctacttccacttcgaggggctgatgcccaagtagacgcggccctaaaacggcggaatgacgttgacgtgtagccgtttatacttccgattacatggatgaggagcccctcgaagcggagatagacttccggcaaatgcgaaatcagccccttgaaacggaagtagacctccggcaaacgcaaaaattagcttcctcgaaacggataaatgtacgtattgggtgtagttgatgcttcagcccctgatatcgaagcatatttcttctggttggcgcgtctagcatgcgcactccgcaatcgaaaattctgtggcctctctcactttaaaagtctggcatgtgcgagggcgttcgcttaaggtgaatgggattgcgcggaatgtggagcgcagggtcatgaccatgcgcgtgctgcagatccagctgcgctcgctgaccgccatggatatcgtggcctacggcggtgcggcggccggcattggtgtggctctatggcagtatgcgcataccaccgcagccgccgcaggagccagcgccgccggctggtcgccgatcatgctcgccgcccacctgcccggcgcattcgcctacctggcctacggcctgcaatacctgatgccgttcggtgcgggcttcccgctcaccctcgccggactgctgctgattgtgctgctgtccgccgaattcttcatccccatgcgccaactcggctcctacttccacgtggcgatgaacggcatgacctccaccaaacgtatcttcgccctgctggacacccccgagcccgcccatggcactgccatgctgccggccgccactggtactgatgtcgggactgataccggtaccaaggccgggaccgaggccgatggcggaatcaccgtcagcttcgaccacgtcggctattcctatgacagcgccgattccggtgccgccgttcagcaaatgaattccgcgccggcacctgcgctcaccggcctcaccttcactgcctaccccggtcaactcaccgccatcgtcggcatctccggttccggcaaatccacggctgccgcgctgcttgccggcacgctgaccggataccaaggctcgcttacgctgaacgacgtcaaggtatccgacccgtccggagagacgctcgcccgaaccatcaccctgatcggtgccagtagccatctgtttgctggtactctgcgtgagaaccttctgatggctttgcctgatgacggccagaacggtgacgttgcgtccgacgccgccaacctgtccagtggccagctccggctgcagcgccggccgagatgagcacgttccaagtcatcaagcggttactcggggaggccaagccgctggccgggcttatggtcgcggcttccacggccggcaccatcggccaccttgccgcaaccttcctaccggtgttcggcaccatcgccggattcgcactcgccggcaaccccgtgaccaccaccatcgtctacgccatcgtggcggccacgctgagcccctggatggtgttggcgctgatcgccgccttcacgctgctcgccagctcgttcgggccgacgctggcgctcgccgccctgcccgcgaacctcacccagaccttcgcctccgcccgtcgtctgttcggtctgatggacgaagcgccgggcgtggtagaaactggcactgcgaactcggattatgagggcatgcgccttgaccgcgtcactttcgcgtacccgggggaggagagcgaggcgattctcgccgacttctcgctcgatgtgccgcagcacggcatcctcggtatccaaggcccatgcggcaggggcaagtccactatgctgaagctgctgatgcgctattgggacccgcagcgtggccaagtgacgctgtccggcacgccgctaccgcaaatcgatgtgcatgcccgccgccgtattcaggccatgatgagtcaggagacccacctgttcgacggcacgattcgagagaatctgcttatcgccttgcctgaatcggagattcgcaatgggggagcggccggtgttcttgacgcccgactccgcgaagccctcgccaaggcatccgtgcttgacttgattgattcgttgccggatgggctcgacacccaggtgggtgagctgggcgaccgactgtctgaaggcgaacgccagcgcatcggattggctcgcgtattcctacgcaatgccgacttggtgctctttgacgagccgaccagtcgtctggatgccttgaatgaagccatcattctgcgttccattcatgagctgtccaagagcgagcagaatgcggataaggggcaagacgtggctgtagtgctggtccctcgccgtgaatccgccatgcgcgttgccgatgcggtgctgaatctgtaaagtcacacagtcacaggccgcaatactctgcaatacaggattcccgccttgcgcgtcggtgcgtttcggctgcgcaaggcgggaatcctgtatttccttatatatcagcctctgataagggcatccagagagtcgagggccgcgtcgatggcctgagcctcgcggtcgtcatccgtctcggcgaaggaatgctcgctgtaggaatcctcgtcggcactgggcagtaataccccgcgaggcgtatcggcactgtgcgcgtgctcaatagaggccatatgtgccggctgcacggcatttgtctgcttgcggtttcgattcgcgtcattcgcgaaatcaacggcatctgcggcatcaacgctatccgtatcatccgcaccactgcgcgtagtcggccgattcgccagcgtgcatgggtcgtcgggcaacgaatcggccaaggccgcgactgctgcgctggccgctgcctcggccgccgcgccgtccagcatcgcaccggccgcagagccagtcacggagccatccgcagggccgcccgtatactcgccgtcgtgccgtctactggatgacttaccaaccagaacagcgcccctcgtacgccgcacaagcgacggcacgttctcatccgtcgtgacttccgagacggtcgctgccgtgtcttcttctgcagccatattcgccgctgccttggcggcttcctcggcagcgcgctgcgccgtcagccgttctgcctcggcccttttggcggtctctatggcgaaaatcttctgctgtgccgcagcgcgagcccgctcagccgcatccataattcccaatgcctgctgacgttcgttttcaatacgacgcagcgtggcttccgcgtggcggatattcgcatcagccgtgctcagcgagtattttgcagaggccaaatcggttttcggctgccatagatgctcgatttcctccagcgtgcgtcccattgtctccggcaccaacgccacgatgccgaacaggcaaatcagatccagaaacgcgaaaatcgcgaacgatatgccgccgcccaatccatcgatcatcatcggcgtgaattgtgcgatgatccagttggcgaacagcagacacatcacacacaatccggtggcacgaccgcgcagatacgtggggaagagctcgggaatcacaatccaaggaatcggccccatcgaaaaggcgaacgatatggtgaacgccatgacgaatataagcgtcagcagcgaattgcccatgaaatacgagcccgaaatgcatagcgcgaacgcgcacatcatgccggtgcctatttccataagacgtttacggccgaacgtgtcgatcaggtacatgcctaccacggtggccaccagctccacgccgcctacgctggcggccgcgaggaactgagtgtccccgccgaacccgagatccgagaacatcaccggcccatagtaggagatggcgttcatgccgatgaactggttgaacacggcgagaaagatgccgatgacgagtgcccgtcgcaggcctggacggaacaaatcatggaattcgtgcgacatctcggtttccagtttgaccgaggcttggatgtcatcggtgcgcaggcgtgcgcgttcggtgccgaggatgtgctcgagcaccgcgaaaccttcatcggttctgcctacctgaatgaggaatcgtgggctttccggtgccctccgcatagccagcaggaaagcggcggccggaatcgcgcctaatcccagcatccagcgccatccaatggcgatatcccagtcgtttgatccgtaggaggcgatgatgtagttgatgacgttagtcaggaagaggccgcaaaccgcaagcaactgataagagaaggcgagcagaccacggatgttggccggagccgattcggtgatatatgtgacggccagcgcggcggtcaggccgatgccgtagccgccggccacgcgcgccacgataagcgctatgggacctatcgtcagcgcactccatacagccgcaacgaggaagaacgcgccgccgataataaggatacgttttctgccgaatcggtcggaaaggaatccggcggtggccgctccgatgacggcaccgagcatgatggaggagatgacgaggccctccatgagagtactgagcccatatctggcgcgcaggaattcgatggcgccggagatagagacggtgtcgtagccgtacagtaatccggcaagacccgcactcaaagccagtccgaatgtatattttcctgatccgcgggtgcgtatggctgtccctaaagggttgggctgcttggaagcagtccgaaacagtcccgccatgtgctcttcctctcaatacagctatgggggtgcctattcatactagccgaactggctccgtctggcgctggtcccggcccgtcacgcaagacaatccatcctgggatgtgaatcagaggaattcgccagtctttccgaatgcactctaaagcaattcgccagtttgcagtcagcaagggtgttattgccatggtatagaaagacgggaaatgctctccttgccactattatcctttgataatgtcccatttatgtccttggcttttattctaagctgagatagtcctctaccgcctgtcatagctcgtgcggtataacatgaggacttggtattacacgtattgcttgatatgactgttatatctgctgctgtgatattgacgataagactgcattcttttatcggatcagcgtacttgatcatattgctggtgaattcatctatgcccgtatggactatatccagcactttgggatcgtagctgagtggcatagtgcccagaagttgtgtgttcacagcaaaaccaagttcacgcatctcttccttggcctgtgtaagatgtgcatcaagcatttcctgctcagtctcaggggcgggagacattctggacttaggaagctcgactctatcgtgtgattcattgtctgcgatggtttcggaaccgagtacatcgattgtcgcccgtattttttcgagcagatcttgagatatgtcaagtagttcagagatttcggcttggtactgttcagattgcggtggttgctcacaccaagtccgtatgtcgtgctgcatgcgaagtatctggtaggcgagtcggttggtcacttggtcgtggagtgttgcagcaattaactcgcggcggcgacgttcctcgttaatctccctctgacgatccagctcatggcggatctgctgcatgcgcatgagcctaatgcgccattgcatgccgacgccgatacatgaagcagcggggagcgctactacggcaatcatgtcaaaaataggcgatggactcgcgccggacattcccagcatagcgtgggagacgacagttacggatgattggactatgcctaagccgatgcctagtcctgtatatcgaaatgagaccagcattagagtggcggcaaatgagaggaacaacgcccaagataattcagataatgcgggaaccatacaaatgcacgcccaaagcagagtttgcattatcgccgccacaagtggaaaacgtatggagatgatggacagaaccatcgctaccacgccaatcgcgaacgcaatccatccaattacacccgagacaagactggcgaccagcagtatacttccgtatccgcatcctgccatgaccgcgattgcgcgcatgtacatccaactgctggtacctatttcgtcgttctgatcctgtgcaagtccattccgtttggtgttttcatggttcatagcagtccgcgtttctcgcacatgatgatggcgtggattctgttccgtgcatgcaatttggcgaccgcacgtttgacatacgtgccgatggtgaacttgcttagggacaaagacctcgcaatctcctcagtttccagtccttcggagtacatgcgcaggatttcaacctcccgtgcggacagtcgatctccgttcatccaacgcttatctgaagccttagtaaagtctggaataaggttggaagcagtgtctggcacatcagtgaaacgtgctgattcatcagcagcgcattgcgtcgccgagcccatcgatgcgcgtcgtacggcgctggacaagatgcgtaagtccgttttggagatcaacgcctgagctccggcttcggcggctgcgcgagcatagcttcccagcgaaaatgaggtcatgcatactactccgatgggtagcgaatgacggcgtaaggtcctgcataccatggcaccgctcgtgttctccatggacatatcgaccaatatcacttgcggacgcgttctcggggacaagcagttgtcaatcgcatcgtcgcctgagattgtcgtccataggatgtgcagccaaggcagactgcgcaggatgctcgacaatgccgccaacgtcagctggtcgttgtccacaatgcccaatgtcacttttccttcgccttgttggttcatgtcttgatgatattgcggatggtcgccagcttcccacaatgtcacttatgaagtgacatcggtggattgtcccggaagaaggcgataccttgaagacgttccggaaagattccggaacggcgaacgcgggttccggtcagtgttgacggaattcatgggtaacggaacgatcggatacgagaatggagcacaccatgtccattcaaacaggaaaacagtccaagctgaagatgatggcggttgcattggtgacctgcgcatcgatgacaatcatccctgtggcatccgcctctgctgctgaggccgacgtcattgcgccgaccacggaaagcggagagtatgggattcggcccatgtggctcaacccggagggtaagcatacgcagtaccctgctcagggcggtatctgggaatggggcttctggaacgtcaagattcgttcctattacacgcatgacacacggacgcatggctcttcggtctcgttgaacggggataccgtgcgcagcatcgatacagtcgcaaagaagcagtccattgcagagaaatacgctgtgaactattggggcaataacgacgcctactactatcgggtgtcctgaaaggtaatgatgaacggccgatggcatatggcattcccgtgtggtatcggcctctcctgatgattggagtgtaccatgcatcgtcgcctgttcttcatggtatccacgttggtatttctgctcgccacgttattgtcagtcatggccagcgacctacatgacagagctttaccccaaggaattcatcctacaatctcgatgacactggattttcaatcacctaacgtggatgacgctcaaatgctgcgagagcttgctgatatcggagaacagcaacaactcggcatcgtcaaggttatgcctgaccttgacggggatgcatccgctcaagtatttgtcgcgctagattccactgcaagtgaaagactgcccgagggaacttcagtccgtcgatttggaaacatgccgagttctaaggtggcaggacagtcgcgtctgtcggcggcctctgcgagcggtcaatactatctactgcaaggcaaccagtctgataaagcactgcgcgattggacggtacgcaatggggtaatggtggcgtggggtgcggattcgttgcgtgatgacgtgcgcttgctagcctcacagtcaagtttcgtgatgtcgatggccgcggctcttgccctgatggtgacgatggttctgtattggatggcatctaaagttcgttcaagggcgttgcgggtattagctggcgtctcggtatggcgcatacagaaagacgacatgatgggcattctgaccccatcgctgtgtgcggcatgcctaatcgacatcgtctcagtcacggtggttggtgcggttagaggcgcggtgttcataccatacttctctcgcatactactggtacttgaagggaccgtgttggcaggactgtttgtggcgatgctgattgtcggcatgctgtcatggccttcagcaacgatgatcatgcgtcgcgcatccggcaatatcggactacgccgatctgctttggcaatgaaagcgatggtattcgtagcggtgctggcggtgactgcgcccgcaatgtcggcgatagcatcggctgattcatcggcccgcgagcaacgtgtatgggagcgtttgtctaatcaggtctcaatagcgctgtcgtatgaaaataacccccaactggatgcgaaggtcgcgaacgtgatgcgtgaaatagaagatgacgggagaggagctctctcctacacgttcacgccagaaatgaccggagccccaagtgctgaaccagtagcgttagtcactcagcaatggctcaatatggtacaggtcgacccggctcacatggagcactcagtccgcgtcacgttcgattacctacccgcggaggcgaaagacatagtttctcagataccagcatggagtgcagattcccagaccagtgtgaatatgctcgaaagagccttgtattatagcgtttccggcgatgcaatacccgtgctcaaaggcggctctgacactatgcttttcccgaaaaggctcacgctcatagttctccctgactactcgggattctccgactcaggatttctagtgccggcggccaccacacgcaacatcgtgttgacgggtcttcaggatgtacgagcaagattgcgacaagcagggttgtcaagacaggtcaaagtgcgatacatcgctgaagagcagattctgcaggcccagttctctgcacatttcgcttggctgcaagccgctgcatttgtaatgcttattgttgcgtttgccttaaccgttatggtgcatgcgatggtccgcgctgcgctgcgcgcaagacacgactatccgctcatgctcaacggtagccccgcaagacgattggcggagtccacgatacttgtggagagcagtacggcgttagtaggaggaattatcttcgctgcaatagcacttcgctctacaggcatctcagctgcagtaatgaccggagcgctgggtttgctggcaatcttcatttccgcactttcgcacattctgtccgtacagcgcatgtttgtgggcatcaataatcgcactctttaatcaaccgagcccagcagaaaggacatgtttatgaccactatagaatgcgacaacctgacggtacgcattgccgggcgaacaattttcgaacacgtcgacctacatatctccgaaggtggtatggtcgccctcactggccccagcggatgcggaaagaccacgctgttgcacacactcggtcttctacaggaagcggatggtggacgacttatgatcgatcgcgaaaatgtcacgcacgcgacagccagaagacgtagacgattctggcatgacacggcctcgttcatccttcaggactacggcattatggacgaggaaagcgtggctttcaatgtctccatgcagcttggaccatttggacaacgtgcgggaggggaccgcaaacagatacgagaggctctcagagctactggactggcaaaaagaactcaggaacccgcgtctcatctcagtggaggagaaaaacaacgtcttggaattgcgcgcgctatatacaagaacgcgtctgtaattttcgcagatgaacccaccgcttctctcgatgcgcataacaggcaaatcgttattgatttgttgcggcaccgagctgatcaaggggcaattgtggttcttgccacgcatgatcccattttagtctctgcatgtgaccaaaactaccaagtaggcaatcataactaatcattgattgctatacctcgtgaagtggaatagtgaaaacgcaaggaggaatgatggtccagataaacgctgacggtatgacgaagcgcaaatcgctggctaggcgggtgctgttatacgctatcatcgcatttataacgtcggcgctcattgcggctgtcttgatcatgattggtctcattccgctgaaaagaaatggcacaagtttgccgtgcaacgatttggcatcctaccaaacaacgaagcagatatatgtcgagagcagcgcagccattgacaaactcaaatcagtagggaaaagcgttaaagtgaacattaaacacgccgattgcccctcccggatacaggacaaaggatatgtcgaaattacatatggaaacgatatcgaacgtgacaaaatcatgaagattcttaatgatgatggtttgggaatatatactgtgcttgttcgacagtaatttttagtgaggatatgaaaaaggaatactgaagaatcagtcactatgcgcgccaattgacttttgccttgattggtagtgttttttcggttattcgctgtttgtggtgagtggtggtcaggcggtggtgacggctttgaggtcgagtttgccgcaggtcaggtagatcatggtggcgaagtagtccgtgttgcggaagccgcgggcccgtctcttcacgttccggatgacgctgtcggcgtcctcgaggacggcgttggtgtacgggtgctcgaagtatgcgacgatctcggcgaagtggcggcggatcggacgggccgcctcgttcttgggccacaggcgttctggtcccagcacgtcaacagctttgccgaggtgctgctgccacgccacatgggcggcgacagcatggtcaacccgccccagcggttgggttacaaacggttcggcaacgacatgctgctcgacttctacaaggccgaacgcgacgccatcgaagcaatctgccccggcaagccgtggtacatgatggagcactccacctccgccgtacaatggaagccgttgaacacgcgcaagcgcgccggtgaactttgggagctcgacggcgtccccgccatcaccagtcaccccccacggccaaggcgccgccatctacgtgggctgcgaccttggccgccacgacatcacccacttgctcacagaactcaacacaacagccccctccgacgaaagggctcccgaccaaaggccgggtgggggagagatcaacgccgcaaccacgaccgcagcagccacgactcatgacccccgcatcctgcacaccatccgccaatcctcagacggcaccatccgcttcggtttctctctgaaccgttcgaagcagcccgttgccgtcaacggcattgagtaagagccaatcatcgcctgccggtgcgaacccggtctagacgatttcattgccgggaacgccggccccaccggctacgagctggcccgcaacgccattctcatcaccaaaaccacgctctagatgagtgtccaaccggctatctccgtttcaaggggctgatacaccggttgggcaaatgtctatctccgtttcaaggggctgttgcaaaagtagacgcggccccaaaatggcttaatggcgttgaagcaaagccgtttatacttcctctttcgcggatgaagagccccttgaaacggaggtagatgtccggaaagcctcagatcagccccttgaaggccggatatggctcgaaaatggtgccatgtggtcctaaaataggtgagtcgatggtctttcagagatgaaaacgaggtatgcacagtggggaaagccgaatcgaacacaagtcgtacggtcggcgcggtcaaggctgcttccactgcatcccctgcctccgccaagcgtcgagtcaccctgcgcgatgtggctcaaaccgctggagtgtctctcaaaaccgcttcaaacgtcattaacggttccggccgcatgaccgatgaaacccgtgcaaaggtcgaagcagtcgttaaggacctcggctaccgcgtcaatgtggccgcccgcaacctgaatcgcgaccacaccggttttattactcttgcggtgccatcgctcactccgccgtatctcgctgaactggccaatcgcaccattgacgccgcccgtcagcgcgactactccgtatacgtcaccacgtatgcagagggctcggccaaaggagcgcgtgacctgctcaagaacttcaactccactgtgtcagacggcatgattctctccatgagcgaggtggaggatatttcgcccgaagacctgaaggttgatttcccgctggttattgtcggtgcccgaaccacatggggtgttgccgaccacgtgactccggacgatgttgccgccgcagcaacagcgtcaggctacctatacgatcgaggttcttctcgtctcgccgtagtgggcgcacgaggcgattatgatacggccgctttgttgcaggctgtggaaggcaacgcacaactgcgtttgcgtggtgtcattgaagaaacgcgccgccgtgggcttgagctggatcctcgtctgattggtaataccgctcaggattggaccatcggcgctggcgctcgtgtgactcagcgactgattgattccggcgtgccgttcgacggcgtggttgcctttaatgatcagctggccattggcgcattgaccgcactacgcactgccggctatgaggttcccgcgcaggtgcaggtcatcggcttcgacaacaacgaggaagccccatacctgcaaattccgcttaccaccatggattccaggctcgactggaccgcgcccaccgccgtggaccgcatcctcggccgtatcgctggagacatttccaagcccgaactgctcaccgccgaatcgcaagtaatcgcccgcgcctccacgcgctaaacaacattgtcgtaatgctggtgctgttgcacgaagtcgttgttgtataaatgtcccatggggcggtgatttcctcatggggcggtagctgagaatggctctattctgcggaagataaaattttaccgaccgccccatgggcaagttaccgccccatgggtgtacgggtaaaggcggccgaatcgcctcgtgccgcccccgtggatatgcaagttaaagagcaccggcagcatgacttaatgcacatagagcgtcccccgcatggttgtgccactgatgccggcctgtactgggtcggctcaggtgtcgataaccaagctttgttcgatttcgatggcaaggcgctcgcctctctgccgacgttcaagtacattcacaccggtgccgtcaccgatcatgtgttcaccaagatagatccagtggagattatcgcgactgactcggattccatcgacgtgatcaaagcgcaattgccgagtgaggcggctgcacactatcaggatggggtggacgagaccgaaaccgtgacctggcaatccgctgcgcttgactggattcgtggcgcgggcacatacaccatcacgggcaacctgcctgccgacgcatggggcaatgtggacaaggtctcactcgtcaaaaagaccgaaactccggtgaagccatccacggagaacttggacaaggccgtggccgaatccggggaaatcaatcgcgatgagtacaccaacgagtcgctcgccaaactcgatcaggcgcttgccgccgaccagttcatgctcgattacgatttctccgctcccgctgatgcggcgaaggttaccgtaacgctcaagtcgaatccgaatgttactgaaacctatacggttgctgttgcctctcgggccgaaggtggttccggcagcggctcggacggtgcgggtaatggcggggctactatcaatcccgatacgggcgagggtgataagaccaacggtgcgaatggcgacgagattactggtgtgctgagcaataccggtagcgcggtgactgccgtgggtcttgcggttgtcgttctcggcgtggccggtggggtctcgcttgctttgcgtcgtaagtgctcctgatagagactgatgcggcattatgatgcggttgccggcaactggctgccagatgccatctgtcggttttcgtctgctggatgccatctgtcggctgtcgtttatcggttgttggctgtcagatgcgtctgtctcggcgcagcgatgcgattctgtcccggttcgtgcatcaatcgtttgatgtgggtaccaggacagaaatcactgtcctggtttgcgaaaacgggtgtttttcgcgtaccgggacaattcccgttgccccggtttgcgtgtcaaccgttctacgtgagaaccgggacagtatgttgatttcgggattggctgtattctgctgattctgtttgtcggggtatgtggactttggggattggcttgtcctagttctcgaaaatggcccgaaattgcgtaccgggacaacgatttctgctccggtgtaaacgtcaatcgattgacgcctgtaccggggcaaattcgcgcccgggaacaatagggcgagggccggtcgcaggagtagagcgtgatgttgtcatgattgcgcccggctctcccacacggaaggccgggcacaatcatgccgtttggttgcagcacccgcacatcgcctgcataaccgtgtacagtggcgtgtagttgcagtacatgaaggagcatcgcacatcatgaccaacgggcacatcaaccccgccaacgtgccggacatcgccttgaaagacggccattccattccgcaggtcggccttggcatcctacgcatcgacgacgagggtgtggtccccgtcgtcgaatccgcgctggaagccggctaccgccacatcgacggtgcggccggctacaacaacgaagccggcgtgggtcgtgcgctcgccgcttccggatacaacaccggtgccaagcgcgagaccctgtgggttaccgccaagctgcgcgacgaaggcatggcacgtacgctcggcgtatgcaacttcatgcccgccgatctgaagcgtctgcacgaggagaccggtgcatggccggccgtcaatcagattgagctgcatcccacgtggcagcagcgcgaagtggtggcgttctgcaaggagcacggcatcgccgtggaggcctactcgccgatggcgcgtggcgccgacctcaacgccggcgacggtaccatcgagaagatcgccgccgcccatgaggtcagcccggcccaggtgattctgcgttggcacatcgaaaacggcacgatcatcatccccaagtccgtgcatgccgaccgccagaaggagaatctcaatctgttcggcttcgccctgaccgccgacgaacatgccgccatcgacgcccttgacggccccacccgcgccggccacgaccccctcaccttcacctatgcgtgattgatggcacgccgtaacgcccactttcgccgtcgtttcaacgcctccgggccgctggagcgcgtgctgattctcatcgttctcgccgcagcaatcggcgtgaccatcggcctgttactgccgcaggtcagctccgacgcggccaaaatcaccggtggctacactgccaccggttcagccgccgacactttgaacgcgctcgccgtagacgacaaccaaagctcctccggctacgaccgcgattccttcggtttccgcaccaccgacgccgacggcaatggctgcgacgtacgcgacgatgtgctcgcccgcgatctcacggacatcacctacaaatacgccggttcctgtgtggtcgagtccggcacactggccgatccgtacaccgctcagaccatccattttgtacgtggccgcgccaccagcgcccaagtgcagatcgaccatgtggtggcccttgaaaacgcttggcaatccggtgcgcacgactggtccactgccaaacgccatgaattcggcaatgacccctacaacctgctggccgtcgacggcccggccaatcaggagaagggttcggcttccgccgcctactggctacccaccaacgccgactaccgttgcgactatgtggcccgccagattggcgtcaaagacaagtaccagctcaccgtcacctcccaagaaaaggacgccatgctcgccgtcctccacacctgcccgggccaggccgtgcccgcagacgaataagaggaagggtatctcgcttgagagaggtacattaggccattcgcagagcgctatctgctttcaaagcagatagcactgtcagctacacatttcatgagcgagttttcggcggtttgtcgtattccatgagcgagatggcgggaaatgtcagctgccagtccgccagtcatccatcaatcgtccgcagattgtccgtctgttgactcgggaaacatgcctgtgctataactgcgcgcggtatgaagggaacaggtacaaacaatatggcagtaacacacaccgaagcagatgccactgcggcaaccactatgacgaacgctgtggcagacatcgaacaggaaacaccggaaatcgagaaggaacgccagcttgccggggccggagcagggacgaacaacaaggaaaagccgcatgaccatgcgctggccagcatccttggccccgcgttcgtggcggccgtggcctacgtcgatcctggtaatgtggcggccaacatcacctccggcgcacgatacggctacctgttggtgtgggtgctggtgctcgccaacgccatgagcgtgctcatccagtatcagtccgccaaactcggcatcgtgaccaacaaatccctgccggaactgctgggcgagcgtatgagcgatgccggccgcttcatgttcttcatgcaggccgaggtcatcgccatcgccaccgatctggccgaggtgatcggcggcgccatcgccctgaacctgctgttcggatttccactgttcatcggcggtttggcgattggcgtaatctccacggtgatgctgtggttccaaggcggcaagacacagaccacattcgagcgcatcatcatcgtgatgctgctgattatcacattcggcttcatcgcaggcctgttcgtagccccgccgaaccccgacgaagtggtcaaaggcatgattccacgcttccaaggcgccgactcggtgttgatggccgcctcgattctgggcgccaccgtgatgccgcacgccatctacctgcactccacgctggtgaacgaccattacgcaggcggcgaaaagccgtcgatcaaaacgcagctgagaggctcgaaaatcgatgtggcctgggcgctgttgctggccggcaccgtgaatctggcgatgctggtgctcgccgccaactcgctgcatggcatgtctggcacggactccatcgacggcgcacagcgggcgatcacgcaggtgctcggcccggtgatcggcacgatcttttccatcggcctgctggcttcgtcgctgagctccacatcggtcggcacgtacgccggctcggaaatcatgcacggtctgctgcacgttaacgccccgatgtgggcctgccgcgtggtcacgctggtgccggcactgattgtgctgtggttcgccaaggacccgactcaggcgctggtcatcggccaggtggtgctttccatcggcatcccgttcgccgtgattccgctgatgcgatacacgcataacaaggaactcatgggcaagtgggctgatggaaccgtcaagcacgtgatctttatgatcgtcgtggcgctgattgtggcgttgaacgtgctgctgattgtcctgacgctaatgggcagggcgtaatagactccagctgaaatcctgcgatagcacaacataataagaagccccggtgttggaaaccggggcttcttattatgttaagaatggttgaatctgccgtcagttcgcagccatacgccgcgcacgccgttcgcgcagcgcgcgcaaggaaataatgtctcgcgtacgaccggcaccgtcgcccttgacgccgaagaacaccatcaacaccattaccagacagatcattgcggagatgcgcagcgcccattgaatgccaaaaatcgaagcggcgacggcggaggcgccgccccgcttatgcaaagcggcaaacgtttccatcagaatcaccaacacgggtgcgcccacagcgcccgcaatctgacgcgcggtattcgtcaccgatgatccggcggacacttcgctcggcccgttcaggcaattcagtgaccacgtggtaatcggcatcagcaggaaacccatgccgatctgacggatgaactggcagatcgatacccaccagatccacgtatccatcgccaccagcgacatgcccaaggtgccaagggtcaacacaatcgaaccgaacaaagccacgggtcgtgcgccgaatcgatccatcgcacggccgccgaagaactgggagatgcactgaccgatagcgcccggcagcatgatcagaccactcatcgtggcagaatacccacggtcggtctggatatagagcggcatgatgaccagaatcgaactgaacgcgaaaaatgccagcgacgcggtaatggtgccgatggtgaacgaacggttcttcagcacttccaagtccagcagcggcggctgggggagtgccgacttgtcctcggctacggcctcgcgataccgcttgccagcgcgcaggttacgcagcacgaaccagacaatgccaatcaggcccactgccatgggcccccacgttaccggtgcggcgaacccgtaggcctccgaattggtgaagccgaacatcagcccgccaaagccaatcaccgacaggctcaccgagaaaaagtccgcgcgggcagacgggtcatgcgagccgaaattatgtagtccgaacatggccgccaccagcgagaccacgccaatcacggtcatggtcaggaagatggaacgccagccattgacgtcggtctgccagccgcccaaggtggggccgattgccggagccacgctcatggccatgcccacggtgcccatagcaaagccgcgtcgggacagcgggtagatcgagaacaccgtgatctgcagcaccggccacatcacgcccgtgccggccgcctccagcacgcggccgagcagcacgaagaggaagttcgggcccagccaggccagcagggagccgatcgtgaacaccgccatcgagcagatcacgatctgtcgggtggagaaacgacgggtcaggaacgcggtcagcggtaccataacgcccatgaccagctggaacacggaggtcagccactggcccgtggttacggaaatatggaattccgaaacgatgattggcagcgccgagctcagctgcagctgcgtaaagttgccgacgaaggtaataaaggtcaggattgcgatggaaacaaacgcggcatgactcagcttgccgtcaacgtatgattcctcttggctcagcactcgttgcagttcgccacgacggttcttgattccgttctctccagccacgcacactccacttccgttgctcggcctgatggctttgggcggtgtcggttggcatgttcggcactggttgtgcctgcggcgcgtgccggtatgctggtttcgttttttcttcttctcgcataccgacttacgtgccgacgtgaggcaaatgtattcggcgaccgtcgttattttcttgtgcttggccgggcagcctgacaaaagcaccccaatacgttatacctaggggtggtccaggtggctgggtggctcagtaaggactgttgccagccgaattctaaaacaatctaaaacaatctaaaaagttctaaaagagcttcatcattccgagatatccaatgtcatacgaatatatgccgcatgttctctgaggtattcacgaaggtacaggatggcgaaatcgactttcccgtatccacgatcctcgattacctgcgcctcaatgaggcgcgtgcggtagatgctggcgtatttcacgtcctgcccatgcgttcggcaacggtggaggtggaagaaggtccgtcatcttgcgccattgccagaagataggttttatcgatgggcgaaagcccatccagttccggtccgtggactgtgtctcccagatgactgagcgcatcttggaccccggcttcagcatcttccactgagacggtaatggctgtgtcgtgcttgtgattccgagcgatgattcgccaaatatgatagccgacaagctgaatcatgaaaggatagcctgcagttgcttgtgtagcgatccgcaagggttccccttctagaatcattccggtttcctggaatgtgtccgccaacgcatgagagacttcggccagatcgacgtcgctcaaccgctccggttgtgcacgtcgtaggaaggtcattacgttatcattaagccattttgaggacatggaaggcaacccggcaaacacaaaagccagatttctgtcttcactggtcagatgttgtactgcggtggcgatggcgaccatgtctgcccgagtggcggcttgggcctcgtccatggtcaccagaagaccgttgccatgcttttccagctcgtcgagccgcagactcatggtttcgcggagtgtcaatggcattcggttcttttcataatggactccaccaagactgcctcccacgttcatgacactgatagatggttcgaacgagaaactgaaattcccctttcgcggctgcagcttgtccactaaccgttgcgccatgccgtctgatgcggtttcgctgatggtttgccatcctcgtttttctgcgattctccgaaattcagcgagcattacggttttgcctacgtccctagccccggtgatcctcatcaaacgtccaggtgcgcctgatccgttgtctagaccttcttcgaagtcggcgagcaccatatctcttccaatgagaacgggtggaagatgcccggcgctgggcttaaacggattgattctggtgctgagcatgtatcctcaattctcaagaatctcagggttcatgaattatagcaaagtcacatacgaaagagaacgctcatgaattgtttgcggtggtggtggacgtggactatgtaggcaaacagcagttaaagaacctgttgaagcagtttgggaatggtgtgcagcttcgtccgacttatcttgtcagctccggcaagggggtacatctttattatttcttgcaggagccggttcagttgtatcgaaaccgggaagaagtgcttgcggagctgaaagaagctcttatccggcggctatggagtgataccagctctatccgtccggacagcccggatataatcggaatttatcaaggtttccggtgtgtggggagtcagtcgaagctgggtgtagatttcccagtaaaagcctataagctgtcagagaaccgttacacgctggaggatataaaagccagcataccgagctgtaaggtagaccttgctccgttgtacgagaagccgagaagaaaaagtaccgttacgctggaagaagcaaaggagctgtacccggaatggtatgagaagcggatcgtgcaaggagagccgaagcagaaaagtaagaagcagggtggtacgtgggtatgtaacgaagctttatatgagtggtggaaacggaaaataaccgaagaagtgaaagccggagggcgttatttttctattatggcgttgtgctcttatggcttaaagtgcggcatatccgagcagaagatacgtagagacgcctatgcgttcctggatcatttagagagccttactgaggacgaggacaaccatttcagccgggcagatgtgaaagacgctctccgggcattgaaaggggacagaaaaaggctgtcaacgatagcaagccgggaatggatagaggataacacaaaggttacgataccagcaaataagcgaaattacagaaaacaagaggctcatttatatcttgcaaggcgaaaaaaagaggatatgaaagttataggtgaagtagtaaaagagggcagaccaacagcagagcggacagtcagagaatggcaggagagccacccggcaggaaagaaagcggactgcatccgagagacaggacttgcaaagcatactgtttataagtggtggaaagatataaacaatgaaaatatatagggaaaaaggagttattaaataactcttttttccctattgtctattgctgaagatttgaggaaaaatgaaggaattttgataaaaaaagataattcatcaaatatattaaagccaaggttattattccaataatgatgctaataggcaatattttttttataaatagtgttgcaagagacgttcctaaaagaaacgcagatccatatgggataacaatattcaacataaaaattttattatgtttttttcgtaaggttgattgattataaattgattttagaatgtggctaaataaatacaaacatagtatatttagtaaaataaaaataatcaaaaaaccaatgatggaaagtatatgatgcttttgtataaataaaagtaattctatatgttgtatttgaaagttatcaataccaactaaagaaaagtctgaaaatccagtttcgtcagatatagactttatattttttaaaatttgtgattcctcaacaaatggtagtaaatcacaatttatcatagcaaagtataataatgattcaaattgaaaattagttttgtccacttcccaaagagtggaagggtaaggaataagcatataagtattcaaagtgatattagaggtatttttataatttatagaacaatctgtttctataaatccgataacttcaaaattagtatttttactataataatttccggtaattatgtctccgattttataaaaagatttatattcagaacccaatagaacaggaatcgagtcatctttatatgaaatactattccatgcaattccggaatttccctcaacttttatattataaaactcataggctttttgattaagttgtaacgcttttatatttattgtaggagactgactattatcaataaattcatcagaattataataaaagcgttggtctccattaaagtcatctatatctacagcgatagcctgattgaatgaggttaaaacatcgaagttacttgatgcatttaatgtgttatagaagtttgctaatatatttatgttttgattgtctgttctaaaattataaaattcatctggatcataaaaattgtcaaccattttgtaaaaatcattttgtgatgaaagtgttttaaatacaccattgctttgcggaatagaagcaatgaaaggaacaaatatacctgacaaagtaaaatatatagagaaaataataaaagaaaataatgttataaaatattttttagtgttcatagaagactccttaaaaagaatatagtaaatttaaaaagcttatcataggaaacatataaaagtcaatacccgttgtctaaatgaaagtgcaacacccgttagattggaaattgcctagaaaaccagtccgaagggatgtcgcacctatgggagaagtatattcgcacctgtcggaagaggaacgccaggtcatccagatcgaggcaggcaacggcgccagcatacgcgggatcggcgcgatgccgggccgcagcccgtccggcaccagccgggagatcaagcgcaacacatggttcccgtccaacgagaacgagtcgtaccgcccgtaccggccgaaaagactgaagacggggccatggaccggccgctaccacatcgccgggcccgcgcagcgcaaggccgaccgcaggagatccaagccacgaaagccctaccggctgtcgcacgaccgcctgtgggcgcgggtggccgaatggctgggccgcggctggtcgccgccgcccgtcagcggcaggctgcgcgtcctgtggccggacgatgcgctcatgcgcgtgtgcccggagaccatctaccgatgggtctactccagcaggccgcttcgggaacgctgggcgcggtgcctgccgcgagggcacaggcggcgccgcaggcacggcggcaggaggacgtcgcgcttcccgatccccggccgagcgcccatctccgaacgcccgccggaggccgacggcaggagcgcgttcggccattgggaggccgacagcgtcatcggagtgggatgcaacccgcacaccgaggtggagaggaggaccaggttcctcatggcccgcgtcgttccggacaagaccgccggcgagagcgtcggggcgcagccggacatgttctcgccgctgccggccggcgcgcgcgccggcgtcacgcacgacaacggcaccgagttcgcccaccacgaaaggctgcgcgacgggctgggcatggccacgtacttcgccgacccgtactccagccggcggcggggaagcaacgagaacgggaacggcatgatccgccggtatctgcccgaacgctgcgagatacggatggacatggcaaaggaggtcagggagatcgtcgacgaggccgacaaccgccccatgcgcgtgctcggctaccgcacgcccgccgaggcgttcgccgacgaactgctggaattacaggaccaacaagggtgttgcacttctaaatagacatcgggcaatctaaaaggttctaaaaggcttcggggcaaacctcgcatttccgaagcgcccatgcatgtcgtcgattatggattcagtaagagcatcatcgtatccgcaaggacgaagaaggacagtacggggccgtcgtcggagcggcggagcaggttcggcaccgtgacgccgcgctacgataccgcgggcaatctcgtcgcctggcaggtgcgctacccggacccgaaacgcccgggcaagaaggtccagcggcagttcaagccggacatggagcacgaggcgcaccagtggctcgaagaggaacggcatctggtggaactggaccgcaagaacatccaggaatgggtccatccgtcagaacgccgccgcaggaagcgcgcgagccttatctcgttcgaggattacgtgacccggtgggcggaaggataccggctgccgaacggcgagaggatagccggcggcacgcgccggaacctgtatctcgacatcgcgcacttcatgccgggcttcaaaggcaagctcctgaccgtgcgccactccgtcaacagaggatattcggatcgcggctcgacgcgcatcgccaggaccaagaccgactccagccggcgcaccgtgcctatccccgacgagctcggccacgtcagcgagaaggtcgccatcaagcactaccagcgcatcgtcgcccagcaccgcaaccagatcgtcaaccaactcgccgaagatttcatcaaagcggctgtcgtatatgaagagcataaatgagacaacagtgatactgtttaaaatactattaataatcgaaattcattaacaaatatatggatgccgacgatgtgatgggcatttcgcgaatattaaaattgcctcactaaattcgaagtcttcataactacttttgttttgaatttgcggttggtcttcttttggaaggtcaaccgcaaattctaatcatattcaattcaattcgataacagtatctattgctggtctttttataagattctcttatttatctccctgtattatctccttatcttgtaatttatgcacgcttgcaatactatataaaacaagtgcaactagcgccataaatcgagtccagttggtattgcagatgatcagcgcgagaaggataagagcacaatatattgtggatctaatccaacgatagtgatgcttgtcgttgattttaagagactgtattaccacccaaataaacgcaccgactataattgcaccattcaaccataggaggagtgatcttcctgtagggtcgggggtgtctgagactgcaaaattgccgaaccagcatatgcatgcacctgtaaacagtgcttcgggtgccatcagcattttttgcgaaaacatctcacgatgtcctttctactggacactgactccgggcggaatggctatcgttaggcagattccctttccggtggctacggcacgggtgatttgcagagcgagattcgcaagatatgcggctcctacagcggaaacaagtatgccggcaattgttccagcgggtcctccgaccatggtgcccaacgcagtcaaggccgctgccagcgcctcgggtcctatgccggccgcgacagttactgcggtagcaatgcctatagtgagatccgagtaggaaatataccatccatcgcatttcgccattgctccggatggagaagcggggactctcgcaggtgaagtgtcatcggcatgagtgactcctagaacggcatcttgcaagaatgtatattgagattccgaaaaaccgtatgcattcttaagttcgctctcattcaaagtaatggttaactgattgtttacatatttaaaatacgggccaacagatacaattttattcaaagtatcttgttgttcgttggtcaattcaataggattggtttgacatgtcgttacatcgataggaggtgaattatcctcggcggccgttgcggtgcccgtgaaggctgacatgcacaaaaagattgcaataatactgctcaatatgcgcctaaagtatttcatgataatctcctttgattattgttttagggaaccttgtcccaatttaattaaagcatatagtgcacattccagggctctatcattggtggttttgtcatctgaagatgacaaaaccaccacagcttctgtcatttctggtattgccaatcttcaatcgtatgctctctcggaatgcgaacagtgctacatacccaatgtctgatatatcagaggaaaagcgtgaaacgaccctgctcgtgctcaaggacggcaccctaaggagatctcatggacaagctcggccacgtcagtgagaaggtcgccatcaagcactaccagcgcatcgtcgcccagcatcgcaaccagatcgtcaaccaactcgccgaagacttcatcaaagcagcgaactagtgtgctctttttagggtatcgtgtatagattatagatttcgttttgtgacagcggcttgcggtaaacttgtctcaagtttaccgcaagccgctgtactcagaatctaaaattaagtacataaaagcttcaattatccatattagagtatatttaaactgtttaataaatgtcacacaatgccaattgtgtcgaattaacagttcgcatatatacgaatgatatatccttttcgaccattgcctcccaaaagtgttggattgaataaaagacagatacttaatacaaattcactagtgtattcattagccacggtatgaagagaacgaagaaacatcctataacggaaacaataacaatcttcattatctttttgaaattctgcttatccatggtgactcctcagagaagaccgaaacaggctataacaccaccgacgttggcggctcccatcgcagcaactgctccaatgcaggcagcgcaaacaggtgcggcaataggttgtgcagcacatgcagtcgtgcaggtaccaagaataatccaggcaacagccacatcgacccctaaaacagcagtcagacaagtggctgcctctccccatccctgagtttgcggaagactggcgtactcatctaactttttttgaatgtcttcattggagatgaaatcgaagtcgctgacttgctgattaaccaaatcgccgttcatgtaaacctgcattaaaaacttattattatcggtttttgaaagcaactgctctgcgtagttgctgatgttccagctagagtcaaagacggcggtaatattactcaatatagagtaacgaggatcctggatttgaagagttattgaacgaaaagttccgttatcggtgtcgaactctagcaatgaaggttcgctccagttgagtttgacatcttgataatgtgtctttatatgcgctgatttcaatagggctttcgtgtttgtgactaattttgaccttacctcgacatcatgaatatcttttgcttgacttattgtagttttcgctaattcgcattcaacattgcactgtgttctcgcttccgttgctggcgaagcgtaggcaaaagaagcaaaattaaatgacataataatggtgcaaagtgatgcagcaactcgtttagctatagttttcatttttcctccgttaacacctttgttgacaaaagagacattataaaaatgtctcttttattttatgatgatggggtggacgcctttaatgcagaagcttccccgtgaatctagattctttccgtatgttgtatacagaactattccattttgggaatagttctgtatacaatgagtccgtgaccattagaacaaatcgaacgctgctcacacggcgggaagccgctctccggctcggagtgagcgaacggcgagtcagtgcgcttcgcgctgccggccggcttgaatctctttccgcgggaggcggctcgctggtcacggaggattccgtacgccgccaatcacagtggcaaggggcggacgggcgcccttattcaccagacatggcgttcggggcgctatacatgctcagcggactcgatgcgccatggctgggtcggcagcaacggtaccggctcaaaggctacctgaggcagatggatgccgagaatctgactcgtctcacccgacggcgcgcaatgatggtcgaatactggtgtagggactccaacctcgccaaggtcaaagctctcattcgtccttccgccgccaccggcatactggcgggcatgttccagctgactgtcacggatgtggtggaaggctacatcgctgccgacgctctggatgatgccgtccgacaatgccggctgaagcaaggcacgacgccagttcgggtgcgactccacgtcgccgatagtcttcccgccggtgagaggactatgtctctcggcgtatgcgcggccgacctggccgaatccaacgacccgagggaacgacgcgccggcctggaaaccctccaacagctgatcgacgaccaccaccgcaaggagcatcaggaatgattcccacaatccacatccccaacacgggtcatccatggagcaccgtatacgcggtcgccgcagcagacatgtcggaatcatggctgcttactggcgggctcatggtccaactgcacgccatcatgggcggattgaccgcgcgccccaccaccgacgccgacctgctcgccgatctcatggccgaccgacgcggcatcgccagactgcgcggtgttctcgccgcctgcgggttcgagacgcagccgggcatgctgaccggatacacgacccgtatgagcgcaccaaacggcgacattgtggacctgctggtcgctgaccacctgcccaagttcctcggaaaagacgcgaccatcgccggcacgccggtgctgtccatgccgggcggcactcaggccgtggaacgcagcatgcaggtccggctcatcgacgaccagagcaatgccgatgccgtgattcgcatcccggacctgctcggcgcactgatactcaaaagcgcggcatacagcgccgatcacgccggctacagcgaccgtcacctctatgatgcagccatgctcgcatctctcatcccagatcccgatgcggagctcgcacgcctgcacagcggtaccgaccgcaaacacatcaaactcctgcacgagctgctcaccgaggattcaccttactgggacaacctcgacgaaccacaccgtcaggacggattggacaccatcgaaacactcgccacatggtgacgggcctgtagacaagttgtatatatatgaggacatgaaattctgaattatgtagctcaaaatgtcatatcctcttacttacgtcggaatgcagccgaatacttgatattcgatgctttgttaaaccagctttgacagggtggcttctctttttgatgtcaattttgatttagcagagccagagtatccggcagtcggtggacgcggcgtttttccgctggtgttccggcgacagcaagtgcaggatggcaatgattttctatgggatttgtgtgggtggacttatgttccgcccacacaaatcctaattgcaagtgatgggacttacgtctgaccttgatggctccaggttataaggggtctttagcattccatactgagcatgacaattgaactgttttctcatggatgcgtcagcccatgccgaatagtaagtccaatgtctacttgtatggaaacgatcgtaaacctgtccccatccgcggtcggtatcccatagaagcgctcttctaggcataatggacaaggaccatacgccgctgcgattcatccaatatccatcggaaaacaggtccgtgctccaggagctatacaaacccgcttccatggtggtagtggtagcggcatcttcttcagcgttagccttgaggtaggcttccacgtcttctctggtgcgaccatatttcttgtattgcggatcattgagatatgcttcaatctccgcttcggaaggataatgtgactgcgcatattgcggcgtcttagccgcattggtggaggtcgtctccgtcgcggaggccaccattaccgaggagaaggagaccgtgacggcgagcaagagggaggccgtcgatttgaccagtcgattattacgcattgcgattcttcttcttggatagggaaatttttatggaatatatgatttccatgagtatgagaattcccaacaggatggaaaccaaagggatatatgagatatagaaatctctcatatccatatctgcttttgctgaataagcgacatcgcaatatgtcagcattacaaaaacggcagagacgatcgagataagtatcggcaggacgaagaagcgtgcaggaatccactgaaatcggtgccgatcaagataatgcagataatagatattgcatccaatcatcgaacaataaagaagaagcgtccacatcggagccaactcaatggtgtttgatatagccatttctctcctttgagtccgtcttcctacacgattaaggcatatcggggtcaggcaaattattttctcaatatgcagtcagtctgtgaatagcttcagggtcagccccagaagatgattctcagacttaaggccacgatataaagtatcgaatcctatgcagtcgaactcaagataccctggacggtttgtcatctcaagatgacaaaaacaagcaacggctctttcagcatattcacttacactgttccttggtttcaatctccccacaaggcgcacgcggggtgcgccttttcgcgatcgagggagatcaatatgccgaaaatcaggcattcccatggaaaccatccgcagaagcctccgcgaagcaagtggggaaccgtgctggcccgttatgacagaaccggcatgctaatcgcatggcaggttcgatatccgaatccattagaacccggcaaacgcgtccaacgccagttcaagccggatcaggagctcgaagcccgtagatggctggaagccgaaaagtatcttgtcagcctccatcgtaacggcatcgccgaatgggttcatccaacggaacgaagccgacgaaaagccgtcgaggaaaagagccggacacaacgcaatatgttgttccgtgactatgtgatgcgatgggccgaggaataccggctgcccgacggcaacggtatcgccggtggcacgcgtcgcaatctttacctggacattggccattttttgccaagtcttggggacctgccgcttaacgagatcactccgtccatcatcaaggcttggtatgatgcgcctcacccggaaggacggtgggcgttccgacgctcatgcatgcggctgaaggcggtactggaatcagccacccgaggcggattggacggttcggagccattgctgtccttcaatcccttcatattccatattccgccagcgccacagcccgcccgcatcaatgtaccgccggtgactccttccgaattaatcctgctggctgacgccatgcccgattacaccagactgtccgtattcctctcgactttagtgggtggtctgcgatgtggtgaactctgtgggcttcaggtgcaagacatcgatctgaacaggcagatacttcacgtccggcactccgtgaatcgcggtgacgctgacagaggggatctccacttcggcaagacaaaaacggaatccagtatcaggaacgtacacatcccggatacgctgattcctcttattcgacagcacctttctgattactgcgatctgacccgaccggattcgccggtgttcgtgcccaaacgtgcaagaatcatgtcccagacaacgctggacggccagttcgccaaggcccggctgaaagcaggacgccctgatctgacattccaggcattacgagccagccatgcaacattactcatgattcagggtggaacgttgcgggaagtcatgaatcaattgggacacgtcagtgagaaggtggctatccggtactaccagctcaccgtcgcctcacatcagagtcaagtggttgacgagcttgccgaatcatttatgagcggcattcagcggcgtgagtcctagaccaaagtgatgtaccatcgcgatacgtggcacaccttcgtataggaaatgccgtgagggatctgaatctggtccctcacggcatttcggtatctggttggtcgaagtctcacaatcgcagcatcagacggattggaagcgcagatggtccgttaactcccgcaccgtatcttgcagccgacggagttcggagtctcggctgaccgtgctccattgcgtcgcatacgcctccatccagatctccaatgcttcagcaaggttcgcctcatcgttatgttgagacgtggtgttcggttgcaaagtgtcagtgatcccggtctcggacgcaagccggaggccaacccggttcagcagtcgttgtccctcgacggctatgcggaatgcagcggcgtttcctgcgttccgcggtcctgcggtcgcggtgatcgcggagattcgacgggcactggcctgcagaaggtgatctgcggtttcgccgagcgtgatgcggtgtttcagatagcggagcagcattcgtcgggattccgcaagtgacggtgtcttgctttcgttctggagggaacggatcacatcgtccggtcgttcgttttccggcagcagtcccgggatggtttgcaggaccccggtgttgactccgccttgtccgtcatcaagttccagccaagtgatcaggtggttccattcgaaactggccgcatgacttgcatgcgtaagaatattaagcagttcaccgctggcgtcgtggtattcgagtcgggagatacggcggagcatgtcggcctcatccgggattcgcctcgggttccatgattcctgtgcaccgatgatcatgccggggatggccatgcgtgggtcgttgacgtggccgaagtcgccccagtcggtgacgagcatgccctgggcgccgtattgcctgccgtagcgggccatgcgggtgatgttgctccaggcgtcgtcgatgcgcggcaggagcgcgttccagcaccatacggccgggcatacgatctgcttggcaccggattcggcgacggtgtggatcttctcgtccgtgacctgagggtcgtactgccagttgagcagggtgacggtttcggggagccggtcgaggatctcggggtgttcgagggcgatgtcgccccacatcatcggccgcctgccctgggcttcgaggtggcggcacaggcgggtgacgtagtcggcgtacatggccgcgacgccgatgcggtcggcgaggggcttggaccggcccttgccgaggtcgaaggtctcgtcggcgcagatgttgaatttgttggagcggaacagttgcaggtagtcgtcgatgagccggcacgacagggcgaaggcgcggtcgtcgccgatgttcaatgtgtggtggtgcatgcggtcgatgaacccgaacggctcgtcggcggtttcggggaactcgccgaggtcgcgcagggattgcgtgcgcagggccatgtagaggtgtccgaacgtggagaccgacgggaccagctcgatgccgcgctcggcgcagtagtcgtcgaatgcgaggatgtcgcgcggggtgagcgggctggaaccgcgccaggtctcgctcatcgagtcgaacgcgaaggtgtgttcgatgtagagctggagctggttgtatttgtacaggcagagcttgtcggcccagtgtttgagccagtcgagggtggggacgcgcccgcgggtgacgtcgaggtagtagccgcgcgtttcgaaggcgggtcggtcctcgatgtgcaggcagggcagggcggcgccgcattggcggatgagctggcgtaaagtctgcacgccgttacgcacaccctcgaaatccgctcccgctacggtcacgccgtccggggtgacatcgagcgtatatgcaccggacgggtgtgcatgggggtcgtcaaaggtcgtcaaggtgatgaatcccggccagcggtcgccggtggcgatatcccattccaatccggtggctgcgcggatgtcgtcgatgagctgcacggcaagtatgtgccgatcgtcaccgactgcgcgcgcttcgttgattcgtccgcacattggcagcaatgcgatgttcgctttatgctgcatggtttgcggcgtggggatgatggtccatcccttcagggttgcttgatcgctcatggaagtcctttctcagtggttcacctttgattgcgttatattgcgttttgggttccgagatgacgcgcggcgccggaaccactcgcagcaatggtcccggcgccgcacgcattgtttatcgctccgtttgggctatttgacggctccggtagtgacgcccttcatgatgttcctttggatgatcatgaagaagatcacgacgggcagggagaagatgacggatgctgccatctgtccgccgaagtcggtgcccatgctgggtgtggagaacgaggagagccacacaggcagcgtgtacttggactggtccttcatgaacgtgtacgcggtcatgtagtcgttccatgcgctgatgaacgcgaacacggacgtggacacgatgccgggcgcggccaaggggaaggtgatcttccacaggatctgccagtcgttggccccttcgacggccgcggactcgaagatgtccttggggatgttgaggaagaagccgcgcatgttccagatcgcgaacggcaggaccatggcgatgtacgcgaggatcaggccgctgtacttgttcagcaggccgaactggttgaagatgaagaactgtgggatgatgccgcccgaggtcatctggatggccagcacgaacaccatgatcgccttgcggccgcggaaccggtagagggtcagggccgcgcacgcgaagaacgcgaggatgaccgacaggacgatcgatacggcggtcacaatcacgctgttcttcaggttcgtcaggaacgacgtctgggtgacggccaccatgaagttgtcgatcgacagcttcgcgggccagaacacgggcgtcgcggtcatgatctggttgcgcggcttgagcgacgtgacgaacatccagtagaccgggaagatccacacgatgcagaacacgacggccaacacgatcgtgccgatgcggcgcagccgcgaggaaaggctacgcttagcgcgcggcgcggcagaggttatggttgcggtggtcatcacaggtcctccccggatttgagcaggtatcggatgtacacgctcgtcagggcgagcaggatgagcgtgaccagcacgctcgcggcggcgccggtgccgatgtcgaacgacacgaacgccttcttgtaggtgaagatgccgatcgtcgcggtcgtctcgcggggggctccctgtgagacgggccagatctggttgaacacgttgaagtcccagatcaccgacagcatcgtgatgaccatcaggctcggcttgatcagcggcacggtgatctgccagtagcagcgcagcttcgagcagccgtccagctgggccgcctcaaggcaggacttgtccacctgtgtggtcgccgcgtacaggttgatcgcgatgtacgggacggcctgccagacgaccagcagccagatctccaggaacgcgagccacgtgttgtcggtccatgacaggttcgtcacgtccccgaacaaatgggtctgggtcagcagccagttgaccacgccgtaccccggctggaacagccacttccacaccaccgacgaggccacgttcggcatggcccacgcgaagatcagcacgaacgtgaccagccagcgcatcaccggccccaatttggtcatcagctgggccacgcccatgccgatcagcacgctgccggccacgagcgcggctgcgaacccgaacgtgcgggccagcgacttgtagaactccgggtcggtcagcacgttctcgtactggtcgaacccgacgatgttgaacgagcccgtgaacatcaatggcggcctgtacgcgatgcctgccgactcgggccccatggcctacttctacgacaaggacgtgttcgacaaggccggcatcagtgaaccaccggccacctgggacgagttctacgaagacgcgaagaagatccgcgccaccggctcctacatcacctccgactccggcgacgctggcctgttcaacgcgatgatgtgggccatgggcggccacgcctacaaactcaatgacgacaaactgaccatcaatatcgccaaggacaagggcgcccagcggttcatggacctctggcagaagatgcgcgacgaagacctcatcgacgtccacacgaagacctggaccgacgactggatgaagtcactgggcgacggctccatcgccagtctcatcagcggcgcatggatggccaacaaccttctgcagggcgtgccccaagccaccggcaaattccgcgtagccctcctgcccaccatcgacggaacgcccatcaacggcgaatacggcggtagcggactggctatcgccaagaagattcccgacggcaaactcgacgccgccaagaagttcgtcgaatacgtcaccaccaacgacgaaggcatcaacgcccgcgtatccaacggcagcttccccgccaccaccaagaccctcaaccagaaggacttcctcgccaagaccacgctcaggaacaccgacggcagcgacaacgagttcttcggcggccagaaatataacgaggtcttctcccaggccgccaaggatgtcaccggcaagtgggagttcctgcccttcgaaccctacgcccgctccatctacggcgacagcatgggattgttcttctccggcaagaccgacctgaagacggccgctgccaagtggcagatagcgctaagaaattatgctgctgaccaaggatttagtatcgtctcaagataaatagattacaaagatgactcctgtaagaaattagctatggttcatatagtattataaaggagtatataaattatactcgtaattagatgaatacttcgcgttaagcatatttcataaatgtgtggaatattgacatgggcctatgtttgaattgatgtcactatttcagttgtgtaaagacactcaatttaatccaattgattgcaatttgggtgcggtttgaaagatggagcttcgatagaattcgactaacatagcgtttgactgatttggtttccagaaatagttttttgctatgtcgtcattactgagtccttgtgcaattaaggcacatatgtcacgctctctagtagtaagactcttgaatgattcaataaatatattttgctggtcttgaaaaatgaatttgctttgttgatattctactagtttctttgttattcgtggagtaagaattttaccattttcaaaaacagcttttatcgattccattaattgtgatttacttatgtctttcagtaggaagccgctggctccggcgtcgagtccgccgaaggcgtagtcgtcttcgtcgtaggtggtgaggatgaggattctgatggcgggccagtgtctggcgatgtgtcgggttgcttcgatgccgtccatgccgggcatgcgcacgtccatgaggatcacgtcgggcaacggccggtgatcggcgtccaactggttgagtgtgtcgatggcggtttgcccgttctccgccgaggcgatgacggtgatgtcggtcacgtcgtcgagcatgagctggaagccgagtcgtgccagtctctggtcgtccacgagcatcacacggatcatggtcggaccttcctttcagtcggttgtttcccggtcgggggaatgaccgctttgacctgccattcggtgccattgaccggcccataggcgaacgtgccgccaacgtcccgtacgcgccgtgacagtctgtccagtccggtgccgtcatcgggtgcgatagcttgcgccgcaccggtggctccgtcgttgcggacgatgacggtgactccgttgggctggtggttccatgagacgttgagatgcgtgacgtgtctgcagtggcggatggcgttggttatggcctcgcgggtcacgtcgaagcagaggtccgcctggggttcgtcgtcgttgcggacgccggtttcggtgaatatggtgatgatgtcgagcgtgcgggcgtgtgcgaggatcggacggatgtcatcccatgaacgcatgctccggtagcctggttcggcgggatcctcgtcttcgtcggtcgtgtcggtttcggtcagtgcgcgcacggccttgcgcgtgtcctccaggctttcccgtgcgatctcgttgatgcccttcagagcctcctccacgcgcgagtcgccggtcttaccggtcaatccttcggatagggcgatgatcgcggtcaacccgtgccccacgctgtcgtgcaattgtccggcgatgcgcgaacgacgcacggctgcgtcacgctgcttggcggcggtctgcgcgcgccggtgttccaggccggcggcggccgtggcgttcctggcttggaccatgccgcggcgtgccagggcgatcgcgccggcgagggcgagcaggaggatgcggccgggccattcgccgaggaaccggctggcgggccatgacatgaacgtcgccaaagtcacggtcaacgtcgtcacgagggacccgatgtacatgcggcgttccccggccgtacgcatgaacgcgtagaacgccgcgaccagttggaccagcaggatcgagtccgcatgccagaaggacaggaccagggtcaggatgagctgcgatgccaacgtggcggacggggcccggtaacggaacaccaatgccaggcatgacaggagctggaacagcagcagcattatgaatccgccggtctgcttggcgagcgtgtacatcggatccaatggggcgccgatcatgcgctcccacgtgagcatcgccatctcgaccgcgagcacgcataatggcatggctatggcagtgaccctgccgacgttcaccgtttgccgctccatacgatccactgtgccacctcgcagggtcatcggcgtgttcactgggcgaggcagtccgcgccgggcatcaggcagccgagcatcgtgaccgaaccggtgaacagcacagtgaacacgatgatgatggccagccatacgaacggcgagagcagcgccccgatccatgcggcgacacggccgccatgctcccatccgtgcccgtcgtggccggtgatccacgcgatcagcacgccgggcagggacaggaacaggccaagcaacaggaacccgacgatcgaatcgttcggcgcggtcgcggctggcaatggtcggggcggattcggccggccgggctccgggacgggcgatggcgccggcaggggcttgccgggtgacggttcgtgatgtgcgggaatgtccatgagtgccgatccttttgaatgtcattggagcttgttgatgttgatggcgccgttgtcgccgggcaatgcgctgatggagaccttgacggtgccgtcgtcggccgtgtagtcgtatacgccggcctgttcctcctcggtggcgttgcgggtgaagcccgcgtccttgatctttcgcgcgtagtccttcgcttcggcgatggtccatgacacgtcgatcaggtagccgttgtcggtctcgtccctgatgcgggtcgtcacccggtcgggttcgggcacccggccggcatactggccgtcaggccaggagccttggacggagccacacgccgccagcccgaacaaggccgtcaaaatcagcaagaacgcgagcagcatggatgccggggcgcgcctcggcattgccgtgtatcggacaggcatgatcatcctccttttccgaatctgatgccgtcaacggcttctgatcgcgtcggccacgctgcggcgcaacgcgggccggatctgcatgtactggatgaggaacaacgccagccagcaggccgctcccgcgccgatcacaccagcccacgggatcccggccactggaacgccgacgagcgtgatagagcgtgttgcgagcacgagcgagctgacggcgaccgggatgagcgcgaggacgaccgcgccggcggccaggtgcaggctctgccacaggatcatgcgcgtcacccggcgcggcgacatgccgatgctgcgcagcagcgcctgatcggcgaccatgccacggttcgacaacgcgatgacggccagactcgtggccagggacacgatgcacagcatcgcgatcatcagcagcgagtccgcgtagttcaggctcgtcggatggccgcccagggccagtatccgcccgtaggaccgcgcgcaggtcagcagggtcgtggacaatcccaaggccagtgcgagcggggcgatggtgttcatactggacacggccttcgccttggcggcacgggccgcgagcacgccggtcgccgacccgcacaggcggcacacggcgcgtcccgcatccagcaggattgggaccagcacgccagtgaggacgtacatgccgaacgacgcgatgatcccggcccataatgcgccgttgaacgtctggccggcctcctgcccgaacgcgtgggcgcgcggcatgcccatgccggagaacgccaatgccaatgccgccgccatgacgaccagtcccagcgcgcaacgcgcccaataccgccatccatgccgcccgatcggcgcgtccctgccacggatcgcctcgatgggacgaaccttcgccgcacgcatcgagggcacgaacgcgcccagcatgcacgtggccatgcccagcagcagcgagccgagccatgccgtcgcggacggcgcgaatgcgggagggacgaacgagccgagcccgccggcgaagctctccgcggccatcgcgttgaactcgggaaccgcgagcagactggccggcatcgcgagcagtgagccgagcagcgagccggtgaggctagccacgcccacgagcatccacgtgcccgcgcgcacctggctcggactggcgcccatgagacgccattgcgcgaacgtgccgcggatgcggtcaaccgtggccgaaccgaccaccgtcagcgagaagaacgcaagcaacgccaccacgacatagatcgtggccgacaccatgccgaactcggccgggtccagacccgccagccgggcggccgatgcgaacgacggcgacgaggtccacacgaactggttcatgcacacgcccaccagcgtggtcaccaccgcgaccaccatgatcgtgggcacccaacccgcgagattatcgcggaacacgcgaagcacatacctacccacgacgggcctcctgaccgtgctgcggcatggccggctcgaacgtgcggcgcatgccctcgacgatctgcccagcggtcagtctgcccgcgatgtgggtgattccgccgtcacgcaggaagaccacgcggtcggccagggcggcggcgtccgtgtcatgcgtgaccatgaccacgttggaacccgaatccgccagctcgcgcagcacctgcagcacgagctcgctgttcgcggtgtcgagcgcgccggtgggctcgtcggcgaacaccaccgccgggcgcaagagcagggcccggcacagggccacgcgctgctgctcgccgccggacagggcgctcaccacggtcctcgccctccggcgcaggccgaaccgggacaacagctgcgtgacccgaatgtagtcggccttgcgatgggcgagcgagagcggcagcatcacgttctcctcgaccgtcagatacggcacgaggttgtactgctggaacacgaaaccgatatgcccgcggatgaaccgcgaacgacgctcctcgtccaacgcgtagatgtcggtgccgccgatgacgacccgacccgagtcgggcctgtccaaaccggacaacacgtacaacaaagaggtcttacccgcacccgaaggcccgacgatcgctgtcaacccggcaccgggaatatccaacgagacatcattgagaatcacactcggactggaaccatcagcggaaaccacacgcttgaccaacccacgcgcctgaaccgataaatatgtatttaccccaatgaagtcatttggttgttttttcatggacgagaatccttcctacgagagtgctactgccgacagtatccataaagacaagtcaatcgtctatgccggagagacgattgacatcaaaagatgtcaatctgtgtcgaagagagagtcgagtaaccatatagttgataaacagccaccagtcaaagaatcatcagaattgtgatgtccttcatctaacagttgcaaaaacaccgaattatgtgcggacggaacaatagccgaatatgaattcaaccattgttccgtatataagagaggcgcctttatatcattcttgccggcagtaatccaaatgtcaggagcctgattagaaaaatcagctggaagacgccgcaattgcgccaaaggtgaaaacgagtcatagcaagaagatgatgagggatatccgaattcatcccaatcgctaattgtaagtggattgtcggggtctgtgagaatcaattccggtgttaaaaaagggtgcgataattgaacaattttgaaataatccaggcggcgcaatgcggcagaaagaacaaccaaagcgccggcgcttgaacccgctgctccaatgcgtttggcgtcacataagttatttgcaatcaatcctttagtgcaatcgagaaaatcattgatagatatgaacttatttaaccaaaagtataaatatcccttgattcgtcctattgctttaaacatttcaagcgctcctattggtgtaaatgaggggtgaccctaacgagtcaccccctcatttttaacctttatgaatcagcagaagaaaccgctggtgctgctcgggcgaccgaagcagaacgagtagctgtagccactgtcatgcaccgcgtcgtcattcacttcctcgatcgactgcatgtcgatgattttattcattgttgttcctttctactattttgttccgcggaccttccgcagaacaaatcttttgcatctgggagcgggaataaatcccaaagattatgggtaaggacatttaatgctgttagtatccctgctgatccggttgaataatcgcttgagaggcgcaagtatgaatctcccgggaattgtagcgtattttcccaagacaaactatagtcgtttaattcatctaaaagtctattatttgtttgtgttgtttgcggtgaccatgttgaggcaaaatggtttgcaactaatatcccagcaatcccattgtttagtccggaaaaagcatattgagatgatgaacatgccgcaatgagtgagtcccattctttatggaaaagagaatcatcatgtagtgcaattcgtgcaatggaaattgccactattaggccggcagaaccatctgcaaggtaaggaagagacctattgtgcttatccttaattcctcgcattccatttggctcaataacggtattgtctaaatctctgcatatgcaattaagcgcacgccgaatataagctgggttatgttcgatgtcaatacgacttagagctaaccaaaacagtgtgataccactccatccatgcaggaggccaccttgttttatgcttgcgatttgattggattccatccattgcgctatacgatgtccaagtgcaatagcctcatggaaatacctcttatcgtctgtagccattccgtatgatatcagggctaatccttgaccggctagtccgccattaaggtcaagatttcgtgtctctttccaatgttcatatgtgctaaataatagttcgtgagcagtttctaattctcccaactcaaaagcgactaatcctatgccggatagccctgtatataatccaaagtccgattgattgctttgcgcgaaaccgtggatcatgtctttcatccattggacgtcatccgaattgataattgagttggccctatacaggctcattaggattcccgccgcgccggagcttacgttacttgcaccccaaatggagccccgtgttacatcaccaggatatagttttcctggcaatttatgacgggtatgaaaaatgccattaataatttcagttttaactaatgacaaggaatcagggtgtgataacagattaaaggaaaaacgtggtgtaaactgtgtaagatgtgcatctggagttaatggaacatctgaaactccagatgcacatgggcaacgtgattcaacatcctttaacagatttatatattccatgccaaattttttcgaaatattattcttaactctgatccaatgatctgggctaagcatgcaaatcgaggtatttgcatagcatagacatgcgagtacccttgaaacagcaaaccaatctgcttcttgagcggagcaacccaatgggggatggaatcccatagcattatgtgctgatatttccttggagtccaaggtgcgtccatcctcaaaatctataaagtgtatagacattgttttaggattaatcattatgtttcctaaatgaatatccccgtgaacatagcctgtgcgatgaataatttttacagcattgataatcgatgttgcgattgtattgatatcacttctatattgcatcaactgattagtatgatcattttcacattgatagggatagttttccgacaaccaatggttcagtgtgatttcattaagccattccatttcaatgtagccatgttcccaagcgttaaaccttcgatatggttttggtgcaatgccggtatttttaagaagattgagcatcttccattctatggatagtctctcaatggcatcgcgttggcgtgcgtctagaccggcatatggtctcgcttcctttaaaagggcaatctcattctttttattggttgcacgatataccccaccggaattcgagaaatgtacagctttaatctcatagttatctaaatcggtgggaatatttttcatatattcattcagagatattcctacacactttggcttgtcgattccctctgctggatgtataaaatgtggaagcctcttatcggcgaccagtattccagattggtctgggatcatagaaatataatcgttattttcatcctcgcgacgcaggtcaatgaatcctccgtatcgaaagaagattggactttgcttgtatctaatgtcactaagaatataagggcctttttcatctttgatgaggggatataaatcaccgactattttttcaagttcatcatttgttgatggatatatggtgatgaatttcccactacctgaacgatttgctgccttcccgttgcagttgagaaaatctctatgtgaactttgaaatttgaatgttgtattatatttacagcaaatttgtattacttctgcaagaatcttttctgcgttctcttttgttgcgcttaaatgaatcttccatccgttgactcgcatttttccattcggagagcttacatacgtccacggttctcttcttgttacataccaagtatcgggaataagagattccgcaatccaatggtcacgcttcatggatggaagcatagaagcgtgatctacaaaaaatggagattgtttcgtaattgattcgaggtaatcttcttcaccaatcatatttttccttttttcttgtatgctttaataatttttcattgttgtatccttacttattgatttcaatgtgtttggagcggattgtcagctgaagatgacacatatcttcgtgttcttaccattgacattgcttgctgtgatgcgtgggacttgagccagctgacggcgatttgcgtgcggtcatgcagttgcaaggtgaagaggattcgactgatggttcgtcgtatcgtcgcgggctccagtaccagtttgcgggcgatttcctcgttggtcatgccttccgcgatcagtgtgcatatctcgcgttggcgcggcggcagggctgcgaacgaatcccgcagcttctgttgttcgcggcctgctgtgggtctgggcatgccgtgttcgagaatctgccgggtgatgcgtggcgtgaccacggcgtctccgttcgccaccgcatgaatcgcatccttgacggctgcagcactggcgtctttgagcaggaatccgctggctcccgcatccagtccaccgtatgcgtagtcgtcctcgtcgtacgtggtgaggatcagcacgtgaatggcgggccatcggcgggtgatttcacgggtggcggtgatgccgtccatcacgggcatgcgcacgtccatgagcaccacgtccggcagcgggcctcctgccgattccagtcgctcgatttcagcgatagcctgtcggccatcgcccgcctgagcgacgatcgcgatgtcactcgccttgccaagcatgagtttgtagccgagcctcgcgtattgcaggtcatcgaccagcatgatgttcgtcatcccacgtcacgcctttctcttgtcggacggacgtcagcatcgcggtcacccgccagacaccggtttccgccctgtccggcccgtagcagaggaacccttcggttcgggcgatggcgtccgcgattcgcgccagaccggtgccgatggcaccatcggaaggcttggggaggttcgttgatccgtcgttggtgatggtcgcgatcaggctcccatccgccgcgtgatcccatgtgacgttcagatgcgcgaggccgggcgcatggcgcaccgcgttggtgacggcctcacgggtcacccggaagcacagatccgcctggtcggggtcctcgctgcgtcggccggtctcggtgaatgtggcgatcacgccggaagcccgtacgtgtgcgagcaccggtcggatgtcatcccacatgtatcgctgcgccgactcttcgatcgcggtgtcattcatctcgtgcgactgcgtaccgcctgtggtcggcggaataccgggcaggttcgcatcggtggcggtcaaggcccgcagggcgtgccgggtgtcctgcaggccgcttttggcgatgtcgcggatcgcgtcgatggcctgtgcgacctctggatccacatcttgtccttccacctgttcggccagtccttgggccaatgcgatgatgctggtcagatcgtggccgacgctgtcgtgcatctcgccgacgatgctgccgcgccgaacggccgcatcccgctgttgggcgagcaagtccgcgcgcagacgctcgtcgcgttcgcgttggagcgccagggaggataggcgtcggttgcggaccgcataacccagcacgccgatgaccactatcggaagcatggcgggcagtatgtcaagccagatcgaccatccggcctgccgccagccgtctccggcgaacgcctgactgcccagcaccatgcaggaggcaagtccgaagcacaggatccgcaaatcactggagacggtcatgatcaacgcccaataggcaatcatcggcatgatcggagcccattcacccacgccggcgagatccagcagcaacgccagagcaagctctccgcccatcacccattcgggtctcacgtaccgccatgccagcgcgacgccgccggcaaaaacggcggccagcatcagcataaacacgcttggcgtgtgcgtggcccaatacgagtgatacgacgggacggcatcgcgcctggtgacccatagcatgcgcagcatgaacagcgtggccacgaccggcaatccatagaccggcaggccgcccggtttcctcaatcccagcggagcatcgcccgtatcccatatcctcgactcacaatcagacatactcgcatgcatatccgcttggtgcttattctcctgccgcacgagcgatgacgaccgtcggcgatgtgcgaatgccacgttgcgcggtgagccacgaaccaagcatcgccatggcggcaagcaagagcacgaccacgagccacaggagccacggcatgccgaataccagcacgtcaaacgacaaccagatgccgatggagaacgagacggatacgagcagactgggaacgaacgcgatcagggacgaggtgacgacaatcataagcccatccaaggcggcgatggcgttgagctggccttgggttccaccgctgacggctactagcgcgaggtcaagctcccgtccacgctgggcgatcagatagcccgagcacaccgccgccagcaccaggaccagcgatgtgccgatcaatgccaggatacgggcgaaaccgggcacctccaccgtcggcgtccccgcgggaagcagccgcgtccacgcggtgatggtcgaggtgagcgactcatatgacatgagcagcgtcaatccggcggccaagggaatgatggtggacgaggacgcgcacaccctggcccgagcctgctggcatgcgatgcgccacgccggccagggaagacgcaccaccgccgtccacatgcgcaccgtcgccgacagcacggccggaccggcaaggcagacggacacggtgaacagcagcatcgcgatcatgttgccgtacgccagcggcgacatggacgaaaacgtgacctgcaccgacatccgcgccatcgatgtcttccgcacgttcagcagaccgaccgccagcgagaccaacgccccggcgaacatgatccaggcaagaacaagacggggaacaccgaccgttttcggagggttcgccgcctcgcgcaacgcctcgaccggcgatatgccgccgaccacgcgcaccgtcaacagcgagccgaccaaggccatcgcgaatccgaagacgataccgcaactccacgcccgcagcatgcccgtcacatcctgcggcagaaacggcaacccgttcgcctccaactgccgggtcgcgaacggatagagcccccgtgccagcgccggcgagacgataagcgagacgagcgtggcggcgacatccaacagcagcacctgcgcgcagacgcgcgacgtcaactgtccgggcgtggcaccctgcaatgcgatcaaggcgagggcgcggcggcgctgacggatggccgaggagaccaccaaaagcaccatgagcatgcccacgacgatcatcggcaccagaggagggccgctcagctccatcgagaacatcaccgccctgccatgcaaccccggaaccgccatggccatcctcgcgttcgacaacatgaccatcaccatgcccgacacgcactgcaccactgccagcagcagcaataccgcgccccacacgacaggcgcatccctgaaatcacgcaacaggccacgcatcaaatcgcctcccgcccatcaagaccggacgaatcggaaccgacctcggccaacacaccgtcacgcatccgcgcgacgcgatcgcagcggaccgcgacctcgggactgtgcgtgaccatgaccaccgcatgaccaggacgatccgcgaacgcgcgcagctcatcgaccacacgcccgccggactcggtgtccaacgcgccggtcggctcgtcggcgaacacgatctcgggatcggcgacgagcacacgggccaacgccacacgctgctgctccccgcccgacagcaacgtcacgttttgcctgcgcaacccgagaatccccagacggtcaagcagcccggccgcgcgatcccacggatatttcgcaccgcgcagcgtgaacggaagcctgaggttgtcctccacgctcatcgaaggcaccagattatacgactggaacacaaaccccagatgatcacgccggaaccgcgccgactgggcacggctcatacgggtcacctcctgtcccagcacccgtacagagccatcggagacggactccaaccccgccagacaatacatgagcgtggacttgcctgaaccagacggtcccacgatccccgtcatctgaccccagccggctgtgaaatccacatgcctcagcaccggcaccgtctcacccctacgcagctcgaaactcttcgacagccccgcggccgcgaccggagccgacgccattgcatcgctccccgttcccctcaaatgtcgaaccattatccaccttcctcacctgcgtattggacttcgatacccccactatccatcgaagagacaatgagcagcaagaagacgtgcgaaaatgtcatctagagatgacaccctcaataggggaaaataatgccaaagatgatggcacctatagagaatgtctctttttattgtttttaaggacggcgcaagctgctgtttttggcaagcatgtagtacaagggaacggttttgagaaggtggtcgtgtttcccttctccaatgacatggccattactcaggacatatatcatttcggcattgcgcacggtagtgagttggtgggtgacgataatgaaagtgcggtcttcggcttgttccagtagttgggtaacaagctgttcgttatcagcgtccaggtttgcggtggcttcgtcgagcaggatgatttttgccgtggaaagaagggcgcgggctatggcgagtctttggcgttctccgcctgatagcatgattccgttttcccctatctgcatatcgagacctttgtcggatcgatctagcagatgggagagattcacggatttcaatgcccgtcggcattcatcatcgctacaatcgtttgatccgagaagtaggttctctcgtatgctgccggacagtgctggtgaatcttgttccacgtatgcgatgtggctgcgtaaatcgtctcgatcacaggttgttatgtccttgccgagtacattgatgtttccgctggaaggatcatagaaacgttcgataagttgcaggatcgtgcttttccctgcgcccgagggcccgacgagtgccgtgacgcttccctgggatatggagaggttcaggtcgtgcagaattggtttggattcatatgagaagtagacgtgttggaattccactgctggcggacaggggctgctgtgtgccagcggcatatgttcattgattgttgtgacgacggtgtcatggtccttttcttcgggaatatccaatatttcccgtatacggttcatcgcggccattgaattgccaatttgtgagcctgcgtaaataatctggctgagcggtgagatgctgatgaacagcaacatgatgaactgggtaagtttttcgacggatagcagccctgtggttacgcgccataatcccagaccgaacacgatgatagccgcgagctgcagggctatcgtggccagtggattgacgatcgactggattctggcgatcttgagtccggacaggcggacacggttgattaaggcggcaatgaccttattctcgttctcgaagccgtttgaagcacgtatggtgcggatgccggcgagatcgcgattgagcgtggaggtaaggtcgccgagcgtgtattggctgtcatagcttgctcgttcaatgaatttagcggacagcagcatgagtgtgaatacggtgagaagcagggtgattgctgtgccgaataggattgggtcaagcattgccataaacacagcggaaccgatgacggtgatgaagcctgatgcaagggctgatgtgcactgcatgaatgcattacgcagttgtgaggtgtcgttgctgacacggctgagcaggtcgccggagtcgcgttgatcgtattcgcgtatgggcaggcgtagcaggtgtttgcttagtgtgagacgagcatcccttacgatatcctctcctgtactctgcagttggtagttctgtagggctgatatagctcctgaggcgatgacgagtaacagcattccggcaatgacgggccactggggaacctggaatacaccgttctggaagaagttggtcatgtacttaggcaggagcagcgtcatagaggctcctatggttccaaggcataggatgagtgccagccgtcctcggtattttcggaggggagaaatcagattgtacatggaggcaggtttcatgtgcatggtgtcgtcctggtcgttgacggtcattgcgtatctttccgttcggaactggctctagtaatggtgtattgtttgacggcatcaggttcgccgatgggtataccgttggcttctacccaagcgtgtgcgcggaagggacgatcggtgaatccggtgcaccatgtgacggatcggtgagagatgcggcatgccgccgctgtggagagcgaccgaagcagacaaccttgctgactgcggcatttgcggcttaccacgcatacggcattgcggtaacgctccgccgtgctggtgtcggccggcggatatcgttcggaccacgtttcaagccggcggcagaactctccgatttgctgtcgttccatccgtctgccgatgatgatggcaatcagcgctatcaggcggtcgtgaaagttgacgtgtgtgaccgcttccggctgtaaagggatgctcatagacgcacgtgcttccccatatcggcgaggaaacgatccgcgtcccgggcgatgatttgtccgtcggcctgatattcttcggcgattttattcgtacaatcctcgatggttttgccgcacatcagaccgtcaaggataatccggcctatttcgttgacctgcagatattcaccggtgtcgttgacgaagacgattgccccgccctccttgggatacagggatatctgattcctcagactgatgcttgtctgtgtgtcatcggcttgcatgtctcagccacctttccactgctgctactcgttgcatttcaaacaggaatgtgatgtcaggcatcggcatggaagctcgacgccgtatggctggcatatcgatcagtccctcctcgtccagcactccgccggcgattgagtcgagcagcgcgtccttcgagcgttgccatgccagatacagtgaatatgagtgatcgcctttgacgggacgccggaatatcgtttcggggattatgcccttgagcgcccggtataacacggctttgtgtagatttccctcggtgcgtgcactgattggggcgcatagcgcatagtccgcgattccgtggtccagatagggggagcggaacgttatgtcgtcggaggagaacgtccgattaacctgattgagtattcgtgcctgcattgacagagagtagagcgcctgatgacggcttcggtcggggctcaatggccgaatgtcggcgtgtttcaattgtgattcaacggcgccatataggatattcctggctttcgcggtcaggaattcgggaatgcgtatggcatcatgccatccacaaggcgaagagcgatggtcatgaccttgttccgcgtccaggaacgatgaccgtaattcctcatgcagatcggtgccatcggtgagatcgagaattgcctgatagggtgggacccggtaatcggcgctgtattgtcttcggatgtcccgtagccgtagcgggtgttcccgcaggcagctccatgatgaggatggcatggatgcgaacagctcgtctcctccgaaacccgtgacatggatacggcttgcgtctgcttccatttcggagattcggctgagatagccttcgatatcgctccagtagaccggttcttcaggtatctctctgttgggatattcggctgcgggttcgaatgatctgtttccatccacgacccggccgattttgatgagtggcatccgaacgtcctcggagattcgctcggcccatcgggaatcctgattcattggatcgtcgggtgtttcatgatacaggggcatacgaaccccctcgctggcgaagacgtatgtgatggcggcggaatccactcctccggacacatcggcggatagtggtgcctcattgcgccactcatccgcgatcgtcaggaaacggcttcttagtgatgccaagatctcgttgctcggaacatgttttgcgggtgaaggttccgctctcgtatatcgcggcctattggatttgtcgaggtgcagtatggttgcggcgggtatggaatgtatgttcctccatggggatttgtcccctcgaaggctgtcagggagcgaaggcagcaaatccatgacaatgcgttccaggtcaagatcggcgttcgtgatgcttgcaagtcgggaggcgctgtccgacaggagcacttcatcttcggagacggtccagaacacgcgatcgccactcagcagaggaacttggacgcatgttccctcgtcattgatgctgatggaggcgggaagcttcgaatagttcgtcggcttcccgccgcggacaatcacggtacggtttgggttcttatgcgtaaacggcatcacgtttccctatcctgatacagctagggatcatcaatatatgcagggtttcggtcagttcgatccccaagggaacggggccttggcgccgccaacatcgacatagttgccgaaccatacgccattggttgcttccttgaatgatgcgatgacctcaacggccgggggtacataatccttcatcttcgttctcctcatgctctgtatatgggaccggattgcatgccggtgcatgccattccagttaacctgatttggatggtacatccaagaatgtgtttggtgtttgtcatcttcggatgacaaacaccaaacacatggaccttagggaagcgggtgatccgctggcgtttttcagtcttccttccaaagctggccgcgggagccctcttttaccacggtgcctttatccagtaccacaacgtcatcggtaatcggcctcagcctgctgtccggttcggatgcgatgagcaccgcaacgccacgattcgcctgcttccgtatctgctcgcagatccaattcgtgcccgatcgatcgagtgtctggagcggttcgtccatgatcagggctttggggttgggaagcagagctatggcgaatcgcattttgaggacatcgatcggagcgagatcgtggagcctgacggtgagaagattctgcagttcggtcatgtgaatgatcccgtcaagaagcggatcaggcgtcccggcccagagcgccttccaacgaagataggttccggccgagtaatacggggacagtgaaatggcttcgggcattgcactcacaacgttttttggtatacgggatgtgccatagggtttgccacaggtggatatgcatccggaatccgggatatccagtcccaacagcatccggagaacagttgttttgccagcgtcatgcgctcccatcagaacggtgactcgacctgcataggcggcaaatgagatcccatgcaattcgcggccggcatggctgaatgagacattctcaaacgcgatgatgggtgaagccgaatcgggcagctggcacatcgttttcctttcttcgattgacctggccgcaatacagttaaccagttcgctctattctccagtaaaacgattgtgctgtttgtcatctgaagatgacaaacagcacaatcgttgagatgaatatcgtgatctttatgctggtttgccgcctgttatttggtccagccccgattgataccaggctatggcgatttggactcggtcccgcatgtgcattctggccaatatgcggcttaccgtgcgccgtaccgatgtcgtttcgatgaacaagtgttcggcgatttcctgattggacaagcctgccgccacgagttccgcgacttcatattcccgcttggaaagtccgtcgaataggcttcgcagcagcttgatgcgggtgttgtccgatatgggccgaaccccgcgattgagcacttcaccggtgattctcggtgtcaataccgcatctccgttatacacggcgtgtacggcgtcacgtagctgtttgggggtcgcatccttgagcaggaatccggatgcccctcgcgccaatccgtcgaaggcgtaatcgtcctcatcgtatgtggtcaggatcagtatctggatttgggggaattgctccttgatgatgcccgtcgcctctatgccgtccatgacgggcatgcgcacgtccatcagaatcacgtcaggcagttgctgcggtgattgccgtaggaattcgattgcttgggcgccgtccgcggcctgtgagctgacgatgatgttcggatcgttgttcagcatcatcatgaagccggtgcgcgcccctcgcatgtcatcgaccagcatgaccttgatgatgtcgtctcttgcatccttcatggttcttccgtttctttcaggggactagtgccttgaccgcccagccattgccgtatggcccataggacagggtgccgcccattttcgcaaggcgttgggagagtcgttgcagtccggttccacctgtcggcttcccgctttgaccggatgcctcgccggtggtgtcgtgtccggagacgtgtccatcgttgcggatcgtgattgctgttccgccatcacggtaatgattccaggagacggcaatgcgggtcagtcccgcgccgtgccgaagggcattggtcagtgcctcgcgagtgacggcgaagcataaatccgaacggcggggatcctcgacgcgtcttcccgtttcggtgaacacgacgatgattccggtcgcgcgtatgtgttccagtacgggtctgatatcgtcccaatcccgtaagcgcaggacgtcatcctgattcactgggtcaagaccgacctgttccaaagacggctgcgattcctcttcattgaagaccttcagtatgcggcgcgtatcgcccagactgtcttttgcaatcgatgtgatctccgctaagacatcggccagttgcgagtcggaatagccgccgttccttatgcagtcctcgcctccttgcgataacgctatgatcgaggtcaatccatgaccgacgctgtcatgcagttcgttggccatgcgaaggcgccgttccgtacgattcttctcctccgccagtattgcggtctttcgccgtgcttcggacagtagcctattcgccgttcgacggtcccgtgctatggacaacagtgaggatgcgatgccggccaaagcgacggaatatagtaacgccaaatactgaggctgcagagaggcgggatgcatgtattgcactgcgatcatgcagatcatggccagatcgcacatggcctgagcatacaggggaagccggatgcacagataaagcaccaggataaccgcgacctgcgtgtatgagtgcaggccaacgccgaacaggacgctcagggagagctcaatgaattccaaggccagcaacgccacggggcttctggaccttaacgtcacgtttatggctcctaaaaccagcagtatgaggaagtaccatattcccgctccttcgttgaggaaccggataaacgaatatcctgtgccgattgccatccgctcttccacataatcgcggatcagcacgcccatcgtgccgacgatgcagatcagagtcgtcgtgaaacgaagcaggcgttcccctttgagctgccgaaaccataggatcaatcgattgcgcggggtgacggccagcgtttgtccctcatctgatgatttaccccgacgtgagcccataatgaggcggttcctcgcaacctgcaccttacgccttcttcgttgtccgagaatacagctctcccattatctacgattcacggctcacccgtccatgacttggctcctgtttgacatctacggatgacagtgacctatcgcagacttccgctctgatttcggagagaatgattcaggcgaggctgctcgacatactttccttcatcggcgcgggaacacggcccctggccatgcgccgtgcgaatgaccgtattgcctggccgctcgcatgctcgcggcggtgcgccgggcggaccgcaagacccgacgcaacgaactgcccgaccgcacctgcatcagcgaccggctcggagaccaaaccatcgacgtcatcgaaaccaacgaaaccaaaggcctcaacggcagctggacacgcagcacccgcaaaaatgctcgcaaactcctcaccccggacgaactcggacgcatcccctcggccgatgcatctacctactcagaggcataccgccatttttcagccagaggcggtgattggtgatacatagttccaaaaaatcctgaggtattgtcatcccggaatgacagttgacaatttggagcttgtaagtccaccttcaatttgagaagctgacaatgcaaatggaacgagagaattgcgaatgagacttttgtcgatgtcttatagcaataaaatggcaacattataatactgagattttataaggagccctatgataaaagagtttacgaatgcagcacgatcgcctccattaagtgcgaccaatagcaggctacaaaataatgctgatgtattactcaaggaaactaatgcaattaactaatgaagttacatagtgtttgttaacattattcaaaggagacaatgatgtctaagcatgaaaatgatatccgcctcacgtcttgcgataagggaaagcgtcaaatggcaagtgcggcagttgctcttgcggcagtgttcgtcactccttttgttgttccacttgtcgcttctctaatggtagtgctaggaattggaagcgcagcagccaccgcaattgtcgctgtagcttggcttggatctgctgcggtgggaatgatcttccccgcggcggcgccactcacttctgccattcaatccatgattggcatcttgggaacatcaggtgccgcagcatggtgatttattaattagatattatggccttgcaggaaaggaataatgtgggattcctgaagttgctctttattaagacgtgttgtatcctaatgatttccttaatggcgtttctgggtggtggacttttggccagactacgtccgtaccctttgagcaaggccataattccaaacgtgtatcttaatgaactgctgtggaataatactaaagtatggctaacactattattagggggatttcttttttctgttcctacaactatcgtattggttattaactatggcatctttggttggagtgcggctcagtatttgttccaaggctttggtaataaattattaacagcggttattccgcatcttttctttgaatgcttttccttgattactgctgcaggcattgcactaactattacacattatgaattatgtttcttacaaaacagtcagaaacgaaatgttgatacaggtaatgtcgttttattgaccctgtcaatggcttttatttcatggatttcgcttgtccttgctgcaattatagaaacatacgtatctcatatttaaggagcatcatgattcgcctttcggtctggtttgagtccttgaagtggcgtatttccaacgggcgtcgccatactttgaactggtggtatctggtattggccggcgtgctgatcgtgtggcttggtgtggcagaggccgtggcgttgcctgcgtatggcaggtacgcgcatgaggtgttctcgaatttgctggccggggtgccgtccacgccgcccgcggtcgtgcaggtgacggtgttccaatggtcgtgttcggcggtctggctggtgttggcgtatcggcagtgggctcgccgccagttcaaatggatgattgtgttgatggtgtgcagcctgctgtatatgccatttgtggtttatctgatgcatgaggtggtggatcagcgcagaggagtcgttcggttggaggaaaagcctccggaaccgagtattgtcgctgacgatgaaatgatcggagatgagctaggacagatagattccagtatcgcggcatcagtaaacgccggcgatccggtatctcatcgcggcaagactcgccatggacgccactgttgaggttcgcggcctggtcaagcggtatgcgtccgggccgacgataggcccgatcgatttcgaggcgcagccgggtcaggtggtggcggtggccgggtcgaatggtgcgggaaagtccaccacgctgcgcatgacgcttggcctgtccgctcccagccggggacatgcgctggtcatgggccgcccgtacgggcagttggagcgaccgggtctgcaggtgggcgtgtttctgggcggccggttgggcgatgagtcgatgacgggccgtgagtatctgacgttcatggccggcatgatggaattgcccaacgtgcgccgccgcgtgcgccgcgtgctgcgcgactgcggtttggagcgttggccgaagacacggatcaaggggtattccacgggtatgcggcaacggctgggcgtggccggcgcgatcatcgccgacgcgccggttctcgtgttggacgagccgttcaacggattggacatcgccggcagactctggctgcacgactcgatgcgccaatggtccgccgccggcaagaccgtcatcctcgcggcccatgagatcgacgaactgcaacgcatcgccacccacgtactgatcatcatgcacggcagacagatggcctatgggccgctcgaacaggtcatcgccgacaacggcggcaagtccgggaccgtgttccggttcgcgcccgatgtggatgagactcgaaaggccatggtcatcggcgaattggccataaccggagccgatcttcacctctcggatgacggctcctatctggcacgacagacggacgaggccgccgtgttcgccattgcggcgaggcatgacgccacactggtccgtctggaccatgccgagccgacattacgtgacgtgatgaccggcatgatccggcaaaccccggaaaaggaacgcgcatcatgaacaggacgggacgatgcctacgacgtttgatgctgctcatgcgctacgcggtctgccggccggcaccgctgactgcttggcttggtctgccggtggcgttcatcgcgttctccgcactgaccagcgcctccgtgcggctcatgttctccgccgattccaagctcgacggcctggccacgcttgcgggcatggggccgagcatcgccggcgccgtcatgcccatgaccgagcccgtggcgatcgtcgccgcgctgctcaccatccgcatcctgaccaacacggccaccgccgtgccgttgtttctggtcgagccgaaacggacgcgactgttcctggccctgtgcgccgacatcgccatcatcggcaccaccgtgacggcagccggcgcgcttgccgcgaccggggtctcccgtctcatcctcaatcccgtcgtgcccgaacaggcatggcccgcgccgctgtccacggcattgctgctgtgcctgcccgtggcgttgatactcgccggacgaatgttggtcgccgccgcgttatgcgtgaccctcgactcggcgggcaaaggcgcggccgcctacatagccctgtattatctcctgcccatcgtcgtgaccaatctgcaggcaccccaaacgttgcacgaatggctgccctccatagccggcaccgccatactggaacccaaaccaggcatcagcccgatgctcagcggcgcgattgccctcgcgtatgccatgaccgcaatcggcatcgcctgcatcgcccaaaagcagagagatatcagatgatcaatctttgtggaatttgtcgagaagctattgtaagcagccgcggtggttgcttcccgtcagtgggaataacgtagcatcgtcgatgcacagtgacgtgctcggtaaacatattgatgttattgatacaggaacttcaataatgtcatgattggaatcattacatccagagcttcctgtggctcgtaatcgatagcgcaggagccggcccccatgatgcacagggaatccggctcctacttccatttcctcctcagaggctggcttatctcataatatatcgttcaccagcgaccagtgatatctgattcgtttcgggaagagtcaacttgtgcgaagatccacggtccgaaaatccaaggaggcgaccatcaggctgaaatccagcggaccgttccctgcgttctgacgctttcatcgctccatgcgaccggatcactcattggctttcacctccgttatgtctcttcttctgcgggacgagttcagcgattcccggtcgaacggcggtagcacggtgtaagtgttcaccttggagaaccctgtctccgttcctgacgaaccgggcaagcacactgttgcgctcttcgttgccgcgtggaagctgcacgaaggatttgtcaatcggcacgaatgaccgtttcgagcgggcaaggagtgcctctacggtctcacgccagtcaatctgattatcatccatatgcctttcgcatgaacatcattgccattgcccgcaatgctaccatgcaagccgaagagagcgaatgtttcattatcgcagatgacatacactacagcgggtttgcgatgcggggaattgtgcggactgcaggttggggatatcgatcttatgtcgagaacgctgcgcgtccggcattccgtcaaccgaggccgaacagatcgtggtcgcgtgcgaatcgccgataccaagacgcgttccagcatacgcagtgtgcccattccggacgggctcatccccgtgattggtgatcatctgcgtcagcactgtgactggactgatcccgatgccatggtgttcccgccaagacgggtgaagattatgagtcaaacaacgctggaaggtcagttccgcaaagccagagaaaaagcgggaagacctgatctaacctttaaatcgttgcgtgccagccatgcgacactgctgatgctcaggggcggcacgttgcgtgaagttatggacgagctggggcactccagcgagaaggtcgccatcaagcactaccagcgcatcgtcgatcagcaccggagtcaagttgtcaaccaactcgtagatgaattcatacatagccagtatgagtcaactatagatgacaaaaaactagtaaacagaatgagaagaaaaccaaagtgcaataatacagacactcgatagaggtgaggtgagaagaatgagttatgattgggtcgatgcgaaaattatagctgtatcagattgtgattcctctcatgttgctattgatattgaagtaaaagaaccaatatgcttctccaatacgaatattccatatgatatttattatctaattcctgatccaatacacaaagatagatttattcaacgaacatatacagcattactagaaaacaataataacagaataattcatactattatatataggcataggaatttcggtaaggcatatcactggctgaacgatcttgcgatgaaccaacatgtaagcataaagttgggacgcccttctattaaagcagaaacgctgaatgctggttcattagtatttttaggcgatgatacatcagtttacgcgataaagaaaatcgtagaatatgcaagcagaaaacataactgtactgtattcgtcgagaccatagaaaacatagattattctataggattcaaaacgtcaaaatatttttcaatccaaagagaatcagaaggagtgctttccttgataaaagggaagaaagatttgttttcaggtgatgtcgccgtgtgggctgcaaacgaggtggcgacaatagtgaaaataagaaaatatttatcagaaaaagaaatattttgtgctgaattgcatggatattggagtcaaaaatagtcaaaggataattatgcttttctcaaaaagaattttaaaattaagtgaatcgccgactttgcaattgaataataagataaatggcctattgcaaaaaggagaggatgtaattaacctaaccgtaggcgagccagattatgtcgagcctattgaatctagttattctgcaataaaagcaatttgtgatcatttcactcattatactaattcttctggcattatttctttgagagaaagtatatgcgctaaactccttaaagagaataatcttgcatatactcctgatcaaattgtagtttctgcgggtggaaagcaagcacttttcaatgctttttttgttttgctgaatggtggagaagaagtattaattcctactccagcttggcctacttacaagcaacaagttttattgtgcggaggaacacctgtattaattccgttagatgaatcctctgaatttaaattgacgaaggagactcttaaagctttcattacgcctagaagtaaaattctagtcctcaattctccgagtaatccaacaggagcgacatattctgaagaagagttggatgatcttgtctcaatcgtagaagagaacggactatatgttattagcgatgagatatatgagagattggtatattcgggaacatactcgtctccggtcggcataaatgattatatgaaaaaacattcagttttagttaatggtttttcaaaagcatttggaatgacgggatggcgtattggatatactgctgcacctcttgatatttcgataaaaattgcagcgtttcaaagtcaaacaacggcaagcatttcttcgatttctcaagtggcagcaaaatacgcaattaataattttgataaagaacacttaattgagcttaaagaaaaaagaaattatttgattcatcaattggctgatactccgttaaagatagatgtagaacccggaggtgcgttttatttattccccagagtcgattccgtcttagggaacagtatatatggagaatccattgattcggttgaagctttatgcgcttctttgttggagagagaacatgtcgcaataacgccgggatctttttttgatgctccaaacaatgtccgcatttcttatgcaaaatcaatgcaggaaatttgcgatgcggcacagcggataaaaaaatatttcaaggagggcatgaaatgattaatttaaaagattataaatgggtagtttctgagagtagcaaaaaagcgcagagaatgaccatggcaggcgatgcgctgagatgtgttcttaccttgaataatagactagaaattacttctgcaatggagacgctaaccgataaagaaaagaatattcttcgttttttggatcatagtttttcatgcgacagtgatgaagtgacgctctacgcatattacagatttaatcgtctgcagatttctgatacacgtatcgatgaatccgatttgtgtcgttttgtgatttcttttcaagtgcccagaaatatttggactaattatcaagaaaaagatgcgaatgagttttctgctgaaattacaagatgtatgaagctgatatcgagcagtactattgatttaagacaaaaaaatgcaagaattgggtattatttaagccatatggctcctgtgatttattatgtaggagatcatgtgtattcaaattttgattatttgaataatttaactagtaatagaacaaatttcaagaaaaacaatctatttgaatactgggattcagaagatcataggtcttgggacaaagaagacctgatttttatctgttttctggattatcttcttgaatctggaattcaaacaagatgtgaagagttcaatgctaagcaaatttctttaaaaatattagagaaatactttgatattaagcatgatgaatatctttctgaaggaatcgttagcagcgattacaattatgaatcttcgctggaatctaaagcgcaatctttgaagaaagaatttgcgctagcttgcgatggaagaactgtgtataggtatatcaatggtttgtctcttcagaaagaagaaagatatcttgatgatgaatctttaagagcagaacttcctgaatatagttctattaatcaaatgctcaagaattcttttaatcttgatttctattttgaatatgagtatgaaaattctctaatgaaatattactcagcaaatgggaaagattgtgaaagcgcatttctttcacttcttaaggcaatattgaaatgcgtttcaaatgatacaaaatcagacctcgctttttcgagattcttctgtgatatagggcttttgattcgtctaacgaaggaacaaaaatatcaagagatatgtgatttgaatcctcgtcactactattgctatgtgcttcctggcgataatatggtgcgaaaaatgccctccgtgataacggctaacgttgccatggccgtcacaacgcggatgctctataacggttggcattatatgccagcaaattttttgtcgagtcaaagcgtcgataacagcaagcgggaatattacttttctgctgttctgcccgacgttgctaagcttgataaatatcatcatgttggccatgttaagtctgaagttaacaatacgatacgtatacctggcgaactttggattaatggccgcgagtttaaatctttgatggatctgagattaatgcgtcaaggtgatgaagaatacacaatctcagatttgaaaaaagctcttaaagcatttaaatatgtccaaattgctgagcaaaaattgatcgattatatttctgatctaaataattatgatttttcgcttacgcagatgactaagaaaacctatatcaatcttatccaattaatgaaaaaggagaattaatgaaaaagcgagttctttttatcaatgttaggtcgcacatggttgaacggatggaaccgttgttcgccgcgaaaaatctaaatgtcgatcctgtacttttatgtgataaagatcctgaaatagatgatagatacgtaaatcctgataatgtgttcattgctgatacatatgatatggataaagcattagaaatagtaaaagaaattcatcaaaagaatcctgtttccggtgtgttgacttgggctgacaaggatgtagaacttgtttcaaggattgctgcagccttgggacttccaggcccatcgatagaggctagtaaaaatgctagaaataagtatttgatgcgtagtgcaattgctctgaagcatccagaattgtgcccacggtttaaaagtgtgcgtagtttggaggaacttcaaactgcagttgatgaaattggtgtgcctggtgttttgaagccagtaggtgcttctggaagcaaatcgattataaaaattttcgataatcatgatttgtattcagcttatcatgaggtagtcaaagaaactcgtatagatcgtgatcccgtatataattatttccccgatcaatatatttacgaggagctcatggatggcgacgaaatctccattgaaggattcgtatcgacgtttgacaataatatcattattgctggtatgacggataaatttgtaacggacaaatattctacagagtataaagaatttgaaccatcacaaaaaaatccagaatatttgagggtatatcgagagcaaattactaaggcaatacgagctttgggcatttcgcaatgctcttttcacgccgaatgcaaggttaatggaccacaattaaaggttatcgaaatagctgcgcgtcctggtggagagtttattacaactcatcttgtacctcttgcatcaggtacttcttttgttgaacagaatattaaaaatgctttaggactacccattgatacgcaaattgaatttgctcaatggtcacagtctccaaaatgcattgccggacatcttgattttatgtcgaaccaggaaggtattgtcacacatattggtggattgcaacgtatatatgaagatcctaatgtagttaacttccttccacttaaagaggagggcgatagcattgtacttcctcctgatgattttagctcgttatatacagcaacaatggttgtaaaaggaacaagtattgaggatatagaaaaatcttttgatttaattcaacagagatttgaaatatctatttctaaggaagcgattaaataaaatgcgagttctcattatgtttaccagtatgactggcaatgatgaagctattgcagatattctatttcgaatatttaatgacaattgcgtacaagcagatgttagccgaatagaagatactgattatgcttgtattactaattatgatgtcctagtagttgtttcatatacatatgaagatggcgaagtgccgcgacctgcttatgacttctatgaatggttggaacatgaaaaactttcttcattgacttttggtgtatgtggttcaggagatacattttatgaggatttctgtaccgcagtcgataatttcgactcaaggctagagaataccggagccatacgaggagccgaccccgtaaaagttgagttgtacccagaagctgaagacgagcagagattgggtaattttgttttgtcgattttaaacacaaaaaaaggacatgatgaaaatcaaaatgtttaaaggcaataaatctgtcatattatttatatttggaacatttatttcaaatataggtaatggaatgttctcgctaatcgtggggcagatgctatatgctgctacaggatctgtcggagcttttggcctgatactgattattcagaatttatcatcgcttttgttgaatataatagcgggatatgtcgctgatttgattgatgcaaagaaagtctctgtttacattaatctaattcaaggtgtgattcttttaggaggtgtattttcatgtttaatgttcgcaaaaaatattgtaataatacttatgttaataaatactatattaagtatctgcagcccctttttcagagctgctaactttaagttgatccctgaagttgaacgccataatataactctgctttcatttaatggaattcggagttcggcaaaccaaagtggacagctaattggtgttgcgcttgcggcacctttgcttttgacaaacaatccagtttatgctttaggaattaattctggctgttttctcataactagttttatgatgaacagaattattttagtgagaagttctgattctatcaatacaacaaacgataaaaatgtgttgagatcgatgtatcttgcgtggttttccatgataaaaaatattttggaaaacaaaaaacttacattactgatcgttttctctatttttgattatatatcggttagctttgtaaatcttatcgaaccaaagtttgcaactgaagtattggcgaatagtgcttacatatcgatattggatggaggctttgccctgggggcgatctcttcatttctattagtggagagagtattaaaccgatggtccttcagcggggtcgctccgctgttgatgctccttcaagcaatatgttattgcatcctaggttctttcccatccccatttttttcgtctttagtaatgtttctaatcggtttgattaatggatcaagtattgctgtttttcagacggaattgcaaaagactgcagaaaacacggtgcatggaaaactatcaagtttgcgagatatttttgttgcattttcaactttagtatttatacctatatttacacatatagttgataacagcatattcgttggcattgatgtatttgttggtgtattggccattatgtcattgcttttatatttttctcgttttgccggtgctaataaggattgaagatcatgatgaattttttaatgattggagaaagcgctgttatagcaaaatgcatttctgaatcagatcctgattctgttatatatattctgcatcaaaaagacagtgtggataataccgtaattgatatttcaaatgatatacatttcttccaatatgggaatagagaagaattggattctatcatttgcttattggtgcaaactgtaaaatttgatgcagttattccgtgttttgaaaattcagttgaggatgcaaactattgtgcgaagaaactatgcgtgccgcgtattggcgatatcggcgcacatatttttagaaataaacttgagctaaggaatttttgtaagaaatatgatattcctcagcctgattacatatttgcgtcaagtagagtagatgtaaaaaagttttatgcaaatcgtcagcaatcatcagtagtgatcaagcctagaacactttctgctagcgaaggtgttgtacgtattaatcaggcatcagagatcgatgagaagtgggaattctgcgagtctatagcaagtctacataatgagaaggatggtctactcgttgaagaatttatccctggtgccgagtattcctgtgaatatattgtagatgataaacaaatagtttttcgaaatataacaaagaaattcaaatacgaaaatggtttttttgttgaatctggacatcaagttccaggaataattagtgaaaaagcaaaggtgaatatatatcattttatggatctgcttgtaaaaaaggcaaagatagaaactgctgcattacatgctgaatggattatctcttctgatgacaatccttttttggttgaatgtgcgggtcgacgtcctggtgacaggattgtagatctcatatccataagctatgaaatgaattttttatggatgtattgcatgctattatgcggtttgcatcctgtttttccttcaataagttcacgcttttctcaacagaattacttcgattttcaaccgggcattgttactggtttcagtcatcctgaagcattaaaaggattccaacatgaattaacctgttcaataggtgactatttaagtgaaatatctgatagcagcaaacgacgaggttatatcataattgatgatatagattatttttcgcttgaacgtcagatgaattgtgtacttagtttatttcatataaacacatctaaggagtgaacatgcatgtatgcatgattaatcgtgtgccctgggttcgcgcctctgtaacttcgtggcttgagcactcagaaatggaagacacagatgtagttttaatttctcgatacgatataccagactctgaaaaaagaggattgagcaaatttgtttacttcgaatcttatgatgatgatttagcgcttgaaaaacttgtgatagagctgcatggcgaaagaccttttgacagaatcattgccttgtcagagctggacattctgagggccgctaagctaagaagcttgctcgatattcctggtcaatcttatttcagcgcatttctctatcgagataaaattgctatgaaagaatgggcgagtcttgcgggaatctcggtgccttcgttcacggttgcttttgatcaagaagatatttattctttcgtggcgagacatggattccctatcataataaagccgaagaatgaatatggatctaagaatgtttcactcatttcagataagggtgagcttcaatccttttgccgagttttagattttaatgatggactagatgtcgagtctttcattcagggaaatctttaccatgtagatggaataatatccaatggacggcttgtgttcacatcagtatcgatgtatttgaactcctctggaaaaagtacaactttgtttaacgaggatattaaacctcaatttccattgagcacagttgcagatctacagatatctccattttctactccttttaaggttctgacaaatgaaacgcgcaaattgcttgcggacccaaagtttgataatggatctattcatgcagaatggatccttgatgaatcaatgaaaccttatttcatagaaatagcaagtcgtactggtggtttgctcataagcgatgccatacagcgaaaatatggttttataatgaacgaagagtcttttcgcgtacagcttggtttaccgttctgtgcatcatgtgttacggataaattgtatggttacttgtcgattctgccaaaaagaggcagaatcgacaagtatgatattaatacaattgctaataattctaacgtaatatcattttttacttcatataaaagtggagattatatcgatgctcaatctgaatctactgataatattggacttcttttatttgaaatagatcaacgaaagacattattggaacaagtagaatattggactctttttttgaattctaaaattcatgttttaagtgactaagtcttctgctcctgctcgctcatcctgaaagttgtttagaattgtgaacgagatgagtgcttgaaccgccattgagtatggtcgattgcggatatgtatatagttttctcttgtttcacggattatatcatgtagaaatatcatattccttacaatcttaccttagcgcaccaaggatttttttagttcagaaaggtgcgctaaggttttttgttgctgcttcgggaacagtcaagatcgtccgtgtttataatgggttgatttcagtattcatcttagagcagcaagtcattgatttgatgtctaatttatcttttccctgatatatgtgcatgattttctagtgaggggggtgcggatgtttttttggacggtcaggcggccagtccaagacttctgcggtattgcacggggctcatccagtccagtgacttcttgatcctggtttcattgtagtgggtcaggtaggcggccaggcgttcgcggaactcctcgtagcccacgcccctccagtcccgcccgtagaataactcgttcttgagcctgccgaagaacccctcggcggccgcgttgtccgggctgcatcccttggcgctcatcgaccggatcagcccgtgctcctcgcagatgcggatccattcgtcccaccggtagtggcagccgcggtcggaatggatgattggatgttccccgtccctgagcgtggcgaccgcgtcaaggagcatccggttcgccatgtcggcgttcggggagcgcgacaaggtccaggagaccaccatcccgtcgaagcagtcgaccaccggggaaagccagcacttgtacccgtccatggtgaactgggtgacgtccgtgacccacagcatgttcggcgcgtcggcgtggaagtcccgctccacgaggttcgccggggcctcgccgatctcgccggcgtaggagctccaccgcttcggccgcttcaggtacacgggccgcatggcccctcgcgcatgatccgcctgacgaccttctccgagacgacgatcgggtcggactcgtcaaggcgcagcatgcggtggatggtccggtatccccatgcgcgcccaccctgctcgaacaggccggcgacgcgggcccgcagcacggcgtacctgtcgcccgcggcgatcgcgccgcgctcgtaatagtaggtgctgcgtttcagccccacggccttcagacaggccgccaggccgaattcacccctgatcgcgtcgacgacccgcgtcctctccctgttcgtcagcatggacgggtcgaggcgcgggtcgtcggcttttaaaacatcgatcgtctcccgcatcaccgcgttctccagccgcaggacctccacctgccggcgcagctcctccacgtcatcgccggccgcgggcatcggttcggccggcatcggcgcgtttctcctgtccatcagtcccagtatcccctcgctccggtagcggcgcatccactggtacacgctcgtcggcgtgcaacccgcgtcgcgcgccacgcgggcgaggggctcgccctcgagcgcgcgtctggccgcattcgtcttgcattccagcgtatacgaacgcctgcacgcgcccgtgtaacgcgggtcctcgcgaacccatttcaccagcgcgccctcggacgggtaaccaagctcggcaatgaccttcctgatggtcatgccctccgtgaaatacaggtcaacggccctgcgccgatcctccatcgaaaacatgcggactccaatccggacgcccaagcgtccaactttccgtccgcatccccgagattctatacccgtcgtgcagtcatcattaagatgacaacaattcagcaaaaatgctggttatcaggaattcttggtttcaatctctcacaagaggcatatattcagtgcacctctttgatttacggagatgttatgcaccagaacaggtattcccagaaaaagcaatcgcgtaaagctcgcagtaagtggggaacggttatagctcgatacagcaaagatggtgaaatcgtggcttggcaggttcgctatcctcatcctacggaatcagggaaacgtgttcaaagacagttcaaaccttggcaagagttggaagctcgaaaatggcttgaggaagaaaaatacttggttgatcttcaacataagggaattctcacttggactcatccgacactgagaaaaagagaagcaatgcaagaagatgacaagacgaagcgagataaagtcaaattctgcgattatgtgaattggtgggaaaagaattatcgactaccgaacggcgaagatgtagcaggaggaactaggcgcaaccttcatgtggatataggacattttatgccttttttcgagaacttgcttctcactgagattacgccaatgataatcaaagaatggtatgatgctcctcactgcgagggaccctgggcatttcgtcgttcttgcatgaggttgaaagcggtactggaatctgcgacaaaggccggattagacggatctgcgtcattgctgcaattcaatccttttatattccatattcctccagcccctcgatcatctcgaattgatattcctccagttacgccgcatgagcttcggattttagccgagtcaatgccgacgtacacgcggttatcggtatttttttccactttagcgggaggtttgcgatgcggtgagctatgcggtcttcaaattagagatattgacctggacaaacaaacgctgcacgtgcggcattcagtgaaccgaggtaaaacagatagaggtacggtccaatacggcaagactaaaacagaatctagtgtgaggaacgtgcatataccggatgcgattatgccaatgctgcgacagcatttatgcgactattgcgatatatctactcctgactctccggtatttgttcctaaacgatcgaagataatgtcgcagaccacgttagaacgccagtttgctaaagcgcgaataaaggcgaatcgacccgatctgacttttcagggattgcgtgcgagtcatgcgactctattgatgttacaagggggaactctgcgtgaagttatgaatgaactggggcatgtcagcgaaaaagttgctgttagatattatcagttgacggttgctgagcatcaaagtcatattgtagatactttggcacgagattttatatttgaaagcagcaggtaaaatagactttataaagaaattgtattagacgatccgtctacgtttcagagagagtttatctaatgcacgacgcctgacggtaatcaagccgtatgcggagacattggtgtcaagtaattgtttccgcaagatgcggctaccgagaagtgtaagcatgttgtctttcgatgtcatacgaaagttgacatcgaaagattgatttgagatgcaactaccgtatttatggcatacttcaccggagtaagaaagtggtggatatgaatattattgctgcactaatgattttctctctgacggcttcggggagtccaatggaatctgtcaattatgcagttccatatgcatctaatgcgtcagagccttctttgatgttgaatcaacattgcccgccatttctgctatggctttgccgtcactgatttgtgcgtactggtattgacgcatggaactgccatgttccatcttcggatgaggttttcacggctcctccctcggactgaattcgttcggtgtgcagtctcagcccgttgttcgaagccggcttgtctggaagcagtgtgctatctgagatttcgttgacctgatcgataatcatcgctccgtctttataggtgatgcgaatgaaatactcgctgttcggcgatgcatgaacggcaatgtttgtatacaattcaggcagcagtgaggatatttcaatcaggcaacgggaatccgcgtggttcagggaccgaactgacagttcggttttgccggagaatccgagtctcattaacgattcgtcgccactgttgatgattgattgtattttcgcggcggctgtcgtgctgtctccggtctgatggggaatttcctcgccttgcatcagattgatggctgttctaacgtctttaagagtgtccattattttcccgtgcagttcgctgatttcacgttccgtaaattcatattcgttctggatcatcttgtcgtccagcagcattgcggcataggtcaggttcgcggcgaccgaatcatggatatggatggcggcctcgttttccttgcgtagcgtgtccaaacgttgccgtagctgattgcgttccagtctgtttgtttcggcctgatgcttcatgttcctccatccgagggctcgtccaatgtaataagcgaagaacatgatgaatagcaatgtgaaagattcccgaaatggtgtccctgcttcgttgaagctccacatgcgtgcgaccgagacgatcagcgggtacataaacccaatcggtgacttaatcgataatcctatatacgccaacgaaagccaagtgccccagagcagggtgggtcctccgtcatcgggtatgaagcagcatatgataaacgatgctagtgccaggttgctccctaatagtggtcggctcggaagcatcattaccgcgatcatatggatgatacagaataccagcgtccatattgtattggggggcaatatcatagtttccgccatagtgagtgcgacgctaactatggaaagtaggtatccgatgtacgtgggatggttgagcacaaaggaaacaagaggagatttccgaatcctcatgattccctctctttgagccaacatatcaccgcttgagttcgatttttaacgtccattttttcggtcacgcgtttgatgtaggtcttgacagttgattcgcctatgcccaagtaatcgcctatctcctgggaggtgtatccacgtgcgcacagactcatgacctccgtttcccttctggtgaggtttttgtgatactgaccagcgtcttcgggcgaaagcttggagtacgcttcctgagcagtctcggaagattcatattgagtgccgggctgttgcccgttcgcaagccgatatgatgcccggcatatatctctcatctggactttgggaatcaggcaattggccccattggacagtgcatcagcatagtaacgctcaggagagaaggcagtcacccctatgagtgcgattttgggggtccgggaacggatccttcgacacacttcgaatccactcatgccttctagtgacatatccactattagtacgtcgggctgtgtcttgtcgaagagacttttgctgacggcctcctcacctgtgaatgcggtccagcatatgtccgctgacgggaggagatgcccaatcagtagtctcatcataccgatggcaagtttgtcattgtctacaattgcgattctgattctttttcctaagtacattgccttgccgtgtggacccgataacgaatttatttgaataatttggtgccatacagtggcatgcaaattacttgtgcagagacaatatttgcagtatcgccccgtgtctagattaaaattactcacctcagttctaggttctaaagaatgtcatatgataacacaaagtatctgtgtctcatgcatgagacacagatagagttgctatcactccttactctcgagcatctgattatagcaaagctgcaacattggaatgtccatattgtttcatgcgacggttttgtcatctaaagaggacagtgcgtcattcatgtcgattcagaagagaatgcttccgggcaaagcccgttcgacatactctccttcatcggcgtgggaacgcagccttaggccatgcgctgcgcgcatgacggtgttgtctggccgctcgcatgctcgcggcgggtgggccgcgtggaatctgacgaggggtttgcggccaccaccagcatgccatgcgctccgtcttcgcttcctgcgccgtgtcccgtgccgctccgcctgcgcgcatggcaggcgggtggtgtccgaaatggaaaccacacggaaaggaccgatggacatgaacgacatggtggacacccgcactacgggaacatgattggcggagcgcgtatgcggcgggttccgtaaggaccggcgggagcttggccccgagaaggcggccgacaagtggttcgcgcccctgatggacaggtggaacggcctgctgtcgcgcgacgggggcggtttctcccatgaggagcgcgtcacgctggcggtgctggcgaccgagtgcctgagcatgcgggacgcgctgatactcgccgcgttgcgcgagatggacggcgacgaactgcacatgctgtacgcccggccgcattcgatggagtcggcggccgtggtcacgcgcgaactgtcacgggcgttcgaggacgccgactgtcagccggacatgcggcgctgggggcgggcgacggcgttgctggaatcggtgacggccgacgcgccggacgggtacgaggcacagccgatggcggcgtgcgcgtacctgatgtggatggccgaccgttcgaccgtggccgcggtgcgcgcgctcaaggccttggccttggacgaggactgttcgctggcgaccctcgtgctcgcggccggcgagcacggcatccgccccgcatgggcgggacgacgacgctgagcgtcgggcgtccccgcggattcacccggccggggcgaacggccggcgagacgccggcgcacattgcggttgaagtccccgcgcaacccatccagcatgtcgccccgtaggggcatggcgatgctgcgcgtcacctcctcgggatccagcatgcgtgtggcgaccgtgatctggacacccatgttctcgccgaccgagttcaggaaacgtccccaccggtccacgacgtccagctgctggtcctgggtcgcgacctgatagttgatgtcgctgatccgcagcgacacgctccaccggtcgccgcccagatacgcgatcccgttggacagcatcgaatcatagccaagcagctccttcgacgaacgaggtatgcgacgattcccggagcgccggtttccggcctttccatgtcgcttgtcgttgcctttgaccgctttgctgccgttgatgtcagacatgacgacgtgccttccttcctccgattcgtctacgggtcttctccttcaacgacggtttgccggggaatctcgcgggaacatggggttcgagcggatacaccttcgggccgaaacgttggcgcagcatgtatcccagataccgttccggcttcagtcccttcggacgccaccagccccacagcgcgaacggcagacacaccacgaacagcagatacgagcctaggtccgtcagccccaacgaccagaacaacgccgcctccccgccgcccaggacgagcatgcacgcggcggccgccagttgacgccagcccagcccccacatcaccttcgcctcgacattggcgatctccttatacacgcgcatctgcaacatgaaagaatcctttccgattggccccggttccgatgcggctattcgccgcctgctatggcgcggctgacacgctggctcaccgcgatcacgaagaacagcaggatgcccgccatcatgagattgccgaaattgcccgtcacccacgacaccatgcccttgtccgcggaatccgggatcctcacggcatcgaccacgatccgctgatagaacaccagacagacgaacacgcacaccgcattcaccgacgtacgcgcatacgacttgaagaaacccacgccgatcggcttggtatcctcatgcaccagaaacgcgaacggcaacgactgaaacgccgtcaacgcatacaactcgatgaaccgcacatacagcaccaccgtgaacaccaccgacgccaactgggacaacaaccacgggatcaccagcagaaagaacaacgccgcctgccccatcacacctgcatcacggatctggtcgcgcatcagatcgcccaactggccaccctcgcccgccacctcaaaggacatctgcgaggacacgccctgcataaggaactgcgtgacccggttgaacatgccgatgaacagaccggcgttccgcacggcgatgaacaccaacgcgatcctgaacatggttcccgccacgatcttcacgcccagatcacggtccgcctcgatacgagtcgagttgcgcgccagctccaacgtgaacatgaccgcgagcaccaccgacgtcaaaggcttgaccgccacctcatgcacgctcaccgccaactggtaaagggcgggattccacgtctccggcgcctgggacaacaatccggccgtgaccgaaccggcaccgccgccgccgatcatgttgagcatcgccacgatgaagtcctccacaacacgcccccgaaccgactcaacccaacgcgaccgcgttgaagacctgcgcggccgcgatgatcatgcccccgcccacgatctgccacaaccccgactgcgtctgcggcccgttatgatccttcaggccgccgccgaatgtgacggcgccccacaccagccacaggccaccaccgatggtggcgaacctgacgaacaactgaagcacctgattcaacaaatccacgacggcctcctctgatgacgatcaaggagcccgacaggcaacggtctccgttgacacccatcgtcagggaaagccggcggaatagcggcggacaagaatggtctcgttgtcctttatgtgcggtgagaccgttttgatcaggacgaataaagaaggaggcgagcaaagctcgcctcctcgattcatagagtcaaattcagcggaaccagacctgagcgtgatagctggtcgagtacccgtcatcggcgtatgcgcggctggactgcagagtccacacggtgcttgctacgcgcctaccatgctgcgcataggagcgaccttgggttcctccgttggtccaagtctgggccaaggcatagtccgtgccggcatggagagcgtaggttccggccgcgttagcggcaggaacggtgaaagccatcacggctgccgcagctgcggcgacggctccgactttgcccagcagaccgattttgcttttggcggtggtgttcatgggagttccttcctccctgggttgtccaacctttccggttggtgctcccataatatgcattgactgactagtcagtcaacaagaatcgttgattcttgccatacgattcccttatagcctgttatcagagagttcagccgctttgctcagaccggttagggacagatagaaatcaagagcctgacggagctgctgcttattcttccatcgatcggaccttatgacggcgatgtacatatcgattagggctcctgccttaatgctgtcatgggcgtcgttgagctgcccaaacaagactagttcaagtgcttcctcccacttcatgtgccccgcgttctccgctcgggctttttcttcatgcagcagcaatccggaacgtattcgcgcatcttcatagtgcatgtcagcaatcgcggcgagaatccgagcgaaatcgcttctgccgctacattgggacacttttgcgcacaggcgctcatcgcaccattggataagcgtatcccgtaatgcttccttcgtgtgaaaatggaacagcactgtgccacgcgtcaaaccaagtcggtcagcgacgccctgcaatgtggtcttcgcatatccctgtgtttcaaattcgagagccgcggcttcgagcagggcttcgcgcgttctacgtctccgttccgcactattcatcgatatcctcgcattcattgactaatcagtcagtatgagtaaggatatcttatcgtgaataaatcatctaatgggcatgccgatatgtcgatttagcatgattccggcgcggaatacatcggctgtgggacggctgatgttgaggctggcgccgatggcgtctgtgcaggctttggtgatggatagtccgaggccgtggccaggttggttggccatgcgggttgcgtctcctcggtggaatggttggatgaggtcggccgtggcttcggggtggtccggctgttttgtggtgttggtgatgctgatggtgacgtgctgcttgtcgtcgtggatggtgcaggtgatggcgccgtggtcggtgttgtggatgatggcgttgcgtatcaggttgtccacagcgagcgagaggtagcgcgggttcgtctcgatgaaggggccgtggtatgcggcgagtccgtcggcgtcgatgcgcaggtgacgtgcctgtgcctgttcgcggtgggtttcgagcgtgtcgcgtacgatgcgggcggggtccacggtttccgtgctggtgtcgggcacggtctggatgcgggagagttcgagcagactgttgatgagttcactgcttttgcggttcgcttcgatggcgtggctgatggctggtttgacgtcctcggggaaccggtcctgggccatgagcgcttcgaggctggtgccgatggtcgtgatcggtgttttcagttcgtggctggcgttgcggatgaacgatcgttgcagttcgttggattgctcgatgcggtcgagcatcgtgttgagcgcgtcggctaggccggcggtctcggcgtcgggatgatcgaggctgatgcgcccggcgggatggtcggggtcgagttggccggtctggcggctgatggagtcgaggtgtgcggtgagtttgcccgacaggttccagacgaggagcacggccaggagcgcggatacggcgaacacggcgagcgatccgtagcgcatccattgcacgacgccgtccctgacggtgagcaccacgccctccgtgccggtctgcccggcggtcggagagagaatggcaccggtcacgtcgcagggatccgcgttacatgagtcggccgtgccgggaaccccgtcctggggcgtggcaggttccgtcgtgatggtgttctggttgctgcctgtggagatggtgtccacctgatgctggaacgcccagtcgagcgagatgttctgtacgaggatcacggcgaggagcatgccgagcaggagcagtccgacggtgacggcgaggcggatgcggaagctggcgggtttgcgcgggcgcgcggcgtgcccggccggccggttggtcgtgtcggtgtcggtcatggtatgcggtatccctctccgcgcgacgaggcgatgagcgaggggtcgggcagtttgcgtcgtagcgagtagacggcggtcttgacgaggtcgggctggtcgtgcgcctcggacggccacagggattcgagaagggcgcgggtgttgatccacccgccgtcggcgcgcagcagttcctccaggagcgagtattcgcggggtgcgaggtcgagaggccggccgtccgcgtaggcgagccgtctcacggtatcgacggacagccgtccccgtgagatcacggtgggcgcgtcgtcggcgtcgcctcggcgcaggagcgcgcggatgcgggcgaggagttcggggtaggcgaacggtttgggcaggtagtcgtcggctccgaggtcaaggccgtgcacgcggtcctcgatgctgccggccgcggtgagcatgagcgtgcgtacggggatgcgcagcctgtccgcggtgcgcatgacctcgtctccggagagcacgggcagatcacggtcgaggagcatcacgtcgtattcccccgtgagagcaggtccagcgcctcgacgccggtgcctgccagtccggtcgcgtacccctcgtgcctgagacagtcgtccagcacggccgacaagtcggcgtcgtcctcgacgatcaggatcctcgccatatttcgttgcctccgattccgattcatggccttcatgcgattgccttcgcgttctccattgtggtcggcgtgggtgtgcgttaggtgagcgcgacacgcacccatcgcacacggagagccggctgtaatgggcatcgtccggcaaccgccgggccaaagcatcgccccggcagcggcgaacccatgcaagggaggaacacatgcgaaccacatccgtattcagactgtcggcggccgcggcgctggccgccgcgctggccgcgccattgtcggcatgcggccaacagcagtcgtcgcagtcatccggcgcgccctccgcgacgacgtcgcaggacgcggcgccgaagaccgacagccagggcggcgacgcgccgcagggatcgaacccggcctcgaaacaggccgccgaacgataccgcgactgtctcacggcggcgggagtgcccgcgcagatcatggacggcaactgggtcgtgctccaatggaccggcgacggctccggctcggtgtcctcggggtccacggacggtgaccgggacaaggccatcaaggaatgccaagccaaggtgcccgactaccacgatcccgacttcaacaccaagtaaacagaccgcaccagccgatggaaggggaaaccaccatgaccaccagcacatcatccatcctccgccaagaaacgctgcgcagggccgccgcgctgctgtcctgcatgggactgctcgtctcgctgacggcatgctcaacgccctggaaccagaacacggccgacgacgcgcagacatccggcaccagaatcgcgccgagcatgagcgccctgttcgaccagtacctcgccaaggacacactcagccagttcgagcgcgacgtgctccaacgggccaagaagaccggcaagatcagcgccgaggactacgagaccgcgcacgacaaacagaccgcgtgcatggccgagaacgggtggcaggaacagacccgcaaactgtccaacggactctaccagaccaccggtgtgacgccggtgccatcgaccgacgccgaagtgaacaagtacatggaggcatccaacacctgctccgagggtaccagcaagatcatcgaatccctctaccagctccagcagggcaacccgggcctcctggccgacccgtacgagaccgccgtggaatgcctgaagaaaagcagcctcgtcgatgacgcctacaccggacgcaaactcgaaaacgcgttgaacggggacggagcgtccaaaggactgccgttcgacgcctcgtcggacgccgcccagtcatgcttcaccggagccggccttgccgtcaacatcggctgacgaacaagcatccgacgaaaggaaacgaccacatgaaaacacgaatcctgaccccgctgatcctgaccggcctggggatgctgtccgcgggcgtgctcgtcaccgcgctcgtcatccccacgcccacacccgacggactgtccgcggccacgagccccgacaccgtcacggccagccgccagcagttcgacgacgaacggaccgtcgaggcctcgttcgagaccagcgcggaacaatcgctcacctcgcgcgccgccggcaccgtcagcgaaaccctgtgcatgcccggccaagcggtcgaatccggcaaacgactgctgtccgtggacggcaaacccgtcatcgccctgcacaccgacacgcccctctaccgcgagatcggcaccggcgacaccgggcccgacgtgctcgccctgcaacaggaactcgcccgcctcggctacaacgccgaaggcaacggcacctacgggtggcgcaccaaggacggcgtcaaccagctgctctcgcaggccggcgatcgcaaccccgacggcaggatcggaccgaccgacgtggcatggctgccccagaccaccgccacaccaacccaatgcacggccggactgaacaccaacctgacggacggtgccgaaatcatgaagaccggcggccaactgacggccatcaccttccccacgccggcgaacctgagagaaggcaaacgcacgttcacgctcttcggcgtcaagaccagcctcgacaagaccgacggcaggatcagcgaccagaaattcctcgaccagatccaggccagcgacggctacaagaccaccctcgccgaccaaggcggcaagaaaccaaccgccaccctcgcgctcgaacaacccatcgacgcgatcaaggtcccgccctccgccatcaccggccagaacggcacccgcgcctgtgtctcgcccgacggcaaacaggctatccccgtcaccgtcatcggctccgccctcggcgccacgctcatccaacccgaacaagccgacgcgacaatcggcaaagtcgccctcggccacaaactcgacgacatccaatgccccgccgcaatgcagcactgacacaaggaggacgcgcatgagcaccagcatcctgcccctcgaaacggtcgcggaccccgtgccgacacggccaatcgactccgcgcggcccgcggccggcggaataccgtcggtcacgggcgagcacgtgggccaccggttcgcggacggcccctggctgttccgcgaccttgacttcaccctcacgaccggcgaggccgtcggcctgtgcgggccgtccggctctggcaaatccaccctcctgtccatcatcgccggcttcgagccgcccgccgaaggaaccatccgacgcagccgggtcaaccgcgtgcgctgggtgttccagaacccccacggcatgccacggcgcaccgccatcgaccacgtcgtccaaccactcctcggccagggcatcgaccgcacgcaggccgaagacgaagccatcgccatcatgagcacgttccacctgaccaaagtcgccgcacgcgagttccgggaactatccggaggcgaagcacagcgtctcatgctcgcccgtgccatcgccagcaaacccgacctcctcctcgtggacgaacccaccgcccaactcgaccagcgcaccgccaacgacatcgattccaccctcaccggactcgcgcaaggcgacgcgatcgtcgtcatagccacccacgaccccaacacccgggccgcgtgcacccgcgtcatcgacctcgcgtggcacaatccgaaccccaacatcgacaccaaggacgacacacgatgaaaccgaccgccatcctgtccgaagtatggcgcaacgtcgccaccggcactacacgtgccctcgcctgcgccggcatcctcaccctcatcgcagcaggaaccgccgtattcgacctgaccgccattacttccctccaacacgaatcacggcaatgggccaccagcgccgccgccatccacatcatctccggcagcaagcagatcgacccgaccacctgcgcaaacctcacccaaaccaccggcaccacaggcggcaccaccacgaatcccatccaagcggccggtgcgctcaaaagcaacggggaaatcaccctgaccgccatgcccgcggccccactggacgcctggcaggcgacaccgggactcgctaacgtgctcggcgttggagcaagagagcaaacccaacccggcgtatggatctccagccaactcgccgccaccctccacgcgcgcgaaggagacgacctgcccacaacccagggcaccatgcacatcagcgcggtcttcccctgggccgacgacagccgcgaccaacgactcgcctacgcgatcatcacccccacacccatcaacgccggccagcaatgggacgaatgctgggccaccatcaaccccgcaaaccccgacgccgaagacctgctcaacaccaccgcgaccgccatacccggagccgcgcccgccacccaaaccaaacaagccaacaccatgctcggcaccaaccccgacctcgacacccgctaccggcagcgaaccacccgcagcatgctcgccatcacccccatcgccgcgttcgccatcgccatcatggccacgcgcgcgcgacgcatcgaaatagccgacgacctgcacatgggcatgccccgccaaggcatcctcgccaccaacgcgctcgaaaccctcgcatggaccctgcccgccatcctcaccgccaccgccatcacctacaccacggcacgctggaccagcggacacgccaacgcactcaccctgaccaccatccagcttcccgcactcaccgcagccctcatcgccgcgcaaatcggagctgccatcgccatcaccgccatacacgacaaccaactcttcgtcttcttcaaaaacagacaatgagcatgaggggtgccagttcagactgccataagccttgattaaagggcgagcatgtttttcaatgacacgcccgccctctatgcattgcccctttgtcgggacgcttgaagtttatcagttgtaggtcatttcctgagtaggagaatccgtcatcttgcaaatcccgggttatgctgtagtaaaacctttactaaagtttgcggggaggatgtcatggccacgctcaaggaggtcgcggaacgggccggggtgtcacagagcacggtgtcgcgcttgctgaacgacccatcgttctccatcaaggaggagacgcgacggcgcgtgctgcgcgtatgcgaggagctgggataccgcaacgtgttccgtcccgcgattgctgtgctggacgctcctccatccggggagaagctgcaggacgcatacttctccgatctgcggaaggttcttgcggagtgtgcggagtcgatggaattggaccagcccacgttcatccggtccatacgcgagctgacggaacgcgcggcggagttcgatgggttcatcaccgtggatgccacggtgtttcctgaagcggacctgcgcgccctgcatgcggcactcccgcatggcgtgtgcatcgacacgaatccggcaccgcacctgttcgactccgtacggcccgatctgtcgcagacgatgttggacgccctggacgcgatgattgcggcgggccgtagacgcatcgcgtttctcggcggcgtgggcagcatcatgggcacacatgactatcccgcgaacatccgcacgttcaagacctgcgcctactacctgccgctcgccggcatcgtcgccagcctcgtcgtcttcctcctgaccgtcaagatcgacgagaacatgcacgaccgcatcgtcgagcaactcgaagcgcgcctcgcctccgaggaaaccgacaagcagtaagaaatccaactacaaacaaaaagaccttgggtgggttgtcatctacagatgacaacccacccaccactcaagtcgttcgaatcgtaactgcgcaattatttacagtaagtagttattcgcattgcgggcaactgcttactgtccattacgttcagattcgaaagattggagaagtcatggccacttttgaccttgatacccatgttgaggaaactgagggggacgctcgtcctcggattacctcgaagttcatgtgcacccctggctgcccgaccggcggccttgcctgcttcacttcccaatgtacaatggttgtagcttcaccggtggaagcaagcattagcaacgtccgtcgtagcatcgtgcgttcctagaggcaagccttgtctctaggaacgcctttttggaaggtggatcatgccagttatatcggcgaccaatctctcgattgggtacaagaattccccgattgtcagtgacatcaacttgcggttgaatacgggtaggatcgtctgtctgctcggggcgaacggcgcgggtaagaccacgttgatgaagacgctgctcgggcggatcaggcccgtgagcggggaggtcacatacaccgggacgaacatcaacgagatgtccgcggcgatagaccatcccagtttctttccctacctgtctggtagggagaacgtcgaggtggtctccgcgttctggggtctggacgtggacccggagacggcgttgaacaatgtgggcatcaaccacgcggcgcatggacggaaggcgaaggactattcgacgggtatgacggagcgtctggagctgtgtctcacccttgtgccgcatccgaggtttctgttcctcgatgagccgcagaacggattggatcccgatggcatagcctccttgtccgaaacgcttcgcgcctatcgggacagggggaactgcgtcgtcatctccacgcatctgcttcatgagattcagggagtcccggatgaatgcatcgtgattcgacatggccgggccgcgcaattcacggatctgaccggggtaaacctcgcggacctgtatcaggggaggtaaaggtgagtgccgtttctcctgttcgcgcgttggtcgcctattactggaacgtatggtattttctcgccgcggtgttcggagccgtggcgtcccttctgctgggttcgtggatttcaggcgcggcgaacggaaccccgatagctggaggatacagcttcttcttcaccggcacccagccggtgatttgtcttgcgctgctctttgtgtgcgatgccagggttgcgaaggcgcactatggaggtttgccccgccacgtgtattccgcatggaagccgtgctcgctcagaaccatattccgggctttgattctggccgctgtgaacctgctgagcgtattatgcttcgacgtcatcatggttctgatgggtaccgggatgcatccgaatctggccgtcgtcctgtgcttcgtcgtgctgcaaagccttttgactgccctgatctattcgatcgtcgagattgccgtcaatcccgaagtcgccgggatcgtctcggccatcctttgctatgtatgggttcttctgccgggcgacttgtccgactatgcgacgccctacgtcgcgaacgccctacgggtcgtcgggttgaatctgaacggcaccgtgatgtcgccggcggaaacggcgagccgatcgtctgtcggccctgtggtggtggtcgtcccgattgtggtgctcctggttgtctatgttttgttgagctggttccgtcgcgaaggagtggacaggaaatgaagtccctattgcgtattgagcgcgtggcattgatccgttggtcgatgctcgcctttgtggccgtgctgctgcttccgctgttctttttgcgttacgggagcatgggcgcggtggcgcagtcggcgatggtgatggcacttcccataaccacggccggccttgttttctcccatgcgagggtgccccgctcatatcgttccttcagcatccacgatcggctcctgcttcgctttaccttgaagtcactattgcttggtgtcgcggtcagcatctgcctgactctgctgtacggatttgccgtcggatttatcgtcaataagagaccgctctcgttgcatgtcgctttgatgtttgcgttcaccgctgtcgttctttcccttgcatgcttcgtcctgcgactctgggccagtcctgttgtcgcttggagcattgtcggcttcttcatcgtcgccggccttccggtcagctccggcatgttcgagggctcgccgattctgcatgccgttataccgaccacatggatgctaagcggggcgcgatttgccggttatgtgattccggtcggtgtagttgttgccatggcaagtgcatggctgctgcttaaggcggtgaaacgtgtctagatatactctgctcggatctccatacgtgaggattgcagcgcttcccgtcgacaagtttcctaagaaaggcagttccgcgttatcggtgttcgcggacaccgtcatatccgaacccggtattcgtgcagttctagaaaactctgctccatcattttacgctgctgtcacaaaaaatcttgcagaagattaggggaattgggacgcttgatgatttgaaacgagttttggctgatcgaaaagttcctcgatatatctatgctggtgcgtcagacaacaagattctgcttgatacttcagctttcgaccatcttcgactcctaaagcacgtcatcgaaaactctgatgaggatatctggatagagagaggcgtcgaaccagaagatttaggtgttacgaagtctgagtcagacgataaagctaggtttgctacggaaattgtcatttcggtttcttcgactgattgggcggagacggcgactctgcctgtcgctcagattccgcccgtcggtctcaatctagacttgtcaaaacggtccgttagagagttcaaccgcttttacctttgttgtgctatgcaacgactctaatcaggagagggttcttgcaactgcctttgatgttcttgatgacgctggtctcgaagcatactttgttcgctactctgaggaaggtcgcccaagtttacgtatccgcgtgcggggaagctttgacgacacgttcattcgggtgttttgcgattcggtactctcgctacgcctcgcgacagatgtcgaattcaatcttagacttcccgagtattcacggtatggaggtcccgagtgctttaaatatttagaatcgttctggtgtcttgagagcacccaactggttaagatgtttacccgcttatcatcggataccccgagcaggtacaaaaagccaaaagcaattatatgcgtttccttatccagcaactggggttcaccagacattacgtatctgccgtagcagaaagctatgaacatgagtttgaagcagatcggcattctattagaaaagccgccagagctctgcgaagtgtatttagttccgacgatatgcccgaagtgtttaccgacgaaatgcaagaggttcttgcgcgtttttcatcctgccagcttcaaagtaatgcttcagcccaagacgttaagcaatctattgcacacatgtctgcaaatcgccttgggcttgatcgtaaagacgaggccatattctggcgggctcttctcaatcatctaagatccgcagattttggaggtgaggaatgaagacacgtaatgacattcaacaggaggtgaccctcattgcaagtaatctcgaagatatcatccccattcggtatcaagaggctaatcgtacgaaaagctttaacattaacggagggactcctgccgcaattctatatttaagtgtccttgacgcattatttcccgatgctggatatgatgttcaggctcacaactacgcgacaagcatgattttggaatataaacataccccaaacattggaattggactgttcgggggaccacactattggcttggtgtctgcagtcgatttcccgtggaggaagcagatatcaaggcgcgattagagaacttgaatcgaggatcgtctttcaggcaagacaacaattgacatttttatcaaacgtgaatgcgccaatatcatccgaatattacgacgttatatccggactctctggcgtggttttgtatggcatgcgattccggtccgatgggctgcgattgatttctcggcagatttgcagtagattttgcgaactattagcaacttcgaatttccacgccttcgggtctttatcagccacttcgggacaggattccgtggctcagaagacgaccaccgactatggttacgcgcatggtattttgggagtattgatgagttgcattctttcggatgtgaaccatgataataatatggaaccattcgctgcgataaggcagcttgttgatatttcgaatcactcgagaaactacatacttccatactcttcctcagattacactgaaaccgttagtaatggacggtatgcctggtgttacggcaacatgcccttctattttttgtcactaatgctgaaaccggttgatccaataattgcggaatctctattgaatgccgctattgctcccctgaaggttaataccagtcaagtacatgatcttggcgtaatcggtcttgttgataactctatatgccatggccgagcgggaatagtcctagggcttcacccctacttgagccacaaggatagtcggcctattcgcgatcagctccttgaagagatcgattgttctgttgcgaatcctattgacagtggatttctcgaaggcgacttgggcaccttggctgtccgagtggcactagaatacaccgactctattgcgcatctaccggctttctttccttttgtttctcctacactttgggagggaatatgattgctagagcattaaatgtgacactgatctatggaaaatcgagaaatccagtcttgcatagtttgaaccttgaaatcgattcagggcaagttcttccaatccttggcggtaatggaacaggaaaaacgacactgttgaaagcactatcggggctacttcgcccacacttgggtcgaatcctaattgatgattcggatctttatcagaagagagggagtgcactgcaaaggctctcgagctcgctctactccgaaagatcattttattatcgcttgtcagcccgcgaaaatctccgctatttcttgtcgcttcgtggcatttatggcaggactgcaatgtcgtcaattgacatggctctggacagattcgatttgcttggattgcaggatattccattcatgcacttatccctagggcaacgaaagcgactaggacttgcgcgagcgttcgctgcgccagccagtctctatatcttagatgaacctacggcaaacctagatgccaagtcatgcaggcttgtctatcaagccatgacggacaagagcgccgacggagctagtatactattctctacccacaacgtggccgaccttgctacctccacaggaaatgtaatatatcttaaaaatgggaatgcgacacgtgttcatctcgagactcgagactccattactgcccgcaagcgttttagaatagtcggatctcttgaccctgaatccattgcatcaattcccgaagtgtcttgtgtgatttctcagtccgaggtcgaggttgatatacctgttggtaagtctcttggatcagtgcttcaatcctttgaacgaattgggatcgaggtcaacgaagtaattgatgaccggagtagataaaatgcattcttttttaatcggcctctacctgtatttgcggagagaattccttgaactcgtaacttataagctctccttgatgctaggtgttgtttcagcggttgttggcatagttcagtttgctttcttggctgtttttctccagcagggaaacagttttccttcattacagaattatggtggaagcgtgatggcgtttctggtctctggagcgctttttactggttttatgagttcttctctctccagtttctcgcaactaatatcctctgagcagcggacaggtacattggaagctgttttgactacaccattttctattggccgagtgattgcatatgctgcggttagctcatttattcaattggtaatcggcacgtttttaatgatcactttttttgggattgcattctctatccccttcaacgttaacccgtggcaactcatattggtcatgattctcggctacttcacacttgttggcctcgggctcgcgggtggaggagttcttttggttacaaagaaaggcgacccggtgacatggttgttgacaacttttacgacattattttccggagtactttatccggtcgaaattcttccacagtggcttcaatcgattagttggtatgtgccaaccacgcggatattgagttctctccgggggcattaaccggctataccagtatgtttatgcttgatgtggtttaccttatagttgcaagcatagttagtatgagtataggattgctggtatttagatggggtctaaacagagctatatgggatggttccgcgacaagttattaaataatcatacatttgggatattgaagtttgacaatatggcatagaaaagcgtttcttgtcaaatatcatatgaactttgggattgacatactctattagaatattgtaccagattaaggtcattatttcaaaaaaatgactctattctaatagaatgtttccttctttcgtcgcgccaaaagaaacatcaattgtaatccgtaataatttgatgaatacatgatagttcttccaatcgtaagatactccgactggaagaactatcatgacgggaagcaggtccgacgtccgggtcagatcacggacgattcgtaaggaatctcatccgtagtctcggcgacatcctcatcggtatccgcgatatcgctggactgcgccgattctgagtgacggccgccagcactgttcccgtgtctgaaccggcgggcggcgaccagtcccacgccgacggcgagcagggtgattgccgctgcgatcacgccctggatggcggcgccggtatgggcgagcccggtccggtagccgttccagtcgtcggtgttgctgaccacttcggtgtcggggcagacgagcctgccgtcgatcgtgaccgcgtcatcgggtgcggacgtctcgtccttgccgtcgaacggatccgggtcggagacgacgcattcgaccagcggcgtgccggtgaccgtggcgcggtcggtgtgatggtcggtcacgcccttgaggatgcccttgacctcgacgctctcgccgggcttgaggacacggctgtcccaatcggcgggatattcgagatcggtcacccggccgtcgccggcgaccagctggtccttgaggttcaggtccttggttcggtaccatgcgccctgcttggtgtcggggtcggtggtgctggtgttggtgatggtgaacacgatgcgcgtgtcgccctgcatggccagcgcgtccttgacctggtcgcggtcgccggccggccagccggaggcctcgtcccatttctcgatcttcaggctcggggtcatgtcgggcgtgtgcgtctcgacctggttggatggacgtttggtgccgttgagggtttcgtcgaaccggttggcgatgtgttcgccggtcttgacgcgcttgcactggatgaacgcggtccatgcctgctcgctttcgtcgttgccgctgacgaggtcgagcatgcgctgggtcgcggtaacggtgaccacgcccttgtcatcctgcgtaagggtgaacagttcgccgccatacacactggcgtcgaagccgctgccggcgatcttcacgcccttgcgggcgatcaccctgccctgctcggtcaggtcgcgcatggcgtacacggcccattggccggtgtactggtcatgctcggtgtcgagcgggtcggtgatgctccagtcggtgaccttctggtaggcgcggtgcgcgggtagcacggagctgtcgaggcggtagaggaacaggccgttgaggtacacgctccgcttgtcgatggattcgccgtccaccttcacgaccacgtccttggacgggttgacgggtttgagggggttggcgacctcgttggtgtccttgcgggtgtcgttgacgacctgcgtggccttgttcttcacgatatgtccgtcggtgaccttgatgacggtcatcggcaggctcacctcgtagctcgtgcccagcatcgactggtcgatggccggctccttcaacgggtcgtggtccttcttttcggcgtattccttgaggttcttgggctgggggtcgcccttgatggtctcgccggtggccggcaccttcgtgtccgcggtcctggcgtacacgtaggcgacgccgtcgatcgccgcgatgttgaacttcgcggtcacgtccttgccggtcgcggtgtcggtgacctcgatgcgcttggcgtcgagggagaggtattcgtcgtcccagtcgtcggtcatgccgagtctccagaccttgtaggcctggttggtctgcttggcgtcgatggtcacgcggtagtagatccggtcgcccagcagcgcggtcttgccgtcgatgctgatggacgggtcggcctgggtgtccttcttcacgggagtgaagtcgggcggctcgttccataccttgttgctcggggtgatcatgttgttcagggtcagggcccactggttgccgattttggtgtccgtgggcgcgtccttggcgaccgtgccctcgaagcggacgatgatgcgcgggttcgcgccgttgcgccagttggtcttcacgtacccgtcggagaacacgaggcgcaccgcgtgctgcgcgtcgttccactgggtctcgtactcggtcttcgggatgaacctgccggtggacaggtcggtgacctccagggtctgcttgtccacttcaagatgctcgtcataggtgtcggtgaccgccacctcgctgaccgagtacgcgagattgccgggcaggtggggctgggtctccagacggtattccaagcgttggcccgggtagacgaccctgccgtccacggacgcctggtcgcctccctgcgaggattcgccgaccacgtccttgacgacgggcggtatgtagccgcagatcttcggctcgttcgtggggatggtgtgcgtgttgacggtctgggagcccttgttcgtcagcgccttgccgtccggcgcggtgcagaacgacagttcgtcgctcgcctgcttgccgaagtcgtcgcgcacctggcccgcgcccttgccgttggcgtaggccgccttgccgggaatgagcagcgtgacctgcttcgcggtcttcaatcccttcaatccctcgcgataggcccggcctgcggtggcggtcaccgtggtgccttccatcgtgatcgtccactggtcggtgacgtccctgccgtggttggcgatgtcggtgacgctggactcgcgatcggtgccggcatcggcctcgtacactctgatcttcgacttgtcgtcggcgtcgaacaggtagtcggctgccgaccagtcgtccgtgagcgtcagggtctccggggcctggatgaggttcttggcgatggtgccgttgactaccgaggcgacccggtccccgtccagaagcgtcatatcgtcggcgccggtccggttggtctccttcgggtcgatgaccgcctcccactggcccttcgcgttcaggcggatccagctcttgtcaggattcggccgccacgtatcgaactgtttctttccggcgtcggcctcgggctcgtggttccactggccccacgcatggtctttgacctgctggaagtcggagggcttcgacacggtcacgtcgaagctgaactcgtagacatggtccatgggcatctcgcccttgtccgccgaacgagcggccgacactgtgttcgacgccttgtcccaagtgatttcgaactcgccggaaacgtcgcgattgtcgtcggtcctgtcgatgagcctgtagttgtccacggagtattcgacgccgttgggttcgatcacgtcgcggaaacgcatctcgtagccgccgcggccggtgccgtatgtgatggtggtgcggttcgtcatccggtcggcgctcgcgccgtcctcgatcttcttgaccgggggctcgggcggcaccgagctcaccttccaggattcggccgggtcacggtccgcggtgtccacggccgcctgcatgcggccctgcttgggcacctggatgtcgatccagtacgagccctcggcccagtatttcatgccgaaatccttcggcgaggcgagatcgtcgagctgagtgtccccattgctggagaagctgatcggcttgctcacgctcttcgcgggcaggtaggggccgttctcgtaatggatgatcgcggtgccgttcaacgtctccttgatcgcggaaccgccgttgtcggcgtggatgacgtcgccgaccgggtcggtggagccgacctgcatgtcggtcttctgcttgtggctggtggtcacgttcagcttgtaatcgaccggcggctggttctgcgccagcacaatcacgcggaacgaggcgttcgggttggagtcgatcgactcctgtgccagcgagtcaacgctgcgcgtgccgagcttgtccttccacgtggtcgaggtcgagtacttctggccctgatacatgtagtcgcccttcgcctcggccttccactgcgcctcccaacggttcttcgcgttcgagctcacatagctgccgttgaacgaaccatccgccaagcgcacgtagcccaccgccaccagacggcagtccgcgttcccctcacccgtataggagcgttggcactcatcgatcgcgtcgctcaaagtcttgttcatgttcacgaactggttctgcccgttcgccagatcggacgacagacgcaccttcgcgtcactcaacgccgtcttcatgccatccagcgtggccggccacgaatccttgtagatccaatgcacatcggccgtctgcgtcggaccaccgcccgaaccgccaccgtcctcaccggaaccaccgccaccgttatcggccaacgctaccggaaccagacaggccagcaacgccgcggcggcggtgatcgacgccaccgcaccggcgcccttcttcccgaacctcatacgaaatcctttcccacatacgacagaagcgcccctctccgggaaagggaggagacggggactccagaacccgcctcctcccgggtccctggaagaaaagcacgcccgcaagcccgacggccggccgccggaccccgaacgcaccatcagcatcaccccgcgccaggtggttctgcggcggacaacacaacgtacatggcgtttttgtggccaacggccatttgcgaccattccgctcatgagttaaaataggtcgtgaaatattccattagtacttgatagcagggaagcggcattgaaatattcatctgaagattttgtcaatatggacgaggtccacgcacttgcggacgttctgaccccaatcggaccggcactgtacaccgttcttgccgaggcgcgttcggatctggaaaccagatatcccgatgatctgttctggccccatcagaaccgacagaatctttcccgtcttgtcaaccaacgcacggctcgaatttgggaacaatatggttctgacgattggacgctttttgaccggagtggtttccttcatctgagggaaaacgagaccggcgtgaagctgattctccgaaaggtggatcctctgactcatggagttcctaagtcaaatgcgacccgtgccagccgtgcatacttttcacagagccagtgcatcccgaagggacagttgcaagcagtggatccaggcctgttcgacgaaggaaagctgattcccgatcttcacgatattggcttggtgtgcacttgggatgagatgacggatggaggtgtatccatcgtcgtttataagacagaaggcccggggcgatacggcgaaaagaaccactatctatttaaattcccgctatttgatagcgttcgtggcgatgagcaatatgagttcattccactacaagaggatcaggaaaatcttctgccgaatttgctggccgatcagaccgatgtcgaagatgtggataatacagactcttcgtcgtcggagaaaaatgagaatgaggacgcaggcatgaattccgacaataaaggaaatgaagctaactaggaatagctagtcgtatatagcataaatagatagagagatactgcaatgtccactttcaatccagaagggattgcactgaagcagcgtcttgctttcaatccagaaaggattgcactggcacgacgcttggagggcgtcactcagaaggagttgtccactcgttctggactatcccaggcaaagctcagcaagcttcagaatggcattatttcctttaatgaatcagatgcggtgaaattatccggcgctctagactaccccatttcttatttcgaggaatctggaacggttatcccattatccgaacttacatatcgaaaaacatccagatcatctatgggtgaattgaattcggtttctacggagtactcattactcatggatgtaattcaaaaattatgtcatgtgctgaagatgaaaaaaaatccagccgcatggattgatgaaatagctccacacgaacaatcgctctccgaagagaaaatagagagattggctatccgaacacgtgaatgcctcggattaaagcctgatggtgccgttccgaacgtaacccgcgcaatcgagcgggccggaatcattgtttctccgatgagatcattgaatatgcgcggcggggcaaatttgactagcgagggagtgactgcgccttcgtcacagtggcatgccatgtgtattggatatttaggtaatggtgcattaggaggcgatcgtttacgctttactaaagcccatgaacttggtcatctgatcttgcatcgttatcgtaaacctgattcaccgcaattagtggagcgtgaagcccatatatttgctggagcttttctgatttcgcaattagatgctcgcttggttcttaaatccaatttatcgttgcgcgattttcttccaattaaggcaggatggggcatttccattgctgcgcttatctcacgttctcacaatttaggaatcatcgatcggcagaggtacacctccctcaacatacaactatcaggcaaaggatggaagaagcaagaacctgtacccgtcggaatcgagaatccgctattgctgaaacagatgattacatcggcatacggatttaagacagatcaaggactgaaaatagattctattggcttggccagtgagttgggagctccatttagatatctagattactggtccgatggattagatgatgaaggtatgcactggggtattgccgccaatcgctttgagcaaagacccaatcgtatgattgcttaatccttggttctgtcaaatcaactttgacatcggcaacacgtctggttgttggcgttcccaggaacgccaacaaccttgggaaacgaattgatcattcacgtcgattctaatttaacagaacctaatttctacatagggttcttccgtttccctcttgagtaagagtggaagaaccctattctgatatggttgaattgatttatactcaaatggtaatttaatttgatatatacctactcaacaaagaaatgaattcaattatcggaagcaatgatttgtagattagatttttaaggtgtagggccatactcgtttctctttactttaatcattctaatgattttcagcaatgtgagtaatgatataaacgataacggcgccgaagatgccaatggcggcgaggattgccagtctggtttcacggcgttccttggccgccatatcggcctgccggttggccagggcttcggcttcggcggcgacgccgctggcggcgatggccgcgatgtgcgcgctcatctggtcttcgagcgtggaatcctcgctcgtgccgtcgaagggctcctcgttttcgttgtggttgtcgttcatggttctgctccgttcctgattgttggattgtttgctttcctgattgttggcttgcttgattgcttgcttgattgcttgcatgtccgattgcctgcatgcaatcaagtttgattgtttgattgtctgcatgcgggcttgtttgcttgtcagctttcgttttgcccggcgaggatggacatgcgggcggcgataagcgcgtggcgcgcgatctccagatagagctggtggccctcgccgtcgccccagaaccggtcgaactgttcggtcggcatcatgctggcggggtcgaacccgttccacacgccgccgcagaacaccttcgccgccgcgttcacctcctcgtcggacggcatgcccggatgcccctccgcggcgtccgcggccgcgcgcatctgcgcgccgagcacgcgggcctgcaatggcgagagcgtgtacgccagtcccgccgtggagcccgcggggaatcccgtgttcacgccgagggtgatgacgtgcgcctcctcgccgagggtgatgacgtgcgcctcctcgccgatgctgatccggtcgccgagcacggagacctccatcgaatagtccatagtgtctcctttccgcagacgcatcggctttcgggatcgcgtctgcatgtttgactgcctgaatgtttggttgttggcttgtttgcctgctggattgtcggattgcctgattgtttgattgtctgacgggttacggctcgtcgtcgctgtcgagtcggtcgagctcgcgttcgatggcgtcgcgcaggagctgctgcatgggcaggtcgtgcgcggcggccgtggtcttgagccgggtcttgagcgacacgggtatgcgcagtgagagcatgaccaacggttcgcccgtggccttggaggtcttgttctgttggcgcagcacgtcgtcgaacggtaccggtcgtgccagtggctggtagttgccctgcatggtctcactcctgctttccggcgatctgctggagttctgtgacgaggtcgcggtattcgcccagctggtgcgggttggtgccgagcgaacgcttgtaggactgggccttcggcacgatcgtgtcgaaccggggagtgtccatggcgttgagggcgtccatggtgtcgcggaacgccttcgtgttgcgttcggccttgaccagcagcagcgcggcgggcgtgctcatcctggccatgtcgagggtgctccatgcctgctggaggtccatgggcgagtccgacgccggcacgatcacgaagtcggccgccttgatggccatgtccagggtcggtccctgcggcggcgcgtcaatgatcgcccattcgtccgggtcggctcccgcggcgagctggcggagcgtggcctggttggcgggcagcacgtcgaacgtcagggggtccgcggtctgttccgcggctgcggcccacaggctcgcgctggactgcgggtccgcgtcgtacacgacggccctgccgcccctggaaacgatgaccgaggcgatgtagatgctggacgtggtcttcgcgaccccgcccttggagttggctatggcgatgcgcattcgttcttctcctttgcgactgccggatatcatgcgaacccggtcagtcggtcgcttgattgtccgcttgtctgattgcttggattcctgcttgtttgaatgtttgattgtctgacggctcatgcggggcggggcgatcggccgtcctgccccgtgcgcgcaggcgtcgttgctggcgttcggcgctggcctcgccggtggcttcgtcgaacacgttccggtgggcgcgtatccagtccgtgagcagccgccagcgttgcggccacggcaggccgcggtcccggcaggggacgccgtcggcttcggccatgcgcgcgatcctgcgccggtcggtgcacaccttgccgccgtacacgccccattcgagtccgccgctggccgcgtaggccaggcattcggcgcgtaccgggcatcgttcgcacacggccttggcgaccgagtggaacgccttcgcgtcgccgggacggtgctcgaactccagcgaccacaggtagtcggaccatggttgcgggaagtcgcggcattcgccggccttcttccacgcctcaagacgctgcccgtccccgctcatggccgcaccaccgcctccgccgacgcgccggtcttcgccttgcgccgtccggcgacgtcgtgggtggcgtggttgcgtttgtcgtacgcgcataccgggcacgcctcctgcgagatgacgccttcgatgtgttcctggcacagcgaggtgcgcagcagcgccgccccgtagatcggcacacggctcgcggacgacgagctgaccggtatcgcccggttggggtccttgacgaccggcagcggggcgtccggcgcccgcttgcccgtcggatcgggatgggtgagcatttccagccgcagctgcacgtagttcgcggcgaacctggcgccgctggtgagccggggcagccagtagcggttgcggtacgcccagtccatcgtcgcgacgatctcgccgtacggcctgtcgatcagcaacgagtggacggccttgcggtcggccatggtcgccggaacatcgaacctctggtccacggcgagcatgcgacggcggatgccgtcgagcacgcgcacctcctgaccggcgcgttccgtcaccggctcgggcagcttgccgggttcgggcacccacagcgggttcctgcaaccccttggaggcagggccttgccccaatcggtcgtcggaacgggttcgggcttcgggtcggcgaccggtttcgtggcggcttgttcggcgttgaggggagcatccccgaaggggatgaggggagaattgtttatcacttgtctattgggtgactttctgtccaagattccgggacaatttgtcctcgtctccacgtccttcggctcgggtgacaatccgtcgggtgacaaattgtccttcatcggatccggcttgccgtcgccttccgccagcgcgtccaggttccggggcttctcctcgatgttctcggcgggatggtcgccgtccatgacgacgtcccacacgcgcgagcggtgtcccttggcgatcggcttgcgggtgcgcgggttgcgcgccgacatctcctggtcgccgggcctgatgtagcccttgcgctccagctcctgcaacgaacggatcacggtgcgctcacagcacccgcagttgaacgcgatggtctccacgctcggccacgcggctgcgccatcgtcgtaataggcgcggcgggccagatacaccagcacgaacttggtgatgcccttgacgtcgtcgcgctcccatgcccagttctcggctctgctgctcatcgctcgaccttcccgccgtcatgcgccgggtccgcttcgcggcgttcgcgcagcctcgcgccgatgtcgtcgcccagacgggcggcgcggcacaacgcatacgagagaacgccgccggacacgcacacggcggcaacgaccaaccaccacatggttcggccggtatcggggaaacggtccgcggacgcgcgcctcagcggcgcgagccccgggacgggtgggcgagcatggacagcacatgagccttcgcgatgcgcagatcgacgttgccgccggcccgcgtcgtccgccgcgcggcgtcgcgccggcgattaggctcgaagacagatgccgggcgaatgccggcggtattggtagaatcggtcatggcgatgaccctccttcacttgggatacaagacgtcggcggccgggaatcttggcggatgtacgggtcggagacgccttcggttgtcgttcggttccgcgcctagtgcgcggaaccttcttttgccggaggagacagcagcctgttcacgatggcggcatcgttgcccagcacgaaatccgacggcagtcccttcatccgatacagccagacgagatcggcctgctgccaatggagggagccgttcacctttcccgcaaccgatgacttcgattgccccatctccgcggccagaccgcggcaggacagaccctgctgcgccatccaacgagccaccggagacagtacggaaagatgcttttgtctactcacagttgacatagtaattaagtattttgcctttcgcaagtcggagtgctaatatcgtgtccagagatgttggacatatcaacatgtgtttgcgaagcagtgaaagggcgattgccatgaccacgacgataaagaaacggatgacgaactcgggcgaatacctgcagaaggtgatcgtatggaacatcagcatgctgctcaccgcgcacggcctgtcccagacggcgctcacggaacccctgaagatgaccaggggcggcgtcagcgcgaagatgaagaacaagaacacgtggagcatccccgacatcgcggcgctggccgactacttcggcgtgcccgtgacgtccctgctggacgacacgctcatgcgtcagatgctgggagaggggaacttaggtgcatctttggtggcagcgaccaccgcacgatttcctgttcgagcagctgaaggccaagctgacggcctgaaaccgttggaaacaaaaggctccgggccacgatacctcgtggaaaccggagccggtgggtacccccagagagagtcgaactctcgttgtcagattgaaagtctggtgtcctaaccgttagacgatggggcgaacaactcgagttactttacgggagattgttcggttatgcaaatcgacggtatttcggcgtgtcgcaatcagtgcagggcgacggcctgataggtgaagtcgtgaatcacgcggccggcggccaggcccttcttctcgaagttggtgagcacgcggccctcgaaccgctcggattcggtgaagtcggcgtgcggcatgtcggcggccagatcggcgttgcccttgcccacgtgctccagcgggaggctgacggttacgctgcccaggttcttccaaccgtcgagtccgtccatcacctcgtgcacgtgcagggcatagtcctcgatgtcggtggcgatgcgccagacgccgtctgcggccagtgcgcgatggatgtcgccggccatggcctcctgcacgatgcggcgcttgtggtgcttcttcttgggccaggggtcggggaagaaggtccatacttcggctgcggtgccgggcgcggtgaccttgaacagctcgggcgcattgacctgggccacgcgaatgttggtcagcccctgcttgccggcgagcagcagcgtgtgggccacaccggggtcatagacctctagggcaaggaagttcgtctccggatgggccgcggctgcggccaccacgttctcaccctgtccagtgccgatttccacaatgagtggattgtcgttgccccatgcggactccacgagcgcgcggtcgagcgtgacgccttcgcgcacgtccagcagattgccggccgcaatatccaacagatatgtgccggcatagttgtcccatgcgcgctgcaggcgatcgtccaaacgtccggagcggcgtacgaaggagagcaccttgtgcaaggggtgcgccggtgcctcggtgtggtctgtggccatcgcggcgacggaatcgattgctgtggattcgggatcggtcatatattcctcggattttccttgtgcgccgcaccgctgttcattcattaggtcgatttggcgttcattaggtaggtggtgtgcgataccaaccaccatatcaagccatttacccggtgtccgtgcgggccggctccgggccgacctacctaatgaacgccaaatcgacctaatgaatgcagatattgccggacgacaccaccgttttgtgcgattatgttcgtgtgatatactaaaattgtttcaaaaggtaacaaagcggaccaaaagtgaacagccgctgaactcccgacggccgacacttgcaacccgcacaaggaaaggtcaactatgacagttctcgtcaccggcggctgcggctacatcggcgcgcatgtcgttcacgcactccatcaggccggcgaaaaggtcgtcgtcgtcgacgatctgagctacggcaagcccactcgcatcgaaggctcccgcctgtacggcatggatattgccgccccgggtgccggcgagcgtctggccgaaatcctcgacgccgaaggcgtcgactccgtgatccacttcgccgcgcgcaagcaggtcggcgaatccgtggagaagccgctgtggtactaccagcagaacatcaacggcatgctcaacgtgctcaccggcatgacccaatccaagaacgccaagaagctcgtcttctcctcctccgccgccacctacggtgtgccgccggtcgacgtggtgcccgaggacgtcgttccgatgctgccgatcaacccctacggccagaccaagctgttcggcgaatggatggcccgcgcctgcgagcagccgttcggcatccgcttctgcgcgttgcgctacttcaacgtggccggctgcggcccggtcgaactcgaagacccggctattctgaacctcatcccgatgctgttcaaccgcctcaagcagggcaaggcccccgccatcttcggtgacgactatccgaccccggacggcacctgcgtgcgcgactacatccacgtttccgatctggccgatgcccacatcgccgccctcaagtacctcgatcgtgacgagcgcaagtacgacgccttcaatgtcggcaccggtgaaggcacctccgtgcgtcagatcgtcgacgaagtcaagaaggtcaccggtctgccgttcaccgaggccgtcatggcccgccgcgccggcgacccgccgcacctgatcggctccccgaagcgcatcaacgaggagatgggctggcacgccaagtacgacgtggaagacatcgtcaagtccgcgtgggatgcctggcaggccaaccccgaacaccacatcgacgtcgacacctggaagcaggctgactgagattgacgattgctttgcggtggatgccgtgaagcgtttccgtccataagggcgtggccggggttccggtcgcgcccttcgtcgttttgtggatgtttgtgacagacgtgttcgtgtgctggcgatagcaaaaaccttgaaattatgcggaacacgccgaagtttgcgcgatcggcgaatttcagtaatatatacatctgttgcctcacgcaagtgagaacaatggccccgtagctcagttggttagagcgccgccctgtcacggcggaggtcaccggttcaagtccggccggggtcgctggaatggttatgaagcccgggttatccgggtttttgactgttcatggctctgtagctcagttggtagagcgagcgactgaaaatcgctaggtcaacggatcgacgccgttcggagccaccacaatgaagccccgccttgtgcggggcttttgcatatccgtcacgtacctactccggcgggctggccggtcaatgcgaaggctcgcgttcgccaacaactgtcttcctcaccgcaactacgcacgccaacagcaccaatgcgaacatcgggttagggttaagtaaagaaacgtgggtcttatccgcgcgtgtcatggtcggtgcgatcgtccgcctcagccgtttctgggtctgtggcgctcatagagtcagtattgcagaaaaagcacccgcgagatgcgcgcgcaaagagaatcgtgtgggacggcacgtgattttgccgatttttgacgtgccgtcccacagcgttcgaagaacgccctcagagctgagggcaaagaacggctctattctgcggttctcggcttatgtcatgcgggatagcagatgcgtcaaccgattgacgtatctgctatcccacacttttgtgggacggcagatgaacaatggtaaaaaccgcgtgccgtcccacaaaacggaatcaggcctgccaccattggcgcagagggtaccacttgccgtccgggtggcccacgcgatccggcttgacagccaggaactggtggatctggatgccgtcgagctcgaagttcagagcgcaggcggccatgtacataccccataccttggcgcgttcaaagccgacctgcttgaccgcgtcgtcccaatgctcggagaggttctggctccagtgatgcagggtgagcgcatagtgctggcgcaggttctcctgatgcaccacgttgaagccggcgtcatggatgcacgattcgatgaagccgggcgcgccgaggtcgccgtccgggaagatgtaacggtcgaggaattcgtcggtgccgggcttgccgtgaggcttgtcatggctgatggtgatctggtggttcagcagtcggcccatcggcttcaggagacggaacatctcttcgaagtagctctggtagttcttgacgcctacgtgctccatcatgccgatcgagcagataccgtcgaagtcatgctcgggcacctcgcggtagtcctgtacgcgcacttcggccagatcctgcagcccttcacgggcgatccattcgttggcgtacgcggcctgttccttggagagggtgacgccgagcgccttgatgccgcgacgggcggcggtgatgaccatcgaaccccagccgcagccgatgtccagtaagtgctggccgggctgcaagtccagtttgtcgagaatcaggcgcagtttgttggcctgtgcgtcttcaaggctcatgtgctcgttgtcgaataccgcgcaggtgtacgtcatggaggggccgaggaagtcggcgtagaactcgttggacatgtcgtagtgaaagctgacggtttccgaatcggccttttcggtgtgcggcatcaggccacgcttgatgcgggcgaacttgcttgggccctcggtggcgggcaccggcggcttcttgaagccgtgactcagaatgccggcggatacgcgggcaatggatgcgggagtgagtgggcgaacgtatttggccagcgacaccagcttgcgcatcgccggatacgggtcggcgtagtcaatgtcgtccacgtcgaaatcgcccagaatgtatgcgcgcacgatgccgatttcattcgggtgcgcgagcagctggtacatgcagttcggcgcggcgattttgaccttcaaatccgcgtctgccgggccgaaatgcgagccgtcaaaagcgtcgatacgaacgggagtgtcggggtcgagaaacagggatgccatctcgccgactgtcatagccttgccacttgccattatctgcctcattctcttatgatgatcaccccaattgtcgaggtatcttagtcctcttcaagagactgaaaccgttgaatacaccatctggtgaaccagttcgcgttcggctgatgaaacacgaatggaattaggcatctcgcatattgattgcgtacgcgcgaagtaagcggataagagacgagtttctcggagagcaccaagcgactccggaaaatggtcttatcgttgagatctcgggcgattgaactggtttggtcaatggacaataatttgacaagtgcagaattccgccatttcttgccattattttcagtgttgttctttcagcgtgttttcaggtgaatgctcatgcgcggagtagactggggaaccgttggaccactcaaagagtgagcggaccaccagttaagacactagctcaaaaggagagtccctatggtataccgcatgattttcaaccagactgcatacttcggacgtggctcgatcaaggaaattccggccgtcgccaagcagcacggcttcaccaaggcatttatcgtcactgatccggtactgctggagaccggcaccgccgagaaggtcaccaaggttctggatgaggccggcctggcgtatgaggtgttctccaacgtcaagccgaacccgccggtagagtgcattaaggacggcgtcgccaagttcgccgaatccggcgcggacttcctgattggtctgggcggcggctccccgcaagacacctgcaagggcatcggcatcatcaccgccaacccggagttcgccgacgtgctgtccctggaaggcgtcgcggataccaagaacccgtccgtcccgatcttcggcgtgccgaccaccgccggtaccgcttccgagacgaccatcaactacgtggtcaccgataccgccaacaagcgtaagttcgtggccgtcgacccgcacgacatcccgatcgtcgctttcgttgatcctgatctgaccgactcgatgccgcgcggcctgaaggtcgccaccggacttgacgccctgacccacgccatcgagggttacattaccccgggtgcctggagcctgtccgactgcctgtccatgcagaccattcgcatgattgcccagaacctggccaagtccgccgatggcgacattccggctggcgagcagatggcctacgcgtcctacatcaccggcatggcctactcgaacgtgggcctcggcctggtgcacggcatggctcacccgctgggcggccgtctgggcgtggcccacggtgtggccaacggcattctgctggccccggtcatggaatacaacaaggacttcaccggtgagaagtaccgcgacatcgccgatgcgttcggcgtcgaggacgcctacaccggcgacctggagactgtgcgcgaagaggccgtgcaggccgtccacaagctgaccgtggatctgaagaacccgaccacgatttccgaagtgggcgccaccgagggcgaccttgagccgctggctcacgacgccttcaacgacgtgtgcacccccggcaacccgcgtcaggccacgcaggaggacatcctcgccatctacaagtcgctgatgtgattcgtcgatgacgccgacgatgccggtgggttcccctcgtcgggaacccaccggcatcgctatctctcgtgcttttcgtcgtagacttcgtcggtggtggtctcgtcgtacagctgcttgccttgcgcctccgccagttccatctgctcgttgatccacgcggcttcagcaggattgatatccgcggaattcagcactttctgccacaccgggtagaacatgtgcatcgccggatacatggcggtgaacaacacctctggcttatgcgtgcgcgtgtgctgcggatgtgcatcaaacgtattcttaaaacgtcgcatgtagttcaggaatgaacccagcgacgtgtccatccgtcgcgcgctcatcgcggcgatcatgcgcggcgagtacacggttttcagattcttgcccatcagatgcagggaaatatcgatatcctcatgcatcacatcggccttatctcggcagacctcattcgcgatctgatgccaagccgaagcgcgcaaggccatattggaaccgaacagcagcggctgtccgccatcggcgcggtagattcgcttgcgcaaggaattgtcgcccttcaacccaaaatggcgtgagggcatgtcgtaatacatcaccggaccagtggcacccatcgcggccgggtcttcggtgaagatgccggagaccacctccacccagtcgggccgaatcatgcagtcggcatcaaaacggcccagcacatcgccggtcgcggcgtccaggccaaagttgcgggtgggaatcagtccctgttcatcgttctgatgcaatagtttgatcggggcctcgggatgttcggcgatgaactgttcgacaatcgcgcaggtgttgtccgtagaacggttgtccaccaccagcacctcatgcggcatgatggtctgacgggtggcgttcagcaggcagtcgcggatgcgttcggcttcgttccacgctgggatgatgatcgaaacgttgagcatgacatcaacaatagaaaagcgggtgtacgccgccggcgtattcgagcttcaaacccctcgctacaatggggagccatgagtgaacgcgcgcgaaacgtaaacagcaccgacacgtcgagaaccggtgccgcagaagccgggacagacccgggcgacgagaatcgtatcgactttggtactttgttccctgccaagggagattcccgcaggccaccggaatggttcggccgcgcgctgctgtatgtggccctcgccgtcatcgtgttcatgttctgctggcgctcgtggggcgacatctcctatctggtgttcgacatcatcatctcgctgttcctggcgctggccgtcgaaccgctggtggtggcgctggtggctcatggctggaagcgtggcgtggcttccgccgtcagtctggtgggcgtggccgtggtcgtgggtgtgctgctcacgctgttcggcaatatgttcgtacagcagatgattgccatggtccgcggtttgccggcaatgtatgggcagattcgtgagttcgcggaccagtacaccacgttcaagatgccggaaatcagcaatcttggcatggaaatcttcaacaatatccagacctcgtgggtcaccgatttcgccggcaccgccatgagtacggtgggtggcctgttctccttcctgctgaacctcatgaccgtggtaatgaccacgtattacatctccgccgccggcccaaagctgcgccgctccttctgccagtggctggcccccaacacgcagcgtcgattcctgctggtgtggaccgtggcccaaggccagatttcgtccttcctgttctcccgttcgattctggcgttgatcaacgccatttgcactgccatcttcttggagatcctgcatgtgccctactggctgccgttggccctgttctgcggcgtggtatcccagttcatccccacggtcggtacctatatcggcggtgcgctgccggtgctgttcgcttggggcaaccgcgggtggacgtacgccgtggcggtgctggtgttcatcatcgtctaccagcagattgagaacctgattctctcgccgagaatctcccagcgcacgatggacatcaacgcggccgtcgccttcctctcggtgctggcgttcggctcgctgttcggcgcgttcggcgcgttcctggcgctgccggtcaccgcatcgctgcaggccattttccgtgcgtacaccaagcgctatgagctgattgactcaccgctgatgaacgatccgactccggagaagaagtccaagatcgtcgaggcgtccgaggcgttcggcgagcacgtattgcagccaatcggcgagcacatgccacgtgcggccaaggggtccaccagccgtgtgccgatgaacgaggaactgcgtttgctgcaggaacagatctatgcgattccgccacacgagacgaaagaatccgatttggacgattccgccaccgtggcgattccgaagaacgtgctatcctccagcgctcgcaagggattgcgcggcaccgagccggagtcggatgtcgatgataccgataatgccgataatacagtcggtgcggatgcaagctctgatgagccggacacggcggcgattccgcagcgtggtgccgcgaatacgcagcagcctgagcggcccgagcaacgcaagcaaaccaagcagtctgatcaatctgcctccagcaatcctagggcggggtggcgctgatgaccctgctttcagtactcgatattcttctggtaatcgtcggtggtgccggcatgatatatcagggactgtgtatcgtgatgtccctgttcgccaagcccgtgcgcttccccgacgccccgatgaccaaccggtatgccgtgctgatctccgcgcgcaacgaagaaaaagtgatcggcaaccttattgggtcgattcgcgatcagacctacccgtccaacctcatcgacatctggctggtggccgacaactgcaccgacaacaccgccgacgtggtgcggtctttgggctgccatgtggtggaacgccacaatcttgagctggttggcaagggatatgcgctgacgtatctgttggggcatatgctcgacatcggtgtggccgacgactatgaggcctacttcgtgttcgatgccgataacaagctggacaagcactacttcgaggaaatgaacaaggcgttctgctccggattcaagattctgaccagctaccgtaattcggtgaatctggcggataactgggtgtcttctggttctgcgctgtggttcatccgtgaatcgcgattcctgtctaactcgcgtatgattctcggctcctcttgccacgtgggcggtacgggatttatgttctcccgcgaggtgatgaagcggaacaagggatggaagttccatctgctcactgaagatcttgaattcactatggattcgattctgcatggcgaccgcatcggctattgcggtactgcgattctctacgacgagcagccggttaccttctcgcaaagttggcgtcagcgtttacgttggagcaagggattcctgcaggtattccgttattatggctcggcattgctgaaacgcgcggttcgcgaacgtgatttctcctgcatcgacttcaccttgatgctgtgtccgtttaccgtgttgggcgcgattcgcgcggtgatgggcttgctgttcgccgcgtgtggcttcgtgagttggccgagccagctgcaatcgctggccagttggtccagcggcatcatcatatcggtgttgggcctgatggcattggctgcattgaccatcattgtcgagcgcgaccagatcggtgccacgaacaaggagctgctcgcctatgtgctcagcttcccgatttacatgctcagctacgtgccgatctccttccaggccctcttctccaaagcccagtggaagcccatcgcgcataagggttgaccgagtccgctagttggagctgctcagcggggcaatacaacagcaacccgggggtttgcttcgctgagggttggctggtgggctagagtggatgtatgagcttagacaatactcaaaggaatgtcggatttcagccgccgatgatgccagccgccgcccccgcgcctgcacagccgtcgcaaccgcagccacaagcatggccgccgaatccgaatgcggcggtgtccattcgtggcctgttcaagcacttcgaccggaagatcgccgtcaacggactcgcgctcgatattccggtcggctcgttctatggacttgtaggccccaacggtgccggcaaaaccaccacgctcaatatggtgaccggtctattggtaccggacgccggcaccgccatgattttgggccatgacgtgtggagcgacgtgaacacggccaagcgcatgatcggcgtcatgccccagcccgaccagatcttcgaccgactgaccggtttgcaattgctcgtctactccggcatgctgcgcggcatgagccgcgatgagaccacgcgtcgcgcccaggacctgctcaatgctttcgacttggccggggccgccaacacgatggtcaccgattattcggccggcatgaccaagaagatctgcctggcctccgcgatgattcatagcccgcgcattctggtcctggacgagccgtttgaatccgtggacccggtgtccagcgccaacctcaaagacatcctcatcgaatacgcgaagaccggcggcacggtgattatctcttcgcacgtgatggcattggtcgaaaagatgtgcacgcatgtggccgtaatcaacaacggtctggtgtgcgcggccggcacggtggacgaggtcgccgccggcgaagaactcgaagaccgcttcctgcaactggtcggcggccgccacgaagccgcccatctcgcatggctcgacggcgggcaagcccaagcccaagcaccaacttcggtccagccggtccagcccattccgcttacaaccgccacgcccgccacacccaccgatgaggcccgccgatgatcagcagcgccatcaccctggtccgcctgcgctggacgctcacgctcgccaccctgcgaaaatcggcgtggcagaccgtcgcctatgtcttttccgccgtactcgcggccggcaccatcatcggcaccggcgtgctcgcatggttcatcggcatactgccgcccttcaccgtgaacgcggatggctttccgctgaacatccttggttccggaggcatcgtcaacatgatcgtcgtgctggtcggcgcgaccatgaccatcttcatcggcttcatccagctcatgatgcttggcgaaggctccaccatgaacccacgcaaattcgcgctctacggcatcgccgaccgcaacctgcaattcggcttgctgctttccggcctgtccggcatccccgcccttaccggcgtggcctcactgatgctctggacactggcctatcggcatatgggaccagccgtaatcatcagttccctcctcgccgcagtgctggccgtcatcaccatgatgagcatctccaaactgctcatcgccctatccaccacgctggtgaccagcaaacgcggcaaaggcgcgttctatatcttcatcgtgctgacgttcgttatcatctgtcagttgccgaacattctggtcaactccggcgtggccttcagcctcaacaccgaaacctggggcgcggcgaccaccatcgtcgcatggacgccgttcggcgcggccttccaactaccgttcgacgcgcttaccggagcctgggcggtgctgctcgcccgcatcgccatccttgccgtcacatggattgtctgcttcgccgtctgcacctggtgtctgagacatgaacggttcaccatcggcgcaaacagtccgtccgagaccgccaaaggcatcggcgcattcgcatggatgcccgattcggcatccggcgcggtttccgcacgcctgatcacctatctcaaacgagacccccgtcaagccatgaccttcgccatgccggtcctgttcctgatcatcttcgccttccaggcacacggcatcagcgcggtcgtctggcagtcgctgatctggtgcggctggttcatgtccgtcgtggaaagcaacgggctcgcatatgacggccgcggcttcaccatggaagtcatcgccggcgtgcgtggccggaccgacagaatcggccgcgtacgcgtctacgtcggcatcatggtcgtctacatggtgctgctctatctcgccggcatcgtgctggtcggcgcactgaccggacgctgggcgcagcccgatgacctcgctaccggcctgatcttcctcgccacgggcatgggcatcgccttgagcggactgggcgtggccgaagtcacctcctgtgtactgatgtacccggtcgcctcaatggacaagccgttctccgcgcctcaaggccgcgccatggcccaaggcttcttcccgttcgtctacatgcttggcagcctgctgctcatgctgcccactggcatcgtggcgctggtcatgctgctgacaggagccgaaggcggcatgtggctggcgattattccggtcgcgctggccaatggcatcggcattctggcactcgggacatggctgggcggtaagctgatggatgcgcgaatgctctcgattgtggcaacactcgactcgttcgcctcattgcagaaatgattgccttggcataaggagcacgatggtatctacagcggtatcacgccgtcagcgacgtgaagcgcaacggcggccccaacaatcgcatcgccgaacactgaccgtcatcatttccgcactgaccaccatcgccctgttcgcggggtactgcgccgccgacatcaccgacgtggcccccggattattgacgttgaagcccgtcaccgcacctgtttttgccgatccagccaccgccaaatcaggcggcaccgtcgccggcaccttgaacacgaacaaggccattgattccacggccgcttctgcgctggtcaacgaattgctgtccgcgcaaggcgtgggaaacgatacgtcggtgatcattgaagacgcccaaggcaccgtcgccgccgaacacgagtcgaacactccacgcgagcctgcatccacactgaaaacgctgaccgcgctcgccgcctcatccaccctgaatatggcatccaccttggatacccaagtgttcctcacccaatccgatgacggcaccaatacgttgaccctcaaaggcaatggcgacatgctgctgtctgcaggcgattccgacgccaaccataccaacggacgtgccggtctgaacaccttggccaaggccaccgtggccgcgctcgcccagcgaggcatcacttccgtcaatctcgagtacgacgacaccctattcggcgactcacgcattcccgcaggtctgtcggaaggtggcgcggttttaagcgactacaccgtctacttcacgccggtctcatcaatggcgattgatggaggccgccaacacaccgccgatacgcctgcgccggccgaccccgatgattcggccggctacccggaactgtcccagcacaccgccagcgacgtggccacgaaattcgccgaactgctccaatcgaacggtgtggccgttaccggagacgtgacggcaaacaccgctccatccggcgaaacgcctttggcttcggtgagttcggcaacactgtccgaaatcatggcatacacgttacggcattcggacaatacgctggccgaggagttcggcagactcaccgctttggcgaaatcagcgacaaacagtcctgaaggcggcacggaggcggtcaaatccactctgaacgatctcggtctcgatacatccggtctgaccatggccgattgctccggtctgtctcccggctcccggctcaccgtacgcacgctggcggccgtccaacaacgtaatctgaccaccaagagtggcgcggccggcgcggaaggtctatccatcgcgggattggtgggcacggcgcaggatcggtatacggatgatgccgtggctggtctgctgcgcgtcaaaaccggcagcctcggcacggttgcgtcgatggccggcaatgtgtcccgcaccaatggggagcgttgtcgtttgccgtggtggtcaacaatcctgaggattatgccgccgcgcgtagcgccatcgactcgttcatcaccaagctcgcggggctgtgaaagacccatcaagtgccatcaaaggctacaaaggccgtaaacgtccataaacgcacgagtacacataaccagaaaaagggtggtgagtacatggcatattccgcacgattgcgcaaggccgtaggcgcggtccgcgcaacgctgagcgctgtggaactatgcgatgtgcaggctcccgaattcgcgcagcatggggaccatgccgttgccgccgatgcgccgctcgtgctcgtggcctgttcaggcgggcgcgattcgatggcactggccgcggtgagccatatcgtatgcacgtccatgggcgtgcgttgcggtgccgtgattgtggatcacggcttgcaggagggttccgaacaggtcgccggcgaggctgcgaatcgttgccgtgcgttgggactgggcccggtcatcgtgcgcaacgcaaccgtgcaggcacgcggtgagggcctcgaagcggccgcgcggcaggcccggtacaacgagctgtgcgccgcggcgcgtgaatcaggtgccattgccgtgctgttggcccacactatggacgatcaggcggaaaccgtattgatcggactgctgcgcagccgtggcgtggatgcgttggccggcatgccgcaggtcttcacacgcagtggcgtgacttttgcgcggccgctgcttacccttactcgagccgagaccaccggcatctgtgaagacttaggtgtggaatattgggatgaccccaccaatggcgatgcggtagacggcgagttgccgaacgactatccgttgcgctcgcgggtgcgccatgacctgctgccggccatcgagcgattcgctggattcaatgtcgcccgccatttcgctgaaagcgcacggttggccagaatggataaggagtatctggatcagcgatccgacgaggtgatgggggaggcggttacgacagttgattggccggcatcgtcggcagcggtatcgaccgatacgccacgagcctgtgcggcaggcgataccaacgattcgagccatggtgtcggcctgatgatcagcgtcagacgtattgcacgtgagccagaggcgattcggttgcgggtcatcgctcatgcgctgagccaagccggtgtgaacgccagtgccgcccagattgccgccatcgaccggctggtcgtcgattggcatggccaaggcggcgtctcacttcccagaggttattcagccaatcgcaagaaacacgtcattcgcgtgtgccaagatggtgcgcatgcgaatcgctgacgttgaggaagatattgaccacgagctggtcagcaaagaacagatcgatgccaagatccacgagatggccgctctcgcgagcgaggattaccgcgataagaatccgctgctcgttgcggtgctgaaaggggccgtgaatacgctggtcgcattcacccaggccatgagcattcctgtacagatcgacttcatgagcctgtcgagctatggctcgggcacagtgtcgagcggtgaggtcacagtcaggcaggatttgtccgccgatgttcgcggacggcacatcttgattgtggaggatattgttgattcaggacacacgctcgcgtggctggtcacagaactgaaacgtcgtggtgccgcttccgtggaggtcttcgctttgctgagcaagccctcccgccgagaggtggacgttgatgtgaagtacgccggctatgagattccggacgagttcgtcgtcggcttcggcctcgactttgacgaacgctaccgcaacctcgattcgatcgcggtcctcaagccgtccgtctaccaaggagtgcaagcatgagcttcccgcaagggccgggtaacggcaataatccgaacccgaacaacaaccgtaacaacggcaacccgttcactaacccgttcaaccgtggcaataacgggaacaatggcaaaggcaacaacaacgagaaccgcccgatatggcagtccccttggctatggggtgccgtgctcgtggtcatggtcgtgctgatgttccagatgttcgccggcggtggcaccaaaaccatcgacaccaaagatggtttcgcactgatcaatcagggcaaggccacgtacgccgagattacggacaacaagcaggtcgtccgccttaagctgaagaacgactacaccaagaagaatgccgacaccggcaaggtgaccaactacggcaagaacgtgcagttctactacaccttcgcgcagggcgcccaagtggccaaggccgtggagaacggcaaccttgagaagggctggacctcgaacatcgagcagaccagcatgctgagctacctcgtcacctcgatcctgccgttcatcatcttcttcgccctgttctggtggctgatgagccggatgggcggcgccggcggcatgctcggcatgggcggcaggaagaacagcggcaaactgctcgacgggcagacccccaccaccaagttcgccgatgtggccggtgaagacgaggccgtggccgaagtcgaggagatcaaggacttcctcaaggatccgtccaagtacaaggcgctgggtgcgcgcattccgcgcggcgtgctgctgtacggccctcccggcaccggtaagacgttgctggcccgagccatcgcaggcgaggccggcgtgccgttctactcgatggccggctccgacttcgtcgaaatgttcgtgggtctcggtgcctcccgtgtgcgcgacctgttcgatgaggccaagaagaacgcccccgccatcatcttcatcgacgagatcgatgctgtgggccgcaagcgcggttccggcatgggcggtggccacgacgaacgcgaacagacgctgaaccagctgctcgtcgagatggacggcttcgacaacgacaccaacctcatcatcatcgccgccaccaaccgtcccgatgtgctcgaccccgccctgctgcgtccgggccgattcgaccggcaggtgggcgtggcggcccccgatctggaaggccgtgaggcgatcctgagggtgcatgccaagggcaagccgttcgtgccggacgtcgacctgcacatggtcgccgtgcgcacgccgggcttcaccggtgccgatctggccaacgtgctcaacgaagccgccctgctgtgcgcccgtgccggtgcccagttgattgacaaccgcgccatcgacgaggccatcgaccgtgttcaggccggaccgaagcgcaagtccaagggcatggctctggaagagctgcgcaacaccgcataccacgagggtggtcatgcgctggtggccgccgccctgaacaacaccgatccggtgaccaaggtgacgattctgccgcgaggccgcgccctcggctacaccgccgtcatgccgacctccgaccgctactcgcagtcgcgcaaccagctgctcgaccagatggcctacgcgatgggcggtcgcaccgccgaggaaatcgtcttccatgacccgaccaccggtgcctcgaacgatatcgagaaggctacgagcatcgcccgtacgatggtgatcgaatacggcttctccgacaagctcggcgccatcaagtggggttccgacgacgatcagaccaccgtgatggacggtctgcagccgcgcaaatactccgaccgcaccgccgaagtgattgatgacgaggtgctcaagctggtggaaaccgcccacaccgaggcgtggaccatcatcaacgacaaccgcgatatactcgatgagttggtccgccagctgctggtcaaggaaactctgaacgagaaggagcttgcggagatcttcgcgccgatcaagaaggcgccggtccgcccggtgtggctgtccaacgaccgccgccccgactcggacaaaccgccggtggagattcccgaaagcctcaagcgctcggtcggcatgaagccggaagagtagacacgatgacgattcggcccgacctgtccatgtggtttctcacgtacgcaggccgggccgacgtcgttgtggacaatgacatggtgaacgaaacgattgggagggatcagatgaatgaaaacgggaagtcctcatacgacgaggaaggcgtgcgcgaagccgtacgcctgttcctgaagtcgattggcgaggatcccgagcgcgagggactggtggaaacgcctgaccgtatcgcccgcgcgtgccgcgagctgttcgccggtctgcaggcttccccggccgatgtgctggagaagcacttcgacgtggataccgacgagctggtgctggtcaaggacatcgaactgtattcggtgtgcgagcatcacctgctgccgttccatggcgtggcccatgtgggctatattcccgccaaggacggggtgatggggctgagcaagctcgcccgactggtcgaggtgtatgctcgccggccgcaggtgcaggagcgtttgacccagcagatcgccgacgcgctggtcgagtacgcgggcgcacgtggtgtgattgtggtgaccgaatgcgagcacctgtgcatgtcgatgcgcggcatcaagaaatcctccgcgcgcacggtgacctctgcggtgcgcggcatgctgcgcaatccggccacccgagccgaagccatgagcttgattcttgacaagtgacgcaacctaggctcccctctctgaggggagcgaagggaaacaacgaaggggaaataacctatgactgatttgcaggcgttgcatgacagtacgcgcaccatggtgatgggcgtgctcaacatcaccgaggactcgtcctcggacggcggcctgtggctggacccggccaaggcggcccaacacgggcgcgacatgatggccgccggcgcggccatcatcgacatcggcgccgaatccacgcgccccggcgccaagcgcgtgtccgaggccgacgaactggcccgcatcaccggtgccgtcaagacattgattccggccggtgccatactgtccatcgacaccacgcgcgcatccgtggccgccgctgcgctgagcgagggcgcccagatcatcaacgacgtctccggtggcacgctggatgccgaactgccgcatgtggtcgccgaccacgactgcctgtacatcgtgcagcattggcgcggttggctcgccggctccaagggcgcgaaccccgatcaagacacctccgtctacgagcgcggtgtattgaccgacgtacacgacgaactcatgcgccaagtcgacggtgtgctggccgccggcgtaaagcctgagcgcattatcatcgacccgggcctgggcttctccaagcctggcatcgagcacaacctgccgctgctgaccggactcgagtccttccgcgccactggatatccggtgctgatcggccagtcccgcaaacgcttcatctcggcgatgcttaccgaggcgggcgctgccggtgctgatgggccgatcatgtcccagcgcgatgacgtgaccgcagccttgtccgccctgtccgccgaacatggcgcatgggccgtgcgcgtacacgacgtggccaaaagccgcgccgccgtcatcgccggcaacacctggcgcgaatacgcatgatccccctggctccctgttttggttgcttctaggccttggctcccctcgggcgaggggagctggcgccgaaggcgactgaggggagcatttgagcagaaagccttaccaatggacaccatcacacttaccggcgtacatgccaacggcacccacggtgtgctcgccttcgaacacgaacggccacaaaccttcgtcgtggatgtcaccctgcaccttgatctggccgcagccggtcaatccgacgatctcaacgacaccatcgattacggccgtgtggccaaggacatcacggctgtcatcgaaggccctcatgtggacctgatcgagcgtctggcccaacgtatcgcggacgagattcttgccgatgcgccggccgtcgcctccatcgacgtcaccgtgcacaagcctcacgcacccatcgtcgtggcttttgcagatgtatcggtctccatctcgcgcgtgcgtgccaccgataatggacgtactgctgaagagcatgccatccataacgcggtggtggccttgggcggcaatgtgggcgaggtggaatccaccttgcgagccgccgttcgggagattgacgcgttgcctggcacacaggtgactggtatctcaccgctttaccgcacggccgcgtggggcatggccgacggtacgccggatttcctgaacgccgtggtggagcttgaaaccacaatgggcagccacgaattgcttgccgcgttgcaaaacatcgaagcgaaccatggacgaattcgtgagaatcattgggattccaggccgttggacttggacattatcgactttgatggcatcaccagcgcggatccggatctggcattgccccatccgcgtgcttggcagcgtgcgtttgtgctggctccttggttggcattgaatccgaacgccaaactcgccggagcccatgaggggcctgtagccgatttgctggccaccgcgccggaccgtaacgccgtgcagctcgagagcgaagactggatgctcggcgggcatgcagtcaagcaagaatccgcgtcggagtcggcacccgtctcacgcaaggcgattatttcgctggattccacctcgcaggatgccgaacggctgttccgtgaaaccatcgtttccatcgacagtgttcctggcaatcaggtacagggcatttcgccgctctaccatgtcagccatttcgacggcccggacgcgatgagcgcggtcatccaaatcgaaaccaagttgccgcccgccgacctgattgccgtattgggcagcatcgaaagcgttcatgatctggcagtcgaccttgaccttgttgacatggagggcgtgacttccgacgagcccaactgcagcattccttggccgtcggcccgtaaccatgcgtcggtattggcaccttggctggatatggacccgaatgctactctgggcggcgacccggtggccttccttttggccatggcaccggatgccggacaggtcggattgctatcggacaactggatactgtcgaacagttgaactgatggcagaaccagttacgaacggtaggctagaaaccagacggtgacggaccggtatctgacctcgaacagccgggcacggcagtgacgaaaaccaaatcaagatgagcagcccaggagcgagggccgttcgcaaacagcaaacagcaacgcaacgataaggaggccggacatgaaaacacggcgaacagcatggtggcagtatatgatcggtgccgtgctgggcctgttggcgggtatcggtctggcctcctacggcgaaagctcgggactgtcactgattggtgcgcctcggattgtgaccggattgctggccgtgctgggcgttatcgtgctgatcttggccctgcaagtgcataaatacgcgaataccgaccccaagaagcgtccgcatagcttcatcaatcccactatcgcggtgtatacgctggtgctgtctaaggcactgggattggcgggcgcaacgcttgccggctggtatggcggtcagattgtgatgagcctgagccatattgaggcggatttttatgcacacgccgtcaccgagtgcgcaatcgcggccgtggtgtgcatcgccgacatgatcatcggcattatcggcgaatggttgtgccagctaccgccgaacgaaggccccgaaaacccgaaaatcaaggaagccaagcgccgtagcgacatagcccaggcctacaaaagataatccgtgataagccccctctgacgagggggctgtaggcgtagccgactgggggagagaagaagaaaaaaccacaccatcggccaagccgattcccactattcctgcggcacgcgaaccatagcttcctgagcgatggccgccaccaagtcgccattctgcgcatacactttggcgatgccgagtccgcgcccgtgcgcggcgataggcgtatcctgcacatacaaatgccattcgttgatatcgatatcctgataccaccacatcgaatggtcgatggacgcataggaaatgcccggtgtggaaatcgacagtccggcgcggcgcagcaccggttccatcatcacctgatcgcagccgagtgccagcatcgcacgatgcatgacctgcggcacatcgacgtggccatcggccttcatccacaccatctgcttgccggaatcatgctcggcggaatccttgtccgcgcgcagcatcacggtcggcgtcacgtggcggatatcgaacggcgatttctcggcatagtaattggcgaacggcgactgtgcggcatacgggcgcatgagctccttggcggaagtcaacgtttcgggatcgggcaggttttccggcatcggatcggcaaattccacaccctcctgaccggtctcctggaaggaggcgatggccgtgagaatcgacccctcggcttgggtgacgttgacccgacgagcggagaacgagcggccgtcgcgaaggttctcgacgtcaaacagcaggtcttgacgaatatcgccggcggcaatgaaatagccatgtaccgaatgcggcaggcgtgaagggcctactgttttggacgcggcgatcaccgactgggcgatgacctggccaccgtagacgcggccagtggggaagtacatactctcgccattgatgtatgtgtgattgcggtaagcggaaggctcgcccaacttcagcaccttcaccagatggtccaatggagttacggtggttgcctgagccatggcgttcctcgattcctgttctgctgtgttcgatattcggttatcgtattccaacctatggttggcagtctatccggtgggggttaagagttccgggagcgaaatgtaacgagactgtttggaaggtaaacggttggttatgcggtgcgttgccgctacgttgctgctgcactgccggtgtgttgccggtgcgttgccgtaggtgactgtgggattttatgggatgcggggcggggcagtcatggggcaattatgggaaagccgcccctgagggacggctttcgacgtataaagcgtgttgtggcactaatgccggcgtatctcagccgcgcacaagcttcttgtgcaggcggtgcggacgggccgcgtcctcgccgagtcgggccaccttgttctcctggtaggcctggaagttaccttcgaaccagtaccacttggccgggttgtcgtcatcgccctcccacgcgaggatgtgcgtggcgacgcggtcaaggaaccaacggtcatgggaaatcaccacagcgcagcccgggaactcgagcagtgcgttttcgagggattccaaagtctcgacatccaaatcattggtgggctcgtcgagcagcagcaggttgccgccctgcttcagggtcagggccaggttcagacggttgcgctcaccaccggacagcacaccggtcagcttctgctgatcggcgcccttgaagccgaagctggccacataggcgcgggtcggcacctccacaccggccacctcgatgaagtcgaggcccccggacaccgcctcccacaggttcttgttcgggtccaggccctcacggttctgatccacgtagctgatcttgacggtatcgccgatcttcagttcgccgctggtcagcggttcgagtccgacgatggtcttgaacaacgtggacttgcccacgccgttcgggccgatcacaccgacgatgccgttgcgtggcagcgtgaaggacaggtcgtcgatgagcacgcgatcgccgaacgccttatggatatggttggcttcaagcacggtggaaccgaggcgcgggccggccggaatctgaatctcggagaagtcgagcttcttgttgttgcgtgcctcgttctccatctggtcgtaacgttccaggcgggccttgttcttggcttggcgggctttgggcgaggagcgtacccagtcgagctcgttcttcaggcgtttggcgagtttggcgtccttggcgccctgaatctccagacgcttggccttggtctccaggtatgtggagtagttgcccttgtacgggtacaggtggccgcggtcgacctcgcagatccattcggccacgttgtccatgaagtaacgatcgtgggtgacggcaatgacggcgcccttgtactggtgcaggaactgctccaaccacaggatggattcggcgtccaggtggttggtgggctcgtcgagcagcagcaggtccggggcctcaagcagcagcttgcacagggccacacggcggcgctcgccaccggagcacacgttgaccggggtgtccggatcggggcactgcagggcgtccatcgcctgctcaagctgggagtcgaggtcccagccgtcggcggcgtcgatctcggtctgcagcttgcccatttcttccatcagcgcgtcgaagtcggcgtccgggttggccatttcttcaccgatctcgttgaatcgggcgaccttctcggcaatcgggccgaacgccatcttgatgttctcgcccacggtcttggtgtcatccagcggcggctcctgctgcaggatgccgaccgtgaagcccggggtcagactggcctcgccgttgctcacggtctccaggccggccataatcttcagcagggtggacttacccatgccgttcgggcccacgacgccgatcttcgcgccgggcaggaagctcagggtcacgtcatcgagaatcacgcggtcgccgtaagacttgcgggccttgatcatctgaaatacgaattcagccatataagtgtcttatcctgtcttatcgttgcaatttcaacgttttgccgggcttggattccgtgatgacacactgtggaacgatgcgtccggtttcggggggggttccgaacgacccgtttgatgccgcccgtccctggatttccgtgtcatcgcggcgcctcggtcccaagcaaaagcaccttgtggattatcccatatcccatcgtcataccgcaacgggggatctcctgtaagtacatttggtggcagtttggtcatgcggcgagtctgcgtcgcaatatcttcggataattctgtctgaacgtgcgccggtcgccgcatcttgtggtcggttttggcgctttccccggctttgaatttcagtgcggtcagttcgatggtgcacatgaggtcggcggtctgctcgagatgataatccttggggtcggccttgcgataggcgaccgtctccttggcgagcgtgtagctgacggaggcctacaatgcgttggtggcgacctgctgtccgttgtcatagtggatcttgatggtgtcgtacgactgaaaccggtcgagatgcgtcagcaggtagtcagccaggataacgcccgtcttcttgcgcagattcggttgtgggttccgatgaaaaggacatggcccggctttggtacgattttcagtcgcttacacatgaaaaccgcgaatccgccatggccaaggcagggacggtcgcgggcgaaatggaggaacgcaagctcagggcggccgtgaaccgcctgcgcgagggcgtcggcgagaccgccgcctgcctcctgccggggttccccgcgaaccataggatcaagctgcgcacggacaacatgatcgagcgattgaacaaggagatccgccggcgcacccgggtcgtgggcggcttccccgactccaacagctggccaacagccaatctgcgcaaagaagcgggcactatcatttaacaaatgtgaaatacaagtaacaatttaaggaataccattgcggggaataataaccagctaggtgaagaaaggagttgttatggtagacgtcaagttacatggtattgccgaaggccgtctgggaactggttcaatgtgctacgatttggcaaatggtaacacagtcgcagatgttgtaaagcatgtagctctacaagatgaaggcctgacaaggaccctaattgatgaatctagacaaaagcctcgtcgactttgtcgaatcatgattaattgtccttcttgtggagcaggtaaatgaattctattgaacaacggctgcaacgtgctgctttattggcttctggtattgatgcgtttggtacgggctcgtttgtcagcgctgcggcggtaattttttcttcatataatcatgtttctgcaggcattattggtcttggactgaccttttcagctgtttctggcatgattgcttcgatgcctgctgcgtatctcgccgaccgtatcggagggttgcgcgttttcacttactcgtatttgctacgagcggtaggaatgcttggatggcttattatctctggtgatgctgcatttcttgtctatatgacgctgttcggtattatcgaccgctcagcagcatcgcttacacgaggactgattatcgcaccgctgagccgagagcaagccacaatactcttgggtcgcatggcattaccgacgaatgtcggttacgcgcttggcgcggcactaagcacaatgatgctgcttatccagtacgggaatgtgatcatagtggcagcaaattcactctcgttcgttgtcgtagttgtgctatatcgcagagcgctcaaaggttgcaatgtaaccgctgcaaaggtgaaacgttcaccgctaacttcgtggacggtttttcgcactgcactaacttcaaggtctcgttctcggctgattatcgaaaatttcctgttctcgtttcatcgtacactgctcaatgtgtatctaccattactgattattcattacgcgcctaccgacacatggcaggcgccagccatattcgttgccaatacggtagttattgcactagcccaaggtcctgtcaaccattgggccacgaaagcacataattatgcgctggcttggcgctgcagtggactactgcaggcaattgcatttattgctgtagcctgcatacctttcctgtcacatgattttcccttcatagcactggttatgttgcttgccatgctgcagattatcgctgaactgctcagcaccgcaggtattaccatgtatatggcattgctgagcagaaaagattatctaactactgacttaagcgctattaatcttggtggacaattccagaatattgtagggccatcactctttgctagcacgattactgccgctaattgtgtgcttcctgctgctatgggtattgccattacgctcgctgctgcgctacctagaaaatctgaataagagcataacaatcgtggatacctcattgatagaaaatcataattcgcacaattcgcctcttccaatctgtgattatgtaagactgttttcttctcctttggacaaaggactctacgtaggatgcggaaacggaaggaatgcgtttccactcctctcagagggatggaacttatatgcatgcgacgtatctaatttcaatatacaaagagccaaaagtatttgccacaatatgctgatcgatttgaggttcttagctatgaccaagctttctcttatatactagaatttgattatgtgatatgtagtagagccctagtatatggtagttttgaagagagccttcagcgatttaaaatacttagacggcggcttaggcctggcggaattcttttgttccagctacctgctattggaacagatttatggcctaaatgggttaactatgcgataaccgaaatggggagtttgatagttggatataacttacattccctgtcaaaagtatatttatcgtttactgatgtatgtgatttactagaacgtgcaggatttaaaatttgcaacggtcctacgccatacgatcttccaagaggtgaatatccaggaggaattgtgagaaattggcttggtgtagcaattaacaataattagctaacagttgtccgctgtcaatcgtgtaacgacgattcatgactgaagaacgactctcatcgtcaatgctccagataataagctatcaaccactgacgatagcaaaactcgaaacaattataacatattacaaactatcatgataactctcttcaattttggtggcaccgtttacacttaattgtatccaatttaattatggactgttctggtaacaaaaagctactaagccgaaaagtaaaaatcagataatcaaatggcttaaaaatcctcacactgattcggcagaatacaagatatgaggtaacggcgtggcgtttccctgcgtgtgtttcgttctcaaaaatatcgcttattttcaggcgaaagaacgcgtgtaagacttgctaaaaaccttctttagagtgatttttatatgtactcgaaaaaatctaagatagcgcccgtcttcttgcgcagattcggttgtgggttccgatgaaaaggacatggcccgctttggtgcgattttcagtcgcttacacatgaaaaccgcgattggaaagaaggccggaagccatgtccgataaaatcatacggttcgacgacgccatgttcgggtcggcggtgatcgagcgctgccggaggcgcgaatccagcgtcgaggaggcgctgatggagatgtgcctcgcgggcgtgagcacacgcagggtggacgacatcagccggctgctgtggggcgagcggatgccatcccggacattgagcgacaaactcaagaaggtctacaaggagatcgacgggtggcggaaacgcccgttggaatccgagtacccgtacgtgttcgtggacggcgtgtggcgcaagcgatcccggggcgggcacgtggagaacgcgggcgtcctcgtcgccatcggcgtcagcagccgccagatctcgtttcagttgggcttcgaaacggctcttgtccccatcgaactcgcttctgcggtgcgcgaacgtcacatacgtgaatggcgggttcctcgccaacgtgaaaaatgcgatgaagagacgtttgtggtcggtcgtggacgggatctcgtagtcgtcgtggccgttgaacagtgggccggcatggaaagggatgtcgggcagggagacatccgcgaggtgttgttcgtagcgttcgatgtggggattgaccggcttgggctggtcgtggaacatcagggtgatgaggtggtacttggacagtttgccccatctgccagattcgtcgaccatggcgtccagctcgttcattgttgactcccggagaaaaagaagtgcctggctctgcgatacggggctccagagcccaccgcgctgtcttgaaccgccgtccgccgacgtggcgttgacgctccgaaccgatcatgattcaccggtggatcaccttgacgttgatgtagttactgagtaacatcagcattacattactcagtaaccatatcgagaagaggtgctcatggccgccgcaatcaaccgcgcaatgccgagccttacctgccttgacaccggggaacaggcgatattgacgatcgtcgacgcgacacgtacgcatggcgacggcgcgcgcagggtcgtcgctctcagccatgcgaatctaatacttcgctccggggagttcgtggccgtaatgggaccgtccggttcgggcaagtccacgttgctcaaccttgccgggggattggacacgccgtcttcaggcaaagtgctggtcgagggccgcgatctcgcttcgctgaacgttgcccggcgtgccgcgattcgacggcggtcgattggctacgtgtttcaggatttcaatctgctgccgtcgttgaacgccatcgagaacgtctcgttcccgttggaactggacggctggccaatccgcaaggcgcgtaaggctgcattggaggccttgcaagagacgggcgtcgctgaactggcgctccgtcggcctgaggacatgtcgggaggtcaggcgcagcgtgtggccatcgcccgagctttggtgggccgacgccgcctgctgctggccgacgagccgaccggcgcattggattccgctgccggcacgaaggtcatggaggtactgcgcagccgtgccgacgcgggctgtgctgtgctgatggtcacgcatgaacctcgctttgccgcttgggccgatcgtacggtgttcattcgcgacggtcgcatcaccgacgagacaggagcgaccgactttgacgaactgttcacctgcgatggtgaagatgatgacgatgccggcgatgcgcgcaacagctcgcaacagaactttcgcaacaatcccggggaacagtgatatcgatgctcttcaattttccgcgtcgccgcgtcgccgcgcgtcttgcctggcgcgatatgacgcgacacaaagcgcgcagcatattcgccacattgttggtcgcattgcctatcgccgcgctggtggcggggctggcactgctgacaggcacgccgaattcccggcagcgtgcccttgccgccattcctcggaatgcgcaggcggtgctcaccgccaccgcggtgctcaacacaggccagccgttcatgcaggcgcccgagggggcttcgctgtgggtggatagtccctctcaacaacccgcgagcgcggcgaacatcgccgcaatcacgcccgaccaggacgccctgctgcggtattgggattcggaaacgctaatcgccaccgccggcggcgacttgcagccgggcgatcagattcaggttgatgccgccggcgccgataccactgactccgccggctcctccggcgccgacctcgacggcgcggtacgagccaagctgcgcgagaccgaacatgatgcgctgccactgttaatgcctcccgttgcacagggtgccgcgccgcaggatgccacgcaggcggttatcagcgcatcgctcgctgagcagctgcacctgaatgtcggagatacattgacgctcaccgcgcctccatttcaaggtgcgtacagtacgaacggacgcattggcgcggtgctgcagaactcgcggcgcgcgtggcgcatcagcggcatcgccgatgtcacctcaacgcttgacgtatggacgtattccggctggctcaaaggcatggtcgaggcggatggcggtaatggggtggatgcgcattatctgttggtcggcagcgagccattgacgtggacgcaggtcaagcggctcaacatgctgcaggtggtcgccgtttcgcgccatgtgctgacggatggttatccgagtgcggaagagcgatatccgcgtcaaatcgacgtgcagcagcagttgatgcaaatggtatccgtcactgtaacggcttttcttgggattgccctgacgctattcctgatcacccccgcgttcgccgtgtcggccgaccagtctcgtcgcatattgggattgaccgccgcatgcggtgccgacggcgtggatcttcgacgcacgatgagcttccaaggcttgtttattggcatatcaggcggcatgatcggtatcatcgcaggcatcggattgtcatatgccgccgcaccggctctgaaaggcgcctatgtgcatgaggtcgccggtatgattccgtggaagatgctgcccttggccgcgttagcggcagtgatgatcggattggctgccacatggatgccggcgcatcgcgtcagccgcatgaatgtggtggacgcgttgaaagatcgctcggacaacggcgagcgcaaccgccgtgaatctcggttgtatcgtgtggtgacggcgatttccaccgcggcattgcttggcgcggccgtggcctgtgccatgggcggccttgccatgcccatgccggaattcggtgatgccgactacggtagtctgccggccgaggcaatcggcgcgcaattgctgctgatcggagccatcgtgttctcgttcgccggcctgatccagttgattcgtctgatcgcgcaattatgcgaacgccacggcaccttactgcctctggcggtacggatgggattgcgtgatgccggcgagcatcaccgtcgattcgtccccgccgcggccgctatcgccgtgagcgtggcggtcgcctcatacgcgcttaccatgaccggctcactgattgccaatgatcggtcgaatgccatggaagtggtgcatggccattcgcatgcggtggtgtcccctgaggttccgattgacaatgccgtggatcgtgcagtggtgcgatcggcgctgaatgccatcagtgatgatctgcccgtcaccgcgcatcagcctgtgtatgcgctggcggaagtgccgccggagaccgccgacaagttgaatgtcgctgaggcgaatgagcttatgcgccgattcccgaatgccgctgccagactggcgactccattggattgcattacgagttccgaccctgatcgcgggcaagacgtggcttcggcgcataatccgaacgcccagccatactgcgtgggagcatcgcgttcctatcgcccgttgtatcgaggcttgactatgatcaacgcggatttctccgtgctgatcatgtccggcgatgcgatgcgattgtcgggatttgccaatgccgacaaggcggcggacatgctcgaccggggcggcgtggtggtcggcaacgcggcgacgctgcgcaaggacggcaccgtggatttggaaatctcccatagtgcgcacaatcccgacggttcctcggcccccgatgtggtcactgggtcggcgagcaggccgggagtttgggtggatgggttcttccctctggcgatgagcaaggaaaccgcccaaagcctgggactgaccgcattcaggtatgtgggcgatatggtgcaattcaccgacgcccccggctggagcactctggacaagctgcgatcgatcattgacgacaggctgccgctggtgaatggcaccagtcagtcctaccgctacagctggggtaccggcgatccttcaagcatgcttgcggagctgctgccgttcgcattgctgatgctgctcgcgatagccgccacggtgatctcgctgctgctggcgcgcatccaaatcatccgtgatctggccacgatgcatgccgtgggcgcatcccccggtttcctgcgacggttcacgctggcgcaggccgccattatgttggcggccggaacaccgactggcatggttacgggactcgccttggggatatttcatgtggcttggtacagacacatcggctatgacggcgcatggcttgacacagtgccctgctggggcctgcaggccgcgttgttgatcggcgttattgcaatgggcctgggcgtggcatggctggccgcacgtccgtcgcgcaagctgaccagacgaactttggattgatcgaccgtacgatatcggatgatatacgaaggacgaaggaacatcatggcgatacgggaagcactgatggcgctgttggaacaaggaccggcaagcgcctaccaattgaagcggcggttcgaacgcaccacatcaagcatatggccgttgaacatggggcaggtgtccaccacgttgcagcgactgcatcgtgatggtctgatcgaacaagtcgacggttcggaacatgacgttcccgacgattccgattcccgctccgattcaccggtggcatggttgctcaccgccgccggccatgctgaggtatcgcaatggtggcgcactccggtattgcccgagcagcgcggccgcgacgagctggtgatgaagctggcgttcgcggtagtcacgccaggcgtggatgtgtcgacgctggtgcaacggcagcgagtgtccatgcaacggctcctacatgatgtgactcgcgcacgccgtcagacggacggtgatgatctggccgcccgactggtgcttgaccatcgcatcttcatcaccgaagccgaactgcgttggttggagaccctcgacgaagcgcagttgcgcatcgcgcgcacgcatcgtgcatccgcgtcgatgtcagccgtcacttccgtcgaggaagatttcgccaatgcgagaacgtagttttgctttgccggctgattccgtccctggctccgccatgattccgttgccgttgccgttgccgtttccgtcggatgggttgcgcccgtcgaacgggttgcgcgtgatcggtttctgttttcggatgttggcgcgatgcggcggatgcacgccgtcttttttgtaggggggtgttcctatgtttttgtcaactccttggggagttgacgtgtcgggattccggttggctgtcgtgggcgcgcttcgccctgccggtggcgtccggcgtcctttcccgtgtggcccggttcaggctacgagggctggttcctggtagagggttccgtttttgagcatgctgtagatcacgtcgcagcgccgacgcgcgaggcagatgatggcggcgttgtggtgtttgccctgttcgcgtttgcgcttgtaataggccacggagggcgggtgtttggtggatgcgacgaacgcggtctgccacagcgcgttcttgaggcgtttgttgccccgcctggagggccgttcgcctttgatgctggtgccggattggccggtgacgggcgatatgcccgcgtaggcggccagatgggcggacgatttgaagttggcgatgtcgccgccgatgccgagcaggatgttgcttgcggtcctgacgcctatcccgggcatcgacgccgggaccgtgagaagagggtggtcctccaggagcttctcgacctggcggccgacctcgcgccgccggtccctgatcgtcttgatgtcgtgggcgatggaggggatgatggtctcggccatgagggtgccgggcacggtgacggtctgctcgccgatcgccttgaacatgtcgtcgatgatgcggccggcgcgaagcccgttggacttggcccagtccttcacgtcctcgatcccggcccgtttcacgcccatgggcccgccgtatcgttcgagcagcgcgagcgtcgcgtcgcgcgtgattctctcgcccttgagcgcgcgttcgaacgcggggtgggtctgcagcagcaggctccgcaggcggttgacgtggcgggtggattcgtgggcgaggtcctcgtcgtggccggcgagcagcttcagggcggcgagggtctcgtcatccgggcccgcgtccctgagcgtctcgggcagcttgagcgcggcccacgcgatcacatgcgcgtccctgcggtcggtcttcgcgtccccgggcagcagctgcgcggtcctgcgcatggccgtgccgggaaggtaggcaaccgcgatccccatgttccgcgccaccgtcaggggcagggagccgatggtgttgggctggtccacgaccagcagcacacggccatgcttggagagcttgcccagcatcgtgcggatggccttctcgtcctgtttcaacggcttgtcgtacagggtgttcccgtcatggtcgagggcgtgcgcgtggtgcgcgctcttgcccacgtccaggccgacccacacgtcgatgtcgtccggggtcatcatcgttcctcccgtcatgaaggttttccggtcgccgcgggctcggaggagtccggacgcccgcgccgcacccacattacgacgagacctgcgccatgcgcccctgaagcgtccgtgtagccggcctggttcctatcagcggtcatcgggcgtccccgttcccggcgacaacaccccccggatcatcgacgacagggcaggaaagtcataccggaaccggcgacccggccccgaccatcggggcctaccaaacatggtaatgggctggattgcggcctggcgcgatccgacatgacgcggccgtccccgatggtgccgttgcggcgatccgccgaggttacgcccatggctgaacgcccggaatgttccttgatatccagtgagacggtccgcgccacggatgtactgtgaacggcggataagcgcatcaggcgcctcgatcatggcagagaggaaaccccgttatggactgttcatcacgatcccaacgtcagactcaagtcgatgcgtccccgacatccccgacatcttcaacaactatgacatcttcaacgaatccgacggcctcgtcgccgctgcccacccaggcgccgccgtggggcgcgctgtgggtgatggccctgggattggccatgatcgtgctcgacagctcgatcgtcaacgtctccatccccaccatcatcgatgatatcggcattaacctgaccgacgcccagtgggtcacctcgctctacaacatcgtgcttgccgcgttgttgctgcctttcggcaagttgggcgacgccagagggcgcaaactggtgtttcaagtcggtaccgtgatcttcgtggcgagttcgacgctcgccgccgcctcgcagggtgcggtgatgctgcttgccgcccgtgtgctgcagggcatcggaggcgcgatgatcatgccgaacaccctgtccacggtgtccgccctgttccggggcaaataccgtgccgcggcgttcggcgtctggggcgcggtgatgagttcggccgccgcgcttggtccgctgctcggtggcgtgttcaccgagaccttgggatggcgttggatcttcctggtgaacctgccgctgggcatcgcggtctttgtatcggccatcttcctggtgccgaagaccggtgggaacgcctcggtcgccggtgccgcggatgccgcgcaggatgcccgatcccgtcgcgtcggtgtggatatcccgggcgtggtgttgtctgccctgacctcggccctgttggtgttcggtcttatcgaaggcgagacctacggttggtggaagcagacctccacgcagttgaagctcggcgggttgagctggaatcgtgactggttgtcgccggtgccgatctgcctgatcgccggcgcgcttctgatggccgtcttcatcctcttcgaatccgcgcggggcaaagccggtcggccggtcatgctggacatgaccctgttccgcatcaagacgttctcgtggggcaatctggcggccgcggccatcgccgccggcgagttcgcgctggtgttcatgctgccgttgtatctcatcaacgcccgcgggctcaacacgctgcaggccggtgcgatgctggccgtgatgggcttggggtccatcgtcgcaggtgcgcaggcccatgtcatggccgccaggctcaccccggccggcgtgattcaacttggtcttgtgatcgagatcatcgccgtcgccctggtcgcggtccttatgcctgtggggttctctgtgtggtggcagcttgttcccatggccgcgtacggtctgggtctgggcttcgcctccgcgcagctgaccagcgtggtgctctccgaagtaccggtcatgcagtccggcgaagggtcggccacccagtccacggttcgacagctcggcaccgccgtcggttcggccatctccggcgcgtcgttggccatggccgtcaacggaacattgccggcgcggctcgaatccctcgggctgcccgccaaggtcggcgacggtctggcccaagcggtcagtggttcggcgggtggagtgatcggcgtgttccgcagcggtgatggaccggcggcccgattcggcgacgaggcgccgaagattgccgatgcgatgacttcagggttcgtcgaaggcggccagtggacgcttctggtcgccggcatcatgctgttcatcggtttgctggcctcggtggccgtgcgtcgtgccgcgtcgtcgcacaacgtgcgttgacgcatgacggctacggtcttatggggagtgcggccgtgcgcggtcgaacggtgtggcccgcataccgtccaccgcgcctgcggtcggtttgccatccagacggcgtgtcgtgatccgatgatgctgtaacatatccttttgtgcctcattgaggcacgtacggccccgtagctcagttggttagagcgccgccctgtcacggcggaggtcaccggttcaagtccggccggggtcgccaccaaactcccgatgcatgtcgggagttttttgtttcctgccgttcttcgatgccatccgcaagggcggcgaaagtgaacgcatccgatccgacacgccgtccgcaccgataccggcattgaaggggacgcccgtttgcatcgggtgaaatgcatgaggaagcgcatcggcggaatgttcgcgacgcatggcgaatcacggaaaatccgcggtgggaggtcatggcggctcactactattttcgctatctcgtacgttacgaaagtcttcaaagagtaagccatgaccacgctcgccattgatatcggcggaaccaagatcgccgctgccgtctgcgatgcaaacgacagcatcatccagcgttggcgcgtccccacgccgatggacgccgacgccatcaacacgcatatcgccgagatctaccgcgaagccgtcgccgctggccacaccgatatcgaggccatcggcatctccgcggccggtaatgtgagcgcggatcgcaagacgctcaccttctccgccaacattccggcctggatcaattacaatctgtccgagcatgtcggcgcgttgatcgaccatgccgttccgatcgtcgtcgagaacgatgccaactgcgccggctggggcgaattcgtgcacggtgccggccaaggcagctccaacatggtcgcgctgaccgtgggcaccggcctcggtggcgccatcgtgatcaatggccagctctaccgaggctccttcggcatggccgcagagctcggccacctgccgatggtcccggacggagaccattgcggctgcggcctgcgcggctgcgccgagcgctatacttcgggaacctcgctggagaacttcgccaagtccgccgtgcgtcgtcgtcctcaggacgccaaacgtcttctggagctgtgcggtggcgacatcaccaagctggagggaccgatggtgtcccaagcggctcaggagggtgacgtgcttggcctgtatgcgttcggcaagatcggcgaatggcttggccgcaccatggccgccgtttccgccgtgcttgatccggacctgttcgtcatcggcggtggtgtggtagccgttggagacattctgctggagccggcccgctacaactaccagcgtttcctggaaggcagcgcctaccgtggccacgccaagatcgtcgccgcagtcgcgggccaggacgccggcctcatcggtgccgccaatctggctcttcgctgacgcagatggcggtgcgtagataacgcgcgcgacgcagatagcaacgcgtaaataatcgcaaataatcgcaaacagtacagtgcggtgattctcgttatgggaatcaccgcactgttgtttttctcccggaaatggcgaaacccaacgtgagcgaatgggcaagataccggcaccgcgcgcgtgggcgacgtcagcattcctcggcgtcgctacgctgactcgcggtcaacttcccgatgctgctcgccgcccgactggtcatgtcgctcggcgccggcatctccctgccgcttatcaccaacatcattctggagaaggcgccacttgaacagcgtggcgcgatgctcggcatagtcggcctggtcacctgcgccgcaccggccatcggcccggtgatcggcggcatgctgaagaaccacttcccgcccaagttcatccttatcggcttcgccggcaccgtgattatggatgtggtgttcgttgcgctgtccggcaatgtgggggcatcgccgcgaatgatggggcggatgcggccggttcgtatacggccgcgttcccacgcagcatgatggtgttcaccggcatggccgtgcttggcgtgattcttgccgcgctcatgttccgattctccactcgccgaccgccagaattgagagaagtcaaatagtacgcccgcggcggattggttggctttatgatggaaccgacattccatcacgggagaagcagggaaactatcatgcttgaaccaccagtcactccgatccgcaaggccaacgacggcctcgaactgcccgccaccggcttcggtacgtacaaggtcaacggtctagccggcgtggacgccatcaagttcgccatccatcagggttaccgcctcatcgactctgcgttcaactatgagaacgagggtgtggtgggtcgcgccatccgcgaatccggcgtgccgcgtgaagacatcatcgtcacgtccaagctgcccggccgccaccatgctcacgatgaggcgctgctcaccattgaggagagcgtgtgccgtatgggtctcgactacatcgatctctatctgattcactggccgaacccaggccaaggccagttcgtcgaggcatgggaagcgctggtcgaagctcgcgaacgcggcttggtcaagcacattggcgtcagcaacttcctgcccggccacatcgacctgctcattcgcgatacgggtgtgacgccggccgtcaaccaggtcgagctgcacccgtacttccagcagcgcgaacagctggcctacgacaacgcgcacggcatcatcaccgaggcatggagcccgctgggccgcgccaaccagatgctgcgcgacccagacctgaagcgtatcgccgccaagcacggtatttccgtggtccaggccattttgcgctggcacctccagtacggcgacgtggccatcccgaagtctttgaacccggagcgccagcgtcagaacctcgacctgaccgcttttgaactcgatgatcaggacatggccgatatcgccgcgatggacaaccccgaaggccacaccttcggacagaacccccactggcacgaagaagcgtgattccaacatgcaacgtcctattatgacttcgcggtcgtttttgcgcacgccgtccgaagtggccggacccggcgacgagcaggtgatcgaagacctcgtagacacgctggaggccaaccgttcacggtgcgtgggcatggccgccaacatgattggcgtaggcaaacgcatcatcgtcttcgtggatgaagaccttggcgggcgtattacggtgatgttcaaccccgtgatcaccgcttcggacggtgccttcgacgcccaggaaggctgtttgtcgctgaccggcgaacgccgcacactgcgctaccgccgtatcgaggtcaactacgaggaccgtcggttccgcgcccgccacgccaccttcgccggttggactgcgcagattatccagcatgaagtcgatcactgcaacggcatcattatctgattcatatcggtgctcgttgcagcccaacccccgaggctggtcatcgcgattacgatgcgattacatcgcaaccgctatgaccagcctttttttatgtgcactggtggagggtgttctcagcggtgttggggtgccatgcgctggcaggttggtttcgctgaggggtgtgggtggtgtcatgttgccagcggttggctggttgggttcgctggaggttctaagcgtcggtgatgtgccaaagagtggcgggctggcttcgctaaggagcgctaccgtcggtggagaaccagtgcgtgacctgctgccgacgctaagcgttcgttaagcgtcgttagcggccaaaacttggacgtgtaacgatgctgggcggttttagtgtcgttgctgtgccgagttgtgggcctctgccgacgctgccagtgcagtagcgtcggcgttgggacaggtgttggacctttgccgactctataagcgagggaaaatcattctccgatgcctaagtgggtctattgccatgctgaatacatctgctgagtgtagctatgcgttcgaaggcgatttcgggacctttctcagtagcaaatatgtctaatgcgcggagttatacacttcaccgtgcacttatacacgccaaacgaagcagaaatcgactgctgacagtggacgacacgccagagacgatgtggataacccagagacggtggataacagctgcgcgatcagtggataacctgcaagaaagtgcggttatccaccgacggtagccactgttatgcacattccataccccttggaatcattgggttttccacttatccaccatctcgccatgcgggcttgcgggccaccgcacgaacgtcatacagtgtgcctcacggcgggcaacgtagcccgccgtccacatcacatgaagggggaaacgccatgagcaccgcaaccactactactgccgaaaatgccggtttgccagcaatgctggacaccaaagacgtagccgagacgttcaaacgctgcaatctcgccgtctatgccgaagcgagacgcatatattatcgcgaagtgaatctgaacccgttcaaaacgtattcaaagcacctgcgtcaaatgatcgaatggtggttctgggattggtttgcctatgattgcactgtcagcggtattggactgaccggcaatgaatccgaagatttacgtatcgaattgcagtacggttcaggcgcaggtatctcgccattcctagccttggccgaattcatgtatgacaaggacgaacgtatcggcacacgcgagatacgtgattttcgcgaacttgatgacaccaatttcgcttcggtgttctggattcgcgatgccagcgcggtcaaaggtcgtctgacagttgaggacatcattcatggtggtgtctacgaggtggcggacgcacatgccgcctcgcaatacgatggtgcgcacggcggcatgatcgtcaatcgcatcgcacatgtgagaggcgtgtggagatcctgtgccatcccgatctatgaggcacgaaggcccgatgacccgcaaatcggtgattcgctggcccgttcattccgggaaaccggatataaaccggactttgccggtctggtgcggtttttctacgggagggccaaagacaccggtctcgactgggaagatgcggaagccgcacgccaagccggtactttggacgcgctgatcaagaaggccggcaatcggtgaaggatccgcctaacgctgctgtccaagtcggcggccacggtcgcgaacgaagagggacgcaaccaaacagaccgcgcacacaatggcgaccgtgctgaacgaagcctgcacgccaatggccgatgccgccgcttccggcactccggtgcgcatggccgctgcggtgtgcgtgttcatgatggtgaccagtagcacagcctcaaacgtcatgatcgcgaagcccagcaaggcgagcggccggccaccgatacggtcgtacagcttgcctgccaccgggttcaggatgcccatggcgatgccgctcggcatcatcaccagaccggacaccagtgcattaacgccaagatcattctgcaaatatgcccatcgcgtacaggaacggctggcgcgtggtgaaggtctcgatgaggaacgcggtgatcgggatcatgatgccgttggtgagcatgaatccggtggtcagccattgcacggtgctgccgggcacatcgaattcatgcatcaacgtgggcggtgcggagatcatcagcgtctagttgagaatggccacaaacgagccgatcatcagggtgatgaccatggcagtggtgttggcaggggtggtgctgttggagttggcgggggaggaaccgacggccttgacccagcgctgcttgccgcgggcggtcacgtcgtccggttcgtcgccatcggccggagctgcaccgagcttgtcgatcagggtggcggactgcggggcggaactgatgtcattccagagcatcgcatcgcgaatcacgttgccctgcttgtcgagaatgaccatgccgtgctgctggccgccaaccgcgagggccgcgacatcgtcgagcccgccggcccgctcggcggccttggtgaaggcctcccaccagaattccgggttgaccgaggtgccatccgggtgcttggcctgcccgaaccgaacctgttcgccggtggcggcgtccgtgatgcggacctttgttgattgggttgacgtatctacgccggcaaccagtactctcgtcatgcattcctcctcgatgaggggttgcgatcaaaagtttcggcgcgccatagccaataagttagacgattaaactatactgtatcaacgttcaattgcaaacggaaacacgcgaaggcgcggtccgattcaatcgtttgacgcacaatatcaatggtgtgatctatggatgagagcgtccacaagacgctcaaagcttagggtgcaaggaggtaggagccaatggcaagtctacgcaggatcaatcaggaggatctgcgcaaccataatttgtcggtggttctcgacactttgttgcgcgcggagaaacccataagcagggccgacctggccaaggaaacgggcctgaccaaggccacgctttcgctgttggcctcgatgcttatcgatagtggcgtggtgcaggaaggcgagtcggtcgtctccaccacatatgggcggcccagcacgccgctggagattcatggcgggtccatcgccggcatcggcctgcagatcaacaccgatggctacggttgcctggcactcgatctgaacggcgacactctcggtcaggagtgggtgagtgaggatatgaccggcactgacccgtacgagatcttcgccaagctcgatgcgatgaccttcccgttggaaagccgactcaaacgacgtggctgcaaagtggtgggagccgggcttgcgctgccgggcatcgtcaccgacgacatgtggctgttggtggcccgcaatctgggttgggaaaacgtcaacctcacccggttcaacgtggtacgccggctggatgtggtggccggtaacgaagcgaagatggccgccatcgctcagattccggggtatgccaccgaacgtgcgtccttcctgaatgtggtggatcgcacggattcctttatttacctgtctaccgatatcggcgtcggcggcgcggtggtgcgtgacggcgaagtggtgatgggctcgcacggattcgccggcgagatcggccatctgtccgtggcgatggatgggccgttgtgcagctgcgggcgccacgggtgccttgaggcgtttgcgggccgtcgcgccttggtcgaggctgccggcattgccgaagatggggatgccaccagcagcgaggccatcgatacattcctccagcgttggcgtgcgggggatccagacgtggccaaagtggtcgatcaggccgctgatgcgctggtttccgccatcgcttccaccgtgaatctggtggatgtcgatacggtgctgttgggcggactgtggacgcacttcggcgacgagctggccaccgtgcttgaaggccggctgcgttcggaaattctgggatacccgaatgtgaagatccgcgtgttcgtgccgccggtggcgctgcatccctcgctatatggcgcggccgaaatgggcttgcgacggttcatcgagaacccgttggggtacacatgggggagaagtagcgccgggagatgctgcttgttgtgctggcgggtgcatggcatgggtgcatggcgcgtgtgccggcgttggtgggttcatgctacactttgcaagttggctgttttacgcagcgaacgtggggccgtagctcagtcggttagagcatgcgactcataatcgcccggtccagggttcaagcccctgcggccccactcttttgcgtcgcctcctgcggcggcacagcgcgtcttcacgtccagacaggcgcgtacaatcccttaggttccggttcacgtcctgccataggggcatgacgacccgggtcccccgaatccataggagacgtaaaatgcagcagggtatccatcctgattaccaccccgttgaggtgacgtgctcgtgcggcaacaccttcgtgacccgcaccgctggcaaggaggatcacatgttcgttgacgtgtgctctcagtgccacccgttctacactggcaagcagaagattcttgacaccggtggccgcgttgctcgcttcgagaagcgctacggcaagaagagcaagtagcatacttcacgccagtccgattcgattcggcatgctccggcatacccgatcgaggactggcgtttttgtattctttgacaagttttgatgcagcattgacctgcgcaatcgaataatcgaacagaacagcaccatacagaagaaagtgtgttatggcagacgaacagttcccggcggcggcaaccgcgcttgaggagtaccagtccatcgaagagcagatggcgagccccgaagtcgtgtccaacccggacaagctgcgcaagctgggccgtcgtcacgccgaactgggtgccatcgtgggtgcctacaaaacctggttgcaggtgaaggacgatctggcagccgctcaggagatggccggcgaagacgccgacttcgccgaggaagccaagcgtcttgaggccgaactgcccggtgtcgaagagaagctgcgcaccgcgctgatcccgcgtgacccggatgatgcgcgcgacaccatcatggaaatcaaggctggcaccggcggcgaagaagccgcactgttcgccggcgacctgctgcgcatgtacacccgttacgccgagaagcgtggctggagcgtgaacgtgcagtccgagaacaccactgagctcggcggcgtcaaggacgtgcagattgccatccgcgccaagggcacgcccgctcccgaagacggcgtgtgggcttcgatgaaatacgagggcggcgtacaccgtgtgcagcgcatccccgtcaccgaatcgcagggccgtatccagacttccgccgcgggcgtcatcgtgttccccgaggccgacgaggatgacgacgagatcgagatcgatccgaaagacctgaaaatcgacatcttcatgagctccggccccggcggccagtccgtgaacaccacgtattccgccgtgcgcatgacccacctgcccaccggcatcacagtgaacatgcaggatgagaagtcgcagattcagaaccgtgccgccgcgttgcgcgtgctgaagtcccgcctgctggccatgaagcatgagcaggaggccgccgaggccgccgacatgcgtcactcgcaggtacgttcgcttgatcgctccgagcgaatccgcacatacaacttcccggaaaaccgtatcgtcgaccatcgcacgaattacaaggcctacaaccttgacgccgtgctcgacggcgacctgcaggccgtcatcgattccgacatccaagccgacgaagccgaccgtctggccaaccagcagtgatagtagcgtgagcgggtttggccggtagatacaatgctcgacacactctaggccgttcggtcaagcctacggtcgagcatcgcatttaccggccaaacccttacattatgtgataattaaggcaccggaagatagggatgtgatggctgctgccgatgtgattcgtgatgccgccgtgcaattgcgtgaggctggtattgagacgcctgagcatgatgccaaactgctccttgccgaggcggcaggtgttgagttgcgcgatgtcgacaaagctctgttgatgggggaggagcttggcacagccgaacggtttgcccgcttccaatccatgcttgcccgccgtgccaagcgcgagccgttgcaatacatcaccggtcatgcgccgttccgctatctcgacctgaaggtcggccctggcgtgttcattccgcgtccggaaaccgaaaccgtggtgcaggccggtcttgactggctgacaagaaacggcatgatccatccttgtgtggtcgatctgtgcgccggctccggcgcgattgggctgtccgttgtcagcgaggtgcccggcagccaggtgtgggcggtggagctgtcgccgaacaccgccgaatggacgcgaaggaatctgtcggaaaccgcgaaaaagtacccatccattgcctcgaattaccatctggaaatcgcggatgccacgtccttcgccacattggcccaattggacggcaccgtcgatatcgtcatcaccaacccgccctacgtgccgcaaaccgacattcccgaacagccggaagtacgcgactgggaccctgaactggccctgtacggcggttcggcggacggcacgctcatccctgagcgcattatcgaacgcgcgtaccgactgctcaagcctggcggcgtattggtcatggagcatgatctcactcaaggtgagcgtctggtggcctatgccaaggccatcggatttaccgcggcccacaccggcaaggattggaccggccgggatcgctatctgttcgcggtttcctgatattttctaaaaatttcaggcttttcctgtcttttttccgcgttttcccggaatcttcttctcattttccgcaattacgccgtctcataataagagcaggttattgcggcttcaaagtcggtctgggtataacagtccgcgatgaacatcgaatgattgagagagacgtaagatgacggccacgagccgcgatgcgattccgttgtatgtggatggacgtctcacgcgcatatcccgcgcgacgattgagttgaacgatgttgaaataccaaggaagaaggaagaggatgaacgtgaagttttccactaagttcattgcggccagtgcggccgcggtaatggcgctgtcccttgcgggctgctccggcggtagcatggatgattcctccagctccaacgccaaggcctccggcgactccatcaccatcggcaccgtgaccaccaactccggtaccgccgccgcttacggcgaggccgaggtcaagggcttcgagctggccgtgtccgagatcaacgccaagggcggcatcaacggcaagaaggtcaagctcgagtccatggacgataagggcgatgccaccgaggcttccaatgccttcaacaagctgtccggcgacaacaacgtgctcgccgtggcaggtccgaccatctccgcaaccactgccgccgtggctccgctggccgatcaggccaagttggccaccatcgccccggccgctacctccgactccatcgaaaccggcaactacctgttccgcacgtgcttcaaggactcctaccagggtgaggtggccgctcgtttcgctgccgagaacttgaaggtcaagaaggtcgccgtgctgtacggcaccggtgacccgtactcctccggcgtgggcgaggccttcgccaaggccgccgagaagcttggcctcgaagtggtggacaaggagagctcctcttccgctgacgataccgagtactccgcccagctgcagaagattcaggcttccggcgccgagctgctctacgcgccgtactactactccgtggctggcccgtacatcattccgcaggctcgctccgtgggcttcgaaggctacgtgatgggccctgacggctacgatggcctcaagctcaccggtgacaagtctcagtacaacaagacctactacaccacccactactccgccgacgacaacaccaacaccaaggtgcaggacttcatcaagtcctacaaggagaagaacaacgccgagccaaacaccttcgccgctctgggttacgacaccatctacatgctcaagcaggccatagagaaggccggcaagaacgccactcgtgaggatgtgcgcaacgccgtgaccggcatgaacttcgacggtgtgaccggcaagttcactatggacaagtccggttccccgaccaagtccgtcatcgtgctggaaatgaaggacggcaagccggtgtacaacaccaccgtgcagcccaagtgaattccatgaattatcgccgcatgattccgatgtcataacatgatgtccgcatgaacaggagagtggccggttcgccgtccctctccctttcgtgttttcatggggcatcgcgtcgcgtcgtacggtgccacattattcgcaatagatataccaataattctgcgcattcatcgcagacaacaatcgaaatacttacaagaaagggggagcagtgatggatcaaatcatcatgtttgtcagccagttgttcaatggcctgaaaataggcagcgtgtacgcgctggtggcattgggctacaccatggtctacggcattattcgactgattaacttcgcccacggcgatttcatcatggtcggtgcctatgtgctgatgctcaccattcccgcaatcgtcgctatgggactgcccgcctgggtggcggtcattcccgccgttctggtttgtgtggccgtcggtgtcatcgtcgaaaaggccgcgtacaagccggtgcgtgaaaagggcaattccatgacggccctgattaccgccatcgccatgtcgctgttgctggagaacggttcccaagccgtcttcggcgccgacttccagaccgtgccgactatcttccacctgccatccatcgcgttcggcaagctgaaactgccgggtgacaccctgctgaccatcgtcatcggcctggtcatcatggccggtctgcaactgttcgtcaaattcactcgccaaggcaaggccatgcgcgccgtttccgaagacaaggaagccgccgtgctcatgggcattaatgtgaactccaccattgccctgaccttcgccatcggctccggcttggccgcagtcgcctcgctgatgtactgcgccgcctacccacaagtctccccgatgatgggcgccatgctgggtcttaaggcattcgtcgccgccgtgctcggcggcattggttccattcccggtgccatgatcggtggtctggccatcggactgatcgaaagcctcaccaaggcctatatcggtaccattacgggcggcatcatcacctcggcattctccgatgccatcgtgttcgccatcctgatcattgtgttgctcgtcaaaccgtccggcatcatgggcaagaacgaaggggagaaggtctgatccgatgaagaagacaatgctttccaccaaacagtcctatctggtgtgcttcatcggcgtccttgccgcattcggcgttgtgatggcgctgtgcgaatccggcttggctgattcctacatcaagggcatcatgatgaccgcgtgcatcgccattatcatgaccacctcgctgaacctcaccatcggcgtgctcggacagctgacgttgggctgctgcgggttcgaggccatcggtgcctacgtggctgcgctggcctccaagtacatggtggccgctggcatcggcatcgatcccaccacccgtttcctgatcaccacgctacttggcggcatcgtggcttgcgtattcggcattctgatcggtatcccggcgctgcgtttgcacggcgactacctggccatcatcacgctgggcttcggcgagatcattcgcgtgatcatccagaacctcaaggtcgccggtggaatgggcctcgacaagggcgccgccggacaggcactgatcggcattgaccgcaccgccaacctgtatgtcgtgttctggatcatggtggtcaccgtggtcgtgctcttcatgttcagtcgctcccggtacggccgtgccgtcaaggccattcgtgatgatgagatcgcggccggcgcatcgggtctgaacaccacgtatctcaaggtgttggtgttcgcgatttccgcgttcttcgcaggcatcgccggcggtatcttcgcccagtacatcggctcgttgaacccgaccatggccggctggctcaactccattaactacgtgatcatggtggtgttcggcggcatgggctcgctcaccggttcgatcgtttccgccatcggcctgaccatcctgcccgagctgttgcgtgccttcgccgattaccgcatgctcgcctactcggtggtgctggtgctggtcatgatcttccgcccgcaaggcatcttcggttcgtgggagctctcgctgccgaggctggtcaaccgcatgctactccgcggaacggctggtaaaggcgcaaaatccgccgccaaggcggatgccgagccggagacccccgagaccgcaacgaaggaggcctgaccatgagcgataacagtcaacccatcctcaaagccgagcatctcggcatcaccttcggtggtctgaaggccgtatccgacttcaacatgaccatcaacaagggtgaactcatcggtctgatcggcccgaatggcgctggcaagaccacggtgttcaacctgctgaccggcgtgtacaagcccactgaaggcgaattctggctggatggcgtccggatgaacggcaagaagacctatcaggtcgtgcgtgccggtatcgcccgtaccttccagaacatccgactgttcaagcagctcaccgttgaggagaacgtgctcgtcgccttcgacgagtcgttcacctaccgtatgggtagcgccatcttccgtaccccgggcttctggaagcaggagaacgagatgcatgagaaggccatcgacctgctgcgcatcttcaacctcgagggactggccaccacccaggcggccaacctgccctacggccagcagcgcaagctcgaaatcgcgcgtgcactggccaccggcatgaaactgctgctgcttgatgaaccggccgccggcatgaaccccaccgaaaccgaggatctgttgcactgcatcaacacgattcgtgaccgtttcggcatcgccatcctgttgatcgaacacgacatgagcctcgtgatgagcgtctgccagcgcatccaggtgctcgattacggccgtaccatcgcctccggcacgcctgagcaaatcgccaacaatccgcaggtcatctccgcctatctgggcagcgacaacaatgatgacgccgacggcgattccacatccaaggctgaaccggagccgagcatcgccaagacgattcaagaagaaggagcacgctgatgctggaaatcaaggatctgtgtgtctcttatggcgcgattgacgcggtcaaaggcatcagcatgcatgtggatgacggcgaaatcgtctccctgatcggagccaacggtgccggcaagactaccactctgcataccatcaccggtctggtaccggcaaaatccggcagcatcacctatgacgggcatgatctgctgaaaacacatgccaacaagatcgtcaccctaggtatggcacatgtgccggaaggccgccatgtgttcacccgcatgagcgtgcaggagaacctggagatgggcgcattcagcctcaaggaccagtccggcctcggcaaggatcttgagatggtgttcgactatttcccgcgtcttaaggaacgccgtcgccagctggctggcacgctttccggcggcgagcagcagatggtggccatggggcgtgccctgatgagtcacccgaagaccattctcatggatgagccgtcgatgggcttgtctccgttgctggtcaagggaatcttcgacatcatcgtcacgctgcgccagcgcggcatcaccgtgctgctggtggaacagaacgcgagaatggccttgtctatagccgaccgcgcttacgtgctggaaaccggcaagataacgatggaaggcaaggcttcggacttgctgcacgatgagaaggttcgcaaggcatatctcggcgcgtaacgccttgcagtgccaatgttcccgctgacggatgtcgtctacaaacgcttgaggcgtttgcttcatggcgacgtacgccggcgggaacattgatatgtgccactatggtacgtgctactgcgcgtaatgctgcagggcggaggcgtccgcgtccgtgatttcgcgaatcggatgggccggattgcccacggccacggtggtggattcagcattgatttcgcttattgaacactcctgtaatttcgcgaaagagcatggatggactcattgtatctacggtctgtgcgtgtggggcgaatcggaaaacggcagtacggcaaacgagcgatgatgaactatgcaagtcggggcgcaatggtgcaatggtagattgtgaatacacaggcgaacggaggtggcgtgagcgtggagggcggaacaacgctgaaggtcacggatgaatcgctggcacaggcggcgcgtgtcatccgggatggtggattggtcgtcattccaacggatacggtatatggagtggcgtgcgatccgcgtaataaggccgctatcgaccgtatctaccggctcaagcgtcgcccgcgctataaggcgttgcaggtactgctcgcatccaccgaccagcttgatgagctcagtctagacctgccgtctccactgaatcgtttgtcggcggcgttcctgcccggcgcgttctcgccgattgccgtagcccggcccgactgcacgttggagactttggccgacaccgccgatggtcgccccggcacgcagggcatccgcatccccaattcggcgctgtgcctcgcgattctcaaggccactggtccgctggccgcgtccagcgccaaccgttccggcgacgaaagcgcacagaccgtccaggaggcggttgatgcgttcggcagcgaagtcgacctgtatctggacggcggtcccacccaaggccatgtctccagcaccgtcgtcaaagccgatccgtatgcgcgcgacggcatcgagatcctgcgtgaaggcgtcatcgcccaaaacgtgattcgcaaggccctccacctcaacggcgggggacttggcgcatgagaatctacttactgattgccgccatcgccggtggcgtcacctggctggtgactccgctgattcgccacgtcgccatcgaaatcggtgcggttggcgaggtgcgtgcccgagacgtgcacaccattcccacgccgcgcatgggcggccttggcatgcttatcggttttgccgtggctaccgtgttcgccagtcggctgccttttctctcgggattgttcaacggcaatcatcagatgtgggtgattcttgccggcggcatcatgatcagtctgctaggcatggccgatgacctgtgggatctcgattggatgctgaaacttgccggtcagctgctgatttccgtattcgtggcctggggcggattgcagatcatctcactgcctttgggcgattcgctgattaccgcctcgccgagtctgtccatggcgatcaccgcattcctgatcgtcgcctcgatcaacgcggtcaatttcgttgatggcctcgatggtctggcggccggtatcgtggcgattggtggcatagcgttcgccgcctattcgtatatcatcgcccggtcttccccgagttatgcttcgttggccacgctgatcgacgtgatgatggtgggtatctgcgtgggcttcctgctgcataattggcatcccgccaaactgttcatgggcgattccggttcgatgctgcttggctatctcatcacctgcgcttcgattgtgatgaccggacgtcttgacccggcctcgattcatgccagcatctatctgccggtgttcataccaattctgctgccggttctggtgttattcctgcctgtgctcgacatgtgtctggcgattgtgcggcgtttggccaaaggccagtcgcccatgcatccggaccgtatgcacctgcaccatcgcatgctgaagatcgggcattcggtgcgtggcgccgtgctgatcctgtggggatgggccgcgctgatcgcattcggttcgctgacgattctgttcttcgaagcgcagcatgtggccgtgggcatggccatcgccgtggtggtgctcaccatagccacgatgtacccctatctgcggcatcgtattcccgagatccaagccgagaacctgacgctcgaatccgcgcgaaagaacgcgcagtattcagtctctaaatcgcagtctgcagtaggggggagccgggattcgattggctctcaggcagcggattcgatgactgattcgcctgcggattcgcgggactcgcaggtgggtgaggtgcaggacccggcagcggataagtgagcgctcacaagcgtgtgtcgtgaaggtcagcgcattttcatatagtgtttacatggctacaaaccttgatgaattgaacgcccagtcggcgtatgctccccttcccccgattttcgccaagctcggccttgcctatgatgatgtgttgctgctgccgaacgagacggatgtcattccttccgaagtggacaccagcactcatctgacccgcgagatcgtgatgaaggccccggtcctctccgctgccatggatactgtgaccgagtccgagatggccatcgccatggcccgtaacggcggcatcggcgtgctgcaccgcaacctgtccatcgacgaccaggccgctcaggtcgacgtggtcaagcgttccgagtccggtatgatcaccgacccgctgaccgtcagccccgaggtcacgctggccgatctcgacaagctgtgcggcaagttccacatctccggtctgccggttgtggacaaggacaacaagctcgtcggcatcatcaccaaccgtgacatgcgcttcatcgcctccgatgattacgacaccctgaaggtcaaggatgtcatgaccaaggagaacctggtcactggtccgtccaacatctccaaggatgacgcccaccgtctgctcgcccagcacaaggtcgagaagctgccgctggtcgatgacgaaggccgcctgaccggtctgatcaccgtcaaggacttcgtcaagaccgagcagtacccggacgccaccaaggatgagcagggccgtctgcgcgtggccgccggtgtcggcttcctcggcgacgcctggcagcgtgcctccgctctgatggaggccggcgtggacgtgctcgtggtcgacaccgccaacggtgaggcccgtctggcgctcgacatgatttcccgcctgaagcacgactccgccttcgatggcgtgcagatcatcggcggcaacgtgggcacccgttccggcgcccaggccatgattgaggctggcgcggacgccgtcaaggtcggtatcggccccggctccatctgcaccacccgtatcgttgccggtgtcggtgtcccgcagctcaccgccgtgtacgaggccgctcaggcctgccgtgctgcgggcatcccctgcatcgccgacggtggcatccactattccggtgacatcgccaaggccctcgtggctggcgcctcctccgtgatgctcggcggcgcgctcgccggctgtgaggaagccccgggcgagaaggtgctcctgcacggcaagcagtacaagctgtaccgtggcatgggctccctcggtgccatggccccgcgcggcaagaagtcctactccaaggaccgctacttccaggccgacgtgacctccagcgacaaggtcgtgccggaaggcgtggaaggcgaagtgccgtatcgcggcccgctgaacgccgtgctctaccagatgctcggtggcctgcaccagtccatgttctacatcggcgcccacaacatcgccgagatgccggagcgtggcaagttcatccgcatcaccgatgccggtctgcgcgaatcgcacccgcacgatatcgtgatgaccgccgaagccccgaactactccggcttccacaacaactgatcggttgatgcccgctagcttgcgctagttaggggttgattccttgtgaaaagggtctgcttatgcaggcccttttcgcgtatgtggctcgagatagcttgtatgcgatggggtatagtctgaactgttcttgtaataacgggtgacatgacgaaaagaggcttaccatggtcgacagccatgatgcagaaacttacagcgcaaaggattcgcgcctgatttggattgactgcgaaatgacgggcttggatatcttcggcggtgacgaactggtcgaagtgtccgtagtgcccactgatttcgatttgaatgtgctggatgaaggtgtggatttcgttatcaagccgagtcagaaggctgtggaccatatgaacgacttcgtgcgcaacatgcacacccgttctggtttgatcaacgaatgggggcatggactgagcctcgaagaagctgagcagaaggtcaccgattatgtgctgcgcttcactccggaaggcgtgcgcccgctgctcgccggcaacaccatcggctccgacaagaagttcctcgaccactacatgccggacctcatgagccacctgcattaccgcagcgtggatgtgagcaccctgaaggagctcgcccgccgctggtacccggccgtctacgagaaccgtccgccaaagaacggcggccaccgcgccctcgccgacatcatcgaatcgcttgacgagctgcgttactaccgtaaggccttcatggccccggtccccgggccggacgatgccgcctccaaggccatcgccgccgacatcgtctcgaccagcatcctcaataagtagtccgccgtacttggctcccctccctgaggggagtctagagaggttgatatgcgccaaaccgaagccttggccgttctgaacgccggcgcgaacgtgttcctgaccggtgcgcccggtgccggtaagacctatgtcttgaacgagttcatccgccaggctcgggccgacggcgccagtgtggcagtcaccgcgtccacaggcatcgcctccacgcatatcaacggccaaaccatccattcgtggagtggcgtcggcgtggccaccgccctgagcccgagtctgctcaaactcatcaaatcccggcgcaaacgcaagattcaggctacggacatcctcgtcatcgacgaggtttccatgctgcacgcatggctgttcgacatggtcgaccaagtctgccgcgaagtgcgtcgcgacccacgcccgttcggaggcatccaggtcgtgctgtccggcgacttcttccaactgccgccggtttcggtgtccgggcgcaaccgcgacctcatcgcccccacccccgaattcatcgccagccgcgaacggtatgcccgtgccgggcttaacccggaaggtttcatcaccgaatcattggtatggcctgaacttaacccggtaatctgctatctgaccgaacagcaccgtcaggacaccggcgaactgctgaccgtgctcaccgacattcgcgaaggcgacgtgacccagtccgaccgtgacgtgctcgtcacccgtctgggcaaactgcccgagcccggccaggtcgccgtccacctattcccggtgaaccggcaggccgacaatctcaacgacatgcgcctgaaccagatcatgcttgagccgcacgagttccacgccgaaaccgcgggtcccgccaatctggtcgaccggctcaagaagaacatgctggccccgagcgactggtactcaaggagggcgcggctgtcatggccctgcgcaacgacaccgatcgccagtacgtcaacggctcgctcggcaccgtgcgcggcttcgcgcaggagaacaagggcggctggccgatcgtggaattcgaaaacggcaacatcgtcaccatgaaacaggccacatgggaaatgatggacggcgacaccgtgctcgcctccgtctctcaagtgccactgcgttgcgcgtggggcattaccatccacaaatcgcaaggcatgacgctcgaccgtgcggttatggacctgaagcgcaccttcgcgccgggcatgggatatgtggcgctgtcacgagtcgaatcgctgggtggactgtatttggctggcgtcaacgaacgcatgttcctcgtctcgcccgatgccgtggtgctcgacggcgacctgcgcgaagcctcggcctcggcctccgaccagttggccgatgaaggtgcaaccgcgttcaaacctgctgagccggacgaatttggtgccaatcccgatgatgacttcgcccaggacgcgttattttgacggtcgatatatcgagcgaccgctaatttgagtgtttctgcacttcgaggggcggattttgagttttcgggacatctacttccgtttcaaggggctgatgtccaagtagacaacgcttaaaaacggcggaatgacgttggtatgaagccgtttctatgtgcgattgagcggatgaccagcccctcgaaacgcaagtagatgtctccaaggggcggaatcggccccttgaagccgaagaagacactgcgaacttgtcttcattgaggaactgaacggctaccatggaataagcggtggtagttatggtgctatccgagatatttcgtggaaacaatgaggttcgcgaggccgcccgggccggtgtgcaaatcgatacggttagtgtggctagtgcgtcagatgcagcaagcgcggcaggcggcagcggcaaaatcactggcgcaatacgtccgtcagcggtggctggttcgttctaccccgctgaccgcacagcgctcaagcaactcattactcatcaattgggttacagtcgagaggttctgcaacagttggagcccacgcttccagcgggagtgccaaaggctgtaatcgtgccgcatgccggttatgtgtattccggcacggcggcccttgcctatgctttgctcgaacgagggcggggaagcgtgactcgtgcggtaattgtggggccgactcaccgtgtggccgtgtgaggcgttgcttgctctaccgcagcggcgtttgaaacgccgctgggcacggtgccggtagatgttgttgctgagcgtaaagctttaggcttggaatcggcttccgatgagccgcttcgttccggtacacatgctcgtccgggggcaccggctcccgcaatgatcgtcaatgaccccacacatacgcaggagcatgccgtggaagtacaaattccgttcctgcaaaccgtgctcggcccagacctcactattgtgccgttgaacgcgggcgacgccacgccacaagagatgggcgatgtgttgcgtgctttgtggggcggaccggaaaccgtcatcgtgattagttcggatctctcgcactatcatccgcacgaagtcgcccgcgcgatttagcgcagatcgccaatacgcgcggcgatcgtcctcatcgatttgaggctcgcctcatagcgcgcggctgccacaatcagaatgatgccgcccaaagcaagccacacccaccagtagtggcgggagaattcggcccgccatggccacagcacagtcaccgtgctgacgataagaatcactgtgccgtagatcaacggtgcttgcagcaaacgcacacccacaatcagcgcggccgctccggacaggccggcgataagatccaccggggcatacggttgcgggttggtccatgcgaggccgagaagtattacaccggcaaggatggtggcgtatgtctcaataacctgtgatgcggtcagccgtcccgacgaacgtccgaatcgctcttgcgcgactgatggctggttcggctgcgtcatcgtgccctcctacccttctagccgtcattgttgcgcgagtgagtccgaataccaagatgaagaccggaatagtgcgaatagcaggcgggcttgtcggttcacgcgaatatcttggaacacatgacttccaatacccttcgtatgtcaaccatgttcctgcgcaccctgcgcgaggaccccgctgatgccgatgtcgattcggccaagctgctgcagcgcgccggctatattcgcaaggccgcacccggtatctggacctggctgccgctcggtctgcgcgtgctgaacaagatcgaggccatcatccgcgaggagatcaacggcatcggtgcccaggaagtacacttcccggccctgctgccgcgcgaaccctacgaggccacccatcgctgggaggagtacggcgataacatcttccgtttgaaggatcgccacgaggccgattacctgctggctcccacccacgaggagatgttcacccttctggtcaaggacatgtactcctcttacaaggacctgcccgtaaccctgtaccagatccagaccaagtaccgcgacgagttccgcccgcgcgccggcctgatccgtggccgcgaattcatcatgaaggacgcctactccttcaccattgatgaagaaggcatgcgcaaggcctactatgacgagcgcggcgcttacgagcgcatcttccagcgtctcgacctgaagtacgtacctgtgttcgccatgtccggcccgatgggtggctccgcatccgaggagttcctggctccgatgccgatcggcgaagataccttcgcgctggcgccttccggcaaggcatggaatgttgaggccctgagcactccggagctaccggaaatcgatgcttccgccactcccgccgcttccaaggaagccaccccggatgccaagaccatcgataacatgatcgagcgtgccaacgccgaccacccgcgtactgatggccgtgaatggcaggcttccgacatcctcaagaacgtggtgatcaccgtcaagcaccctgaggatgaagagcatgacgagccgtggcgtgaagtgattgtcgtcggcgtgcccggcgaccgtacggtggatatgaagcgactggaagcccagttcgctcccgccgagcttgaggaggccactgaagaagacctgaagcagcaccccgaactggtgccaggctacatcggaccgatggtgcttggcccgcaggccgaggctgctggcgtgaagaacccggttcgctacctggtcgacgcgcacgtggtcaagggttccgcttggttcactggtgccgatgagaacgaggtcgactactacaacctggtgtacggccgtgacttcaaggccgacggcgtggtggaagccgttgaggttcgccacggcgacatgagcccggacggttccggtccgttgagcttcgagcgtggtgtggaaatcggccaggtgttccagctgggtctcaagtactccaaggcactggacctgaaggtgctcgaccagaacggcaaggccgtgccggtgtggatgggctgctatggcatcggtgtttcccgcgtgctggcctgcatcgccgaaacacaccacgacgaagccggcttggcttggccgtccgtgattgccccggctgccgtgcacgtggtggccaccggtaaggacgccgtggcgtttgaaggtgccgagaagctggtctccgagcttgaggccaagggccttgaggttatttacgatgaccgcaagaaggtgtctccgggcgtcaagttcaaggatgccgagctgatcggcgtgccgctggtcgccgtggtcggccgcgattacgtcaacgacggcaccatcgaactgcgcgaccgcaacggcgaaaacaaggtcgccgtgcccgccgccgaagccgccgacgcgctcgccgagcgcttcgccgccctcagctgagtcccacttactcagcctcggcgttaatcgcatcaagcgccattctgctcagtcgcagaatggcgctttgttgtggataaccgaaatttatccacattcttaaaatttcaactgcgtcacagtatccacatttgccagttgcccttgtgcgcttcaaatgccatgcctcacagtggaggtaccgctggggcgtgcaagccggcaatgaagccggagacaggctccggcggtccacatccaaacaacaggccagcaggccgaggaaaggaccgatcatggcaaatcaacaagcagcagtgaccgtcaccggctttgtggccggtgatccgacactaggcggaactgagagtttccgcgtgttgacattccgtatgggcagcacgcgcagtcgactcaacccgactaccagacaatgggaggattacggaaccgcatgggtgggcgtcaaagcgttccgtgctttggccgtgaacgccgccagttcggttcgccgcggtgaccgcatcattgtggtcggctcactcatcaccgagcagtggaccaatgagcaaggcgaaccgcgcagtagaaccgttctcgaagccaccaacattgggcatgacctgaccttcggcaccacgtcgctgatcaagccacagcgtgccggtaatgggaacggaggcaatggtggcaacggtaacggcaatgccaacggtgccgccgaaggcatggatggcggaaacgggcaacgagcatcgtcaccgcacatgaggccaacgcaatatagtgtggacggtgccgcatccggtgtgggtatggacccgtatgcgacctcgtcggaatctggccccgtcgaatttggggtcacctccgattccggccaatcgccgtcgccatcaaccgagtcagcggctgcgtccatggccgatgccgtcatgtcgcaaccggacgctggtgctaatcagccacagtccgcagcccaacaaacctacgtcgacggtttcgccgaatcttccgatcccagcgaatccgaattctgagtgccaaccatacatcatgaaaaaccgctgtgttcgcctgtaatcgaggcaagcacagcggttttctcttacataacggggattaccaaatgctcacacggtccttgggcgcgagccacatggcgtcgccttcggtcacgccaaaggcatcgtagaagaggtccacgttgctggcgatgccgttggtgcggaattcggctggagaatgcgggtcgatctgcaggtactgttcggccagctcgtcgcggttcttggtgcgccagatggaggcgtagctcaggaagaagcgctgcaggccggtgaatccgtccatttcgggggcggtatcgagcagtgccttgatggcggcgggggagccgtcttcttcggcgtcgggcttacctgccgccttgccgagcgcgaatgcatacgccttgagcgcgatgttcacgccgcccaaatcgccgatgttctcgccgatggtcagcgcgccgttcacgtgcggcgccttatcagactcgtcagcgtacttctctgccagctgcagcggcacaaagctgttgtactgggcgatcaatgcgccggtgcgggcctcgaagttcttgcgatcctcgtcggtccaccagttgttgagcttgccgtcgccgtcatactgcgaaccctgatcgtcgaagccatggccgatctcgtgtccgatcactgcgccgataccgccataattcgccgcatcctcggccttcgggtcgaagaacgggggctgcagaatcgcggccgggaacacgatgacgttcatgctcggctcgtagtaggcgttcaccgtctgcggattcatcagccattcgtccttgtcgaccgctttgccgaccttggccagctggtagccggtctcgtacaggttcgcggccttggcgttctcggcgggcagcgcatccgcggagacactcagtgccgagtaatcgcgccagtggttggtgtagccgatcttcggcgtgaacttggagatcttctccagagccttggccttggtgtcttcgcccagccaatcggaattggcgatggacacgcggtaggcgtcaatcagattggcgaccagctcttccatgcggcgtttcgagctttcggggaagtgcaggcgcgcatactcgcggcccacatcttcaccgcagacgccgttgaccaggctcaccgcgcgcttccaacgatcgcgctgcttcttggcaccggagagcaccttgccgtagaagtcaaagttggtggtgtcgaagtcgcgagacagggaggaggcgaagcccagaatcatgtgaacacgggcccacagcttaaggtcggccagatcggcctcggcccagaacgcatcaagaccagtgaggaagctcggctcgtgcacaatgatgcgcgcgaacacagacttgaaatcgatcgactgagccttggcagcctcggtggcgtcataggcggtctgccaggcgtcgatccaggaagcgagatcgaagttcttcagcgtggcagccaaatcggcgtaatcggtggggttgtaggtcttcaccgaatcgcgcgtggccacattgtcccaatgattggcggcgatcttggtttccacggcaaggaagtgtcgggccatatcaagtgcggcttcgctgggaaccgtggtgggagcattgctctcgtcatcgccggtgttggccggcagttcatcgccaccgttggattcggcggcgggcgcgtacccggcgttcaccagctgggtggcgaccatcgccacgtatgcttcgcgcacggggacgtagtggtcctcacgatagtaggcttcgtccggcagacaaaggccggcctgctcaaggtgggcgatattgcggtccgggtcgccggggtcgccgtaaacggccaagccgaacaggtcggggccgccggctgggttgatggtgccgagcacgcgcgtgagagcggccttgtcgatggcggaatcgatgaggtcaagctcatcgcggatcgggtcaaggccggcggcctcgatggcgtcggtgttcaggaacgaatgatacagagcctgcgatttggtggccgggcagtcgtcggcgtcgaggatgtcgcgcacttggttttcggcgtcttcggcgagcttgtcgaaggagccgtagcgcgaacgatcgtcgggtaggcggtaggtgtcgatccatggaccattcacgtagcggaacaggtcattggtcggcttgatgacggaggagaacgatgccgggtcgatgcccgacgtcagcgtttcggtttcgttggtcatggccctaagcctaatcgcggcgggggagaagcgttggtgatgcagatattgcgttatgggtattgcgctgtcagtgaactagacggattgcctaactgtagtgatggttcaaattaggtaacttgcctaacatggtatgtggaatctgaatatggaccttgagttaaggagttacgatgagcaatccaaacgagggtcagtggaatggccagacgggccagcccaaccagagccagccgagccagccgaatccggcgggccaaccgggccaaccgcagtatggcgcgtatgacagcaatcatggcggccaatatcctccgcaaggtgcgccgggagcgcaagacactcagaatcagcaggcgcagaacggccagccacaaggcggaccgaaccagaacccgtactacggcccgtacgcctacaatccgaactatggcccgaacggccagccagcatggggtccggacggtcggcggtatcaggcggacggccaatcgaatagccaagcggacgggcagccgaatggttcatggggcgatcaaagtcaacccggctggcagcagaccaactggtatgtcggcaatttcagtccattccacctgatcgaggaatggctgccggaaaaggccaagaccaagattcgcatcatttacggcgtggtgggcgtggctgccatcgccttgggcgctgcgctgttgttggtgccgaacaagacgctggctttggccgcattgttgctcggcgtgtatttcgtgatttccggcgtggtgcgcatcgtcagcgctctcgtggagccgggtctgccgggcggctggcgtgtgctggacgtgttcgtcggcattctgctgaccttcggaggcgtcgtagtcgtacgaaactacggtatgaccggtcagaccttggcattactcatcaccctgatggtcggtttcggttggattatggaaggcgtgatggctctagtcgaatcatggcgcatcccgcgctccggctgggccatcgcctatgccatcatctcgattatcgccggcttcgtggtgctgatgagcccgctgagctccgccgtattcatgattatcttcggcggatgtgccatggtggtgatggggattacttcggtgattcgcgcgttcactttcggcaagcgtcgcaagtaatctcgcgctccagacaatcaatctccggacaatcaatccaaagcgcccgtgcaggttatgtatctgccgggcgctttttctcggccttggccgttgataggctactagcggaccctaggcagaccacgggtgatgctctggcggttgaccccgggctgggctagagttgagaacaagtctcaacaaggtagaaagaacctcatgatcgaattgaagacccctcgtgaaatcgaggagatgaagcccgccggccgtttcgtcggcggcattctgaaggaactgcaggagaccaccaaggtgggcaccaatctgctcgaaatcgacgagttcgtccacaagaagatcgtggaccgcaagggcgccgaatcctgctatgttgactacgctcctgacttcggcaccggcccgttcgcccactacatctgcacctccgtcaacgacgccgtgctgcacggtgtgccgtacgattacagcctgaaggacggcgacctcgtctccctcgatctcgccatctccgtggatggctgggtggccgattccgccgtcagcttcgtggtcggcaaagacccggaccccgaagacctgcgcatcatcaagtgcactgaggaagcgctcgccgccgccatcgacgtggccaagcccggcaaccgtctcggcgacatctccaacaccattggcgacatcgcgcgcgaatacggctacccgatcaacctcgagttcggcggtcacggcgtgggccacatcatgcacggcgacccgcacgtaccgaacgacggccgcgcccaccacggctacaagctgcgcgaaggcctggtcatcgccatcgaaccatggttcctcaagaccaccgacgagatcttccaggatccgaaggacggctggaccctgcgtgcctccgacggctcgcgcggtgcccactccgagcacaccatcgccatcaccgagaacggcccgatcatcttcaccgatcgcaccaacctctgattggcgtttggcgtatggcgggtgcctgattggcctgtgatgggcgatcggcatctcatcaaccgtctatatgtttgcggttttcccgcgaattcgagacgtaacaagccgaagtgcgtttgctttgatagcatgagcgcacttcggctttcgtgtatcgaccggtgtctgccggcggtaacacagaagacataaagtaccgaacactagcgttcgcgaacgcgtgaacgttaatgtttggggtaagtggttcatgaagaggaaggtgcgcgaatggcaacggcacaacttgatgtcgattcgaacaagttcaacctgcccgtggtgaaggctagtgcagggccggatggcatcgtcgtttccaagctgcgcaatgacggctgggtaacgctcgaccccggattcctcaccaccgcacagtgcgaatcgaaaatcacctacatcgacggcaagcattcgatcctgcgctaccgtggctaccccatcgagcagttgtgcgagaactccgattttctggaagtggcgtggctgctgcgccacggcgagctgccgagcagggctgagtatgagcagttctgcgcggacatcaaccacaagacgatggttggcgaagacttccgtaccttcatgggttcgttcccgcgctccgctcatccgatgagcgtgcttgcctccgccatcaatgcgctggccacgttctatccggacaccaccgatatctccgacaccgaccagctcgatgaggccgccaagatcatcatggccaaggcccgcacgattgtgtcgtacatcttccgccgtcgtcgcgatgagccgatgctgtaccccgattacgcgcgtggctatgtggacgacttcctgcgcatgtgcttcgctgtgccgtacgagccgttcgaatctgacccgttgtatgtgcatgctttgggtcgtttgttgattattcatgccgatcatgagcagaactgctcgacctcggtggtgcgtatcgccggttccgcccacgctaacctgtattcggcggtggccgctggtgtcaatgccctgtccggaccgttgcacggtggcgcgaatgaggccgtactacgccaattgaaggcgattcgtgattccggcaagtctgtggccgagttcgtgcgtgatgccaaggaggatggccagaagatctccggccttggccaccgcgtatacaagtcgtatgatccgcgtgcggcgattgccaagaagtatctggaaaagatcatggagcgcgaagatacgcagaagctgccgtctgacgagcgcgcgctgttcgctgtggccaccgagcttgaagatattgcgttgaacgacgagtatttcgtatcgcgcaacctgtatccgaacgtcgacttctacacgggcttgatttatcgggcgatcggcttcgatccggccatgttcaccacgctgttcgcactgggccgcattcccggttggattgcgcagtaccgtgagatgctggccgacccgaataccaagatcggccgcccacgccaggtctacaccggtccggtcgagcgcgatttcgtgccgatggacgagcgctaaatgctctgcgtggtccggtgatgccggtttgttcgatatgtgggagctgattgctcgctacatgataatttgcgtaagaaatattgattcacccgagggtttgccccgctgagattgtgttagcgaagcaaaccctcgagtttgttgtgactatgccgcactgagagggctttagcggggtggtttgttgacttagtcgcggttttgcttcgctgatatcgtcttatcggtgcaaaacccagggttgctggtgggtttgccccgctgagaacatgtcagcggggcaaaccctcggttagtaagagaaaacgcctcactggaataccaaatgaggcgtttacataaccgctaggcacccaatatgggctgactgcttagttcttatgcagcttttcgttgagctcgatgcccaccttgcggtagcgggcttcgatgcggccgttcaccgagttgcggataaacagaatgttgtctttgccggagagctcagcacccttgaccacttccagcggttcgccagcggcggccttggccttgtcccagatggtgatcttggtgccggcggtgatgtacagaccggcttcgacggtgcagttatcgccgagggagatgccgataccggcgttggcgccgagcagcgagtgctcgccgatggagttgcgcagcttgccgccaccggagagggtgcccatgatggaggcgccgccgccgatatcggaaccgtcgcccacgaccacaccttgcgaaacgcggccttcgaccatggagacgccgagcgtgccggcattgaagttcacgaatccggcgtgcatcacggtggtgccggaagacaagtaagcgccgaggcgcacgcggtcggcgtcgccgatacgcacgccggtgggcactacgtaatcgatcatgcgcgggaacttatccacaccgagcacgttgacggtggtggcaggagctgcggcaggcagtccggcctgggaggcgaaagcgagagcggcttcggtggaggcgcgttcgacgtcggccttgcgcagcgtgaagtcttcaacggcgaaggggccgtagttggtccacaccacattggcgagttgggtgaagatgccgtcgaggttcagcgtgttcggcttggccatgcgcatgctcatcagatggagtttcaggtaagcgtccgcggcgttgctgatcggctcgtccaactggctgacgacgaataccggcacgcggcggatgccacgggcgtcggcttcatcgtgagccagagtgccgaaattgtggtttggacgatcggcctcggccggtgcctcaccgagattcagttcggggtaccagacgtccagggtggtgccggcggcgtctacgctggccagaccccatccccatgcggtacgctcttcgctcatagttgctccttacatatcgttgcgtttgcattgcatgtgcatcgcggcatgtgatggttccaccttagcgtcaagtacggctaggcgggggccatagttcgtggaatggcttgaaatcgagttgttcggtaaaaaattaccgaacgtgattggtggtgggatgataggttctccggtgaaattcgctggtgaacaactcgacaaggaggtgtgcgatgtgatgttgcatcattcgggagcataggctgtggccatgcgacgcccggcatcatagagtttgcgcttgagcgaatcgggctcaagaatcactacgcggccatcccaggaatactgcaatgcccaccagaacacagcgcgttcgggagcatcgacgatgacttcgaactgtgtgccgtccgccgaatgtttgatctgagggtcgtcgaaccattcgaacacgttgttgagcatggattcgtctcgtacggccatgcggatgcgaatcggggcatcggctacgggatacgggcggtgacgcatgaagttcactgcatcaaaatcagccggcgctggtttttccagtggcactgtgccgttcctgcctttggcgctgacgttggcgattcggttgaccacgaaaatgcggagattatcctcgccatgtagatggcagatgaggtaataccgtccgttcttgtacaccatctggtaagggtcggcggtgtaggtaattcgacctgcgcccgtacggcttttatgcggtatcagggtgccgtccgggccgtaatcacggtattggaaggttacgccgtggccttcttcaatggcctgattcagttggtcgatggtggataggaactcgccgttgatatgcgtgtaggtggccacgtgctcaaggtaacctactgcttgcccagcggcacctgcgagttcgcggattttaccgatgagatcgtccatggtgtcgaggctgatgcgagacaaggtgaggctgtcgagtagcagtcgcatttcggcggtggataggaatgcgtcaagataccagccgggttgtggattcttgcattcgatgccggcaaggtcgctttcggtgagatgcccgatatgcctgccgaggaattccgtggcggtaagctttttgagctgatttcgtatggttttctcggtcggcagctcgcttggatcttccagctggtgtttacgggcaagttcatcgagtatttgccgcacggtcaggccatgtccaaagtagctgtgacgccacagcacctcgaagatttcgagcgtggtgttccctgcataggatttgcgttgcgccggcttgtctgcatccatgcattaaggctaccgcgcgcttcgtctaggatggaagtgttgggctgaaatgcattcgctggaaaggaggctcgcccatgagtaaagggtatggtgtatttggccatgttcccgataatgcggatgacgatgacctcctgccttatgaggatgatgattccggcgtttcctggggccatgcgttgcgccgtcgcaatccttggaaaaggggaggcgacgaaggtgccgattacgacgatgatcggtatggcgcagatgacacagatgacacagatgacactaatgaggacaggagtctctttgccggcaagagcagcggtataggcggtatctctggcgaggcagatggaatgcttggtggcgcaggcgctgccggcagtagagccgtaacgtttggcggaacggacagtttgtccgccgccgatgcggttatgccctatcgtttcaggcaaggacgttccgtatggttcgaagatgaggacgaaggccatttcgccggggctgcgaagcgtgccgaagcccatgccgtccctatccttgcgttacgcaacgatgtggaatcgtcatcgtcgaatgccgtgctcgctcgtgcccgtagcattgcgcgcaaagcggccaccatggttatcaatccggtatacagcgaaaatcatcgaaccgggtatgccgagcttgacggcattctacgtggcaccaccagcccatcgagtaagtatcgtaccagcgtgcaattcgacctcgacacgggagaagccgtcggtggcaagtgctcatgcccggcttacggccgtggctatggcatgtgcaagcacatgattgcgctcgccttcatattctgcgatgatccgcagcgttttgaagggtaccgtgccggggctgtgaggccgtctcggacgctgattgactatatggagcacgtcgataggcaagatgctcaagccaaagcgcgtcgccgcaatgcgctcatgcgccgattcgatactgcaaaaggacgaaatggcgcaggtggacgacatacgaatagcgggtatggctctcgtgccggcacccgcggcggcgggtatcagggcgatagcgagactgtgggcttgggacaggtgcagcttgttccgatattgagtttcatcgatggcgtgtggagcgtggagttcaagatcggatcgacttccaatgggtccagctatgtactgaaatcgattccgcaatttgtgcttaccatggcgaacggcgactatacggattatgggcagaagcttgcctttacccatacgccggatatgttcgacgatgattcgcgcccactgctgggcttccttgacgacgcgatggccgtgcgtcgtgcggccgagcagcaggaccggtattacgggcatatcgccatcgatcgtcacctgacactttcagcaccggaagtggcccggttgctgtccgtacgtgagggcagaggcgtacagctcgtgttgaacacatggttctccgggcagcctgcatcggtgccggttgatggtggcgagccagattttctcatgcgcattgcgcggcgtgatttcaatacgtatggtccggatgccggatacctgcttaccggagtgccagcggtggaaaccgtgattgacggcggcaagaatgtatggctgttgctcgcctccgctaatccggccggtgtggtatccgccatgatggcgggctctcagcgtaaaagcgcagcaggatgccgattcgtccgttgcccgaaacgattgattccgttgcggggattactgggagacatgtttgaacccgatggcgaggggcaggtcatcgccggcgatgacatcgccctgttcgcacgcacgctattgcctcagctggttggcgccggattgttggaggccagtgagattcctcgcgagctggctgaattaagccctacggaatgcagtctccagttttatctggatcgcgatgagcatggtgtgcaatgtgaggtcaaggcacgctacggcgatgccattgtcccgttgctacccgatggcccgacggtgcatgctagggatgagcgttccatccccttgtctcggggcgtgattgggcgtgatttcgacgctgagcatcttgcgatcgatgtagtacgtgaattctttaccatgcctgaccagcgcaagcgcgttgcggccgccactcatcagacggtgaatgggttccgaacgccggccgcgcgaaagaccgccaaacaattcgtgcctgatgcggccactatcgatcgcgatgacaccacgcagattgttcgtctttttgacgagggattgcccgcactgaaggaagtaggggaggtcttcaccacaccggcttttgaccggctgatcgcgcccaagccgccaagcgtcaaagtcggattgtccatcaaaggcaatttggtggagatatcacccctcgctgatgaagtaccgccggacgaagtgggtgccttgctgtcttcgtatcgtcggcgtcaacgattccatcagttgaaggacggcacgctggtcaaactcagcggcgcgaatctcagcacgttggaccgattggccagcgaccttgatctgagcgagcagcagctcaactccgggctgatcgagttgccgggcggtcgagcattcctactggatggtgagctgccggatgacggctccgatgtagtcaaggacgcttcgttcaccgaatacatcgacgatctcaagatcatcgaccctaagtcgtatgaagtgccggatagtctcaagcatattctgcgcccttatcaggtcgaaggcttccaatggctgaacacgttgtgcgacaagggttttggcggcattttggccgacgagatgggtttaggcaaatccgtgcagcttatcgccctgttgctgtcgcgataccacaacgaatctagtggcatgccgaccgctcaaggcatggatgccggtaatgctggtaatagtgaatcagccgtaaccggtcatattactttcgattccgaagatggcgggtcgcatccatcattgatcgtgtgcccggcgtccttggtgtacaactggggtgccgaattcgccaagttcgccccgagcttcaacgccgtggtggtggccggtaccaaagccgagcgccgcaccgccatcggccgcgcgttccgggcggatgaacccaccgtgctcatcacctcatacgacctgctgcgccgggatgtcgatgattacaccgccaatgagcaacgtttcaatgtcatggcattggatgaagcccagtacatcaagaatcacaccacgaagatagccaaagcggtcaaggccgtggccgccgaccatcgtttcgccttgaccggcacgccgatcgagaaccgactctccgaactgtggagcatcttcgacttcctgatgccgggactattgggctcatacaagcgattccatgagcgctacgagttgcccatctccaacgcccgggctgcggatggcagcacggccgaaggtcgggccgccgcacaggtcaatcctgaggccgcccgggtgtctcgccaattgcagtcgttggtgggcgtgttcatcaagcgcaggttgaagtcccaagtgctgaccgatttgccggacaagttggagaccacgctgaccgtgcagcttgccggcgaacagcgcaaactgtatgcggctcacgagcagcggctcagaatgcagctcgaacacagcgaagaagccgatttcaacacgtcgaagattcgcatcctcgccgagctgaccaagttgcgccagatctgctgcgatccaaggctgctgtacgccgatgccaaggatcagtcagccaagctcgccgccatcaccgaactggtggaaacctgcgtgaatgaaggcaagaaggcactgatcttctcccagttcaccagcttccttgatctgatcgccgaacgcttcgacgcgcaaggactacgctactacaccatcaccggatccacgcctaaaaagaagcgtctcgaactcgtcgaccagttcaatgcggacgatacgcccgccttcctgatttcattgaaggccggcaacaccggactgaacctgaccggtgccagcgtggtcatccacgccgatccatggtggaacgctgccgcgcaggatcaggccaccgaccgagcacatcgtatcggccagaccgaagacgtcaacgtgtatcaggtggtggccaaggacaccatcgaagaacgcatcttggagcttcagcataccaagagcgagctcgcccgccagttcaccgatgcttccttgcttgccgacgaagccggcaccggcgccagcgccctcaccgaagctcccgcctccatcgccaccctcaccaaggacgatctcctcaatctgctgggatgagaagatcctgctcggtgctcttgagcttgggaggcggaaacagtctgggctttgtggacccgttcgctaagccgagaccggagtcgatagcggtgtggcatggtgcgtgcgtggggagcgtgattcagttgttggctgaggcgattcggacgctgtcgttttgtgctttgttttgccgttgaccaattgaaatgctcgttggtaggagacccccaataaagctccgatttgtcgatacgtgagtccctcgttgcgtagggcccgtgcggcgagtcgggattcggcagccgcttgtgcgttggctttttttgctatttcgcgctgccggaacatttctgttacgtgttgtttggcttgtttcggcaacacaaacgtcaccttgagctccggattgtcgtcgtcgttcatgacagtgatgagatctttagccattggctcgatatcgtcaagtcctttggcctgggtcgaccgttcgatagctggtacctgaacgtaccaatatcggccatcgggttgcacaagcacgtcatagttgctcattgccaccacccctttccgagtttctgctcgctctcgttgatgatatccagcgtggttcgttctgagacttcattatggcgggggatgggtatcctcaacccgtccaggcagtaaacctcatgtctgctgccttgccgtaacaaatagaaatcgagccctcgctgctttgccgcttgccgaagtttcttgatgatgagttttcttcgtgtcatcataactctcaatctcgcactagacaaaatgcgtatgccgaattgccgggtgggagttgtgggtaaacgtagagatgttcattggtccttctttctgttgtctgacgcgtcgttacgtgcgggtgcatctgacggtatgggatgaggtttctgattggcaagctgaacgggggtatgtggttctagcttccgagttatccacattgataaagtgctttttaaagtgactttcccgtgttggtcgtggatgctgcgagcaaggcaagaacggtcgatcacgtcgcgatgtgtgtgggtgaatggtgaaagtgattttcgatatttttatatcgatattcgatatattatgatggtgacatacggggcagtgcaggttcatccattgatattggattaaggagcatagccatgaacgctggtatcgcattcatctctcgcaaatctcgcaaagcagacgtcgcttggcgctatgccattgcacttggtcggtggcgggggagtcggcgttatgttcgacgtcagtgccgtcattggcagatggcgcaaccgccacgaacacaggggtctgatcgttggccagaatcgccttcaattcctcgtccgtgtatttcttgacaccgcctttgaacagatccggtcggccggcatgatgcacttcgagcacctgccgcagcagttcgtcgatttggggaatatcggccgccgtggccctacgaatcatcatgtcatccatttgattcagtctgatcgtgcagtctcgaccggcagatgatcattgcccgcgataagagacacgggcgggcaagatgggtgatcgttcgctcaggctttcatcctcgccgcaacgtcacggtagtctggagtgcgtgaatcgcaagaaacagccagtggagaagtatgagcggggcacccgttcgtacacgatgtcgcatattcgcggcaaagacaccaaaatcgaggtgctggtacgcagctacctgtttcgcaagggtttgcgattccgcaagaacgacaagcgttaccccggccacccggatgtagtactgccgaaataccacaccatcgtgtttgtcaacggctgtttctggcacatgcatgaaggatgttccaaacattcgatgccgaaatcgaacgtggaattctggcaggcgaaactactgcgcaatcacaatcgagacatcgcgcagcgagccgaactggaggccgctggctggcgtgtaattaccgtatgggagtgcgaattaacgaaagccgtgcgcgacgaacgcctcgcacggctgtatgagcagattgttgaaggagatgcagattcagcggaataatttcagctcccctctggaggggagctgaaatcaggattcaaacgggaacttcaggccccagcggtcacgaatcgcatccatcagctccatgatgcggatggtgtcggcgtgcggcatcgcctcgcattcgatcttgccatccagcagcgcgttggccgcatcggccacctcatactcataaccggtcaactgcagcggcaccgcaatgctgcgcacgggcttgtgatcgttgttgtagatatcgatggactcgggattgttgatattggtgaccaccaaatacccttcggtgccccacacgtagccgccgcgatcggaggaaaccagcatcgaactggtggacacggccatcgtgccatcatcgtaatacaacgtggtggaattctgcgcatccacaccggtttcggcgggcaccatcgacgtatcgaaatgatcaagtgtacggccatggtcggcaccgatcgccatatccaggaagttcagcggatacacgcccacatcgagcagcgcgccaccggcacaggccggatcggtcatacgtgccttgccggacaccggatagcacaggttggcgctcgccgctttcacctcgccgatctcgccggactcgataacttcgttgatgagcttgcggctgggcatgtagcgcgtccagatggcctccgtgcacagcatgccggtttcctcggccacggccagcgcctcacgtgcctgtccggcgttcgcggtgaacgacttctccaccagcacgttcttgccggctttcatacacaggatcgcctgttcggcgtgcagactgtgcggggtggcgatatacaccagatccacatccgggtccgccaccaactcctcatacgatccataagccttgtcaaaatgccactggttggcaaaagcctgcgcgcgcgtaatatcacgggccgccaccgcatacgggtgaatccatgaggaatacagtgaatcttcagccatctgggtcagggtatcggccatggtgtgagctatgcggcccgcacccagaatcgcgacgttgattttttcgccgctggcctcgaactcggcgcgcttgccattgaatcgactcattattcctccttgaatacgggttggtacactcaatcgacctacagtgattatagaagaagagaccttgtcccgtgaggcggatagaaccgaaatatggaaaacgaagcagcgcagcagccccaatctccggccgcgtctccagtcatgtcccgccgagcgcgtgaggccaatcccttccgtgccatggtattcggcgaacaagcagacaagatgctcgcccaaggtatcagcgtcatcaaattaagccttggcgagcccgatttcggcgcgccgcccgccgtacgcgacgccatgcgcgaacagtacgacggccgggccctgccgtacaccgccgccatgggcctacctgaactgcgccaagccatcgccgacttctaccatgaacgtcacgaccttgacattgaccccaagcgcatttgtgtaacagccggcggttcggccgccctgctgttggccaccgcgctgaccgtggaccccggtgacgatgtgattgtggccgacccctcctacccgtgcaatcgcgaactcgtgcgctcctttgaaggccaggtcatcgacgtgccgacctcggccgccacccgcttccatctgaccgccgacctgtgcagccagtactggacgagcaagaccaaggccgtgatgatcacgtcgccgtccaaccccaccggcaccaccatcgatttcaccgtattggacgaggtgtgcaagctggccgccagccgcggcgcatggcgcatcgtggacgaaacctaccttgatttggccgaccgtgagccggacggcaccgaagtcaagtccgtactggcctgcgatcccggtgccatcgtgtgcaacagcttctccaagttcttcggcatgaccggctggcgtctcggctgggctattctgcccgacgaccccaccgtgctggaagcggtcgacgacctggccaccaactactacctgtgcgcccacacgcccacgcaacatgcggcgctcgcctgcttcatgccggaaagcttggcggaatgcgaagctcgtcgtcaggaattgctggcccgtcgccgcattgtgattgacgggctcaagcgcatcggtttgccggttgaagtcgagccgaacggcgcgttctacgcctacttcaacatctcccgcactggtctggatgcctggacgttctgcgaacgtgtgctggatgaagcccatgtggctctgactcctggccgcgacttcggtgcggccacggcggatacgcatgtgcgcctgagctatgccgcctcacgtgaggccctgaccgaggggctggaacgtctcggaacgttcgtcgaatcgctgtgaaccgtgcggcagccggtgtgattgttgtacagtagtcgaatttgtgtgatgtccggctggcctcgcggtgttggttgcctgccgaacgactcgccatggtggcgcacgggctgactgattgcgatggtcgtcccgttgttcggccatcacgggttaggtaaggtcaggaatagggatcatggtcaatctgcgttcgcacaccacgcgacttggtgtgcttgatatcggttcgaacactatccacatgcttatcgtcgacgccgccccggcgctcgccctgaacccgaggccagcaccaaatccacagtgcgcctgatgaagtatttaaaggacgacggctcaatcaagaagtccggcatcgaggcgattctggaagccgtgtcccagtgcatgcggttggccgaggaatacgaaatcacccaaccgccacagtcaccaacaacgccgcatgatcggagccctcgactttgaccaccttgcattgcccggccttcatgccctgatcaagcaccacgtggtcaataccggcgaacattggcacagtcgcacggttcgtgggccatgagaacgtaaacccatgtccggattcacgtgcggcatccacgaaccggtcgccaagaaaatcacggaatggtgtgtgatcgtaagtggcgttgaaatcgcccatgaaaatataccgtgtatccgtatgcctgcgcatcagacccaactcatccagcgatcgcttccactgccgccaatagcccggtacaggtgcagtggtgtgcacggatatgaatcgaatctgctggccacccatatccaccgtgccgccgggcatgaatgaggcgctggaattcacgtcatcgtcggccggatcggcaagtggcgtggccgaccagaggccgttaccgaatacgccgtcagacgatgagacctgcgcatacggcagatagtgctcaataccagcctcgttgagttttttgacgaaatcctcggtggtctcctgcaaagcaagcacttcgacgcgctgatcgcggaccagctcgacgatggcttgcggatcggcctgccccttgtacacattgaaggtcatgacgcgcgcataggcgtcgctggtgttgggggaggctacggccacggcgttctgcgcggcttgggaaagcggatcggctgagtagaagaacggatactgccaatagccattgcacgcgattgcggcagcggcgatcaatgcggcaaggatacgtcgcgacacgatggccaacagtagggcgatcaaaccaagcaacatgaaccagggcgttgccgataccacaatcggcacaaacggcagttcctgcaaatcggcaggtagcgcgcgggcggcagtaccggcaagggcaagaagggcgaatatcgcggcaagaaaaccaagcagatggtgccgtttacgtggccttactgcggacttggatactgggcgcgccgtggctttggcagagcgtggcttggaagtggcgcgggctcgtacgcttgcgcctgtggtcgtgctccgtgcctttgccatactgccctttcttttggctcgcctgtcgttaccttgcttttcgtgcgatttgccactgtaccgtgtgcggcttgtctttcggtgtcttttcgccatgcgcaagagcagttcgcaccaaaccggcacgaaaaccggccatgccttggtgccgggttctgtcaggtggcttgcatagactgccatgcggcttacgcaggctgccacgcgaacatgatgcgactgggcgtgcggccgtgtacaatgaaacgtcgttgcccgagtagctcagtggatagagcaccgctctcctaaagcgggtgtcgtcggttcgaatccgatctcgggcacttgtctttggaagtgtggcggtacctcaatctctatctatcggtgatgaggcgcaacgtacgtagtcattgacggttatctcgtagtaatattcacaatacgaccccttgtccataaagtgaaaataacggctggtgttcgacgtgtctgcgctatgactagaaaccatgagtgaagataagcagtatgacttctatgtggccggtccgttcttcgatcctgaacagacggcaagtatggaacgtttggaaaagatactggaagaccatggcaaggtactgttcaagccgcggtttgccagccagatcgaagaagcagggcctgaaggatgctttgcggacgatatccgtggcattaatgctgctaaggccgtggtcgccaatcttatggacgaggacccaggcacgatgttcgaaatcggatatgcgcatgcgctgggaatcccggtgtacggctatttcgagaaccttacgccaatggatcgtgtcaatctgatgattgcgcaatcggtcgaactggttttcgccggtcctgatgatgtggcgaaatacttggaaaccggcgaacatacggaagtcgattacattcagttctaaacagctctaacaggttctctgcaagcagggttggcggcgttctcgtacattgtcatgtacgagaacgccgcagtggtatagggatattccaacaagcggcataatggagtcgtgggaaaactagtcggattgccggggccatttggtctggacaatccgttgtttcgcgcgtgttttgtagcatccgtggagttacatgggggtatgactgaaaacatcgctgataaggccataaacgatactcgtatcgtcaagcagttcaccaatcccgtcaaggaaccgattgacagcgacgtcaacctgttcgatctgctcgataaccgcgccaagcgcgatcccgaaggtgccatgatcgaatacaagggcgatgatggcacttggcgcccgtacagtgcccaagtattccgtgacatggtcatcgatctggccaagggcctgatcggacttggcgtcaataagggcgattcagtcgctatcgtctcacgcacacgttgggaatggacggcgctggacgtggcgatcatgtccatcggcgcggtcaccgtgccggtgtacgagaccaactccgccagccaggtcagctggatcttcaacgattccaaagtcacgctcgccatcgccgaagatgacggacagcgcgacaagatcgaatccgtgcgcagcgaggtacccaccctgcgcaacgcgttcgtaatcgaggccggcggcctgaacgccatcaagacctatggcgaaagcgtcaccgatgccgaattctgggaatacaaggaagcctcccacggcgacgaccgcgccaccatcgtctacacatccggctctacaggcaccccgaagggcgtggaactgacccaccgcaacttcgccttcctggtgttttccgcgctgcagtacatgccgcgcgccggcgcatggcctaaccgccgcctgctgctgttcctgccgttgagccacgtgttcgcccgattcatggaattcttcagcttcggcggcacgatttcgctggccttgagctccaatatgaagacgatggtcaaggacttcgaaaccttcggccccacgctgctgcttgccgtgccgcgtgtgtacgagaaggtctacaacgccgcctcccagcgcgccggcaccggattcgctggcaagatgttcatgcgcgccgccgaaaacgcgcgcgaatggtccaaggccgagcagaagggtgagcagttgccgattgccggacgtatcgcccacgccttctacgagcaggtggtgtacaagaagattcgcacaattttcggtccgaacgccgacttcgccattaccggcggcgctccgatggactccgagctttcccacttcttcaacggcatcggcatgccggtgcttgagggctatggcatgaccgaaacctgcggcccggtgtgtgtgagcttgccggaagacaaccgcatcggcaccatcggcatgccgatgtgcggtatcactgcgggcatcgccgaggacggcgagctggtggtcaaaggaccgctggtgtgcaagggctaccacaacaaccctgaggtcactacccagcagatcactgatggctggctgcacaccggcgatctgggcgatatctccgaagatggcttcatctccatcaccggccgtaagaaagacctcatcatcaccgctggtggcaagaatgtgtcgccgggtctgcttgaggcttccgtgatgacctcgcctgtggtcaaccagtgcttggttattggtgataagaagccgttcgtggccgctctggtcacgctggatctggcagatgccaacaattggctggaatcccagggtgccaagccggaacccgatctggcctcgctggccaagaacgccatcgttcacgctgaggtggagcgtgcggtgaacgccgccaacgagggcgtttcccgcgccgagtcgattcgtaagttcgagattctgcccgacgaattcaccgaggccaacggcatgctgaccccgagcctgaagacccgccgcgcgcaaatcgtcaagcactaccaagagctcattgacaacgtgatctacgtcccgctgaagaagtaaccatcaactccctctgatccaagaaataagctctctctgacgagggagctgtcagcgaagctgactgagggagagaccccgcggcttgcccgcgaaaaaacaacagggccgggtgcgacttgcacccggcctcagcttattcagtccaaaatcgccgaaacataatcagcggcggcctgatccagctccgcatcgctgatggtggcggtgccctgcaccaggaatggttcggcatagttcatgcctaccttgtaggccacgactgcgaatgggcttagcagctcctccatggtgtggttgtactcgccatccttgcggtacttggaggcgtcggaaccagtggtgaccaccagcttgagctccttgcccttgagtgcgtggcctccaccgtaggcccagcctgcggcgatgacctcgtcttcccattccttgagtagcgcggggaggagtaccagtagaacgggaactgaaggattacgcggtcggcggcctccagcagctcgtgctccgtgtcggcgttgacggagaagttcgggtattcggcgtattcgtcgcgcacgatgatgtcgtcctcgccttgtgcggcgagttcggcaagcaggcgggcgttcactcgcgagccgtccttcaggtgcggatggaatacaagaatcaacgttgacatgggatttcccttctataaactgctgccaatgtggcctaatcaccactatcgtatgccgggaagcagaactcagtccagtctggactcaggtgcgagccgcgggatgccgcggatgagtaattgatgcgggaaaggatgctgactgatgatctggcgctgaagcttcagtgggccgcatatacgagtcctaaagcggataggatgggatatgacgcggatatcgtcggtggactgaataacgggaggcgcacatgaccatgaaccgcatgctgatgtgccgtacccatccggtaatggagttcgagtatttcgaacgcggcggatacgccctgagggcaggggagatctacgacgagtcccgaatcccgatcggcatgtatgtggacggcaaacctgagcccaccggtgagtcgattaccgggtggtggcgttctcgcggcattcccatgacccgtgacggtatgcgttccgtatttgccggttcgggtatcgcttcgacgaacgatctgctggaccgttccttgggactcagcctgtcggaccagtattgggtgcggcctctcgaccggcccgatctgacgtgggaaaaactgaactttttccacaacgattttgacgaacgacttgggcaggccttattcttcggtaattcgtcgcgcatcggcaacgtgaacaccccggatgtcaccagtgccggtgacctgccgaaacgttggattatcggtcccgatggcgtccgcagcctgatcaagggagggcgcaccggtcaggagccggacaacgagcgcatcgcctggcagacggcacgactgttcggcatcgaccatgtcgaataccgcatcggccgcgccaagggcatccgggtctccgtctgcgatgaaatgctcgaagacacgcaagagctgattcccgcagggcaggttatgcgcatcttccgacgcggcgacaacaccgaacgcaagatgatatggctggacgcatgtcagcaactcggcgtaagtcgtgatatggcaaatgcggcgaccaacgattttctgttccttgattttcttctgcgcaacaccgaccggcattacaacaacttcggtctcatccgtgacgtcgaatcattcgagattcgcccgtccccgatttttgacagcggcgccagcctgtggaacggcatggaccccgaagccatcaccaacgaagactacccggcgaagccgttctggctcgacgactacggcgatgcggacaacgcctactggcagttgggacttatcgacgattgggaccgttatgatttggggatgctcgacgaggtgcctgaactgatacgggcacagctcgccaccaaccgccggctgtccgctgatgtgattgacgccatctgctccgccatgcaggagcgcatcggcatcatccgcaagcttgcacgatgatgccgcgccgggaggcaactcagtcgaggttggactgcgtgcctgcggtggcttcgttggcggcttgctcggcttgtgcctggtcgagcttggcgcggacgtcgttgagcagaccctgggcgcgcttggccaaggcctcgccgatttcccattgacgcatcgactggtcaagattgaggccgccggtttccagtgcctggacagcctgaatcagcttgtcgcgcgcctcttcatatggcatctgggcgatgagctcgcgttccttgtccgccagggacgaggcggggttgttcttgtcggtggatgcggcgttttcggtcatgatgttctccttatatatatatggtatatatgcgtggctgcgtatggagtgtcacgcggttgcggatgtggtggttgcggtaatgacacccttcttcaaggtgacggtgatgtcatccccagggcttacctgcgaagcatcgtctagtacgtggccatcggaggactgcaccaccgcatagcctcggttcaatgtggattgcgggctgagtgcggtcagtgaggcgtgagctcgctcgacggtgagctgggcatcgtccacgatgcgtcgcaggccgatgtcaagccgctgcagggaatcgtcgattagccgctgatgcggttcgagcatggtatgcggttgggtcaggcttggccggttcgcatatccctcgataagtcgaatctcgttctccacgcgcgaacggacccgcagtcgcatacggtcgatggcaccttcgatgagctgcgactgctcacgcacatccggtaccacgcgcttggccgcatcggtgggggtggaggctctaagatcggcgaccagatccagcaacgtccagtcatcctcatgcccgatggaggagattaatggtgtggtgcaggcatacgccgcacgaaccacacgctcatccgagaaaccgatgagatcctcaaacgagccgccgccacgggccacgatgatcacatccacgctcgggtcggcatcgagttgtgcaatggcctgaaccacttcggccgggcattgctcgccctgaacatgcacatggaccaccttgaaggttacggaaggccaacgaaggttcacattggtgatcacatcgccttccgcacgtgcctgaggtgcgcaaatcaggccaatagtcttcggaaactccgggagaggcagtttgtgatcggcatcgaacaggccctcgcccttaagctgcttgcgcaattcgtcgatcatggccttgaggctgccaccggctccgaccttgagaatcgtgtccccgcgcaacgacagcgaagtgcgcttcatccacaggttcggtttgccatgaatcaccacgcggtcgccctgaacgaactggctggccgcggccgcgaacctgccgaagccattgacttccatggcgatatcctcgaagtcgtcgcgcagcgtgatgtaggccgagccggcgcgacgggtattgatctgcgtgatctggccggtgacccacgcggacggccatcgttccacggcaccgtagaacttctggctcagcacacttaccggccacggattttgcgcgctggtttcagcggcgcgtgcaggcagctgatcgatagggcgaggctcattcggcagattgatggtgccctgatcaggcgcgaaagtgccttgacccggctcaaagccagccgaggccagtgaagcggcggtcggtggacggccggtagatgggtagcccattgcagtagtcatgcactccactataagtgcgttggttgatgacggtaaatatttaccgtcgcctgaaaacggtgtgatgatgaatgcgagaaccgtacgaagcgatgtatcagccgatgatggagatggtctggtgcatcagaagaaaggagtcattatggcgaagaaacgggtgctatgaagaggagtgagatatgcgttgcgctgacgattgagagtcgtcagtgagctcgctgtgcgacacgcgagcagaaaacagttacgctaatcacacacttgtggttttggcggaaaatagccgaaaaccctataaatagttcgacacaccactgttgagcactagatatagtggtggggatgccgtattcttctagaggttcaagaaaacgacatcaatgtaatttcgtgtggcccacgtcgagtgcggccaaaatgcggaactcaggagagtgttcgccttataggaaaggggtgcccgatgggtgcacaggtgttggaggaaatcgtcaccgataacgagaccaaggtggccgccaaggcctccaccgtgctcgttgagaagcgtgatggtcgtgtggtcgacttcgaccccatcaacatcatctctgcggtcaagtctgctttcggtgacctgaacaaggaagtcggccccgaagaagatgccatgatccgtggtttcgccaaccaagtcgaaggcgaaatcaaggggcgttacgccggccccgccaagatcgaggacatccagaacctcgtggagcacgccctcattgacgcccacctgtacgatgtggctcgcgcctacaccaactaccgtctcgacaaggacattcagcgtgccaaggccactgatgtcaacgaggccgtttcccgcttcatcaaccacgacccgaccctgattcacgagaacgcgaacaaggattccaacgtctactccacccagcgtgatctgctggccggtgccgtgtccaaggccgccgcgttcaacatgctgccgccggcggtgtccaacgcccacatgaagggcgacattcacttccacgatgccgactactcgccgttcactgcccagtccaactgctccttgccgaacttctgggacatgttggccaatggcttcactcttggcaacgctccgatggcttccccgaagtccatcgccattgcggccacccagattacccagatcatgaaggacgtggcctccagccagtatggtggccagaccgccaaccgtgctgacgagcatcttgcccagtatgccaagaaggattacgagaagttcctcgaggaagctcgtgagaccatccccgacggcatgccggttgaattcgcccgtcgtcaggtcgagagcgccaagaggaacgagcccgccaagctgcatttcggttcccgcgaaccgctgccgatggacaccccgttccacaccgatgttgacgaacttgagcaggagcgtgaaatcctcgccaagattcgtacccgcaaggccatctatgatgccatgcagaccatggaataccagatcaactccaaccgtgtgtccaacggccagaccccgttcgtgactgtcggctttggtctcggcaccgactggttctctcgtgaagtgcagcgcgcaatcctgctgaaccgtattcgcggcctcggcaaggaacaccacaccgccatcttcccgaagctcgtctttactgtgcagcacggcgtgaacgccgacccgggtgacccgaactacgatttgaagcagctcgccctcgagtccgccaccaagcgcatgtacccggatgtggtgttctacgagaacatcgtcaagatcacaggctccttcaaggctccgatgggttgccgctccttcctgcagggttggatcaacccggagaccggcaaggacgaggaggatggccgtatgaacctcggcgtggtcaccgtcaatgtgccgcgtatcgccatcgaatcccacggtgacaaggctcgcttctggaagctgttcgaggagcgtatggaagtcgcccatcaggccctccagttccgcatcatgcgctgcaaggaagccaccccggtcaacgccccgaccctgttccgcttcggtgcgttcggtcgtctcggtgccaacgacaacgtggaccagctgttcaagaacgagcgtgccaccgtgtcgctcggctacatcggccttgccgagaccaccgcggtcttctacggcaagaactggattcgcgaccacggctgggatccggaaggcaaggagttcgcgctgtccatcgtcaagcgcatgaacgagctgtgcaagcagtggagcaaagcggagggctaccactattccgtgtactccactccggctgaatccctgaccgaccgcttcaaccgcatggaccgtgaaaagttcggccgtatcgaaggcgtgactgaccacgacttctacaccaactccttccactacccggtgtggttgcagcccaccccgatggagaagctcagctacgagaaggacttcccgtactacgcctccggcggcttcatcaactactgcgagtacccgtgcctgcaggacaacccgaaggcgctcgaagccgtgtgggattacgcctacaacatcggcatcggctacctgggcaccaacaccccgatcgaccactgcttcgtgtgcggcttccagggcgactttgagccgaccgaggaaggcttcaagtgcccggagtgcggtaactccaacccggacaagtgcaacgtcaccaagcgcacctgcggctacctcggcagcccggtccagcgcccgatggtgcatggccgtcacgaggagatcgcccaccgagtcaagcacatgagcggcgaaaccggtcgtgtgacgctggacgacggcaccactcgcgagtggttcgaagaggccaagtagggttattcgtgagtgggctcccctctctgaggggagctgtcagcaaagctgactgaggggagtccgaggagctattccgaagctcccctcagtcgcctacgacgacagctccccctcaaagaggggagctaatgctttccgcaaggagggaatcatgccggagttgcatacgaccaagcccgaacccaagcgccatgactttgcggccagcgagaccgggcgtggcccctccgtaccctccaacggtcttgccaacgatccgaaagccggtcaatgggatggccggcgcatgtccaagcggatgatcgccgactacaaaaccttcattgtcaccgacggagaaggcgtgcgcaactccctttacgtctccgggtgccccttccactgcgtcgactgcttcaacgcctccatctgggatttccaagccggccacgaatacacgcaaaaacttgaagacaaaatcatcgaagatctgaaagccccatgggtgcaaggcattacgttccttggcggcgagccattcctcaacactcccgtgctggtgccgctcgcacaacgtatccgccaggaattcggtcataccaaagatatctggtcgtggaccggctacacatgggaagaactcatgcgccccggagaaaccccagacaagcttgaattgctacatctcatcgacattctcgtcgacggccgctacctcagagaccagaaggactcgctgctgcaattccgcggctccagaaaccagcgcatcctcgatgtgcccaagtctctggaagccggcgaaccggtcatctgggccaagctccacgatcaagaacgagatatccccgaaatctatttgaaagaccgcgaagccggcgaaggccaacaggcctcgtagtagcagttctggaatgccgcactcagcaatatcgttggaactgttggggaaaggccttcccgtgagcgaaatcacttcgcctcgtgccatgttgggcaggtaatcggactaatattccagaagaagtagccggtcgaagccgtccgcagggtatctgccagccgtcccgaaacggtttctgatgcctcgtggcgtgcactcccggaagtcggaattaagaggaacacatggttgacatcgtcactgacgcgagcgcaacgcccgcctcacaactgaagccgctgcgtgtgggattggatatcggctccaccaccgtcaaggccgtggtgcttgatcagtccgattccctgaaagacaccctattttccgattaccgacgtcaccatgccaatgtgcgtgccaccgttgccggtctgctcgtggacattcataaagagctcgtggaactaggtcgaggcgacgagccgattcgcctgtccatcaccggttccggcggcttggcgctcgccgataacctgcatgtgcccttcatccaggaggtcatcgccgaaaccgaggcgatcgacaaggaataccctcaggccgacgtcatcatcgagctcggcggcgaggacgccaagatcacctacctgaagcccacgcccgaacagcgtatgaatggttcgtgcgcaggcggcaccggcgcgttcatcgaccagatgtccacgctgcttgacaccgacgccgcaggcctcaacgagatggccaagagctacgagaacctgtatccgatcgcctcgcgttgcggcgtgttcgccaaaaccgatctgcagccgctgatcaacgacggtgcggccaagcctgatctcgccgcctccatcttcaccgcagtggccacgcagaccattgccggcctggctgctggccgcccgatccacggtaccgtcatcttcctcggtggcccgctgttcttcatgtccgaactgcgcgccgccttccagcgtgcccttgaaggcaaggtcgacaagttcatcgtgccgaccgacgcccacctgtatgtggcctacggttcggcattgcaggccgacatggattccgacgatcagggccaccatttcgaggcccacacctgcgatgagatcctcatgcgtctggacgagctgaagaacctgccctccaacacacccaccatgccgccgctgttccccaccgaggccgaccgcgaggacttcaacaagcgccaccacaaggaacacatccacatcggcaccctcgaaggcgcgcatggcccgcacttcctgggcatcgacgccggttccaccaccatcaaggccacgctcgtcaatgacgaccgtgaaatcgtctggtccagctacgccaacaacgaaggcagcccgctgaccgccgccatcaacatcgtcaagaagatccaatccgagctgcccgaaggcgcatggatcgcacgctcctgcgccaccggttacggcgaaggcctcatcaccaccggcctgcacctggacgagggcgtggtggagaccatggcccactatcgtggtgccgaaatggtcagccccggcgtcaccgccgtcatcgacatcggcggccaggatatgaaatatctggccatcactgacggcgtcatcgactcgatcgccgtcaacgaagcctgctcgtccggctgcggctcgttcctgcagaccttcgccatgtccatgggcctgacgattcaggaattcacgcaaaaggctctggcttccacccatccggtggacctcggttcgcgctgcaccgtgttcatgaactcctcggtcaagcaggcgcagaaggaaggcgcctccatcgaggacatcgctgccggcctatgctactccgtggtgcgcaacgccctgtacaaggtcatcaagttgcgtgattccggcgaactcggcgacactgtggtggtccagggcggtacgttcctcaacgacgccgtgctgcgcgccttcgagctgctcaccgaacgtcaggtcacccgcccgaacatcgccggcctcatgggcgcgttcggcgccgccctgaccgcccgcatgcactatcaggatgaggccgaccacttggacgtggtggttaaggccgatgggtccgaggaacagtccgaggccgagcccgcacccaagtccgagcccaaggccgcggccttcaagaagaccgagccggccaagcccgaagcccatgtcgttgtcgtggacggtgtgactcacaccgccagctccattctgaccggcgaagcgctcgacaacatgagcatgaccgccgagcgtgacgtgtgcaagctgtgccagaaccactgcaagctcaccatcaccacattctccgacggctcgcgcttcgtgaccggcaaccgctgcgaacgcggcggcgacgccaagaagaagcgttccgaccgtccgaacctgtacgactacaagtacaagcgttgcttcgcctaccgccgtttgaccgacaagaaggccactcgtggcgagatcggcattccgcgcgccctcaatatgtacgagaactacccgttctggttcacgctgctcaccacgctgggcttcaaggtgatgatctccggccgcagctcccacgagctgttcgagaccggcatcgaatccatcgcctccgaaaacatctgctacccggccaagctggtgcacggccatatcaagtggctgatcaacaagggcatcaagaccatcttctacccgtgcgtgagctacgaggagaacctcgtgcccaacacggacaatcattacaactgcccggttgtggccaactatccgctcgtcgtcggcgccaacgtgcctgagctgcgtgaagacggcgtgcgctacatgcacccgtacttcaacctcgccaaccatgagctcatggttgaccgcatcgtcgaagagtttgcgtgggccaacgtgacccgcgaagaggccgaaaccgcggtcaaggccgcctatgccgaagacaaggtcttcaagcatgacgtgcagcaggaaggtttgaccgcgctcgcctatatgaaagagcacaactgccgaggcatcgtgctcgccggccgtccctaccacatcgaccccgaaatcaaccacggcatccccgaaaccatctgctcgctgggcatggtggtactctccgaggattccatctgcgaactgcatccgggggagaagctcaacctcaccgaattccgctcggaaggcgaagccgacccgcgttccaagaacgccgccagattccgccatgtaggcgaccgcacggtcaccaagatgccgttgcgcgtcaccaaccagtgggcctaccactcccgtctgtacgcggccgcacacttcgtggcctcctacccgggcctcgaacttgtgcagctcaattccttcggctgtggccttgacgccatcaccaccgatcaggtggccgaaatcctggcagacaaggcggacgtgtacacgctgctgaagattgacgaggtctccaacctgggtgccgccaagattcgactgcgctcgctcaaggccgccgtcgaggaacgcgaagccaacaaggcccgcgaagccgccgcggccaaggccatggaagaccagcaggccgccgccgaacgcgccgccgaggaagccaaggtcaaggccgagtccgatttggaagctgccaaggccgcgcttgccgaggctcaggccgccgtcgaagccgctcagaagaaggtcgacgccgaagcgcaggccgtacacgatgccgtcaaggcatctcaggccagcactgcgaaggccgtgcaaggtcccaagcccaccggcttccgcaagaccggccccaccgctcccacccccggccgccagattctgctcgacagcaccatggccgccaatccgaagctcaccaaggccatgcgcgaggcctccaagcgtgccgccgaacgcgacctgcaggccgcagccgccaacaagaacggcacttcggacggcaccaccggcgtgacgaacgccaagaatgccaagaagtccggccacaacaacgccaccatgtcccgatacgcgcatcgtgagaagttcgtcaaggacatgaagaaaaactatacgattgttggccctcagatgagcccgattcatatgtccttggtcgaagcggtgattcgttccggtgggtacaagttcgacatcctgaagcatgcgagccgtggcgatgtggaaaccggcctcaaatacgtgaacaatgacgcctgctacccggccatcatggtcgtcggccagctcatcgacgcgattctggaaggcaaatacgatcccgaacatgtagcgctcgccatcacccagaccggcggcatgtgccgtgcgaccaactatttcggcctgatccgcaaggccttggtcgatgccggctacccgcagattccggtcatcgccatttctacccagggcctcgaagacaaccccggcttcaaggccaccctgcccctgctgcaccgtgccatcaaggcgctggttctgggcgacttgctcatgaagtgcctctaccgcgtacgcccgtatgaggtggagaaaggttcggccaacaagctgtacgagctgtgggacgccatcgtgcgtgagaccatcgagcatcacggctattccaagaccgcagccaagacgccgagcatcaagaagggctatctgccgtataacgtgctggccaaggagatcgtgaagtccttcgacaatctgccgctgcgtgatattccgcgcaaggtgcgagtcggcgtggtcggcgagatcctcgtcaagtaccagccggacgcgaacaaccacgtggtcgacgtcatcgaatcccaggattgcgaggccgtagtgcccggcatcatggaattcatgaccacccgcccctacatcaccgactggaacgagaagaacctcggcatgggtggcaacaagacgctctacgccttgatgcgcaagggtcttgacctgtacaacgcgcctatcaaggccgcactggtcacctcgcacggcaagttcaagcaggacgagccgatgcccgaactggtcaagaaggctgccgaggtcacttccatcggcgtgcaggccggtgagggctggctgctgacggccgagattctggagcttatcgaacaaggttgcccgaatgtgatttgcgcgcagccgttcgcctgcctgcccaaccatgtgaccggccgtggcatgttcggcaagattcgccgcctgcatccggaagccaacatcgtctccatcgattacgatccgggtgcctccgaggccaatcagctcaaccgtatcaagctgatgatcgccgctgccaagaaggctcacaacgccaagttcgccgaggccggcgagccgcagggcttcacctccgcggactgatttatgctctggctcgtccgcaattaaggacgagcttcgctcgcgacatgctggttcgcctatcggctcaccctcgcctacggacagcccgcagggctgtccgctttacggctcggcctctgtgaggggagctgtcgcgcagcgactgaggggttatagcctgctagattgattatctgctttagtttgttttcgtgtgatataattaagtcatgcgtgtcagggaatgggcgaggcgtgagggcttcaacgagcagacggtgtggcagtggtgtcgcgagaaccgtatgcccgtcccgttcgagcgcatgaacacgggcacgattatcatccacgacccgaaatacgagaaccagcccgccgcccccacagcgaacggcaggacggtgtgttacgcgcgtgtcagctcgtccgaccaaaaggacgatttgcaacgtcaggccgaccggttgaaggcgttcgccatcaacatgggcgtcaagagccccgaggtggtcatggagaccggttcgggcatgaacgacaaacggcgcaagctcaaccggctattggccgacccgaccgtgggcacgctgatcgtggagcgcagggacaggctcgcccgcatgaacgcgggactggtggagagcgcgttgaaggcgcagggacgccgaatcatcgtggtggacgacacggagctggacgacgacttggtgcgcgacatgaccgaggtgctgacctcgttctgcgcacgactgtacgggcgtcgtgccgccaagcataagacggatgcggcgttgagggcggcgcgtgatgcttgaggcggtcaaggtggcgctcgacccgacgccacggcaggaacgactcttggagtcccatgccggtgcggcgcggttcgcgtacaacgcgggactggcgcacgtcaaggacatgcttgaacggcaggagaagccggaatggtcgtactacgcgctgcgcaggtggtggaacgccaacaaggacgccctcgccgtcagcatggagaccggcaagccgtggtggccggagaacagcaaggagtcgtacaacagcggcctcgaatcattggccgacgcgctgaagaacttctccaagtcccgcaaggggcagcggaaaggccgcaggatgggcttcccacgtttcaaatccaaggacaaggcggttcccggattcgcgtacacgacgggctcgtttggtctcattgactgtgacccttatgcgctgcggctcccgaagataggccgcgtgcattgcatggagaacgtatccaagcgggtggatggcgcgaaggtgctgcgcatgagcgtatcccggcatgcgggacgctggatggcgagtttgaccgtcgagcgcaaggatggtccgatgcccacgccgctgaaaggtggtagtgtcggcatcgatttgggtgtgaaacagctcgccacactgtcagacggcaccatcatccgcaatccacgcgcgttggactcgaacctcagacgattgaggcgggaacagaagaatctgagccgcaaacggaaaggctccaaccgccgccgcgaggcgagaacgagggtcgcgcgtctgcacgcccgcgtggcggacctacgccgcgacctactggacaagaccaccaccatgctcgcccgcacctacgcggacatcagcatcgaggacttgaacgtggcgggcatggtgagaaaccataggctcgcccgctcggtagaggacgccgcgttcgcggagttccgccgacagctcgaatacaagaccgcacgcaccggcgcgaggctccacgtcatcgaccgctggtatccaagcagcaagacatgctcgaactgcgggacggtgaaagccaaactgtccctgtccgaacgtgtctaccattgcgaggagtgcgggcttgtcatcgaccgcgatctgaacgcggccatcaacatccaagtcgccgggagtgccccggagacgttaaacgcgcgtggaggaagcggaagacgggctgacgcatcgcgtcgggcaacgcggcatcctgtgaaacgcgaaccaagcggcggcgtaagccgtgtgaggcttggagctggcctcggcaatgaggccatgcagatgacttcgctctagcgacaagctaaaacaaagtcatctacaacggagtctctagagcgagaaaccgggccggagcctgctatcggtttttcgtatagcgtattgcgggctttcgggcacgcgcgccggccggctcgaatacgatacaaagcatggttactccccgaatcagttacgcgcacctgctcgccaagccgaaccccaagcacgtcgaaagcctactcaagttctttgagaacggtcgctcccagcgtggcgccggtggcttcggtgtggagatcgagcacctgcccgtgcacaacagcgacgacactgccgtaagctactacgagccgaatggcatcgaggcattgctcaaacgcctggctccgtactacgacgaggagaaggaatactgggagaacggccatctggtgggtctcggccgttccggcgtcgccgtttctctcgagcccggcggacaggtggaaacctcgatcggcattttgaagaagccgagcgacctaagtacgctgtactccaagtttcgtcgagagctcgccccgattcttgacgatctcgacttccgactggtcaactacggttaccagcccaaatccagctttgcggatgtgccggtcaaccccaaggatcgctacgatgcaatgaccgactacctcggccgcgtgggtcagttcggcccatgcatgatgcgttgctccgcctccactcaggtcagcatcgactacgtggacgagcgcgattccatcgaaaaactgcggttgggcaccgtcatcggtccgattctggcgtacttcttccgcaacaccccgtattttgagggtgagacgaacccatggccgttgctgcgccagcgcatgtgggattatctcgacttccagcgcaccaatgtgctgccgggcctgttcgacccgcgctatgggtgggaggattacgccatcgacgtgctgtccacgccgctcatgttcgctgacctgacccatacccctgaagctgtggcttctggagcaagccccaaggaactgcatcgcccggcgttccgtgagaacgcgggggaggtgtacccggaccgcgaactcaacccgtacgagatcaaccacatcatctccacgcacttcaatgacgtacgtctgaagaacttcatcgaactgcgtcactgggattcactgccgattgagcgtgccgagcgtctgacggagattgtgtcctctctgttctacgtgcctgagcaccgtgaacgtctggaaagctacttcgagggcatcagcgaggaagaggtgttcgaagccaaggccaacatccaggcccacggtcgcgaggcttcgccatacggccagccgctcgatttctggaaggaattcctggggctcgaaggccttttgtccgacattcccggcgatctgaagcaccccgacgtgttccaggagtaagcgaagaagcatatacagaaaaatctattgcgcgatatcggtgtcgaaggcatgacagaatgttatgttttggcaccgttttgcatatccggccaaggatattggatgtggttgcgcatgggagtgaggagaatgcggatagatggacagcctcgagacatgattaccaccgtgctcgacggcctgatccagctcgccgccgacgattgcgaggtcgtctactcgcgcggcgcgaacgtcatcgacctcgtgcccgaccccgcaggcgagttctactcggacggccagccccgcccgaaaatcggcgtttccgccgccgttgatcaagcaatgatcgacgaagccgtggccaacgctccccagtccgatctgatcgtggccgtggtcggcgacgtggtccagctggtcggcgaaacctgctccaccgccacgctcgaactactcggtggccagaacgccttgctcgacgcgttcgccgctgtgtctgaaagaaaccggcaagtcgatggtcaccgtgctcatcagctccaagccgcaggtgttgcccgcctcccgcaactgcgtcgccgcgttcgggtggttcgggctccgtgcggtgagtgggccgcggccgtatgatggaagcgcgggtggtccgggattttctgcatacggcgggaggcgtcatggtttctatcgagaacgtgtacgaacagattcgtacattcgccgctgatgccggcgctcgcaaggtcgtgctgttcggttctcgagcaaagggtgtgaaccggcctaaaagcgatatcgatcttgccgtggccggttgccccgatttcaatcgcttggagcagaaccttcaggacaatctgtggtcactgcttaaagttgatgtcattaatctggatgagccgatttcttcatcgctgagggcggagattgagcgtagcggaaaggtattgtatgaaaaaatatgagaattacgtttccgcactgaagtcgctgcgcaaggctcccgaacaggatctcagcaatgatttcatccagagcggcattattgacaagttcgggttgcagttcgagcttggttggaaactgttcaaggcgctgctggcttatgagggagaccctgtttccgcttccggctctccgcgagatgtgctcaaaaccgcttttcaatactatgatttcatggacgaatcgttgtggctgcgcatgctgcgcgatcgcaatgattctgctcatatctatgatgaagaacgagatcggcgtcttgtggacgccatcatcgctgattacatccccgagtttgagcgtgcaaatcaggggttggtcgctcgctacggtgaagcattgaacgattagcgtgacaggtatggcatcgggcgcgctgggtgttggcgaacgaattaatggggtgaacctcggcaattggctggtgctggagcggtggatgaagccggggatttttgccgccagcggcgaggcggacgagatctggctgcatcgggctacgaagtcggctgagctggaggctttgctgacgcggcatcgcgacacgtatattaccgaggccgatttccggaacattgccgcacatggctgcaatctggtgcgtattccagtgccgtatttcgtgttcggggatgtgcccggtcacccgggctgtaccgagtatctggacagagcgttcgactgggccgagcgggccgggctcaagattcttatcgacctgcacacggtgcccggctcgcagaacggattcgataacggcggcctcaccggcgtggtgcgctggcatcgtagcctgcgagcggtcgcctatgcgctggatgtgctggtccgtctggctcgccggtatcgcgaccacgcggcgctgttcggtatcgaagtgctgaatgagccgattgactggctgacgtatgccatgtcaccatcgagcaggcaggcgaaagaccggtccgaagcgcgaggaagcgggcctattccgatggcgttcctcaagcgtttctaccgcgagacataccaccggttgcgcccgattctggcagggaatcaagtcatcgtgttccatgacggcttccgactgggccgttggcgggactggttcgtgcgcgagggcatgcggggcgtcatgctcgatacgcatgtctatatggtcatggccgagcaattcccgctgttccgtctgatcccggatcggtggctgatgggctggtatcgcttgtttgtgcgctggaacgaacgccgcatccgccgggccgcgcgctatgcgccggtgattgtaggggagtggtgcgtggctaatggtctggtaaatcgggtggtcgataagcgtacaggcgatggtggccgctccaaggaaaacgccatgcacagtgcatctatcagaggctctatttaccgcgaggtcgccgccatgcaacgcaaggcatggaacgtgtccgccgggcaaatctattggagctaccaattacgtggtaatcgtgatttcttgcctaccatcgacccgcaatccgacacgtcacgcctcgacccctgggatctcactcacgtttggcacgccggttggatggcgtaatgagaacgaaatcgctctctgagggcatgattcgaaacaattgtgtaaggtagagagtgagcttcgtgacccggcctatcctttgcggcggggtgggttgcgggttcgagatgagaggtcagctgccgctggcacctgattcgtctgcgcagacgaataccgcgagagcagggtgcctagcccagtgactgggtgatacggttaggccaaccgaagtcgctactgattccacttcgctggaagtggatgatagtcatgcagaagactgtaaaacatggcttttcatctcaggggggacatctggctcagatgtcccccttatttttcggcaaagggggagccgtgaatataacaaagatgaaagagtatgcattggcgcaagctcatgctgcggctctcctgtaccatgaacgacttgaaggtcgggcaacaagaattcactgcgaagatggtttggctcttgtcatagtttgggaggggatgcggacggaaagttggacgcttgggcgtccggattggagtccgcatgttttcgatggaggatcggcgcagggccgttgacctgtatttcacggagggcatgaccatcaggaaggtcattgccgagcttggttacccgtccgagggcgcgctggtgaaatgggttcgcgaggacccgcgttacacgggcgcgtgcaggcgttcgtatacgctggaatgcaagacgaatgcggccagacgcgcgctcgagggcgagcccctcgcccgcgtggcgcgcgacgcgggttgcacgccgacgagcgtgtaccagtggatgcgccgctaccggagcgaggggatactgggactgatggacaggagaaacgcgccgatgccggccgaaccgatgcccgcggccggcgatgacgtggaggagctgcgccggcaggtggaggtcctgcggctggagaacgcggtgatgcgggagacgatcgatgttttaaaagccgacgacccgcgcctcgacccgtccatgctgacgaacagggagaggacgcgggtcgtcgacgcgatcaggggtgaattcggcctggcggcctgtctgaaggccgtggggctgaaacgcagcacctactattacgagcgcggcgcgatcgccgcgggcgacaggtacgccgtgctgcgggcccgcgtcgccggcctgttcgagcagggtgggcgcgcatggggataccggaccatccaccgcatgctgcgccttgacgagtccgacccgatcgtcgtctcggagaaggtcgtcaggcggatcatgcgcgagggggccatgcggcccgtgtacctgaagcggccgaagcggtggagctcctacgccggcgagatcggcgaggccccggcgaacctcgtggagcgggacttccacgccgacgcgccgaacatgctgtgggtcacggacgtcacccagttcaccatggacgggtacaagtgctggctttccccggtggtcgactgcttcgacgggatggtggtctcctggaccttgtcgcgctccccgaacgccgacatggcgaaccggatgctccttgacgcggtcgccacgctcagggacggggaacatccaatcatccattccgaccgcggctgccactaccggtgggacgaatggatccgcatctgcgaggagcacgggctgatccggtcgatgagcgccaagggatgcagcccggacaacgcggccgccgaggggttcttcggcaggctcaagaacgagttattctacgggcgggactggaggggcgtgggctacgaggagttccgcgaacgcctggccgcctacctgacccactacaatgaaaccaggatcaagaagtcactggactggatgagccccgtgcaataccgcagaagtcttggactggccgcctgaccgtccaaaaaaacatccgcacccccggatgagggaaattttgctcatttatgtggcttggattattatctggatgattccaagcgacgccgtcttcctcctagaaagctctatgaggatttgcttaagggacgcagaatctcacctaagcgagtgagtcctcatggtgatgtgcaatggttgaagaagaaggcagatgtcctgactgatgccatggatatgtcaaaggtgacacatgtcgtagtgtcaggcaatagcagaatcgtgttgtatgcaggcaatgaggtctggtgcatcggtcttggtcgtatgcgtgatgaacggtattatccgcaatcattgataaagaaatccttcgatgaagtgcgaaaaacaggtactatcgcacataccgtggccgcagtcgaaacgttgaagctctgaataattgcgacgctgcgctgtgccgaaccggtgtttggcgacgctaagttgccaagccctggcaagatggcgacgctggcgggattccagcgtcgccaaactgccggttcttggcaggttgacgccactgaatggcgtctgtacggtgctagtctgccaaggactggcagcttggcgcaattactggtgctgagtgatgccaaactgccagcgtttggcagattggcaccgctcgggacagcggcagtcgtggttacagccgcatttacttgatcgcggcaaaccatcatcgctgatccggagcgtcctctgacatcgcagccgcaccaattagcgatatccctcccaaaggggcaaaggcatcagaacatcctcgcaatcggcccacatggtattgagatcttggccgggggcgcgcagccagcgcagctggaggccgtccatcatcgagaatccggcctgcagcacatgtccgacattgacgccttccggcacggcccagttgatgttgagcgccgtggtgaccgtgcggcgctcgcggtcggcgaaataatcgtgcgcggggtgggccgggtcgagcgcctcggcgctcagcgtggagaacatatgcaccaacgcgggcctcttgttgttcacagccaccacctgacgccacatatccgcgataagcgggcgctcctgggcgaccatcgcggcgttgatcgattcggtgatccggtcgtatttctcggtcagcgccagcttgagcagtccctccttgctgcccacgtaatgcagcacgccggccttggtgagtcccacttcggtggcgatgcgttgcagagacgtgccgtaatagccaagtttgccaaacgatttgacggcggcgtcgagaatcgcggtacggcgatcggtgtctgtgtgagaggggtcgttcatacaggcaaccttacggtcggttagtagtgattccaaatgatttcggtgtgttgtgacacagattttgataatctacctaccagccggttggtcgagagaaaacggcagtcgagattcgtggaggaacctcgaacaacagccagacagtccggccgaatcggagccaacgcatatcggacaaccgcacaactcaagaaactcaaggaaagaggaatcatgagcgagtccacctacccgtccgtcaaggatttgactcttgaagagaaggcatccctcacctcgggcggcgactcctggcatctgcagggcgtggagtccaaaggcatcccaggctacatgatcactgacggcccccacggcctcaggaaatccctggcctccagcaccggcgaaaccgatctgaacaactccgtgcccgccacctgcttcccgccggcggccggcctgtccagctcctggaatccggaactcatccacaaggtcggcgaggcgatggccgaggagtgcatccaggaaaaggtggctgtgattcttggccccggcgtcaatatcaagcgcaacccgctcggcggtcgctgtttcgagtactggtccgaagacccgtatctcgccggccatgaggcggtcggcatcgtcgccggcgtgcagtccaagggcgtgggcacctcgctcaagcacttcgccgccaacaaccaggagaccgaccgtctgcgcgtcgatgcccgcatcagccagcgcgccctgcgtgagatctacctgccggccttcgaacacatcgtcaagaccgcccagccgtggaccatcatgtgctcctacaaccgtatcaacggcgtgcactccgcccagaatcactggctgctgaccgacgtgctgcgcgacgaatggggcttcgagggcatcgtcatgtccgactggggcgccgaccatgaccgcgtggcctccctgaacgccggcctcaacctggaaatgccgccgagctacaccgacgaccagattgtctacgccgcccgcgacggccgcatcgcccccgcccagctcgaccgcatggcccagggcatgatcgacctcatcaacaaggcctgcgccgcgatgagcatcgacggctaccgtttcgacgtggacgcgcacgacgaagtggcccaccaggccgccatcgaatccatcgtcctgctcaagaacgacgatgcgattcttccgttgaacgccgaccctgccgcggcccggaagatcgccgtcatcggcgaattcgcccgcaccccgcgctaccagggcggcggctcctcccatatcacccccaccaagatgaccagcttcctcgacacgctcgccgaacgcggcatcaaggccgacttcgcccccggcttcacgctcgatctggaaccggccgacccggccctcgaatccgaagccgtggaaaccgccaagaacgccgacgtggtcctcatgttcctgggcctgccggaagccgcggaatccgagggcttcgaccgcgacaccctcgacatgcccgccaagcagatcgccctgctcgaacaggtcgccgccgcgaaccagaacgtcgtggtcgtgctgtccaacggctccgtggtctccgtggccccgtgggccaagaacgccaagggtatcctcgaatcctggctgctcggccagtccggtggcccggcgctcgccgatgtgatcttcggccaggtcagcccgtccggcaagctcgcccagtcgattccgctggacatcaacgatgacccgagcatgctgaactggccgggcgaggaaggccacgtcgactacggcgagggcgtgttcgtcggctaccgctactacgacacctacggcaagtctgtggactacccgttcggctacggcctgagctacgccacattcgagatcgctgacgtcgccgccgccaagaccggcgcgaacaccgccaccgtgaccgccaccgtgaccgccaccgtgaccaacacctccgatgtggacgccgccgaaaccgtgcaggtgtatgtggctccgggcaaggccgacgtggcccgcccgaagcatgaactcaagggcttcaccaaggtgttcctcaaggccggcgaatccaagagtgtgaccatcgacctcgatgaacgcgcgttcgcctactggtctgagaagtacaacgactggcacgtggagtccggcgaatacgccatcgaagtgggcgtgagctcccgcgacattgccgacaccgttgtcgtgaccctcgaaggcgatggcaagagccagccgctcaccgaatggtccacctacggcgaatgggaggctgatccgttcggtgccaagatcgtggccgccgtggccgccgccggcgaggccggcgagctgacgaagctgcccgacaacgccatgatgcgcatattcctcaactccatgccgatcaactcgctgtccaccctgctgggcgaaggcggcaagaagatcgccaagttcatggtcgacgagtacgccaagctcgcgaagtaagggctgaagcgaggcaatcgcacggcgtaagaaacccccgttgagggggattttgtctgttaacggattacactggaataccgtaaggcagggacaatggagggtttgtggacagaactatgccatacccccgtttagggaagtattcacggggggggcgttcccggcgacaacacccccggatcatcaacgacagggcaggaaagtcataccaggaccggcgacccggccccgaccatcgaggcggcctaccaaacatggtaatggggtggcagcatgaagtgcttttggtcggtgataccgatttcattacccaacagtggattcagcatgcctttccccgagaccatgtggtgatagcggaacgagaaggtaccgtaggcggcaatgaccgtctcagaatcgtcaacatgtctggcgccaacacccttgccgaaaccattactacatacgaatttgatcgcatcgtattcttttccgaaaatctgaccccacgcagtgaccgggacggcgatctgggagcattgcgaagacttctgcatgccattcgcaacaggcaaacgcaaatgctgatggtcagcggccccgaatctgaattcatctatccggaaaacgccgacgtacgcgataccagcaaaagccagatgtctcgagcgttggaagaactctgcctgtactacgcacgcacctaccgtctggaagcgaaaatcattcgctgcccatacctgtatgcacccgaacgcaatggggcaaccgcatatttcggcaggctgttcgaacaggcgtcagcagggtcgatctcattccgtgaacgcgaacagcagcagacatgctttctctgcgccgacgatcttgccgaactgatctaccgcatgttcgacgattggaccgccgaaagcgaagtattccacgtgcccaacgtgttcaacttcacatacggtgatttggctgatgtgatcagcgcggcatttcccggattgtcggtgacttttggcgaagacaggccccaaagttacccggcagacgaccatgcgctgcgcttgcgttatggctggtcgccacgatactcgctcaaacaggatcttcccctggtgctgcaacgctggaaagaggcgcgtgcgcgggaacagtccgaaaagcacccgatctgggattttctgcgtaaccattcgaaaccatggatcgtattcgaaatctgcgtcacgttcatactggaggaactgcttcgcaccgcggtacacggcgacagtcagctgggaaccgtggatttgcgcctgtttttcgtggtgatcgtcggcacgatgtacggaatgaacgcaggcgtgttcgcggccgcgctcgcatgtgccggcatggcgttgtcgtacgcgtcgaacggcgcgtcattcgctccactgttttacgacacgtcgaactggcttgcgttcgtagtgtatttcgttgccggcgcagtatgcggatacgtgcagatgcgcaatcgcgaaaacctgcgattcatgcgtgacgaaaacagtttgctgcgtgaacgactcgcgttcctgcgtgacctgtaccacgatgtgcttgatgatcgtcgtatgctgcgcggacagattatcggcaggcgcgacagtttcggcaaaatgtatgcgatgacccgtgaattggacgaagtgctgcctcgaaagctgtatcacgcggccattcgcattatgcaagatacgttgggcggcgatagtttcggtatttaccgaatcgataatggtggtcgtttcgcacgtttggtggccgcgagtccgcaggccgaatccttattcagtaaatcggtgctgcttgagaattatgccaacattgtcacggccttggatcatgacggattgtgggtaaaccgcaatcttgaacaaaaccttccaatgtatgcggcgggcgtgcatgccgatggcaagctggccgtggtgattgtgcttgccaaagcgcagcccgaccaaatgaacctgtacttccagaacctgttcaccatcatgtgcggcttggtgcaatccgcgatggtgcgtgccttcgattatgagaatgttgcgcggcagacgatgctggtgcccggcacggaattcttgaacactcaggcgttcctgcccaaagtgctggctgcaaacgagctcaagtacgatcatatgagcaatcatctgctgttgcgtgtggaaggcgcctggcaagacgatggtagccgcctgaggggagcccttcgtcaaacggatgaggccggtgtactgcaggacggcaatgtgtatgtgctcatgaatcaggtcagcgagcatgagctgccgatcatcaacggtcgtttgacccaggctggattgcatgcgaagttggtttcagtccacgaggaagattcgttgctggctgaggcttcggaacaagtagctgccgagtcgcaagcggatgaaacgccgcgcagtgacgctgcgccgaatgactccgcatcgcatgaaggtggcgcagcatgaatgcgacggtgatggcgatgctgcttatcgccgtgcatgtaatgatatgcgtgctgctgtgcgtattgtctcgtgttggcgtgcttcgtgtggaggggcgactgcttcctttcatgctgctggtgccattgtgggggccgttatgtgtgctgttgctgcatgcgagcacgctgattcgctctggcgagcacacggttccggggcttgagcaaatgcgtgtggatgatgaggagcgtcgaagcattctcgttggggaacgagccgatttcgccaatacagtgccgttggaagaggcgttgatcgtcaatgattcgagtcagcggcgcagtctggtgatgtccattctcaacgataatcccagccgttatatcgatgtgctgtcgcaggcccgactgaatgaggatgtggaagtcgtgcattacgcggctaccgccttggcgcagatcagtgccaaggaagatcttgcattgcagcgctgccgtaacgattatctgcagcatcgaaattccgaaacgatgttggaacggtattgcgatgcgctggaacgatatgtcaattccggtattgcgcaaggatacgctttgcagttgcagaaacaacgatatgccgaagtgttgcaggaacgacttcgccaacatggcgattatcacgttgcgtgccgtcttgcgcaaatgcagattgatcttggactttttgatgatgccgcacacaccgttgacggcgctatggaacggtggccggatcaaggcgatgtatggctgatgcgtctgcgactcgatgccgcacgcaatgatggcgatgcgttgcatcaaaccgttcagcagatcgaaagcaaacatatttatctcggtggccagggaagacgagctctgcggttctggactggaaccaaggaggttgaacgcgcatgaccagaggattcctgtcagacgtgttggccaagtggaagcgattccgctggcaaggtctggtcaaagtctgggccatgttcatggccatcgctttggtgttgctggtggagagcctgggcgtgcattacggtgcaacgcggttcgacatcacctacttggatcgagacaaagccattccagcagccgacgccatcgctggcgaaaaagccacgaaccttttggtgatcgacagttcgcaggagggtgtctccgatgctgaaagcatgcttgaccgtgtgcttcttgacatgaaagtgcccactgtcaccgtcgatcttgcgcaaggtgacgagattcctacgttgaagcagtatcagacgatggtgattgccatgcccgacttggatccgttgggcgaacatgtgctgcagatcatgcaatgggtcaaaaagggcggcggcgtcatgttcgccatgaccccggagaaaaccggctatctggatgtgatcggcccgcagatcggcattgaatcgtccgcatacaaatatgtggtgactgagggcatcacaccgtccaaggattttatgttgggtggcggtcagacatacatgttcagtgacccgttcaaatcgtcgctgagcgtcacgttgaatgatcgtgcacaggtggaggcggtcagcagcaatggcagaacgccattggtgtggaggagctcggtggagtcaggaacggctgtgatgtgcaatatcggcatttacgtcaagatggttcgaggattttacgcttcggcgttcagtctgctcagttccgccatggcctatccggtgattaacagcgcggctttctacctggacgattttccgtctccagtaccgtctggcaatggcaaatacatcaaacgtgactacaacatgagcatttccgaattctattctcaagtatggtggccagatttggtgcgtcttgcggaacggtacggtattcgtttcaccggtgtgatgattgagaattacggcgatgacaccaagaatgatcctgtacggcagacggacaacacacaattcgagtattacggaggattgctgcttcggcaaaacggcgaaatcggatatcacgggtacaaccatcagccgttggtgttgccgaatacggattacggcaacgaatacacgtacgtgcaatggccgaatcgtaaagccatcgtcgattcgttgaacgaactgattgcctttcaaaagacagtgcttcccgctgcgacatcgtcggtctatgtgccgccgtccaatattctttccagtgaaggccgccaaatcatcggtgaggatgtgcctcagattcgtgccatcgccagcatggcctttcctcccgacagttctctggagtatgtgcaggagttcggcgtggcagccgatggtgtggttgaagctccccgtattgtgtcgggaagcatggtgaataattcatacatgcgtcttgccgcggtttccgaactgaacatgcactatgtgagcacgcacttcatgcatcccgacgatctgcttgatgaagatcgtggcgcgaaagaaggttgggaaacctatcgcaagggattagaagattatttggattggttggaacagtcggctccgtccattcgtatgcagactggaacggaatgcgctgcggcggtgcagcgattctcaggattgacggtttcgatggcaacgtccgatgatagttgggatttgcatcttggcaaccttatcgatcagggctggctcatgttccgtgcgaacaatggcacgcctggcagggttcgtggcggaagcctcaccaagctgaccgggaatctgtatctgctcaaagccacgagcgccacggttcatatcgaacgcaagaccgggggagaggcatgagaatctgcctggttttggaaggatgctacccgtacgtgcatggtggcgtgtccacgtggatgcatagttatatcgaagcgatgaaagagcacgagttcgtattgtgggtgatcggcgccaaagccgaagaccgcggcaaattcgtatatgacctgcccggcaatgtggtggaagtgcatgaggtgttcctcgacgacgccttgcgtctgagcggtgaacgagcgcaagtgtcgttcaccgagggggaattgcggtcattgcgcgaactggtgaatcttggcagcccggactgggatgtgcttttcaacctgttccacacaagaggcgtgcatccgctttcgttcctgcaaagccgtgaattcatcgacctgtttacgcaaatctgcatggaagaatatccgtatgtggcctatgccgacgctttccatactgtgcgctccatgttgctgccggtgttgtacttgatgggcggcgaagtgccggaagcgcagatataccatgcgatttccaccggatatggcggattgctggcttgtttgggcggttccatcaaccatgcgccggtattgcttacggaacatggcatttatacgcgcgaacgtgaagaggagattatttccgccgaatgggtgttgccggctttccgtccgcgttggattcgtttcttctacatgctttcagaacatatctaccagcgtgcatggcgtgtcactagtttgttcggtcgtgcccgtcttatccaaatcggtatgggtgctcccgccgatgcctgccaggttattcccaatggcattcaatacgaacgtttttgtgatattcccctgaagcccgatgacggttgggtcgatatcggtgcggtggtgcgcatggctcccatcaaagacgtgaagaccctgattcacgcgtttcatgggctttcatctcgtgttgacaacgttcgcctgcatattctcggcggtgttgacgatcaggagtatgccgacgaatgccatgagcttgtggagcagttgggtgtgcgcaatcttgagttcacaggacgtgtgaacgtggtcgaatacatgcgcaagcttgatttcaccgtgttgaccagcatttccgaaggccaaccattgtcggtgttggaatcgttcgcagccgcacgcccgtgcgtgaccactgatgttggctgttgccgtgagcttttggaaggcgaggatggcgacgatttcggcactgccggcttttatgtgcctcccatgtaccgcgaaggcttaagcggggcgatggaacgcatgtgttccagccgtacgttgcgtgaaaccatggggcagatcggccgcaatcgtgtgaacgcctattaccgtcatgagcgcatgcttgacgattatcgcaagctgtatgccgataccgcggatcagttcggattggaacgctgatatggccggtattggatttgaactgaagaaactgttccatcgtaggggcttgatggcgatgctgcgagcctacggctatgccggcgtgatttgcgccggcccgatgctgctgggcgtgcttctgcagtttggcgtgctgatcgtgagcagttggtggcaggtgggccgccccgaccgtgatctgcttgtatgcatgatcacatacacattgctctcctcgttggtattgacaagttttctgtcgatgccggtcacacgttttttggcagatatgctgtttgatcacgatgagaagatgattctgccgtcgtttggggggtctaccggcatcatgttggtagcgggcgcggtgttgtacacggtgtttctgctgttttctggagccacgctgatgcagggtgtgttgtgtttgtggctgtttcttgaaatggtcgtcaactggaatgcgatgagttatttgacggccattaaagattacaaaagcattctgtattcttttgttgcggcggtgctggtggcgttcgtcacgtcatgcgtgttgcttgcgttggcatgccctcctgtggagtcgctgttgttcgcagtggtgcttggctatggtgtgatgctggtgtgggatgtactcttgttgcatcgttattttccgcaaagtcgtgagcatccgtggctgtttctgcagtgggtcgatcagtttctgccgttggcgttgaccggattgttcaccactatcggcctgttcgcccatttggtgatcacttggtgtggacctcttggtatcaaggtgaagggtttgttttatggtgcgccatattacgatgtgcccgccatgctggcgtttttgacgattctgatcaccacggtgaattttgtggtgtcggtggaggtcaatttctacccaacatatcggtcgtattacagtttgttgaatgatggaggcacggtcaaagacattaccgtcgccgaaaacgaaatgctggctgtgctcaatcgagaattgcattacacggcattgaagcaattgctggtgaccgctgccgtgatttcgttggaaaaaacagtgctgaacgcgcttcctttgggtttcaacgatgtgatgcacggatatttccgtgtgctctgcgtggggtatgccctttatgcggtcggcaacaccgtgatgctgattctgctgtatttcaccgattattccggtgcgttgacggcatcggcattgtttgccgtttcaacggttgtgttcacggtgatcagtcagtttttcactacgacactgttcggtttcggtttcctgatgggcgcttcgttgtttgccatatacgcgactttccgtctcgcctcatataccgacaatcttccgtaccgagtattggggcagcagccgattgtggcgcaaacaaagcggggacgtttcacggaattgggcatactgcttgaacgtggcgaacagcggatcgaccaatcattgcatcgtccaaggcatgcacggtcttctaacaaggcgaataatgcagaaaacggatggcataatcgggaggaatcgtaaatcatgacatggtggaatcgacgcagcgcaaaagccattaccgcgcttgtcaagcggatagcggcattgatggcaatactgacggtgctttcctgcgccggatgcgcgacctcgacacctggcgaaagcgggcaatcgcaatcatcggattcgtcgcagacgcatgagcaagtcaagaaaagcgctgaacaaagcatcgacggcgcacacttgcgtgacaacgaatcgttatacaaggtgtatgacgatagcggcgtggaaaccatgtatttgacggtatcgcgcggtaattcgtcggaaggcaccgaccatagctggagtgaaatcaaccaatactccgcagatgactatacggccatgggcgttgaacgctacaaggtcaatggtctgctgcaggtgggcgatgagcagggtcccgtctccggcgaactcggcttcggcgaaagcgcgccgaacgccaccgtgcagatacgaggccaatcgtcaagtaaatttcagcagaaaaactacaagatcgagttgaaaagcggcaaaggcaagtggcgtggacagcgcaccatcgcattgaacaaacatgtgaacgatggcttgcgtttccgcaacaaaatggcgtacgaccttatcaagggcattgaccagatgatgggcctgcgcacgcaattcgtgcacttgtatgtgaaagacgagaccagcggatcggattccttcgacgattacggcctgtacacgcaagtcgaacaactcaacaaaaccgcattgcaggcgcacggactcgacaaaaacggccagttgtacaaagtcaatgattttgaattctatcgagacgaagatgtgatcaaacttgccgacgatcccgactacgatcagacgaaatttgagaaaaaactcgaaatcaaaggcgacaacgaccataccaaactgatcgccatgctgaatgatctcaatgattattccgtgccgatgagcgaaatcctcggcaaatatttcgataccgaaaacatcgcatattggatggcattccaattgttgaccggcaatatcgacacgcaaaaccgtaatgtgtacctatatagtcctacgaattcgcatactttttacctgcttgactgggacaacgacggtatgctcatgcgcaaggaatatgagatcaggcaacgtgccgacggccaaagctgggaaaacggcatcagcaactattggggcaacatactgttacgacgttgcctgcagaccaagtcgttccgcaccgcgctcgataaagccgtcaacgacgaatacaaatacatgagcgccggtcgcatcaattccatggtgcggcagtatcgttccatcgttgagccatacgtgcagaagatgcccgactccatgcatgagcccctgacgtcaagccaatacgacacggtggcagaccaattgcacagcgaaatcgagcagaattaccagacgtaccaaaccggattcaacaagcccatgccgttctatatcggcaagccgactcccgccaacggcaagcttaggctcaactgggatgtggcctacgatttcaacgatgaggatctgcgttacgccgtcaccgtgtccaaggactatgcgggcgacgacgtagtgttctcgcaaagagatgtcgtgctgccggaagccgtgatggacatgcctgacgaaggccagtacttcatcaaggtgagcgtgagcaacgcgtcaggctacacacaagacgcgttcgaccattacatcaccgacggcaacaagatttacggcaccaaatgcttctatgtgaaagccgacggcagcattgtggaggatgccaatgagtagcggccgcggcaaccatggcacgtcgctgctcggccgcatcgcgaaccgtgtcggcgaagagctttccgttccgccgcgcacggccaaggaacggttccgtcatgagctcaaatatctgatctcatacgcgcaaaaagccgatttgaatgtgcgcatggcaccgctgcttggccttgacaagcatgcgggtaatggcggctatatgattcgcagcctgtacttcgacgattattggaacaccgcgtatcaggaaaaagtcgacggtgtgctgctgcgcaagaaataccgtattcgcatctacgattacagcgaccgcgtgatcaaactggaacgcaaacgcaaaagcgacagttggatttacaaggaggatgcgccgctcacccatgagcagttcgaccgcattcttgccggcgattacgagtttttgcgcgacagcgagcatcaattgtgccgcgagttttatgtggaatgcatgtgcaatgtgttgcgtccgcgtgtgatcgtcgattatgagcgcgaaccgtggattcttgacgctggtaccgtgcgtgtcactttcgatatgaatgtgcgtgcggcggttggaggattcgatattttcgactccacactgccggtattgcccgtgcttgagcctggaaaactggtgatggaagtcaaattcactgaattcctgccgcagatggtacgcgatctgttgccgggcaaagctcaggagttgacgtcggcttcgaaatacgtgctctgttatgacaaagcctcgtatttgcggggattcggctactggcaggaaggttggagcgtgccgagcctgtaaagccgagcctgtaatcagctgacatttcggctggcgtatcccgaaacaatacacgttacgaatcaaggaagtaacagagaaagagcagcgttatgagcgttaatgacatgatcaaaaagtcggtgctgaaatccttcacccaatacaatgtgcccaaaatggcgttggcattgctggtggcgttgatcgtcggcatcatcatctactacgtgtaccgccgtttctacacgggcgtggtgtattcgcgcagtttcgcggtcacattggtgggcatgtccgtgctcacctgcatggtcacgttgtccatcagtacgaatatcgtgatttccctaggtatggtcggtgcgttgtcgattgtgcgttaccgtaccgcggtcaaggatccgatggatttgctgtatttgttctggtcgattacttcaggtattgcggcgggtgctggcatgtatgtgctggtgattgtggccggattggtgatgatcggcatgttggcgttgttctattcgcatcaggacaagggtcgcgtgtacattgcggtgatccattatgtgggcgatatggttggcgatgagatcacgcgcgcgttcggacgtaccaaattcttcgtcaaatccaaaaccatgcgtagcgaacgcacggaaatggccgttgaagtgttttgcgacgacaaggatatgacgttcgccgaacgtatccgtgcgattgacggcgtcgaggacgtcacactgatacagtacaacggcgaataccacggatagttttttcgacgaggggaggaccgagtgaccgacatgccagaaatgggcggaatgccgtccgacaacgagctggtgcctttcttcacattcgaagacatcgatcatgcgctcgaaaacggcgaattctgctgttatctgcagcctaaatgcaatgcggagacaggaaccattgtaggagctgaggcgttggtgcgctggaatcaccccaaatatggcgtgattcccccaagatggttcgtcccggtattggaaagagccgggcgtatctgccatgtggatatgttcgtatggcgcttcgtggttgagatgctgggcagatgggagcgtgaaggacgcaatctggtaccggtttccgtgaacgtgtccatgatggatatcgaccagatggatgtggccgacatgatcggcggactgttgaacgaatatgacgtcgacgcgcgtctgttgcgggtggaaatcaccgaaagcaccgtggcgaaaaacctgtccatggtgaaggacaccatccgtaaactgcatgcgagaggcatcgtggtgctgatggatgatttcggttcggcatattcctcgctgaacatgctcaaagacattaatgtcgatatgatcaaactggacacgaagttcatcgagctgagcaaggagaatgccggtaaaggcgtgaaaatcatccaatccataattgtgatggctaagaagctgcatctgatggtcatcgccgagggcgcccagaccaaggaacaggtcgattggctggaagcagtcggatgcggatacatccaagggtattatttctaccctccactgccggtgaaacggatggaaacgctgttggccgagcgtgccgacggtcggcactattgggatatgccgtgcgattacctggatcgcggtcatgtgaccgtcaacggccgggtgctgttgggagtctccgcgttggcggccgacgcctttgaaatcctggctgatggtctggcggaaatatctcggttgaatgtggcgacaggcgaataccgtgccatcaaacgagatggggtgattcccgatccggaagtcgacgaattcggcgcctacatgcgtgcggtgaccgccagccgggtggtgcatcctgacgatgtcggacgatttctcgccgatctgaatttgtcttcgatccgggaacggctatacaggcaggaaaccgtgctggggatataccgcagcgagatattggccaaaaccggcgtagtcacattcgcggcggttcccactcacgcatgctccccatccgacccttgggctgtggtgctggtcggacggaatctgcccatgggactattggcatgcagtgatgccgataattaccgcagggactcgcttacgggactactcaaccgcaatgcctacgataacgatttggagtgcatccaggccccgcatgacaagccgttgacggtggtgtacgtcgacatgaatggactgcatgaaatcaacaaccatttgggacatgccaagggcgattcagtgttgtgctgccttgcgaatgcgatgcgtgcctgcttcggggacgacaggatctaccgcatcggaggtgatgagttcgtgattatcagctgcaaccatacagtgagccaaagtatgcgtcggatggcgcgtatgcgtcgggattttctgaaaggtgattgggatatatccgtaggcatggccgaatccgatgatggaggggatcttccagacctcatcaagcaggcggaaatccgtatgcgccaggacaagaaacagcattacgtcaatggtggaggcaaacgccagctccgcatgctcaacaaccagcttgagaatattctggtgcgcaatggggatgtgagaatgctgcttgaatatctgaatgtacgttatccggtgtcatttatcgtcaatctgaataccgatacgcagcgttcgatcatggtgcccgatttctttcagcgtatgcttgatggtcatggcggttccttccgcgaagcattacgtgagttttgctgtgtgagggttgttcccgaatatcaagaaggtctcctgcgactgcttgactacgatgtcgtccgtagccggctcaagtcggaaggtgcagtgcaatgcggttacgtgaggaacgacggtgagcggttcatgttgacgattcttaccgacagcagatccgcggacgagaccatgtgggtgttcgaacataaggtgctgccgtagcggaaggctcgagaccctcagaggcatagccctgggattccgcaacctcgacaccaccatcaccagaagcctgctgcacgccggcggcttcaggcacgccatccaaacccgcctctgacacatgcccctacacgccaaaatcggaaaagctggaaatactacaacgcgccgattgttgtatgtgcaacttttgtatatgggtctcttgattatgaatttgaacatcaaacgctccctcagtcacctgtggtgatggctcccgatcaagacggagcggaggttgctgacacgaaggaggagaacgaatgagcgataccgcagaggcaatcgcgcaggcgcgcaaagccgtcgaaccggacaagcccaaacatgtactgcgcacgctgggccattcgattcgtgaatacaagaaagccagcatcctggctccggtgttcgtggcggtcgaaggtattctggaaatcctgattccgaccatcatggcttcgctgatcgatgagggtatcaccggtggcagcatgccggccaccgtcaagttcggcgtgattctgctggtgtgcgcgatggtttcgctgggtgccggcttcctgtccggaaagtacgcggctgtggccggcgcgggcttcgccaagaacctgcgcaaggaccagttcgagaaggtgcagggcttcagcttcaccaacatcgaccggttctccaccggttcgatcgtgacccgactgaccaccgacgtgacgaacctgcagaacgcctacatgatgatcattcgtctgggcgtgcgtgccccgatcatggtggtcgtagcctggctgttctcgttccgtatctccccgtcgatttccatggtgttcctggcctgcatcccgattctggccatcggcctgtgcggtctggtcgtgctcgtgcaccccgtgttcgagcgcgtgtttcacacctacgatgcgttgaacaacgtggtcgacgagaacctgcagggcatccgcgtggtcaagtcctataaccgcgaatccttcgaggtctccaagttcggccgcatctcccagcgcatcttcaaggacttcaccaaggccgaacgcatcatgagcttcaacatgccgatcatgatggtgtgcgtctacgcctcgatgattctcatcgcatggatgggcgcgcggcagatcgtcgcttccggcaataatgcggcgttgggcctgtccaccggcgagctgacttcgctggtcacctatgccatgcagattcttatggccataatgatgctgtccatgattttcgtcatggtgattatttctcaggcttctgccgagcgtatctgccaggtgctgcaggaggaaagcacggtgcagaacccggctcacccggtgactgacatggccgacggctccatcgaattcgaccacgtcaccttccgctactccgacagttccgaaaagcccgtgcttgacgacatcaacctgaagattcgttccggcatgaccatcggcatcgtcggcggtactggttcggcaaagtcgtctctggtacagctggtgccgcgactgtacgacgtgagctctggctcgctcaaggtcggcggcgtggacgtgcgcgactatgacattgaggcgctgcgcgatcaggtggccatggtgttgcagaagaacgtgctgttctccggcactattgccgaaaacctcaggtggggcgacccgaatgccaccgatgaggagattcgccatgccgcgcagctcgcgcaggccgatggattcgttcaggaattccccgataagtacgacacgtacatcgagcagggcggcgccaatgtgtccggcggacagcgccagcgcctgtgcatcgcccgtgcgctgctgaagaagccgaagattctgattctcgacgattcgaccagcgccgtcgataccaagacggacaagctgatccgcgccgcattccacaacgagattccggacaccacgaagatcatcattgcccagcgcgtggcctccgtgcaggaatccgacatgattctggtgatggattccggccgtatcatggcctccggcacgcacgaggaactgctcaccacttgtgatgaataccgttccatttacgaatcccagaccaagaaccaggctaagaccgaagaactggccgctgccgaacaggctgctgagtcatctaccgctgagccgtccgaaaccgtgacggtgacagtgaccatgcccacggccgataccagcgcagttgataccaatgcagccgatacccaggaaggagaagcacgatgagcaacgaccagagtttcaagaatcgcgagcccgccatgggcaaagccgaccccggaaccatcaagcgcatcttcggctacatcttccaatacaaattgcgcgttatcgccatcgtggtgtgcattttggtcggtgccgccgcgcaggccggatccgcgctgttcctccaatcgctgattgacacttacatcctgccgatggtgggggaatcgaaccccgactgggctccgttgctgcgcgccatcagtctgatgggctgcctgtatgtggctggtatcgtgacatcctgggcttggcagtggctgatcatcaccgttgaacagggcacgctcaagaagattcgtgacgatatgttcgcccatcagcagaagctgccgattcgctacttcgacagccacgagcacggcgacatcatgagccactacaccaacgacaccgatacgctgcgccaggccatctcgcagtcgttcccgcagatgttctcctcgattatctccgcggccgcggcgctgctgtccatgctgtggctgtccattccgttcaccgcgttcgtaatcgtgttcaccgttctgctctacttcatcgtgcgcaagatcgtgagccgctccggccgctacttcgtcaagcagcagcagtggatcggcgacgtgaacgccttcgtggaggaatccgtcaacggccagaaggtcatcaaggtcttcaaccatgaggacgccacccagaagacatttgacgaaaagaacgaggaactcttcgaggcgtccgccgaagcgaacacctggggcaacgccaccatgccggtcgtcggcaacatgggctacctgctctacatcctgctcgccatcgtcggtgccgccgtctcgctggccggcgtcaacgacatcggcctgaccggcgtcaagccgctcaccctcggcacgctcgtctccctgctgaccctatcccgctcgttcatcaacccgatcggccaggtctcccagcagctgaccatggtgatgatggcgctcgccggcgcctcccgtatcttcaagctgatggacgaacccatcgaggaagacaagggcaccgtgacgctcgtcaacgtggaacttggcgaggatggccgcaccatgaccgaagtcgaccacgagaccggccactgggcatggaagcgtgaggtcggcgacgacggtacgaggtctctgaaggccgcagaaaagctgcgcggttccgcctgcgaggtggcgatgaaggccaaggagcaggcgatcacctcgcctgatgggcgttatacgctgctgcgcggcgacgtgcgcttcaccaacgtgaccttcggctacaacccggacaagccggtgctgcacgacatcacctggttcgccaagcccggccagaagatcgcgctcgtcggcgccaccggtgccggcaagaccaccgtgaccaacctcatcaaccggttctacgacatccagcaaggtcagattctatatgatggcatctccgtggccggcatcaagaagcctgatttgcgcaggtctttgggcattgtgctgcaggacgtgaacctgttcaccggtaccgtgatggacaacatccgttacggccgcctgaacgccaccgatgaggaatgcatcgaggccgcgcgtctggtcaatgcggacagcttcatccgcatgctgcccgagggatacaacacggtgctcgaaggcgacggttccggcctgtcccagggccagcgccagctgatttccattgcccgtgcggcggtggccgatccgcccgcgctgatccttgacgaggccacgtcctcgattgatacgcgcactgaagaggttgtgcaagctggtatggataacctgatgaagggccgtacggtcttcgtcatcgcccaccgcctgtccaccgtgcgcaactccgatgtgatcatggtgctcgaccatggcaacatcatcgagcgcggctcgcatgacgagctgatcgcgcagaagggcgagtactaccagctgtacaccggcgcggtggaactggagtagccggtacgccagcaaaaaccgcacctcgattatcgggttgaagcaattctcatccggtggttgaggtgcggttttctatgttgagagccgtgtgttggcgcaggattacgaatattggcggtgaaaagagtacatttgaattgttgctttgacgatgtatcggccgcaaggaggggactatggcgttcgtgacgttgaaggatgttgctcaacgtgccggtgtgtcggctgctgctgtttcccagatacttcacaataaaggccgcttttctagcgatacgcgacagttggtgctgaaaactgttgaggaaatggggtatgtgcccgatcaacgtgctcgctccatgcgctcgtcggatactaagactgttggcctgctggttcctgatttgcgcaatccgtatttcgccgatctggttgcttcgatggaggatgaactctaccggcatggggtctccactctgattggcacgtcttcggaaagcgtggaacgccaggatgtgtttatcgagaatcttttgggccaacgtattgatggggctatcgtcgtaccgcagggtgtgaaatcccccggagtgcaatcgttgatacaacgagacttgccgttggtgttcgttgatcgtcgcgttcccggtgtcgagtcggtgccgtttgtggtttctgatccatatacgggaattcgtgaggctcttgaagaactggtgcgtctgggccatcgacatgtgggctatatgtctcatccttcgctcgaatcgttcagtattgacgaacgagagaccgcatttcgggaagctgccgccgatgtgcttgctgacggcgatggcgttgtcgcagcttgcgactccacttatgaatcgcgtgccgctgcggtagagatgctgctgggtgcaggggtgagcgcaatattgtgcgcatattcgccggatgcgttcacggtgattggactgctgcatgaccgcggggtggcgattggcgaacgcatgtcgttggtgtcgttcgatgatatttcggcgtttaccgtgatgacgccgcgcatcgccgtgatttcccaacaggcggatttgatggggaagcagggtgtggagctattgctgcaactcatccgttcgggatccatggatggcggcatcacgcattccgtgcccacgatgttcatcaaacgcgaatctgtgggtgaggttagttccgcgtccgtcgccaatcaatcagcggaagtgtgattcaagcggcttcgagaggaatgcgcggatacctttgacgcgcaggtagatgaggcattgacaatagtgatttaacgtcttatcatcaaataagctgatgatgaaacgttaaatcatcagaagtcagagatgacccagcggctgttatggaagcaaaggagcactttgatggaaaaaattattctggattgcgatcccggtcatgatgatgccatggccatcatgcttgctgtaggcaaccccaaaattgacctagtgggtgtgaccacggtgggtggcaatcagagccttgaaaaggtgacgtacaacgcccggtccgttctggaaatggcgaaggccacggacatcccggtgcacgccggttgcgataggcccctcgtccgcaagcaggaggtcgccgcatcgattcacggcgagaccggtttggatggcgttgaattgccggttcccacccgtccactggattccggccatgccgtgaactggattatcgatacgattatggccagcgagccgggaacaatcacgcttgtgccgaccggccctctgaccaacatcgccatggccgcccgtatggagccgcgcatcgtagaccgcgtcaaggaagtcgtcctgatgggcggcggataccacgtcggcaattggagcgccgtagcggaattcaacatcaaggtggatcccgaggccgcgcacatcgtgttcaacgagccgtggaagctaaccatggttggccttgatctgacccatcaggcgctgtgcactccggaggttcagcatcgcattgatgccatcggcactgattcgtcgcacttcgccagcggacttatggacttcttccgcaagacctatcgggataatcaggacttcatcgatccgccggtgcatgatccctgcacggtcgcctatctgattgatccgagcgtggtgtcgactcgccgttgcccgctggatgtcgaaatccacggtgacctgacactgggcatgaccgttgccgacctgcgtggcccggaaccgtccgccgaggaatgccatacgcaggtcgcggtgaaactcgacttcgataagttctgggatctcattgtcgatgccatcgttgctatcggctgacgggcgaagaggaatgcgtaaaaggacaagggaatagtcatgtcgacagtcagatccgaaaaaatgcttgatgagggcggcaagtccattgtcgctttgatggctgcgctgatggcgtcggtcttcgcttttcagctcaacgcttccatgctttcgccggcgcttaccactatggagcgcgggctgaacaccagcagttcacagatcagtctcacccagacggtcttcttcaccgcatgtgcgctgttctcactgttcctgcctcgactgggcgatctcgcaggccgcaagaaagtattgctgggcatgctgagcatcaccgccatcggctgtgtggtctcggcgttggccgtgaatgtgcccatgctgatggtcggtcgcgtgatgcagggcgtatgcggaccggtggtgccgatgacgctcatcatgctgcacgccaaggtgactgaggacgccaaatatgcgcgactgatgtcgattcttacctcggtgaacggcggtattggcggtgttgacgccatcctcggcggctggcttgccggcacgttcggcttccgttccgtgttctgggtgatggtcggtgtcgccgtggtcgcaatcgtgctggtgtcgatgttcgccgatgaaagcacggccaaagagaccccgaagatggattgggccggtgcaatcgttcttggcatcgccttcctggcagcctatctggccatcaatgaaatacagaaactcggcgacgcgaattgggtgctcgtcgctatcgaggtggtagcggctgcggtcgccttcgtgatcttctggaaggtcgagaaccgcaatcccgcaccgatggtcaccacccactatctcaagcagccgcgcacctggggcctgctgctcaccacattgctcaccatgaccggcgtgttcgccatcatgaacggcgttgtgccggccttggctcaggacggtaagttcggcaccggattgggagccgacgtggtgtcgttcgccacgctgaccccatatgctttggttggtctggtcttcggcgtggtcgccggtgtgcttgcctcccagttcggttaccatcgcatgctccgcgtgggcattctggtcagcttggtcggcgtgctgttcggcgtatacgttgcacacttcccgagcgtatgggccttgctggttatctcggtggtgctcggtgtggcatacgcgggcacggcgaacatcatgctcaacggtttgggtattgtgctgtcgccggacgacaacccaggatacttgcccggcctcaatgcgggcgcgttcaacctcggcgcaggcctgagctacgcagtgctatatgccgtgatgaacgcattcgcgggctcctcgggcggcactgccggttactcggcggcaatgatcgcgtcggccgtgcttctgggccttgctctgctggcttcgttcgccatccccaagcttgaacgagctgcttgaccaaaggtgtgcgtaacgcgctcgccatcaccgaactgttcggtcatccggaagtcgaggtttacaagggtctaccacattccagcaccaccgattccttcaccgtgggcgagatttccgccttcatccacggcgtcaacggcatcggtgatgttgaaattccggattctagccgtgcaccggaaaccgaatccgcctcgtcatccgcaaaaagatcggcgagtgatcgttggctctattcgtcaacgacaacgaaaggaaatgctatgacagcatctgacattcttgcggcacttgatcgaatccaaggcacggtttgcgtcgtcggttcgatgaatgccgattacacagtggtcaccgagcgtctgcccggaccgggggagactgtcaccggcggcccgctgcaagtgttacccggcggcaaatccggcaaccaggctgctgctgcggcacgtattggcgccactgttcacatgtttggagcggtgggttccgatgccaatgccgagttcctgcttggtgcattgcgagaagccggcgtggatacccagcacgtgcgtcatgtaccgggggccagcggtaccacagtcatcaccgtggacgcgaacggagagaacacgattgtctactctccgggctccaatgcgcaggtcagtgttgattatatcgaggcgatgcgcggtgaattgacttcggcgaatgtgcttggcctgtgcttggaaagcccgatcgagaccgttaccgcggctgcgcgtatcgggcatgaagccggtgtgccggtactgctcaacaattcaccgtttacgccggtgctgccggacgagctggtgcagcttgccgatatcctgctcgtcaacgagcatgagatggcgcagatgttcggtatcgccgaacccgaagacggcgactggtccggattcgactggctggctgcggccgatcgtatgcgggagctcgggttcgaccgggcgattgtgacgctcggcggtgatggctcgatggtgctggatgcatcatgtgctgttgcttcggtgacccgcatcgcaccggttcgggtcgaagccgtggacaccaccggttgcggcgactcgttcatgggtgccgtgctggcagggctggcctcaggctttgagctgcgtgaagcggctcagctggcttcgttcgtttctgcatatgcggctaccggtctgggtgcccaagcgtcttacggttccgccgcccagattcgtgagctatttgtgccctgaccggttttcggtagtttctctcaatggcctcaacccgcacgtcatattcgtgctggttgaggccattgcattaggggccgcgtatatgaacaatccccgaggcattcgccgacgaactgctagagttaaccaacgaacaagggcgttgcacttctcaatagacagcgggatgacgtgagttacactatgtagtaaagtaatttactgaaatactgcgtattgttacgtactgaggcgtggaaggctcaactatggtcacgatgaaggaaatcgcacagagatcaggcttctcgcaggccacggtatcccggctgctcaatggggacccgacattgtccgtcaaagaggagacgcgacggcgcatcatcgaggtcagcgagcagcttggctacgctaccggatcacgccgtatcgcattgccacgccgtgtggccgtactcgacaacgccacccgcgaggaagaactggcggacgcctatttcgatgaactgcggtccgtgcttggcgacaatgccagagcccagcacatggaactcacgtcgttttcccatatcgacaatctgattgccaacgccggtgatttcgacggcttcatctccatcggaccgtccgtactctcttcggatggactgttgaagctccacctggcattgccccatggcgtattcatcgacatcaacccggcgcccagcctgttcgattcggtacagccggacctggggcagaccatcctggaggccttggacgtgctgatggcctccggcaagcgccgcatcggctacatcggcggcgccggcttcacgatgggcctgcacgaataccccgaagacggccgtctgaccgcattccgcaactggaccgagcgtctggggctggatacggaggggctgatctatgcgcagggcgccttcaccgtggacaccggacgtgtcctaggccatcaggcggtcaaggaccaccgcgacgacatgccggatgcgttcatcgtggccgccgattcgatcgcggtcggcgtattgcagtcgttcaccgcggcgggcgtgttggtaccgcgcgacaccagcgtgatcagcatcaacaaccagtccatcgcccaatacacctcgccgacgctgaccagctacgacatcgaccagaacgaactggccgacacggcgatcacgatgctcgccgaggccatctccagcaaacgcacgttgcggcaccacacgttcatctccaccaccctcgtggtgcgggacagtttcgttcccgtgcgatgagcgtacggacggccccgcaacgcacggctgcgtggttgccgatggggcggtgcgggcctatgctggtgcgtgaaacgtctgtcaggggcggttaatgtcgatcgcccggtatgtccctgttgcggggtcgccgacaacgaacgaggatggtggggccgtgggcgtcgccgtccccgcgtcaggtcggtgtgcgtgacggtggtggggcgtcttgacggcgcggtgcgatggtttttggaggaaccgcaatgagcagtcaggagaacacgatcatgcggctgcagcccggtgcgttgcagcagcggacgccgatgcgcagccgctgcgatgtgacgatggacgcgatcaaatcgtatattctgcgggagcggctccagccgggcgatctgctgccgacggagatcgaactgtgcgaggccgtcggcgcttcgcgttcgtccgtgcgcgaagcggtgcgcaagctcgaagggctcaacatcgtcaatgtcgaacacggcagggggacattcgtcggttcgctgtcccttgaccccatggtggagacgctggcgtttcgctcgatggtgtcggtgggcaagaacttcgacgatctgaaggacgtcgtggagctgaggaggttcctcgacctcggatgcgcggatgaggtgtgcgcgaaggtcaaggggacggaacagcccgagctcgatgcgctcgtcgacgccatggtctcgtccgccgaacggggcgaggatttcctgtatgccgacatcgacttccatatgggactgctggatccgctcggcaacaccatcgccaagcagatggtgcattccctgtggctcgtgcacatggccgtactcccgcagatcggcttggcgccttcggagaagatgcttgacacggccgaggcgcaccgtcgcatgctggatgcggcgatcgccggcgacgcccagatgtaccgtgaggccgtgcgcgagcattaccggccgatcgaatcgatactgcgcgaacacctccccgtgcgctgacgcgtgggcgctgcgtgggatcggtccacgatccgtatgcgccgcccgacacgaggcgcggtgcactgatatacatcagatgtctgatgtataatcggggatgtacatgtctcaaccatttcatatttcgaggaggaaatatgaagccggaattcatcgttggcgcgtatgcgtcgcttccgcaggggcgtccgtcgcaggaactgtactacatgctgctgggcgagcagtcatgggtccgcgggacggaactgccgttccccggcgaccttgcgaatgaggacgaccgccattggctcgccaaacacctgcccgcccactggcacacgaactcggtcacggccatccccggcacgatgcggcgcatgaacgaggatccgtggttcggactcgccagcccgcaggaggccgggcgccgcgatgcgatcggattcttcgaggacctgcgacgcgccgtcgccgacgtcgcgcgcgtccgcggcgcgcaggacatcgcctacatcgaactgcacagcgcaccaagacgggtcgccgatgccgatcgtatggaggaatcgttgcgactgctcgcatcatgggattggagcggcgcacgactcgtcatcgaacattgcgaccgttacatagacgggcaggagccggaaaagggcttcctccgcctcgacgacgagatcgcgttgtgcaaggagctgggaatcggactgaccgtcaactggggacggtccgcggtcgaaggccgaagcgcgcggaccgcgctggaacacgtgcgccggtgcgccgacgccgacgcgcttaccggactgatgttctcgggagcggggccgaaggagacgatctatggatacccgtggatcgacggacatctgccgatgaatccggacgagccgacatcgcttatggatgcggatgcgatcgccgaatgcatgcgcgccgcaaacacgcagaaacggccgatcgcctatgtcggcgcgaaggtgtgcgtgccacgggacgcgacgctcgacgagcgcgtgcgctacctgtcgcacatccatgaggcggtggaacaatgagcgatttcctcgcattcgacatcggaggcacgaagatcgccagcggattcgtccggctgtccgacggcgatgccgctcccaccgtgttgctgcgcgatgaggagccgacacacgcctcgcagggaggcgacgccgtgcgcgagcgcatcgtcgcgtccgcgcgccgtcagctcgaccgcgcgcgtgcccaaggcatagagccgtgcggcatcggcatcgcggccgccggcgtgcccgacggcgagaccggagagatcatcgccgcgacggatctgctccccggatggaaaggccagcggatctacgatgcgttcggcgcgatcaccgatctgccggtgcatatggtcggcgacgtcgtcgcgcatgggctcggcgaagcgcattacggcgcggggcgtggcgcccgtgtcctcttgtcggtcggcgtgggcaccggcatcggcggcgcgatcatcgtcggcggcgtgccgttcctcggcgcgcatggcatggcgggacatgccggacatgtcgtgagcgctctcggtgccggggtcccgtgctcgtgcggaagcgtcgaggggcatgtcgaaccggtcgcaagcggcaccggactggcgacgttgtacaacatgcgcgccggtggcgaaccggtgcgcaatggcggcgacgtcgccgcgcttgcggcggatggcgatgcgcttgcctcatcggtcatcgaagacagcgcccgggcgctcggcgcgtgcatcggaggcatggcgaatctggtggatcccgacggcatcgtcgtctccgggtcggtcgtgaatgcggggccggtgtggtgggatgcgttgcgcgatgggttcgcccgttccgcattgccgttgctgcgcgatgtgcggatgcgtgagggcgagctcggcggcgacgcgccgctcatcggcgcggccgtcgcgtcccgtcgcgtcgtcggttgatcgggccgtcgcgttcgggcgcggcggccggcatactctgtgcaaggaaaggatacataatgatgagcaggaatccggttatcgaacgtgtgaaaggcggactcatcgtcagctgccaggcgtaccccggcgaaccgctgcgccacccggagacgatggcgcagatggcgatggcggccgtcgagggcggcgcggtcggcatccgctgtcagggactcgccgacatagcagcgataaagggccaggtggacgtgccggtcatcggcatctggaaggacggttcgcaaggcgtgtacatcacgccgacgctgcgtcatgcgcgctgttgcgcggcggcgggcgcggacatcgtggccttggatgcgacgggacggccgcgcccggacgggcggacctatgcgcagaccgtgcaggcgttgcatgatgagggcgtcacggtcatggccgattgcggcagcttcgacgatgcgcgccgcgccgtcgatgcgggcagcgacatcatctcgacgacgctttccgggtacacgggcgaacgggagaagaccgacggccccgatctcgagttgctcgagtacatggtgtcgtcgttccccgatacgcctgtgctgtgcgagggccgcatccatacgcccgaacagctgcatgacgtgatgagccgcggcgcgtgggcggccgtcgtcggcacggcgatcacccatccgacgtcgatcacgcgctggttcgccgcccggctcgaccattaacggccggtgggggcatgttcgggaacatgcgtcgcacacgtgttcccgaacacgccctcagtgcgtttcggccgcgccgaatacgctcaacggcagcgtggtgaagtacaatcccgcggtctcgcgctcccagagtaatccgagttcgccgtccggcagcatcgtcatgcactgatagccgtaatgataggggttgatgcagcgatgcgccgcccatgtgcgtgcgccgtccagactcagccgcagcaccccgttgccgcgatacggcagcatctggcttgcgttcgcgaacaccatcgtgtccgatcgcggcgcgcaggccacggcgttcggttggcagaagatgtcggggacgtctttgtcgaagtacaggtcatcccatgtctcgccgccgtcgtggctgagcgcgacgccgatgcgcccggcatggttctggttgcggaagaagcacacgacggtgccatccgcgcgctcgacgaacacggattcgtgcgtggtcgcgtcatcgtcccggatgttcttcgggtcgacggcggtgccgttgacgatgcggccgtcgttgatcatcgaaccacgtcgccatgtgtcgccgccatcgtcgctgatgagcgctccgcccgagtaatgcttgagtgaggcgccggtgcagtagaacgggacgagcagacgcccgcgatgttcggaggcctggagctggatgccgttgccgggcgagacgcccaggaagtgcatccaatcctccttgatcatgtggttgatgttgcgtggtgtgctccacgtctcgccgtcatcgtcggaatgcagttcgatgatgaagctcgtgcgttcgatgagcagtgattcgtcggggtcagcgccctccttgaggtagatgttgcccgaggcccgtccctcgtgcgtcacgttgccgtgcgcgtcgacccggtatccggtgcgctcgccgccgccgtcaagcaccgtgccgtcatcggcgagtacatagcgtgtgcctgcgcgatcgtacaggcacggtcgcccgtgccggtcgaccccggtgccgggcgtgttgttcggcaacccgacgccgccggcgaagcggtcgatgaggacggtgagacggccattgcgttcgtcgcatacaagacatgagtcgattgtgcacgcgccgtcgacgccttcgcccggattggcgatcacggtctgcatgtcgagccaggtgcggccaccgtcaagcgacctgcgcatgacgaagttgatgtggttcggcgcgtcattcgcaatcgcggtgcgctggtcggcgccggcgacgaccacgccatgaggggtgcggatgatcgaggggatgcgataactcacggatccgtggtaacccttgtcgaacagtgcggtcgtcgttagcgccggtgcgtccgaaagcctgcggatcgcgccgtcggtgagcggggtcgtgaagacgccgccgttgcgcacctcgcccatgagcctgacgccttccgtgttctgcccgatggccacctcatccagttgcggccagtcgccgaagaacacctgtcccgcttgatgcagttcgtgccagccgtcgacgtacatgtcgatggcgccacgcgcggaacgaatcgacagatcatgccatcggccgtcatcccatgcgccgcgcgcatggtaggtggatggctcatacaggccatccgcggccgtcatcgtgatgccgttgtcgtcgatcgagacggcgaggcgttcctcgccgcgctcgccggcggcgagaagcgtgccgtactggcggggtccgcgcacacgaaaatgcatgaagatcgtgccggaacgtagcgtgcgcacgcggcgcacatctcgcggggcgagctgggccgcggcgaagtcgatgtccggtgcgggtctcggcgtcaaggcggcgatgctttcggaggtgagggggattgcatgcagacgcatgtcggtcacgtcgatggacgggcccgcgaggcgaatcgcgccttggcctgacccctcggttccggtgagcgtcgtggggcacaggttcgccgtgccgctgaagcactgggagccgtcgaggtagacgcgcgtgccgaactcgccgaatgtgagcgcgaacgtgtgcatggcgccgtcggctatccccgtcgtgtcctcgatgtcgaaatcgacgtgctgtcgtggcgtcgtcgcgcgcacgcgcagagcgtcatgttcgatggcgcatatgaggagcggcgcgtcattcgccgatccattgacggcatcgaagatgcggccgtccgcgtgtgcgcggaatctgcacgcgatcgtgccttcgggtgaggggaatgttcgctgtgaccagctgatcgggttggatgctgccatggtcaatgactctcctttgagcgggcccgtatatatgccgtgccatgaatgggacatctgaagtcatggtatccaaccaacgggaaacatcagacgtctgatttcaatggtagcgcacgtcgggggatgccgcacctgcgtggcgcgtggtcggcgacatgcgggtcgggatatttgaaataagacgtcagacgtcttatcattaaacccagttcagcccagaaacggaggcacggcggattggcggtccggccggcctggacgattgtcgatgtcgaccatcgtcgagttggacgcacgatgacacattctcaacgatgaggagatctcaatggtcaagattaatgcaagggtcagggcggccgtggcggccatcctggccggcggcatggttgtcgccatggccggctgcggcggctcgtccgccacggccggcgccaccggcacctcgattccagacacgatcacgacggaagtggcatacgcgagccgtgacttcatgccgaacacgacgtccggagcgctgccgatgtcggcgaactggcatgtcgtcgaaccgctgtacgcgcttgactacacgacttacaagacattcccggcgctcgccaaaggcgcgcctcagaaggtctccgacaccgagtacgtgatcacgctgcgtgacggcgcgaagttctccgatggcacgcccgtcaaggcgtccgatgtcgtgagctcctacaagcgctcgaccgccgaaggcagcctgttcatctcgatgctcgacttcatcgactccgtcgaggcgaagggcgacaaccaggtggacttcaagctcaaggaagccttcccgatgttcgaaaagcgtctggcgctcatcccgatcgtcccgtccggcaagtcggacgccgaactcaagaagatgcccaccggttccgggccgtggaagtacacggcgatcaccgaccggcaggtgagcttcgagaagaacgacgcctacaacggcaagtatccggcccagacaaagaagatggtctggaacgtcaacgtcgacgacaccgcgcgagtcaccgcgatgcaggccggcaagacggacgtcatggaaaacgtgcccgcgaaggcggtgcagacgctgacgtcctcgggttccgacatccagacggtgcagggcttcaaccaggcgttcatcatgttcaacacgaagaagaagccgttcgacgacccccgcgtgcgtcaggccgtgttctactcgatcgacacgaagaagctcatcgacaaccagctgtccggacaggcgcagaccgtcacgagtttcctgcccgagaacttcgcgaactaccataaggcgaagaacgtctacacgaagaacaccgcgaaggccaaggaactgctgaaggaagcaggcgtcaacggtccgatcaagaccacgctgtacacgaccgaccagacctgggtcacgcagctcgccccacagatcaagaacgatcttgcggaatcaggcatcgacgtggatatccagtcgatgaagtcgtcggcgttgtatccgtcgatcaccgacaaggacggcgctgacttctcgatggttctcgccccgggcgatccctcggtcttcggcaacgaccccgacctgctgatgaactggtggtacggagacaacgtctggaccaagcagcgcacgttctggaaggggtcggaaggctatgacgagctgcacgacctgatgggcaaggccctgtccgcgtcgagcgatgccgagcgccaggactactggaaccagtgcttcgatctgctttccgagcaggtgccgctttatccgctcttccaccgcaaggtgagcacggccgtcaagaagggtgtcttcgacgaatacaagacgatgggcacgacgggtctcaacctggtccaggccaaagtcgcacagtgagccacgcaaaggagcgatggcgcagaacccttccctgacgatctgataccaagacaggcccgttcatctcgttccccttccctccgcgatccgtggacgggcccgtcttccccattcccttattcccgattctttcaccattggacatatcatgagtaatttcctcagacttctcgggcgcagattgatcgccctgccgttcatggcattcggagtcatctttctcgtgttcttcctgatgtcgttctcgaagtacgatcccgcagtcgccgcgctcggcgagaacgcgaccggcgcgcagctggaggcgtttcggcacgagatgggctacgacaagccttggtggtcgcagttctggtcctatctggtcggtctgtgccatggcgacatgggcgtgtacggcgtcaacaaggactccgtttccgagcgtataggacaagcgttcccgatcacactgcagctcacgttcatcggactgctcattgcggtcgtcatcgcaatcatcttcggcgtgctcgccgcgctctaccgtgatacgtgggtggaccagacgatccgcgtcctttcgatcatcgcgatcgcgacgccgtcgttctggctcggcgtgctgctcatctacgtgctgcagatcaagctctcctggctgcccggcgcgggtccgctcgtcccgttctcgcaggatccgggtgcctatctcgaacgcatggccatgccgacctttgcgcttggtctgccggtcgccggccaacttacacgcatcatccgcacgtcgatggtcgaggagctcgacaaggactacgtgcgcaccgcgatcggcgcgggcgtgccgaagggcgtcgtcgtggcgcgcaacgtcttccgcaacgcgctcatcacgccgatcacaacgttgggcatgaaaatcggctacctgctcggaggcgctatcgtcatcgaagtcatcttcgcgctccccggcatgggcacggcgatgttcgatggcatcaacggcaacgagccgacgctcgtgcaaggtgtagtgctcatcgtggcgctctcgttcatcatcatcaatatcgtggttgatctgctttacgtgctgattaacccgaggattaggacggtgtgagatgctgttcggacaaaacgaagttgtcaaggcggcggcgaccaaacccaaggtcaggttcaaccgcttcaacaagatgacgttgggatcgaagatctcgttcatcgtgatcctgctgctcgtcgtcgcggcggtgtttgctccggtgatcacgccgtacagcccgatggcgatcaccgaaagctatcaggccccgacgggcgcccacctgttcggcaccgacaaccttggccgtgacgtgctcacgcgagtcatcttcggtgcgcgatactcgctcgtcatcggtttgtcatcgatcgcgttcgcgctcgtcctcggctcgatcatcggtgcgatcgccgccgtgagccgcgcatgggtctccgaaatcatcatgcgactgatcgacatcgtcatgtcgattcccggcatcgcgctcgccgcagtgttcgtggccgtgctcggccagtcgatgatcggcatcatcatctcgatcggcgttctttacgttccgcagatcgcaagaatcgtgcgcgccaacatcatcagcgagtacggcaaggattacgtcagggcggtcatcgtctccggcgcgcgtgccccgtggattctcatcaagcacgtcatgcgcaacatcgcggcgccggtcatggtgttcacgaccctatccgtcgccgacgcgatcgtcttcgaagcgtcgctgagcttcatcaatgccggcatccccgagccgacgcctacatggggcaacatcctgtcgtccgcgaaggaaggcgtcatcttcgggtattggtggcaggcgctgtaccccggtcttgcgatcatgatcaccgtactgtgcctgaacatcctgtccgaaggcataaccgacgcgatggtggcggccccgaccgccccggtcgagaagaccgcggccgacgtggctgccgaccgcaaggaagaccgtctgctcaccgacccggtcgcggcctacgccgagcagcatgatgcgctcgtcgattcgctcaccaagctgcgcaacgccgaactcaagcgcaccgatcgccttgaaccgtggagcaccgaacctcccgtgctcgaggtcaaggatctgtgcatccagttcccgcgctacggcgacgtcaacgtcgtcgaccacctcaacttctccgtacgcccgggggagacgatgggtctcgtcggcgagtccggctgcggcaagtcgatcacctcgctcgccatcatgggcctgctcgacccgaaggcgagaatcagcggcgagatcctgctcaacggcaggaacctcgtgggatgcgaccagcgccaatacaataagatccgcggccatgagatcgcgatgatctaccaggatgcgctgagctcgctcaacccgtcgatgctcatcaagacgcagatgaagcagctgacgaagcgcggcggcacgcgcagcgccgaggaactgctcgaactcgtcggccttgatcccaagcgcacgcttgaatcgtatccgcacgagctttccggcggccagcgccagcgtgtgcttatcgccatggcgctgacccgtgacccgaagctcataatcgccgacgaaccgacgaccgcacttgacgtgaccgtgcagaagcaggtcatcgatctgctcaactcgctgcgcaagaagctcggcttcgccatggtcttcgtttcccacgatctcgcgctcgtggccaaggtcgcccattcgatcaccgtcatgtatgcggggcaggtcgtcgagcagggttcgacgaaggagatcctcaccgacccccgtcacgagtacacccgtggcctgcttggcgccgtcacgtcgatcgaagcgggcgccccgcgtctgcaccaggtgcccggcacggttccgagcccgatcgacttcccgaagggcgatcgcttcgctccgcgctcctcgcatccggacgtcggcctcgacacgaggccggtcatggtccgtgtgcccggcacatggcacttctatgcggcgcagccgggcaccccgttgcccgaaccggccaactacacccgtgccgacgaacacatgctccaggagccggccaaagtggagaagtcctccgaagagaactccgcgagagccgcagaagccgagatcggcgacatgacgatcaccgctgccgaagacccgcgggacggaaaggaaggcgcacgatgagcgaacgcatcgatctgacgaaaccccatgagaacaagaacgtcccgatcatcgaactgaaggacgcgaaggtcgtgttcacgacccgtgcgggttcgggcctgttccaccgcaacaggatcaccgccgtcaacggcgtgaatctcaagctcatgccgggcaagacgattggcatcgtcggcgagtccggctgcggcaagtcgacgacggcgaacgtgatgtgcggactgcagtcgctcacgtccgggcaggtgctgttcaaagggcaggacgtcacgcatcgcaccgcgaaggagcgcatggaaatcggccgtgtcgtctcggtcgtcttccaggatccggcgaccgcgctgaacgcccgcatgagcgttgccgaccagctcatcgatccgctcgccgtgcaccatctcggcggcaagaaggaacgcgacaagcgcgcccatgagctgatccgcatggtcggtctgccgttctcggtgctcggcgccctccccgggcagctttccggcggccagcgtcagcgtgtggcgatcgcacgcgcgctttcgctcaacccggatgcgatcatcgccgacgagccgacgagcgcgctcgacgtctcggtgcgcgcgcagattctgaacctgttgagcgatctcaaacgtcggctcggtttgtcgatggtcttcatcagtcacgacatccagacgattcgctacatctccgatgacgtcatcgtcatgaaccacggcacgatcgtggaacatggcaccgccgacgaggtgatgcgccatccggtcgacgactacacgaggacgctcatggcggccgcgccgtccttgctgcatccaacggccgaggagtgcgcatagcggcacacacgtctccggcggcgcgcgtctcacgcggcgtgcgccaccggaccgacaacacccatccaccatccgtatcaacacgccgagtaccacgttcgacgatgggccggcgcgccatatcccatacacacaaaggatcaatcatggcacagcaattccacggcgtcattccgccggcggtcaccccgctcaccgcagaccaggagctcgacctgccgagcttcacccgctcgatcaaccgcatgatcgacgccggggtcaacggcatattcacgctcggctcgtcgggcgaggtcgcgttcagcaccgatgcccgccgcgaggagatcattcgcgcggcgattgacatcgtcgacggtcgtgtgccggtgttcgtcggctgcatcgacaccgaaacgaaccgcgtgatcgaacatgcccgccaagcccgtgagctcggcgcgtcggcgatcgtcgcgaccgcgccgttttatgcgctcggcggcatggccgaagtcgaacggcacttccgtctcatccacgaggcggttcccgatctgccgctgttcgcctacgatattccggtgtgcgtgcacacgaaactgcccggcgacatgctcgtgcgtctgggactcgacggcgttcttgcgggcgtcaaggattcctcgaacgatgatgtctcgttccgtttcctggtcgatgacaacaacaaggcgggccatccgctgacgctgctcaccgggcaggaggtcgtcgtcgacggcgcctacatggccggcgcggacggctccgtccccggactcgcgaatgtggaggcgaccgcatacgtgcgcatgtggaacgcctaccggaaaggcgattggggttccgtgcgcaccgaacaggacaagatggcggcgctcatgcgcatcaccagcgtcgtgcagggtgtgcaggggttcggcgccggcgtcggcgcattcaagacggcgctcgcgttgctcggcgtcttcgatacgaaccagatgcccaatccggtcgcgccgctcgccggcgagaacgtcgaacgcatcgccgcggtgcttaaggactgcggactgccgctcgctcgcacgccactcgaagtgagcgaatccaccgccgtcaagggctgaggaaagccccgggccgtgggctcgccgcgatgtgccggcgcgtgggatccgacgcgccggcacatcgatcaggcgttgaacacgtaccggtcaaggcggcgcatggcctccttgacgcggctcaagggcaatgcgagattgacgcggatgctgtagggggcctggaacatgtcgccgtcctgccatgcgacgcccacatcccagccgcgtttctccaactcaggcaggctcaggccgtggcgttcgcaccactgctcgcagttgagcagcagcatgtaggtgccttccggtttggacagactcacgccttggaaatgcccggtgatgtagtcgtaggcgtaatcgacgttgccggtgagcaccgccttcaattcgtcgagccactcatggccttcgggccggtaggcgccgatcagcgcgtgcatggaaagcacgttcatgtcgttgtagtggcatttcgagcttttggccacgatgcggtcccggagcgtgggattgtagatgatgtggtagcttcccaccagtccggcgagattgaaggtcttgctgggcgcgtagaacgccacggtcctgttgcgtgcgtcctcgctgaccgattgggtggggatgtgctggtggtcgcccaacgtcagatccgaccagatttcgtcggagatcaccacgcagtcgttggcccggtacacctccatggccttctcgatctcccaacgctcccatacgcgcccgcagggattgtggggactgcagaagacggccacgtggatgtgatgctccttgagcttcctgtccatatcctcgtaatccatgcgccatacgccgtgctcgtccagcgtgagcgggctgtggacgatgcggtagccgttgttttcgatactccgggtgaaaccgatataggtcgggctatgcagcagcacgccgtcgccgggggcggcgaacgcggtcagcgcgctgatcacgccgcccaggaccccgttctcgtagccgatcgcctcccgggtcaatccggtgaccctgttgcgcgtggactgccagtcgatgatggagccgtaatagtcgtcggtgggggagaagtacccgtaggcgggatgcttcgcccgttcgatgatggcctgcgggatcgtgggcacggtcgggaagttcatgtccgccacccacatggggatgacgtcgaaaccctcgcgtggcgggtccggcgcgaatcccgggtcggtgcccagtccgtcgaccgcgatcgaatccatgccatgcctgttcatgatggacgtgaaatcatacgtcattgtccgacaatcctttctcggtccgtggtggctggtctcaatctaaatcgggctcctgacggtgccgtggccgtgggcggcgatttgaccgcgtgacgtgttacgatgtgcaccgtcaccagacagtgatccgttatcagcggggagtcttcggaagaacggcggcaatcgcccagtagaaccgacgggatcggcccgaaacagccgaacacaagcggtcgcgcgggttcgcggcctcgaacgcaacggttcggggtgcggcggccgacgcgataagcgaggtggtaccgcggtgcggggcgcatatcggcgcccgtcatcgtcctcgtaggcaggaacgtcaggcattggctgttccgggcggaacacggttggttccggccacgagacgattgacgatcgggttcgcggcccggcgtgacctccgtggatcgggccgatgaacgtcggcgcccggcgacggccatcaatgacgctcctgtaggaccagtgcacagtacaaacaggagatttacggtgagcgaaaacgtatatcccaaggcgaacgagggcggcgagaccgcgcacgtcgcgccgaaccccagcttccccgacatggaggagaccgttctcgactactgggacaaggacgacaccttccagaagtccatcgaacgcaacccctccggcgaccatagccagaacgaattcgtgttcttcgacggcccgcccttcgcgaacggcctgccgcactacggccacctgctgaccggttacgccaaggacgtgattccgcgctatcagaccatgaagggccgcaaggtcaaccgcgtattcggttgggatacccacggcctgcccgccgaactggaggcgcagaaggaactcggcatcgactcggtcgaccagatcgagaagatgggcatcgacaagttcaacgacgcctgccgcgcctccgtgctgaaatacaccaacgaatggcagaactacgtgcaccgtcaggcgcgatgggtggacttcgagcacggctacaagaccctgaacattccatacatggaatccgtgatgtgggccttcaagcagctctacgacaagggcctggcctaccaggggtaccgcgtgctgccgtactgcccgaaggaccgcacgccgctgagcgcgcacgagctgcgcatggacgccgacgtctatcaggatcgccaggacaccaccgtgtccgtggccgtgaagatgcgcgacgaggaggacgcctacgccgtcttctggaccaccaccccgtggaccgtgcccaccaacttcgccatcgtggtcggcgccgacatcgactacgtcgaggtgcgcccgaccgaaggcaggttcgcgggcaagaagttctatctcggcaaggacctgctgccgcattacgagaaggaactcggcgagaactacgaggtcgtgcgcgagctcaagggcaacgagctggaggggcgccgctactacccggtcttcccgtacttctcgggcgatgaggccgaatccgaaggccatgtgcccggcccgaacggctacacgatcttcaccgccgactacgtcgacaccgtcgaaggcaccggtctggtccatcaggccccctacggcgaggacgatatgaccacgttgaacgcgcatggcatcacgagcaccgacgtgctcgatgagggttgccgcttcaccgcgcaatgccccgattacgaaggcgatttcgtgttcgacgccaacctgccgatcctgcgcaacctgcgcgccggcgacggaccgctcgcctccatcccggaggaacgccgcgcgatcctcttccaggagaaaagctacgtgcactcctacccgcactgctggcgttgcgccaccccgttgatctacaagccggtgtcctcctggttcgtgtccgtgaccaagatcaagccgcgtctgctggaactcaaccagcagatcaactggattccgggcaacgtcaaggacggccagttcggcaagtggctcgccaacgcccgcgactggtccatctcccgcaaccgtttctggggctccccgattccggtgtgggtcagcgacgatccgaagcatccgcgtgtggacgtctacggttcgctcgaagagctcaaggccgacttcggcgattacccgcgcgacaaggacggcaacatcaacatgcaccgtccgtggatcgacaacctggttcgcgtcaacccggacgacccgaccggcaagtcgcacatgcgccgcatcagcgacgtgctggactgctggttcgagtccggttcgatgtcgttcgcgcagttccattacccgttcgagaacaaggagaagttcgagcagcacttcccggccgactacatcgtggagtacatcggccagacccgaggctggttctacctgttgcacgtgatggcgaccgccctgttcgaccggccggcgttcaagaacgtgatctgccacggcatcgtgctcggctccgatggccagaagatgtccaagcacctgcgcaactatccggacgtgaacggcgtgttcgacaagtacggttccgacgccatgcgctggttcctcatgtcttcgccgatcctgcgaggcggcaacctgatcgtcaccgcggacggcatccgcgacaccgtgcgccaggtcatgctgccggtgtggagctcctactacttcttcaccctgtacgccaatgcggccaacggcggcgccggattcgacgcccgccagctgcgtgcggacgaggtcgccggcctgccggagatggaccgctacctgctggcccgcacccgtcgcctggtgttggcggccgagaaggcgctgaacgagttcgccatctccgacgcctgcgatgcggtctgcgatttcatcgatgtgctcaccaactggtacatccgcaacacccgcgaccgcttctggaacgaggatgccaccgcgttcaacacgctgtacaccgtgctggaggcgttcatgcgcgtgcttgcgccgctggccccgatggaagccgagtccgtgtggcgtggtctgaccggtggcgagtccgtgcacctggccgattggccgttcgtggtggacgagaagaccggtgaagacaccgaactcggccgtgtgctggtcgacgatccggctctggtggacgcgatggagaaggtgcgtgaggtcgtctccggcaccctgtccctgcgcaaggccgccaagatccgcgtgcgccagcccctttccaagctcaccgtggtggccgggaacgtggaggccgtcaaagcctacgacgagctgctgaaggccgagctcaacatcaagaacatcgagttctcgacgctgcaggatgccgccgcccacggtctgaagatcgtgcacgagctgaaggtgaacgcccgcgccgccggcccgcgcctcggcaagcaggtccagttcgccatcaaggcgtccaagtccggcgactggcatgtcgatgcgacgtccggcgcccccgtggtgtcgacgccgtccggcgatctcgagttggtcgaaggcgagtatgagctgatcaaccgtgtggaggaggagaacgccacggaggccgcctcctcggtgtccaccgccctgccgaccggtggtttcgcgattctcgacacggcgcttgacgccgatctgcttgccgaaggctatgcccgcgacgccattcgcgccatccaggacgcccgcaaggacgccggtctggacatcgccgatcgcatcgccctggtgctgaccgtgccggccgccaatgtggccgatgtcgagcagttccgcgatctgatcgcccatgagacgctggcctcctccttcgaggtgaaggagggcgccgagctgggtgtggaggttgccaaggcgtgatgccgtggcggactgaccgcgcctgatgcgtggtgcacgggcgcgtggaatgcacgaagtggtcccgccgtttagcggcgggaccacttttttgttccgtggtatgctatgagggttgcgtcaggtattcgttcaactgttcaatgcggtcggcatacagattttggacatggcgtttcttcgctctcacatgattaaagatgtattgtcgtcattcgttattccggttatcacgcaaatccatctccgtttttaacttcgtgtttggggttggacatgatgtaatgtcgggacttacaggggcttgctttctggtgttcgtacaaagacgaataattcactgagcatttcaagtgctcaacacatgcaaacggctttattactggttcatatgtttgttactcactatccgcaatatgcgttttgaattcacattcagattcctttgatggctgtactcattatgccgcctatcttaggtttaaagaaagagtggtcggagtcctccgctgcattgggtgccagtgccttgcagacgctgatgcgtgtgaccattccagttctgacacccgcgataattggcactatgttgcttctgtttgccaatgcctttgctgcctatgctactgcctatgcactcagcggagggtcggcgaatcttattgccattatggtgggcgtcttcctgacaggcaacgtatttgtggatgagaattttggtgctgcgctcattgtcggaatgattgccatcatcctcgtggccttcatcatgcgttctgtgcttgaaaggagaactgcgaaatggctgcagtgactactgattcgaaggccgtctcgtcagtaaagtcggaatcgcggattggtgccgagacgaaccacgattccgctagtggtgccaaatgttttgcgggaaatgcgttttccgacgttcgacggaaccatccgaggtatgtggggcagacaatagtattaagcgtttgcgcggtgtttttcctgttacctcttctcgcttcgctttggttcggaatccatttgcccggcaccttcatcacttttgatccgttgatggagattgttcacatgcctggtattggtgagtcgattgctctcagcattggactggccttaatgacgtgtctgctttctttggtgcttatgttgccaactttgttaattttacatttaaaagcaccgcagatgttgcctgtggcggagggcttctccgtgttgccatacgtagtgcctgccattgccttagtcagtgctgtggggcctttgtatcgcatcatcctgcctcaggcgttaaatagtccgctgggcttagttcctctctatatggtggtgataatgccattcgtgtaccgttcccttgatgcgggcattcgggttgttgatgtgcgcacgctttgggatgcgagttcatcattgggggcaggtgcggttaccacgttggtgcgtgccatcctgcctaaccttcgcagtgccatcatgtcggcatcgttgttgggatgcgcaattgttttaggtgaatttgctattgctcagcttttgctcaagactacatttcctgtgattctttcgcaggttggtactgcgcatccgcactcggctgcagcgttggccttcatcacgattatggtcacatggatactgcttggactgctgtcaatggttggaggaactggcaaacataaaaccgcacaatacagtagtaaggaaaacaaatgacgacagttgctgtgagttctttaccacaggggacatccgtcacgttgcgtaatgtgactaaatccttcgggactacgaaggtgctcaatggacttgacctcaatattcattccggtgagttagtcgcattgctgggaccttcgggttgcggcaagagtacgttgctgcgcataatcgctggttttgaagccgcagatcagggttcagtgttactggatgatgttgatgtgagcggtgtgccgacaaatcgtcgtgacatcggactggtgtttcaagcctactcgctgttcccccatttgaacgcggtcgaaaacgtcatgtatgggctcagcatacgacatgtggccaagacagaggcgaaaagcagcgccgttgagctactggctagtgtggggttggctgattacgcagatcgttatccagcgcagctatcaggcggtcagcaacagcgcgtggcgttggctcgtgctttggccactaaaccgcgagttttattgctcgacgagcccttgtcggctcttgatgccaaggtgcgtgtgcagttgcgggacgaaatccgtgctttgcaattagaaactcataccacgaccataatggttacgcatgatcaagaggaagctcttgtgatggccgaccggattgctgttatgtacaacggacgcttcgaacaagttggaacgcctgcagaaatctatcattcgcctgccactgcgtttgtagcagggtttgtcggatctatgaatgtgctgcctggcgtgttgtcgaccgatggaacggcacagacgattggttgtcgcgtgcctgtacacgcagcagccggtgcggcgacgttgaaccccggtcctgttgatgtgttcgtcaggccggaggagctgcgtttgcaaattgccaatgatgacctcaatgatcacgatgctgtattgggaacggttacatcaactgtattgcgtggcgcattcaccagtgtaatggttgccatgggtgacggattgcatcttcgtgtagatttgccgtcgaaggacgcacagctgttcactccgggatgctcggtaatggtgaggattgccgacgagcctatgttatgcacagcgcgaagagtcgagtgtgttgcttaattccgcctctaccgataaaaatcgtcacaacgaattacggaatccgcgggattctgcgaaaggactttctatgcaacaaagacttctccttattggtgtggacggagtacgccttgacattgtgcgtaaagaaaatcacgcaccgaatattaatcggattctcaataatggatcttcggctgaaatgacaatggaagtgcctactatatcagggccgggatggtcatcgatacttacgggcaccactcatgctcagcatggggtgcaggacaacaccttccgtggaaatcgtttatacgagtgccccgattttctgacacgtgcggctgttgctcatccgatgatgaaaacggttgccgcttcaagttggcccccattggtggatcctgcaggtcctggtccggttattgcaacacgcaacgatcagattatctcttgtcatcaccgtttggtggtacgcgatggtgagacgtatgggtaccgtcttgccgacagtgaaattgcacggtttgcggtgatatcaatatgtaatgatcccgccgatgtctccttcatctatcttggtgaggtggatgaggctggtcatttgtatggtggtattagcgaggaatacgaatccgcgctatcccgtgtggatgagcatgtcggtgaaatacttgatgcagtcgaacgtcgttcgtccaattatccggacgaggattggttggtgtgcattacgactgatcatggacatcttgacgaaggtgggcacggcggtgccgatccggtactacggcgttccttctttggcgcattgcgattaggagctcgctcaagtgatcagtactcgtttgagtccatgcgtcctgaacagattgccggatggatgttgcgacaccttgacacaccgattcggtgaaagacggtatcggtgaccttatagcggctggacttccagccgctatatttgttacggtgtgtcttgagaaacgggccactgtctctgtacttcgccttacgataaagatgacctaacttattcacgggcactaccgtcgccccacagaagttggctgatgtcgtccacgcggcgcgtggagacgccggccatgtacatctccatgagcgcctcctcgacgctttcctcacgtcgccggcagcgctcgatcacctggctgcggaacacctcgcccttcagcttcgggacccgaaggttcagcttgccggccttggcggtcaggtggcggtcgtagtggccggcgcggaaggccttcctgtcgccgcttctctcgtatctggcggcgttggcgatttcgtcgacctccgcgtcaagcatcaggtcgatggtttgctcgaccttcttgcgcaccatccggtcgagcctggactcgaacatggcctgatcgaactgtatgatttccttgggcatggttcccggcctctttccattcgcggttttcatgtgtaagcgactgaaaatcgtaccaaagccgggccatgtccttttcatcggaactcacaaccgaatctgcgcaagaagacgggcgttatcaaggtcggcgcctgggtctttttctacggacctccgccacctcccgcatcaacgcgttctccaactccagctcctcgaccctgcgacgcaaagcctccgcgtcatcatcatcggttgcggacggccggcgacgggggtccgcgggcttattgccctgcgcggcgttcccgttttggggccgcaacgcggccatgccgcccttgcggtacgccctgacccagccatgcaccgcgccgacgcccgcgccgagccgttcggcggcctgtttctgctgtatgccgcccagcaccggttcgatcgccttcagccgtgtctccagggggatgatgggtttggccatatggccagcataccggggatcctttgccagccggcgttccgggcactgcctggtcggataacccaggtgctccaccacctgggccgtggtcatcggcgtggtgaaatacaggcccaccgcacgctctcgttcctcaagactgaacatacgaaaaacctttcgctcagtctccaagaaaacgttcgcagccccttatcccgcattcggcctaacttctattgaacagacacacttgcgatcgcatacctggccatgacctccgtcttggtcatgccgttctcgacgtggtcgcgcgcggcggcgaccttcgtctcccagtcgtagcgtctgccgccgttgcctcccatgaccgcctcctcgccaccggacctgtacgtatgatccatttttccgcggtccgtctgggcatggcaagccgtctggcgagcgtgtccccgccggctccggccttgatgggttccagcgcctcgcgccggaacccgtcgtcgtagtgtttccttcaatcctcacgcatacgaaagaaccgcacctccgattatcgaatctgaatttcctcaatccaacaatcggggtgcggttcattttttacctaccaccttcttatatcaatcttcaagtggagagggaatcacttcttgacggaagaggtctccggccacagggattcataaggatgtccggtcagttcctcgcagaccagacgcgcctcatcggacacatccttcttatctccgccattttcaagacgctcgatttcgctcttcagtacggcgtgcgtatcggcatcgaggtagatgtgcctggagagccacagagcatacgcaatcagcatcacggtgcccaagaagaagatgagcgtgatactgaaacgtacctgagctggggtggtctcgtagttcttcatagtcgcggagttatagcctgtgaactccagtagaatgccggcgatccaagtggcgattgctccagtggacttacggaagaaggtcatcacggatgcgtacagaccggcacggtcgccacgcgtcatgatgtaatcaacatccggcatgaacgggaacaggttccaaggggtgaattccagcagggctcgaccgcactggtagactagcgaagcgatgatgaaaatccagaacgggttgtgaatattcagcaggtagaccgcgatgtagactaccattgccgcgatgatgctaatatagctcagacggaaaatgaacctcgggcccttcaccaccatgagcttcgttgcgacgatggtcaccggaataccgacgatggatagagcttggagcgtccaaggccagctttctccggcaccggtaatgcagcacacaatgaaagtcggtagcaaggtggaaaacaaatctttgccggtgaaggacaacaggtacaccgcaagatgggtgcggaatgccttgttatggaaggtctctgcgtattcgtgaatggaattcttgatgaagtcgctgatcttcaccttaggctggtttgtatgttcctcaatgaactcgtcggtaattgggcgttcccaggtgccgaaggtggagatggcgatggcgatgacgaacaggatggtccaagcgatgcctgcgacgaggtatgcgttggggttgttcgcctgcttaagcacagcaaggataatgaacacgattgcagttccggttgaggaaatgaccatacgagaaccggacagcacggtacgttccttgtaatcgcgagtcatttccgtaggcaggcactcccacgggacgatcagcatggcgatgatgatctccatcgcgacatagaccgcaaggtagtacagccagctagtggacgaaatccagaatagcgggaacacacaggtgaagaggataagacctgtcaccaggaagaaatgacggcgtccgaacttctgtccgagcttggtcgtgtagaaattatcggtgatgaggccaaggaaaagattccagatgcagtccacgatacggcctgctgctgcgatgctgccagcgatgacgggattgaaaccctgagccagtgtcaggtaggcgaagataacgccggagacgatattgttccagccgccgcccatcaagtcgagcatgccgtagtaaattccgcgtttaatgttaattggatgtgccttgtaaggccaatgtaaggcgttcgttgccatgtttttgtctttctttgtgttgcactaccgtttttctcgtcatctttgtgagttttaaacggctgtgcggaaaaggtaacaaccacaatgtatataaggatgtgaacgcgtgaaaagaattgcctttttttgcaatgaatgtcagattagaacaatttggcatattctttgtgactgcaggactgtgcagtgtaaatgctatttttaacggctgaaatagctcaagggcagacgaccggttgaattgaggtgaacgggttgaacgaaactgccttcgaacgtagattccgtcgtgctgatatgaaggatttgccaaccatactgaggaatcacgagcatgcacgtgaattgatggccgccaatggcaatccgacgcaatgggggcacacgttcccacgtggagaagtggttcgtaacgacatcgcaaagcggcgtaccctttcttcggcggtggccagctcgcgctggtagccacctatctggccttgttctggacgctttttgcggaatgaacatcagtatcgcgcagggaatcatcggcaccagcgccatcatcagcgccatatccgcgctgatgttcggggtgtttgacgacaatctatatcgatatcggatagggcgtaggttcggacggcgtcatctcatgttgatgcttattgcgccgtcgctgctcatcggtgtattgctgtggattcccggatcgccagtgccgctgtacgcgtgcgtttacgtgctatgggtggtgctggcctaggcttttcaggcgtgctacaacccgttgcctggcgaaatgacgaaggatttcagccagcggacgaagttgtcgaccaccagaatgttcatttccacttctgccaccactttcataccactcgccggaagctgggcgttgtcgatatacggtgagaccaaggcgaccgcttacatggtagtggccataatctcgactttgatgttctcccgcgccgtggtgattacctggaaacgcacgtgggagttgacgcccgatgaggccggctttggcgaatacgccaacggcacggtgcatgagtcacatcttggactgcgcggttggattcgccgcgtggcgcatgtgatgcgtgagtatgccacgacgttgcgcatccgcgaattccgcaagcatctgacgattttcctgttggtacagacatcctctgatgtcttcggtcaaacgttcctgttttttgttttgtatgactggaataaaacggcggcctttgcgtcgctgctgttgggttgttccatcgtatcgttgccgtttatgccggcattcggcaaagcggtggtgagattcggcgtgcgaaagctttatgcgttcggcctttgccggaatgctgcttggcgtggtttggctggcattggcatggattctgacgggtgttctgcccgttgcagcatggatggcgctgtccgttatcgcatcgttgtggttccttgtattcaaggcgcttgtcggatacctgccatggacggtattggtgttcatgccggatatcgatcagattgttacgcgtcggtatcgttcggccactttttccagtgtacagtcttccctccgacagcttggttcgggcatcgtcaccatcggcgttggaatggttctcgccatggtcggattcgattcctcccttccccagcagtcgtggaaggcgtcgattggtgtggctgtggttatgttgggcttttgcactgtctcgatgatcgtgtgctggattgtgtcgtcacgtctgataatcaaccaacagaccgatcttgatgttttgcatgaggtcgaacgtttgcgtgccgggggagacaaggctgatgttgattcctctgtgcggcgtaccgtggagcggctcaccggtcttccatatgaggaatgctggaaatagcatgaggaaataaaagccgatgcaaaatcgcctacgtcatttcatattcagcatttcgaaaactatactgcaggagatgcgtttacctaacaggggagggcagtatgtctaggcgcaaaacatatcccggaattgtcgatgtcgcacgtgaggcgcaggtgtctccttcaactgtttcgcggactttctcccgacctggttacgtcagcaaagccactgcgaaacgaattttcgatgccgcgaaccgtctcggataccggtctaaggagatcgcgcccgtcacgaccctcgaggtcaagcatcatcttattctgctcattgtctccgatatcagcaatcccgcgttcgcgcaactcatccgctgtatccagcatgagtgcatgcgcgagaactacggtctgctcatcgccgacacggaggagaccaaaataaacgagcgcgatagtctccacgacttcaacaatgtggacggcgtcgtgctggcgtcttcccgattgagtgacaccatgattcgaaaattcgcgcaacatcacaaagtggtcatggtcaaccgcgaggtgcgtggcataccatccgtaataccggattactcgtccagcttcgaatccatggtcgaccgtctcatcgcgctcggccataccagcatcacttatctcaccgggccggaagcctcttgggcggaaggcatgcgctggcgcacgctattcgacgtgtgcaaaaggaagaacatgcctttgaaacgtcttccgggcaagtacccgactctccaagccggtcaggaggcgttccggaagttcatgaagcagcccagttccactgcgataattacctacaatgatctgcaggcaatggggttcatcacctcggcgaggcagcaccacgtggaaatccctgggcgtttttcggtgatcggcatcgacgacaccccgaattgcacgcttatttccccctcgctcagcagcatacacatcgaccgtcgcgaggcgggaaaaaccgcgaccgccatcttgttcggtatggtgaacggccggaatcaatcgaacgcgggcaaacagggcctttgggaaatacctaccagcttcatagaacgggatagtatcggcattccgcttgcggattgttagcccatagctttcaatctcgccggggtccggtgctgccacgtgcgatgaaacgagagtccaacataatcggtttcagcaatcgatggaggtttcctccgcgcagtcgactgaccaattcatccaccgccattttccctatcgtcgcacgatcgatatgaatcgtcgacaatgtcggattgacgattccgctgatgggaatgtcgtcgattcccacaacagacaccttttcggggacttccattccgtattcctccagcgcggccatgaagccgacggccatgatgtcgttataggcgatcaccgcagatgtggcatgttgcgagaattgtgggagacaggcgaatcctccgctgtaggtgggagcggaacatggtatgcagttcaaagcgatatcattctgtcggcatatgctgaccagcgtctccttcctgaccatattctgccatgaatccgttggccctgataaataggttagggactcatgccccagggagcgcaactcatggacggcctgttccagacccgtacgagtatccgcaatcaccgatttgatgccttgtaccgcccggttgataagcaccaaggattttatcttcgccatcttcttgatattcgcgtcggacaatcgcgacgagacgagtatgacgccggcaacgtacgcctccatcagacccaacataatacgttcgatcgagctcatctcttgcgagtcgatgatcattatcgaatatccgtacttccgacactgctgctggatgctcttcacgaattccgcgtataccgggtttccaacgtcgttgatcaccacggcgatcaatttgctggactcgtcatgcgcgtatgcagaacctttgcgcggcacatagccgatttcctccgccacacggtatatggtcctcaatgtatcggcgttgacgcgctcaggatgagaaaaggctcgagacaccgtggcaacggatatccgagcggctttggacacatcgctcaggctaacgcgatgatgtgccggaaacttatcatccacaatttcccttccgatgatttatcccttcacttcggtagggggctgcgtgattatctccaagaaaacgtccgcagccccttatccataaaagaaaaccgcatctcgattatcatccgaatttcttcagtccgataatcggggtacggttaaaagcgtcagctttttatttcccttttacatcaggcctgctgctcttccgggcggttctgctcagcccacagcttgtggaagacgccgggcgtatccacgcgaccataggtgtgagctccgaagaagtcacgctgtgcctgggtcagtgcagtaggcagacgcttcgaacgcagtccgtcgtagtacgccaaggagctggagaagacaggcgtcggaatgcctgcgtcgatggccgccttgatgactcgacgccaagactcctgcgcgtcggcaaggaacttggcgaagtacggatcgagcgccagtgccgcaggatggccgttggtgtaggcgtcggtaatgcggttgaggaacttcgcacgaatgatgcagcctccacgccagatcttggcgacggctcccaggtcgatgttccagccatactgcttggcgccatcctcgatctcgttgagtccctgagaataggcgatgatcttggaagcgagcaatgcgcgacgcacgtcttcgatgaaggtcgcctggtcccccacggtgatggcattgttggggcctgcaggcgcgctgtcctgcgcggcttgcctcagctcaggatggctcgacagcgcacgcgcgaacacagcctctccgatgccggtgacaggggaaccgaactccagtgcggtctgcaccgtccacgtaccagtgcccttcatacctgcgcgatcgacgacgacatcgacgaacggcttgccggtacgctcgtccttctcatgaaggatatcggcggtgatctcaatcagataggaatcaagatcgcccttgttccaatcggcgaacacatcgccaatcgcctcggggaaagtcccagaccgcgacgcagaatgtcgtaggcttcgccgatgacctgcatgtcggcgtattcgatgccgttgtgcaccatcttgacgaaatgtccggcgccatcggtgccgatatgcgtgacgcaaggctcaccgtcgaccttggcagcgatggattcaagaatcggaccaagggtcttccacgattcggcggtgcctcccggcataagggaaggaccgttcagagcgccttcctcgccaccggacacgccgcaaccgacgaagtggaatccagcggcgcgcacttccttctcacgcttgatggtgtccttgaagtaggagtttccaccgtcgacgatgatgtcgccaggctcgaaggcctcttcgagctgcttgatcacggcatcggtcggagctccggccttgaccatgatgatggcggtacgaggacgttgcagggaagcggcgaattcctccatggtcttagcaggaatgaaattgccttcggtgccgtgctcggccagcagcttttcagtacgcgagtaatggcgattgaacagtgccacggtgttgccgtggtgggcgagattgcgggccaggttgctgcccattgcagcgagaccgataacgccgatgttagcttgtgctgtcatgattgtatccccttgctgttgccgttcgttcaaatgaatgatattgctgagagccaatcccaattgactcaatgcctcgtggcatagcacctctggaggcaagttggaaatgagccgtatgccgtgctcatcagcctcgagaggctccaaagtgtcaatctgcgattgcagaagctcgacgggcatgaaatgctcacgctgcgtcatacgttcggcgatatcggttttatcgagatcaagctcgacgaaaacgacttgtgcgttcgcctctcgtaggatgtcgcgatatgcgcgtttcaacgcggaacaagtgacgatggtgttggctcccttgcctgcctgctcggtgatccaatcgcgtaggctgcgaagccagggccaacggtcctcatcggtcagtggatgaccagaggccattttgtcgatattggcttggggatggaaatcgtcggcttcggcatatggccatcccaattcgtttacgagttcctgagccatggtcgttttaccggtgcctgtcacacccatgacgatcagactgacgggttcggcattggaatcaagcatggattctccttgaatggaaagggcgatcagacccgaatacgttccaatcgcccgataatgaatcggtggctaaatcaccactcgtgcatggtgccgtcaagcaggcggtcaacggggagcggagccggctggtacggatacttcgccgcaagcttctcgtcgaagtcgacgcccagcccaggcttgttgcccgggtgcagatatccatccttgaaggtgtacgaagtgtggaacacctcgagagtctcctcggaatgcttcatgtactcctggatgccgaagttcggaatcgctaggtcaaggtgcaggttcgcagccatgccgaccggggaaacgtcggtcggaccgtggaagccagacttgacaccaaagagctcggcgaaggccatgagcttcttcatgtgggtcagaccaccggtgtgggtgacggcggaacgcacgtagtcgatgagctgttccttgatcagggtgatgtaatcgctccacgagttgataatctcgccgatggcgataggcgtggtggtgtgctcacgcacgatgcgcaggaattcttgattctcctcggccggagtggagtcttccatccagaacaggtcgtacggctcgagcgacttgccgaagcgagctgcctgaatcgggctcagacggtggtgggaatcgtgcagcaggatgaggtccttgccgtacttgttacgaacttcctcgaacactcccggaagcgtgttgaggtaggtgcgtgcgtcccaaacctcttcgaccggcaccgtggtacggcgggcaggctcgtagtcgtaacgcaggcccttctcgccggcgccctgctgggagttagcggaaccggcgacaccgtaggtggacggaatgcccggcagagcgaactgaatacgggtggccttgaagcccatgtcgcggtacatgtcgatggaatcgaacaggctcgggaagtccacaccggaagcgtgggcgtaggtcagaatgccggtgcgggaagcgccgcccagcagctcgtaaaccgggacgccggccttcttggccttgatgtcccacagtgccacatccacagcggagatggcggccatggtcaccggtccacgcttccagtaagcacccttgtacaggtactgccagatgtcctcgatgttgtcctcattcttgccgataaggctcggagcgatggtctctaggtacttcgcggcgacgagctcacgtccgttcagcgtggcgtcaccaagtccaacgacgccgtcagtagtggtgatgcggaaaacgacgaaattacgtcccgggctggtcacgaagacttcagctttttcgattgccatggttattccttcctgttatgacgcggcgcgtccgcgtcataatccccacctacggcgaggaagcttatgctatcggttatttgattatgtttatggttgtggtcacgcggctgtcgccgaagacagctcgttgacgagttcgctcaccttgttggtgaaagtggcgttggcgccaagatccttgtccaggtaggacacggctggggtgacgtcatcgttgacggcaagtttcctcacctcgtcgagattcacgtccttggcctccgtgtttccaaatcgacgcaggaacacgatccatgcggcgacagcacgtgccggagccgtgatgtcgcgaccgtccgcaagcgcgtgcttggcgacaggcacgattcgtaccggcagcttttgcgaaccatcggtggcgatttggaaaaggtgatggtgaatgcgcggattggagaatcgctccaacagcttggcacggtagtcgtcactggagacggacaggtatgatccggccagatcccaccattcattcacccatgcccgcagctgcgggtcagcgatggcctcggccaccgactcatgaccgaacagcgggccgacataggcgagagtggaatgcgaaccattgagcatccacagtttgcgctgctcgtagggttccacatcatccgtgataacggcaccggccttgtcccatgcaggacgtcccttcgggaagtcgcctcggatgacccattcgaggaacggttccgtgcgcaccggcgccacgtcgtaccatccctcgtcctgtgccacggtctgcagttcggcgtcggtggtggccggcgtgatgcggtcgaccatcgaagtggcccatgccacgttgtcgcgagtccattccagcaaggtggggtccacggcctcaatggcctgctcgacgacgcgacggaacgcggctccgttgcctgcgaggttgtcgcagggaaggatagtgatcgctccggcgtttgccgcgcgacgcgcctccagcccggccacaatgcgtgcaggcacggtggcaagttcggacacgttcacatcgttacgcagtttggcgaggtcctccgacacgtcggtgtcgttgacatctagatcaccgtgggcgttccttttgtatccagcttcggtaaccgtggaggtgacgatggacacgttcggatccgcgaagtacttgtgcagtgccgccatgtcgccgccctcatgcatcgatgaaatcgaagagatgacttcgaacgaatcgccttccggtgccgaggtgatcagcgtgtagacgttgtcctgaggggccagcttgtcgaccattcggcgagaacgtccggtgaaaccggcgatgccccactgcgcggtgtccggcgcatgttccgtgtaccaggcttgatgcgccctggtgaaattgccgataccaagatggatgatgcgcaccggcgctgcggcgcggccgtgctctgcgcggttcaatctgggcaatgacgtgaaatcatgtgtatcagtcatatttactccttgaaatcaataaaaggtcgttcgagtcagagcttgaacacgtcagaaggctgaccgtccacggaacgaatggcgatctgctcgccttcctcataactcaaccggtggtcggcgaccagaccggagatgtaacgtgcggtcagacgacggttcatgtcgtggcgggcggggatggagcacagcgcacgggtgtcatcgatgaatcccgacagcttggcgaaaccagcgtacggaacgacatcctcgtagtagcgcagaatcggctcaggcgcatccaggaaccaccacggggctccgatgtacagcgccgggtagtatgccgccattggagcgagctcgcgggagtatgcggtctcatccatggtgaatgccacaaggtggaaatcaggattctcgccgtattcgttgagcatggggcgcagccagtgagcccaatcagccggcatcgggcaatccgctccacagtccggaccgtagttgacgagctgcttgcggtagtggttgcgcatcacgccggggtgcaaggtcattaccagaccgtcgtcctgcgcgagctttgcctggtcgttgagcagatgggcgtgcagcttgcgtgcctcatcggaagtcaggctgccactacgagccttggtgtacaagcgaatcgccacatcatccgacaggcgtgtggtgtcgccggaccaattgacttcgtcaagcgaaggatccacaccgtaatcggcggcgactgcgccatgctgcttgaagaacagacgacgacggcgcatggcctctacgaatccttcataagtggcggtgtttacgccagccgattcacccagctggtcgcagagctgagcccaatccacacgatcgaccgcaaggtagcgatccggacggaaacacggtgcaagacgcgccgggaaattggcgtcggcgcgcaccttatcgtgcaggaccaggtcatcggtggggtcatcggtggtggagatgaagccgatgttgaaacgcttcacaagcttgcgggtggtgaaatcgtcggaggcaaggagctcgttgagctcatcgtagatgctgtctgcggtgtcttcattgagtggcttgttgatgccgaacacattggacagcgaatcctccatccagtaacgcatcggcgtgccagcataggcataccagtactttccaaggaggcggaaggcgttgcgagattgttcttcggtgaagttcttctggcccacacccagctcgctgaaaggaacactatgtccgtgcatgatacgggtcacgtagtgatcaggagtgatgaatagatcggtggggttcttgaaatgcttgtcttccgcgaaccagtcgatagggacgtgtccgtgaggggagatgatgggacgatccttgattgcctcgtacagtcgacgtgcgattaaacgttgttccggatccgttgggaataggcgatcttcattgagcgcggataccattgtaactactccttaaaatagaggcttattcacagatgctggatgatggctttcgccaattcctgatattgcgattcgtcgaggtggacgcgatcggggttcattgcgaacaccgtcttccactcaaagccgtcccgatacttggggcacaggtggaagtgcaggtggtgcccgtcgtctccgtaggcgccgtagttgattttgtccgggtggaaggccgcgtgcaaggcttttgccacatggttcacgtcattcaggaaagcctcacgttcctcatcggataggtccacgatttcggaaacatgatgtttcgaggcaacaatgacacgtcccttatgactttgttccttgaacagcacaagcttcgaagctggcagttcggcaattatgatgccgaacgcgtccaaggcctcgccttcatcgcagtaggcgcaaagttgtttctctggctctggcatatctcgtcctttgagagttgctgcaacgatgtggctgttggccacattgctgtgttcgtttgcaagttctttttcaatatatgcgtgggtcggagtgatcagtgccgttttgcatttatttgctcgagttctaaatagggtctataggaacttttgtggtgcttatgatcgaggtccggccttgtacgagtaggcgtgtcggcatgcctttttcccgcgtggaaaatgatgcactcccggtggtgggctggatggtgtgagaacgccatccagcaaagcgaagaaatgcccggtatgcgggcgtgcgatgaagaagaacggacagaccggcaagggcacgcaacgatggagatgccgggcctgccggctgagctcgacgatggtggattggctacaatgtattagacagtcctatgggggacgattgacatgaggttggaggccgacgatggccgacccgaagcatccccgccactacgaggagtcgttcaagcggcagatcgtgcagctttacgagaacggcaagccggcgcgcgagatcaaggacgagtacgacatctcgcattccacgctgcaccgttgggtccagggcatccgcaacggcggctccacccgggccgcggacaaccgcacgcctgagcggaacgagccggtcgagctgcgcaagcgcaacagacagttggagatggaggtggacgtttcagaacaagcggcgccggtattcgcacgaaagtagcagtgatacgggccaacggccgcccgctgcccggtatcggcgcgatgcgggatgctgagcgttccccgctccacctactactggatgaccgaacatcccgaagccgagcgggtggatccgatcgccggcgacgtgcacgcggtccggtgcgacagccatgagcgttacggcgccaggaagatcaaggccgcgcctggagcggaggggcgtcatcacctccagaaggcgcatcgtcgacatcatgaaacggcggggcatgacgagcgcgtacgcgcgcagaacgttcaaaccacacaggacgcgggttaacgaggccaggctcgcgaacatcatcgaccgcgagttcgacggctacgagccgcgcacccgcctggccagtgacctgacgtacgtgcgcgtcggcggcaagtgggcgtacgcgtgcctgctgtccggcctggcgaacaggagcatcgccggccacagcgccgacacgggccgcaccgccgacctggtcatggccgcgttcgccacgctcggcttccccctgaccgaggtggagatgttccacacggaccggggcggcgggttcgacaacgcgaaaatcgtcgggctgctcgatgtgttcgacatcggaggatcgccgtcgcgcaggggcgacccgtacgacaacgccgtggtcgaatccaccaacaggctcctgaagaaggagctcatataccggaaccactacaccagcctggaacaactacgctccgacctcaacgactatgtgtggtggtccgacgaccaaagactccactccaccctcggataccggagtccgaaggaattcaccgaacagggactcgtcctctaagaacctgtccaacacaccgttgccaatccagaatgcctgtgccacgggctgctttcggtgttcggacatgtcggcgggatgccgcccgtgctcgtgctcgacaacgccaccggtgcgggtcaccgtgacgcgaaaggccatgtgacgctcgccacggtgttcgacgcgttcctttcccgccacaggatcgaggccaggttccgcaacccgtattccggcaacgagaagggcgacgtggagaacgcggtcgggttcccgcgccgcgacctcatggtcccgcccctggaggccgagtcccacgggcaacccgcccgcgtcatgctcggacgccgcgacgaaccggcccggagccgatccattacaagctgatggacgtgcccgtcatggaatgcttcgacgaggaccggaaggcgttgacgcccctgccgtccacgcgtttcgacccgatccggtgggaaagcgggaaggcaggcaaatacggtcgcatcggcatcgaccccaaccggtacctcgccggcggcgagtggcatggcaggcgactcccggccgcggtcaggcgggacagcgtgcggatcgccgaccccaagtcgggcgaagtggtcgccgaataccccaggcagtacggcaggactgccggcacgctgcaggatcccgcgctggtgatgccgatgctcgccgcccgcccgggctcatggagggagacgccgatacgcccggatttccccgaggacgtgcgcgaatggctcgaccaggccggcaggcaacggttgcgcgacagtctcagggccatcgcccaggccgcggaagcggcgggcttcgacaacgccatgctcgccgcgtccgactcgatcgggttgcggcccgatgccaggcccgcggacacggacctggtgtcgctcgccctgcgccaccgggacggcgactgggacgaggcaagcgaccagggtcctgacctgaccggccacgaccggttcatcaccgggaccgggccggaaggcaaggaggagacgcgatgagcaggagacctgatcccaggatccccgagaccaggcgccgccgggccggcaccatcgccaaaagcgaacgcgtcatggccatgagccggcacctgaccctcacgcgcggcgtcctggccgaccacctcgcccaagccacgcccgcccaactcgacttcatcgagtcctggttcgaggccgagcccgccagccgggagcaatccaaacgcgcgcggctgctcaaggcggccgggttccccaacgcgaagggtcttgacggctacgactggtcggacctcaggatgccgccggactgggggcgcgtccagctcgagagcctggagttcgtcggcaaaagcgaggacctcgtgccctacggtccggtcggcaccggcaaaagccacctcgccgtcgccccgggaaggctcgcatgcatgaacgccatgcccgtcaggttcttcaccgcctccggcctgctcatgcgcctgaggcgcgcgaaacaggagaaccggctcgacggggaactcgcggccatcggcaaagccaggctcctgatcatcgacgaattcggccacatgcccgtcgacgaggaaggcagcaggctcctgttccaggccgtatccgactcatacgagaccaggagcatcatctacaccacgaacatcgaattcagcggatggggccgcgtgctcggcgacaagaacatggccgccgcgctcatcgaccgcaccgtccaccacggacgcatgatcaggttcgagggcgaatcctacagacggacccacgccctcatgcaataacaaaacaaccaaaaccagacgaaaccagccgacggtaacccggtaaaaaattgaccggtaacccggacagccacccacggtaaaacggcacaccagcgcttgacaaaacacaatatatgaaaaccggtgatgccgacccatttcaggtcggcatcaccggtttccataaaacgccgtattcgtgaaagtcattcaaaaatacaagccgaattcctgatctgccgatgacggcaatcaaggataatcacctgagatcaggcggcctttttgcggccgcggcgcttcatggtgccggcggtggcgttggccacgtcgaagatcacggtcttgctttcggggtaggcggtaccgttgacggactggtaggcgatttcgccttccggtgcctcgggcagagtgaggtatgccttcactgcttcaatgagcgtggcttccttgacgcttaccgaagcggcctgcttgccttcgggcttgctgaacttgatggcgttgccggccttggcggtggtcggggtcacggcgatctgcctggtcttgtcgttgatcagcaccttgacgtacgccgggaatccgagcgcttcagcggtggctttgttgaaacgaatggcggaatcggtgacggtcagaacggtcttgcccaccggcttgaccagctgaacctcttcgaatccctgaagcaatgaagccataattgctctccttattgcattggtcacgtgtctttttacgtcgctaattgtagccagctaattccgtattatacaaatccatgcatgcatgattgcataattgaagaacatttgacctgcgtattgcgctcctcgaatagcgctgattcagccaatgccaaggaaaaggggaaacgggaacccgcgatatcagccgtattgaacatagaagtatgcaatttcagcatcgcgatggctgaccggtctttttgccggctctatttgccgctctgcaagccaattcctcggtcggcaagcttggctcgggtgtagtattcggccatcacggaacggcattgattgccggtgcatacatacatgatctgcataacgacgtcccttctcaagtgttgcgagcattccctcgtatattccagtgagcattcctcgtgaatatgcgtgcgttatgtaccgtagcaataacatggaaaaaccgggaatcatcgactcccggttcagtggtattcgcgaactatgcttcagcgtctaccgtccattatgtcagtcacgtcagcgacgagtggtgctcttgcgggcggcgaacagggcgatgcccgcggcggcaagcaacgcaatggccacaccgtacggtgcgatggccacaccggtgtcggcggtggtggtagtcgtggtaccggactggtcaccggttccggttgccggaacctgaatggtggcggtcttggtaccggatacagcgccaacagccgtgaccgcgatggtcttgccggcctggctggccttgaacgtgtacagcaaagtcaaggaaccatctgccttggcagtgaacgtcttggatactgcagcgatctgctggacgtcggcgacgatggcaccatcgtagtgcacggtgacggattcgttcggttggaatgtgcctgcagggaacgtcacggtagcggtggtgccgctgtaagtggaccattatctgacgcacgggcggcgggcgagccgcacgatgcgccggttggggtatccgagcaaggcgctgccggccgcgtggatcgacgagctcgcgcccggcgaacgccgtgtcaggcgcggcccggtccccgacgggcccaaacgcgaggccgtgctcagggtcgcgtccggcgagatgacgtcgcggcaggcggccgccggtctgggagtggattcctcggtcgtgagaaaccggagacggcaactgctaggcgagaggaaagggaccgcggtggcgaaggacgaaccagaacgcgaggccggcgcgccgcagacggatccggacgtcctacgcggcgagatcgccgcgtaggacgccgacctggagcggttgcgcgccgaatgccgggcgatggagatcaggctggcgatcatgaaggggtcggcggagctggtgggaaaagagccgggcgcagacccggacaacctgacaagccgggaaaagacgatcccggtcaaaaaggccggtgaggagccgcacgtcaatgccgagagcctgctggccgaggtcggcatcgcgcgcagcacgtaccactgccggctcggaacgaagataaaacgttgctgaagcaccacagaggttcctatagcccccgtctaagcactgcaacaaaaagaccccgaccatctcggtcggggtctttgtcgtcagtaatgctcgaagtaatcgctacgagcagaaggtcactcggtgacggccttcttcagcagggagccggcggagatgcgaacgccgtaggaagccggaatgtcaatctgctcgccagtacgcgggttgcggccagtgcgagcggcgcgcttgacgcgctcagcggagaacaggccggtgagcttcaggccttcgccggacttcatagcctcgacgaacacatcctggaaggcgttaacagcagcctcggcctgagccttggtcaggttggacttctgggcgatcttcgagacgagatcagacttgttgtatgccataaagcatccttcttgggtcagggggcgagcacttttgcttcgtccacgttttcatcaatgatactagcgcatgttcctgcgaaaacccgcatcgtataaggcttttcacatctatttcgtgttctgaagcccaggatggacaaaaacggacagatcagacgaggttatgacggtcgagccacttcatagcggctgcgcccagaggaattcgtagccaatagaacaccacgcgatgcagcaacgtggcggatagagctacgccctgaggcacaccgaccgccacgaatgcgaaagtcaacgcggcttccacaccgcccaaaccaccgggggtgggcaccgcggaacccaacgcataggccagcatgaagacgaacgtcgtttcaatcggattcgatgaataaccgaacgcttgcaaggccgcccagaaagcgagcccagtggtcgtgttctggaacagtgcgcccaggcagctgaccgtgagctgtcggggctgggaaagcacgtccagcagctggttgatatacgtcttggccagcggcataagacgacgggtcacccagtggcgcaacggcggaatcatcatcgcaatggacaacaccacaaccactacgcccagcacaaggaccaacgtattcgtcggaatcgcgccggagaacatattgcggccggtgaataggccaatcaacaccagcatggagaagtacacggcgtaatacaccacgagcgcggcgctcatgattgcggtggccggggtgttgcgatagccggatctgcgcagaaactgcaggttgacgaacgcgggccccacgccggccggcatggataccgtggcaaagccgccggcaacctgactcatgaacacgcccgtgttatctcgcttgctgcgatccatgagagcgccgagcgaaatcgacgatccgatccagccgcaggcaccgaacgcgagcgttaccaccgccatcaacgggttggcgttggtcagcgcggttatgatttcttcgggcttcaactgggtgaagaccacgaccacagccacgatgaccagcagcatggtgatcatcgaacgccaggagaagcgggcaagcgtcaccggctcggcggattcggcggtctcctcatcaattatggtgttgatgtggtctcgcagttccttgagcagctgcttgtcccatgtgaccaatgcgcgtgtgggggagggaaccgcgactttctggatgaacggggccagcgcggtcaacgtcgtgtcgccccaagattcacgggcagccgcgactgcaggtttcacgccgatcaacgcggcgaacagcgcaagcaactggaccttgtcaagcgcggtattggccgggccggaagcgttgtcgccattcagccagccggcgataaccgcagtgccatcttcaagcctagcgagcgtatcaggcgtgatgcgccggtgcgtatatccacggcgattcgccacagacagatatcgcatatatgctacggcgtccgcctgggtgagcgtgttcagattggcgggcatctcgatggtgtgcgcatccagcaccagaatcgcggactcgtccgtatcggcgatgccgtagggggcgggcgcaggcagtttgatattgtgcaggccgagcagcatggcaaagtgatgctgaacggcgtcgcgcacggaacgatcgcgtcgaatggacacgctggtaaaacgtacccaatcccagagttgcttcagatagccgacggtatgggtttgcgcgtcgatgacggaaacgatgaaccggcggttattcgaggtctccacatcgtagatgcgtgagccttccgccaaatcgtcatccaaagtggcagacaatgagccatggccgattccgggctcctgatgccggatgagtgaggtggtctctaatccgatgcttgagagcaccgcgacgagatctttgccccacacgcctttattctgcgtgccgaccacgaatcgaataagcatgcccaccgtgcgaccggcggccatcgaaaccagcatgccggtaaccgaatgccacgaaagcaccaccatcaccgcggcgatggcatacaggatattccaactccatttgaccgtggagcgggtacggcgtggcccggcggcggtcaggaaggacgccatgccggcgtagatgtcgggcaacagctcggaaccgtatgaggtggcggctgagaccagtgccattggcagggcggcatcgttcagactactgattgccgtcgatatgacccacacaatgccgtatccggcaaacatggccagcgcggacaccgcagcctgcagccattcccgggccagtagcaattgagcgagcacgatgatcacgatgacgatggtggccagctgcgtcagtacggtggaggggaaagcggccagccagttgatggcttgggcggcggtatgcgcgtcggattcgacgccgcgcgtcatgccgcccagatatacggcgaacaccataaccacggcggccatcaatagcgacagactggctcgggtcaggtcgccgaagtcgcgcgtgcggcgcggggcgatgtcgtcgatgtatggtccggaatcgttgctgccgtcggttgtcgagctgtccgttccgctgacagcaaaactggccgaccggccgtcaccagaggcgatcggccggtcggtagtggaggaggtcgccttgtccgggcgatcttccgtagtggactgatcctgttcagtagtcatgaaatggttacctgacgtctgtccttgttcggttcagtttgcggttcggtttgtgactcagcgcagtagtgtggtggatgcgagggattcgagggactcgcatcgcacctatctcaacggtcgaaagcgacgagctggctggccacaccggtgtaggtggcgggggtcagagccttcaagcgagcggcggtttccgggtcgaaggactgctggtcgatgaactgctcgacctgctccttgtcgatggagtggccgcgcataagctccttgaccttctcgtacggtttgtccatgccgggcaggcccttgagctcgcaggcgcgcatggcggtctggatcggctcgccaagcacctcccagttctcatccagctcacgctcgatgacgtgggtgttcgggtggatggactcaaggccgcccatgaggttggtcagggcgagcaaggagtagccgagcgcggaaccgatgttgcgctgggtggtcgaatcggtcagatcgcgctgccaacgggattccaccagcgtggcggagagggtgtcgagcagcgagcagctgatctcgaagttggcttcggcgttctcgaaacgaatcgggttgaccttgtgcggcatggtggaggagccggtggcacccttgaccggcacctgggcgaacacgccgcgggagatgtacatccacacgtccacgcacaggttgtgcatgatgcggttggcgtgggagacggtggagtacagctcggcctgccagtcgtggctttcgatctgcgtggtcagcgggttccaggtcaggcccatgcggttggcgacgaattcgcgggagacggcgacccagtcgacatccgggcatgcggccaggtgggcgccgaacgtgccggtcgcgccgttgatcttgcccaagtactcctggttttcgatgtgcttgagctgacggttcagacggtagacgtagacggcgagctccttgccgagcgtggtcggcgtggccggctggccgtgggtgagggagagcagcggcatatccttgaattcctcggccttgccggcgaggtggtcgatgatgcgcttgaactccggggtccacacgttttccatcgcgttcttgacgcaacgggcgatggagaggttgttgatgtcttcggacgtgcaggcgaagtgcacgagggtcttcagctcgtcgttgatgttggccagctcggccggagccttgtcgatctgatcgtcgatgtagtactccacggccttcacatcgtggtgggtgatggcctcatgagcggcgtgctgcttgatgccttcggcgccgaagtcctcgggaatggcgcgcaggaaggcctgctcttcggcagtgaacggcttgacgccgtcaacgatcggctggttgccgttgccctcaaagccgttggccagaagaatcatccattcgacttcgacacgcatgcgttcgcggttcagggcaggttcgctcatgtattcgacgagcggagcggtggccttgtggtaacggccgtcgagcggggtcaatgcgattgcgggggaaatatcggtaagcttcataacctccaagggtacttccagccgtgaaccgagcggctatactgtggtgcggcgttcccgcccgagccgtacaggtcatggcctggtatctgatgctggccatcgccaaaaccggtgtgctcgaccgcctcgcatccggccgcgcactcatcgagcgacgcgcctgacactctttgcgcgccactttcccgggaatgttgcgctgatagaggggttctcgggcatgctagcgcaacaagcccgggaaagtggcgctagccgcgtctctgcggtgattgcattgtggggtagccgattgattgctaagcattgacaagttgatgtgctcgttgccgtgagaccccgagtatatcgcctatttgctgtagggcgagacccatgccatgtagttcttgtgccgcggcgcgggtttcccgcgctgcgttcgatctgcattccgcttcttccttccgcagtcgccgagcttcatcaagatgcgcttgtacggattgcggcaattttgtctctatggtgagtgcgaaatcagcatcttgtgtcatgacggtgataaggtcgcgtgccatactttcaatctctgctgttgttcgtgcctgcgtgaaaccgataccgggaatctcaagaatccagtatttttcgccaggacgaacgatgacctgatatgttttcactgctgataccagcctttcccgagtttggcttctgcttctttgcaaataatgtccgcgaggttgttgtcgatttcgttatgacgtgggatgggaatcataagtccatcgagttggaatatctcatgactccctccttgcctgatactttcaaacgtaacattcttgcgttttgccgcttgcttcatcagtttgatgagctatctcctgctcgtcattatattgttaactcctttcttgacaattctgtcaagtgtggtatttacttttaaccgccgaacgctgaactcggtggttcgctcgccagtggcaatggtcgcggactaggtcatgcggccttggtagtagcgggtttccttgagttcgccgttgatgacttcctgaaaatgcgcttcgtggcgttgcacggcgggggagccgagatcggtggcgttctgataagcagcctgatggtacttaatccaatgcgacaactctctgccgttggtcgaaccagccacgggtgcggcgtcatatggggtcagaccggtgatgggcgtcgcgccgggagtgcatgagctgtccgaatgcactgtggatggtgttgccgcgggcgcgggcgatacatgcccttgtacggtgagccagttatcggtgaccgggttggcggaaccatccagtgcggcgaccagttcatcatcgatctccacgctggtgacccatgtgcgttgcggaatcggatgattggccaccggcgatccggctgtcaccacatgctcgatggtatattcctccgcccaatccgaggcaagcgtggcggcaacgatgccaccttgggagtgaccgatcagtgccacgggctcgtccttgccgatgcctgcctgacgcatcgcctcggcaaccatgcgagcgctgtccgctttcctgcggcgttcctgatcggcgctcatcagttccacgttctgcgcccagccgaatggtgagtcaggctgtccatcggtacccgggatggtgaccagccaggagttggttccatcagcccgttcatagcgttgaatggcgatggtcccatattcgagtccgctgttcagctcgattttgccgagccgctcttcggcgagtctgcgcagattctccattgactcggccaccgatccgcttgcgcggacgacgtcggcattcgcctgcacctcgcgtacttccagatgattgccttggatgatgtctttcgctggtccggagaaattggcgatttttcccgcagccttgttgacctcatcggtgtgcgcaatgctcttgccgataggtacgccgccaatgattccgcccgcgccgctaagcactccttcctggaacggatagctgaacgtggacatccatgccgggttcggtttgccgtcaatagcccagccggccagaaagccgcccgccgccgcagcggcaacacccaccgcggcatatcccggtttggcctgtgtgccggcctgcaataattcggtaaacatgcgccgagccgtcatctccgcctgagaatacagagagtgtgcgcgaatcagcagatcggccgcgccacgcaggtcatcgctcaaccgctggcatgccgttgcatggtcataacaccgattgcccagcgcggcatatggtgcagtgacatggccgggaacaacggcgctcggatcgcccgactgcaaggtgacgcacatcggcgcactatgccgatgtgactgtaactgtaatgcggccgattcccaagccgtggctatggccgcaaatcctgccgcctcgtcatcgagagccttggctatggcggcatattcttcaagagtggctggcgcatatcccactccgccgtaaacggacgattccacctgccagtaatcgtgctcgctcatgatgacccccaagccaatcggtgggtggtctccatgtcttgcgcgagactggccgaatactgtgcggtgcgactgagccgcgatcggaatagatcggcggctttaccggtccacacgatgttgcgggagcggttcacggccaccgccgtctggtccgattgcgccagtgtggccgcacgctggacggacacgaggtcgcgactacgctgtaccgccgcatggcaagggcaagtgccgtaatcgaacggcgtcaccgtattgccggcaaagccgccggtgggatcgatgggtgctgggttgctggtgtaggtattcatatatccagctaaaaggacaggactcatgcttgtccagccgggacgaccaatgtggttctagcttgccgattttgggcgaagttattcacaagtgttgtgtatagccgtaacgattatccacaaatagcctgtttggacatgcctcggatcagccatgggctatcgaaaattggacaaacgccaaagccgacagccgaaaccgggaaacagccgcgataaagccatgacccgtgagggtgtgagaaaaagagcaaccgtgaacgattgctcaccacggcttggtagccccggtacccttgttctgcgtcgccttctgctcggattgggtggtgttcgactgggtatcggtggattgctgattggccttcatcagctcctcgacctgcttcttctgctcgtcggtcaacgcgccgcccttttttgcattggatgaggaactctcggattgctgtgccgactgggcttgcccggaaccggaaccgctgttctgcgcctcggcctgtttcagggtgatcttcgtcagctcggaagaaatcgaagcattggtgtcgatggcgtccttgacttgcggcaacagaagcgtgcgcattcgcccggcctcggcgaattgcgcatcggtctgctgctgttgcgccttgagcgtgttgatatcagtcgactcgtcctgagccgctttgatattggcgttcaatgatgcggtggcctgattgaacgtaatcgaagcggacaggtttactgacgccacgccggcaaccagcagcagcaatacggcgccacaagccaggacgatacgtgcccaaagcgggcatttcgcccgcatccgaatattcgccgagccatcgttctcgtggatttcgttactgttcctcacagcagcctccttgaggttgcgatccatgcaccgacttccatggcaagcaatatcgccaacgtaatggccaacggccataccaccggcgtggtgcgtgtgcgctccttgaccgtggtggtcatgcgccattgcttcgacgacctggccgaaaccacatccgccaaagtctgtgaagcgtttacggccacatatgtgccgctgatctcgtcggcaatgtctttgaggttcttctcatccatcttggagatgccgggttcgccggtatccgggtcgatcacccagtggtccgtggtattggaatctccggcgctgacgccatcggcgatgacgggaatcttgccgccctcggtcgagccgacgcccacggtaaacccatcattgagatactggcgcagtgacgagaacgtacggcgcttcacattcgaggtctgttcgccatcagtgatgaggtacagcacaatcgcatcatccgggtgcgcttcacgaatcgacttcgcggtcagcagcaattgatcgatcggagcatccagactggagcccgccgacacggatgtggcttccaccgccaacgtgttggcccaattatcgatggccggcgcatccggggtcagcggcacatcaagcgttcccgaagcaccgaaccgtaacgccgcgaaactggcgtccggataagcggcggtcacatcatgcacggcctgacgtgcggcattgatgcgggtaatggtcttctcggacccgtatgtggcatcggccaccgccatcgacccggtggtatccaccgccacgatgacatcggtggcattgatggcctgtgaggtggtagacgataccacgctgggagtcagtaccatcaccgctacgatgagcagcataaacgtacgacgtatgcaagcccacacggtctcgtcactggaaacacggcgacgaacaaacaatacgatttcgagaatggccagtacggcgagcccggccgccagcagtccgtcggcgacccagcccaaggcgggggagaaggtgaatccgttcatcgcctcaacctccatgcacatacgatccagataatgagtatcacggccagagcaagcgtccacagaccgggagcgtccaccattgaggatttcgccttgttctccacatccgtatctctacgcgactgaatatcccgtaccagctcatctattgacgcgccattcgattgggtgaggaagatgcctccatgcgactcgatcgcggacttcatatccgttgtggtttggtccgattcactggctttcggcccggaatacaggccgtccacggtgattttggtctgctgggtcaagtccaacgcttcggtcagcgaataggtgggtttgcccgacacgacgttgtcggtggccagcacgatggatgccgcacgctgacggtcggcattcgcatgattggcttcgccataagcgaaaccggggagcatcgccgcgcaagacaccacgccgtcgccaatcaaggaggtggcgtccttgcggttctgcgtgccttcgagccaattggcgatgtcctgatattcggcatcggacatcttatcgacgtcatcctgcgactcgacgcctttcagcgccttgctggcggaggtcaactgtttggtgaccagttcgtagtcgtcggtcagcgggaacaccgtgcgtgaggtcgagttgaagatactcaaaccgatacgttccccctcgaaatgcttgaccagttccaaataggtatcgatgacctcgcgatcataggggagcgtggatcccgacacatccagacacaggacgatatctcggctggaagcgcgttcgtcaccggcatccacttggctggggcgagccaccagcacaatggccagcgccagcgcaagcaccagcacgctgatggcgagacggcccaaagcgcgccattgacggaacagacgggaagcgtgctcggtattgagatcgtcgtccatcgagaatacaggggtgtcgtcggcggcgttacggcgggcgaacacgacaatcagcacgataatcgccagcgccgccaagacgccggccagagcggcccaaggccaatgccatgccagcatcatgaacgccacctttccaccagattcgccacccactcggcggcctgctgcacgctggtcgtctgggcgattcggttgcgggcatcatcggcaaattccggtggatacaacgcgctaatggtctgcttcaatgcgtccaatccttggcgattcgcgggcgtgcgattcaggtacgccaaatcggtcagcgtactggaactaagctccctgcctgatgcggcaccggcgaaatcacgggcgatgacggccaattcgacgaaagcctcatgccggggcagtgttccggattcatgacgggccaccacatcgtcgatgcgggcacgccactcggccttggagctggcattgctatgagcgccacgcgcacggtcgctgttccgaggtttgcgtgcggggcgagccagcatgatgatcaacgcgatcagacctaccgccagcaacaggcatgcgacgatggccatcaccaggggagtggtcaaggccaacgactccacgggcctgagatcgccgggatcagtggcgagcgggatgatggggaacatgctgtgcatcatagatcacccgccaaagtcagtccgaccagttcgggtgcagtgcccagtctattgcgtgtggtgcgggccaatgcccgggacaccagggcgacgaaacgatcgaacatggattcgctggacgcggctcgaatgatatgggaaccggcacgggtgagctcctgttccaaagccgcggccatatacgcgcgatgagtatcgacctcggccgctgccttggcgttgcacaggaatgccggcacacgccgtgcactcaagccatcggtgggagcgtgacgggatgagacggccttgaacggattcatcgtcgccacatcgatcagcaccatcggatgggtgcgggtaatacgacggatcgtggtgatatgccgctcctccatcgcatgctcatcggtggccaatacgatcaatgcctcgcgatccttgatacggcgcgcatattccagcagtgcgtcgatattacggtgatgatcccaatcacggtcaagcgccttgtccagcgtgcgttcgaactgtgcgaacccaccgttgaacggcacgcgggtgatgctggactcatcgccgaacaccagcgaaatatcgtccgaccggcgcaatgacagggcggcgaacattcgcagcgcattggcggcaacctgccatgcgcgttctccggaagggcatacgccagtcatctccaggccaacgtccatcagcaaccagacccgtgacgtcgacaggcgctcgcgctcgaccaccatggggcggccttggcgggcgctggtcttccaatcgataagacgggattcgtcacctggctcataggcatgcacatccatcgcatcgccgctgccgccacgacgcccggatgcgtgttcgccctccagcacgcccaaagccttccttactgtaggcaggctcagctgagtgccaagggcctcgatcttcttgcgaacggaatcggaactcacggaacaggaaccgtttcgacgatcttgtcggcgatctgatcgctgaccacgccatcggccagtgcctcgaacgtcagcataatacggtggcgcagcacctcatgagcgaacgccttgagatcctcgggcaccacatagtcgcgcccggacagcaatgccttcgcctggccgatgcgggtcaaggcgatggtggcgcgcggcgaggcacccaaacgcaccaaggatgacagtcccttgatggggcgggagccggcacctcgtgacgtggcggtgatatcgaccgcataacgcatgatcgcgtcggaaacatgcacgcggcgtgccgccttgcgcaaaaaatcaacgtcggacacggaaatgcgttcgccggtgatggtgtcgggaccgatcatgtcggagccacggcgggtgagcatggccagcatccgagcctcttcgtcgggcgaaggataggtcatgacggccttcatcatgaaacgatccatctgggcttcgggcaggttgaacgtgccctcctcctcaatcggattctcggtggcgatcaccatgaacggcttgggcaaggcgatacgctgcccgccgacggtcgtggcaccctcggccatggcctcaagcatggcggactgggttttggcattcgagcggttgatctcgtccagcagtacgaaattggcgtgaatcgggccgatctgcgtggtgaacttctgcgacgcaaaatcgaagacctgcgtgcccaccagatcggatggcatgagatcaggagtgcactgcacgcgtttgaacgagccggatacgcaggtggctagtgtctgggcggccgtggtcttggccaagcccggcacggattcgataagaatatgcccgccggccaccaaggtcacgataagcgattcgcgcagattatcctgacccaccagtgtctgggcgaatctcgcccgaatgatgtcggccaggatacgtgcgcgcttggcgtcatcggcacccagctgagccgacacgccgggcgcgggaacggtgaccggtcgtgcggcggtggtctgcgaaggtatgttcggttgcgtggggaacaaagtcatgtccccactgtaactacttacaatgactgttggtctgtctaaagagtccaatccaccggttcggcacccatggtgactagggcttgattggctctggagaatggtttggagccgaagaatccgcgggaagcggacagcggactcgggtgaggcgatttgataatgaaggcattggtcagcaatggctcgaggctttgcgcattacgccccagagaatcgccaccagcggcttgggcttgccatcggcgtccgtgcgcgcgttcaacgcacgaatcgcggcctcggtgacttcctcccagcctttgccctgatgcgaattcggccgcccgacgccgacggtcagacatctgttgagcaacatcaccccacgttccgtccacggtgtcagatcgccattggtgggcatgggcgccccaaggtcgtcaaccaattccttataaatattgaccaggcttttcggcagcgggtgaacattcggcgccacgcagaagctcaagcccaccgggtgacccggggtcgggtaggggtcctggccgacaatcagcaccttgatggaatcgaacgggatggtgaacgcgcgcagaatattgtggcttgccggcagccacgggcgtccggcggcgttttccgcacgaagaaaatcgcccatatggtggatggtgggctccacgtcggccaaggcatgggcccaccccggctctaccagttcgctcaatggtttgatcatgactcaccactgtagtcaaacgtgcatatccggtgcacggggcgtggtgtggtggactgatgagttgtttgccgattacactcatgggtagttttgacaggaagaaagggcgattatggcacgcgacacgatgacctacgaatcctatgaaccggattccttcgacaatcctccgaaggggccggtgggagttcaccgtggcgctcgttcggtagtggcccgcctctgcccgttcatcgtcgttattctggtggccgcactgtgcggtgtcggggcctgggcatggatttccgggggatacaagaatgtaataggaggatcgtcccagacggcgaccacgtccaagtccgattcgtccagcaaggctgagaccaagaacagcaccaaggatgattcctcgtccacttcggccgattcgtccaaggactcgacttcggattcggcaaagtccgataccgacagtgacacgacatcctcgaatgagaatcaaaactccgatcagcagtctcagcagtccggagccaccgcgactgtgaataaggccacgcaggtgcgtgtggtcaacgccacaggaatccaaggatatgcaggtcagcaggccgatgtgctgcagaccgccggttacaccagcgtcgaggcgaccaatccgcgcggcacattgccggcttcttccgtggtatggtatcagaatgaagccgataaagccaccgccgaagatgtggcgaccacgcttggcatttcggctgtggagcaggtgcaaggactcgccgttcccattacggtggtgctgctcaactagcgttgttgatgcgccccttatatcggcgtgaaatacatcgaaaactgtgagcgttctcgcgtctatggaataattcgtaccgaaaatgtgccgctgcggttgggattgttccctcgtcgctgtacaatcgtcatctagtcgcgaggtagggggagcgcgatgaggttctttttacgttccctataggttttgtgtcgcgacgcctaagggaacaaaggaaagaccagatatggcacaaggtaccgtgaagttcttccttgccaagaaggggttcgggtttatccagccggacgacggcggcgaggacgttttcgtgcactacgcggaaatcaaggacgacggcagcaccaataagttcaagatgctgtacgaaggcgatcgcgtggagtatacgcccgcttcgtccggcaaaggcacgcaggcaaaggatgttgtcaagctgtcttcgggtgaagcccgctccgagtgagcaacacgcacgcaaggatgtgcattgaaggccctgaccgtttcgacggttggggctttttcatgcccaaagcgcaatcgccgccgatgatgttggcactcggcggtcgcgagtgctaatgtctgggttagcactcggaggtcgagagtgataatcgacagctgacggctggtcgtcacgactcgacgcttgcgagtgataaccggtatacctagccatttggaggaatacgcaaccatggcaaagatcatctcttatgatgaggaagcccgtcagggcatgctggagggccttgacaagctcgccaacaccgtcaaggtcaccttgggcccgaagggccgcaacgtcgtgctcgacaagacctacggcgctccgaccatcaccaacgatggtgtgtccatcgccaaggaaatcgaccttgaagacccgtacgagcgcatcggcgccgagctggtcaaggaagtcgccaagaagaccgacgacgtcgccggtgacggcaccaccactgcgaccgtgcttgctcagtccctggttcacgagggtctgaagaacgtggtcgccggctccaacccgatcgccctgcgtcgcggcatcgagaaggccaccgaggtcatcgtcaaggaactcgtcgctgccgccaaggacgtcgagaccaaggaccagatcgccgctaccgccaccatctccgccgccgaccctgaggtcggcgagaagatcgctgaggctctggacaaggtcggccaggacggcgttgtgaccgttgaagacaacaaccgcttcggcctggacctcgacttcaccgagggcatgcgtttcgacaagggctacatcgccccgtacttcgtcaccaacgctgacgaccagaccgcagtgctcgaagatccgtacattctgctgacctccggcaaggtctcctcccagcaggacatcgtgcacgtggccgagctggtcatgaagaccggcaagccgctgctgatcatcgctgaggacgtcgatggcgaagcactgccgaccctgatcctgaacaacatccgtggcaccttcaagtcctgcgccgtcaaggccccgggctttggcgaccgtcgcaaggccatgctgcaggatatggccatcctgaccggtgctcaggttgtctccgacgaactgggcctgaagctcgagtccgtcgacacctccgtgctcggccatgccaagaaggtcatcgtctccaaggacgagaccaccatcgttcagggcgctggctccaaggaagacatcgacgctcgcgtggcccagatccgcgctgagatcgagaacaccgactccgattacgaccgtgagaagctgcaggagcgtctggccaagctggccggcggcgtggctgtcatcaaggtcggcgctgccaccgaggttgaggccaaggagcgcaagcaccgcatcgaagatgccgtgcgtaacgccaaggccgccatcgaggaaggcctgctgcccggcggtggcgtggccctcgttcaggctgctgccaaggccgagaaggctgaggccgtcacctccctgaccggcgaagaggctaccggtgccgccatcgtgttccgcgccatcgaggccccgatcaagcagatcgccgagaacgccggcgtgtccggtgacgtggtcatcaacaccgtccgctccctgcctgatggcgaaggcttcaacgccgccaccgacacctacgaagacctgctggccgccggtgtgaccgacccggtcaaggtgacccgctccgctctgcagaacgccgcctccatcgctggtctgttcctgaccaccgaggccgtcgttgccaacaagccagagccgaagcctgctgccccggccgccggtgccgacatgggctactgatccgcaaacgatcgctagctgattgagctgaaaggggattccttcgggagtccccttttttgtattctggttcccctctttgaggggagctgtcgaacgcagtgcgactgagtggggagctacggtgtagggatactcccctcagtctcgcttcacgatccagctcacctccgggggagagccaagaaactagctggcaaacaggcgcgaagcttggatttcggcgtcagcgtacacggtggaggcttgcgtcagcgagcgttggatggactcgagtgaggcctccatctgctgttgggccgcacgccactgttcggctaccgcggtgaactgggtggccgccgaacctcgccatgcgtcctgcaaggcattgagattggtgtacatgccgcccacggcctgcctgatttgcgagatcgaagtggccactgcggccgaggatgattggattcgctcggaatctacctgatattggggcatcgttgctccttttctagagggttaatggtatgtatggcggccgcttgccaataccggccgctaaggtggaggatatgtcaacaacgaatcgggcagacggaaaaacaactattgtggtcctagcttcggagccgtcctgttcggcctgcgggaatatggtccgaaaatggcttgtttgcgccatttgcgcccttgctgcagtagcgatgaacgcaatgtggataaccgcaaatgcctatggggataactcgggcgacagctctgacagctccagcagcagcaccgacagcggcgtgaccatcaccgagaacatcacggatacggaaaatctcctgggctcccatgcggccaaagtcacggatgccatcgccaaaaccgagaaggaaaccggtgtacacgtgcatctgctgtatctttccagtttcaatagtcaacagaaaccggaagactgggcggcaaccgtgatggagtccatgaatcccaagccgaacacagtgatgcttgccgtggcctcgaatgacggcaacctggtggtcgtcgtgtccaagaactccgataagtggcttctcgataacaaaaccgtcgataagctatccgaagccgcacagcagccgttactggaaaacccaccgagctggtctggcgcggcaacggcaatgatggatcaaatcgtgaaatccaaaaaagcctccacctcatcgtccacggtgaccgtaggcataatcatcatgggtgtggtgttggtggcgctggtcatcatcatcgtggtcatggtggtgattcgtcggcgcaaggagatcaagaaggattccaaggccgaactccaagatgacattcaggaaacgcccagaagagcacgacactctagaaggcatgagtaagcctattgaagcatcgattgttgttgtcgacgacgagccgtccatccgagaactgctggtcgcttccctgcacttcgccggattcgaggtaaacaccgccgcttccggttccgaagccattgaggttatcgaaaaagtgcagcctgatctcatcgtgttggacgtcatgctgcctgacatcgatggattcaccgtcacccgccgtatccgccaggaaggcattaccgcccctgtgctgttcctcaccgctcgtgacgacacccaagacaagatcatgggcctgaccgtcggcggtgacgattacgtcaccaagccgttcagcctcgaggaagtcgtggctcgcatccgcgccattctgcgccgtacccgcgaacaggtggaagatgacccgattattcgcgtcgccgacttggaaatcaacgaggactcccacgacgtgacccgtgcagggcagccggttgacctgagccctaccgaatacaagctgctgcgctacctgatggacaacgagggccgagtactgtccaaggcacagattctcgaccatgtctggcaatacgactggggcggcgacgcagccatcgtcgaatcgtacatctcctacctgcgcaagaaagtcgacggcatcgaggtcgacgacggcgaaggcggcaagcgcaaggttaccccgctgattgaaaccaagcgcggcatcggatatatgattcgcgaaccgaagaactagtcgccccatccataacgcatcgtaatctcatgagtatccccgataagcagtcaggcggcgtaccgccgagcagcacgccgaacgccgccccgaacacgaatcccatgcctgcaatgccgccgttcgccgcccatttccaagagcggaacgaacgtaagaaaaacatgctgatgcggcatatcgaccgtatctcgttgagcagcaagctggtggcctgcaccatcgccgtgctgctcatcggcgtgtcggtgatttccttctccatccgcgcgttggtgaacaactacatgctgcagaaaaccgacacccagttaagctcgcaaagccagctggtggtcaacaatatcgatctgctgtcaagaaatgactcatcggggccgaacttgtactttctgcagattcaatataccgacggcaccaaagacaaagagggcaatcctctggtcgtgaccccgctgatgccgcagatgcaggacggtatcgtatcggtgccgattcttcctacctatggtgataccagtggcatcacgctcggccaggcattcactacgcaggcagtggccaagcagatcatcacggtgcagtccgacagtgcggacagccagaacgatccggccaacggaaactccaattcctctgacaccatcaccaaggtactggccaaccccactgtcaatgccaaccatgccgccatcgtcacggcgagggcgccatggcgtattctgccggtgaccttccagcaaaacggcaaggaccgggccgtggtgtacatcggcttgtcactggccgaccagatcgacaccgtcaacacactcacccgatactgcattgtggtcggcatcgccgtggtgctgctcggcggctccctgtccacgctgatcatccagcacacgatgacgccgctgaagcgcatcgagaaaaccgctgcaaagattgccgccggcgacctgagccagcgtattccttccgcgccggaaaacaccgaggtcggctccctggccgcctcgctgaactccatgctcgcccgaatagaatccagtttccatgagcaggaggagaccaccgacaagatgaaacggttcgtctccgacgccagccatgagctgcgcaccccgttggccgccatccatggctatgcggagctgtataagatgcagcgcgatatgcctggtgccttggagcgtgcggacgagtccatcgaacatatcgaacggtccagccagcgcatgacggttcttgttgaggatctgctgtctttggcccgtctcgatgaggggcgcggcatcgatgtgaccggcacggtgaaactctcgtcgctggtcaccgacgccgtcgatgacttgcatgcgctcgacccggaccgtgccgttcgccgcatgcagatttccctcgaaccggcgcgcgatttgaaccatcccgccgaattcaaccttgccgaaggcgattggcccgaggttgtactgcccggcgacgcctctcgactgcgccaggtggtgaccaacatcgtgggcaacatccaccgctacacgcctgccgattcgcctgccgaggccgcgctcggtgtgatgccggccgccatcgatccaagacagctcgctcgcatgcccgccagcgacgcgtcaatgcggcggttcatcgacgccgccgaagtaggtgcctcgatgcagaccggctatcgatatgccgtattgcgtttcgtggaccatggccccggcgtgccgcctgaatcacgctcgaagattttcgaacgcttctacaccgcggacccgtcccgtgcccgagaaaagggcggtaccggtttgggcatggccatcgcgcaatccgtggtcaaagcacatcacggctttatctgcgccaccggcaccgatgggggaggcctgaccttcaccgtggtgctgccgattgagcagatcgccgctcctgagcccaaacagtccaccggaaaaaccaaggacgccaaacagaagacttcttggttcagctctgagcgtaagactcaggcgactcagcccaaagcgtgaggtcaagccctgtgaggtaaactgtaccttcggtttactatttccattgaggattaaggaaggttcgcaatgcccaccggtcgagttcgttggtttgacgcagccaagggttatggcttcatcaccagtgaggaaggcaaggacgtgttcctgccggctcaggccctacccactggcgccaccacgttgcgcaagggggccaaggtggagtattccgtggtggacggccgtcgtgggccgcaggccatggatgttcgcctgatcgcctccgctcccagcttggtcaaggccacccgcccgaaggcggatgacatggccgccatctgcgaggacctcatcaagatgcttgatgcggctggcaatacgttgcgccgtcaccgttacccatctgctgccgacagcaaaaagctggccacgttgctgcgtgcggtggcggatcaattcgatgtacaggactgatctgatctatgactgataccaccgaaaccatcgtgacaccggaccctcacgccatcgcgcgcgccgtgctgctcgaagtggccgacgagagcgatcaggtgggggatttcgttacctcatatgatcttgaggatcatgtcactgacttccgcttcgccgcgaatatccgtggctacgaaggatggcaatggtcggtgacgctgtatcacgacgaggagatcgactcctggaccgtcagcgaatcctccttgatccccactgagggcgcgttgatgccgcccaagtggattccttggaaggatcgccttgagcccacggatctggctcccaccgattcgatcggcaccgatccggatgacgagcgcatcgaggaaggcgaagtcgaggaatcctcgctgcaggatgtcaacgatgccgtcgaggccttccgactgacccgccgtcacgtgctgacctcgttggggcgtgcgcaggctgccaagcgctggtatgaaggtccgcgaggccccaaagcgttgagcaccaaaaccgccgaaggcaacctgtgctccacctgtggtttcttcgtgccgctcgcgggcgaactcgaccgtatgttcggcgtgtgcgccaataagtggagtccggatgacggccgcgtggtttccttggaccacggctgcggtgagcattccgaaatcgaacctcccgagccaagccagctgtgggtgcagtccaagcctgctttcgacgatctgcatatcgacgtggtggccgaccgcccgcgcaagcaggagccggctgcccaggacgaggccgaaggcgaaaccgacaagacaggcgagcctgccggtgatgatatcgaagcacagaagactgttgacgggaacgccgtcgataccgagcccgctgaggaggcggcaggcgatgggacctcgcaatcccagtctgccggtgatgagtccgttgcacagaacgcatccgattccgttgtggatgttgatgcagctgattccagcgacgagtccaagtctgatgctgacgacgaggccaccgaagaggacatcctcaacaacaccgttgccgatgatgatgaggatgatgagatggacgacgaagaggataacgttcgtccttcagacgatgtgactcctgaactcgaaaccgtcatcgatctcattgagcagctgcgccagaacagggcggacgaggaataaaataaacgccaatcctgctccccaacagcagaatgtactttcggatcaacttataggtctcagcgaagatgtttcctaaaaagtagatggtgatggggttgcaggaataaagaattcctccctgcaagcccatcaccgaggcgtgcgttagcactccatgccgatttcggtgaatcagtgcaccacggtcaccgtgcattcggcgaagttcatgatctggcgggacaccgatcccaggaagtgcgcgtccaggccggacaggccacgcgagccgaccaccagatggctggcgtaccgcgatgccgcgatcagccccttggacgcgggaatatggaaggcattcgcgctgaccttgacgccatcgggaatccgggccttggccatcaggtcagagagaatctcctcggcgcggcgctgaccgaccttcaccggtgccacggcgttctcatagcccggaataacgcccaaatccttgagctgccagcagaacatcacatgcagcggcgtgtcgtgcagtcgtgcctcttccagcgcgaagtcgaacgcgcggcgggaagtctcggaaccatccacaccaaccaccaccgggcggcgagccacctcgaccacgggctgtggctgcgtgtagtggaccggctggtctcctggcgtcagggcattggcgatggcatcggtcacggtctcatcctcgctgccggcgatgcgcaccacggtcaccggcacttcggcggcctcggccagcgaagcggacagggaccccatgaaccagcgggccacacggctcagcgagcggcggccgaccacgatctgctgcgcatcatggccgatctgcagcagggccgaagtgccggaggccttcaccgaggtgagcttcagattcgccggatcgaagtcgatgcctgcagcggccttgtcgacccacacacgcagctcgttggcaatatcgtggcggaccttggcccaggcctcgtcgctgtccggttcggaccccatatcccaggaatgcgtccagccaaacacggcgttgacgctctgaccggttaacgaagcctcctcaagcgcccacttcagcgcggcaaaggattcatcggaaccatccacgccgacaacgatgtcgggcttggttgtcgcttcactcatttcgagcctccttgtaatcgactacgggtgaatctagaaccagcatatcgttttcttatcctcttacggcgcaattcatggaatccgatgaataaacgtcatcgtgaatcggtagagtaagacggaatgtcaattgaggaaggacaagcatgttcgaacggtttaccgaccgtgcacggcgcgtgatcgtgttggcgcaggaagaggcgagggcccttcagcacaactacattggcaccgaacacctgctgctcggcctgatccgcgaaggtgagggcgtggccgccaaggcgctcgcctcgaagggcgtggagctggatgccacccgcaagcaggtcgaagagatgatcggcaagggcaacgcggcgccgaacgggcacatcccctttaccccgcacgccaagcaggtgctggagttttcgctgcgtgaagccctgcagctgggccacagctacatcggcaccgagcacatcctgctcggattgatccgcgaaggtgagggcgtgggcacccaggtgctcatcaagatggacgtcgatctgggcgaattgcgcagcgcgaccatcgatatgatccgcggcaactccggcactggcgacggcaagggcgaactggccaatgccggcggcgtggcggacaagcagaacaagtccggttccgccatcctcgaccaattcggacgcaacctgaccgccgaagccgccgaaggcaagctggacccggtcatcggccgtaccaacgagatcgaacgcgtcatggtcgtgctttcccgacgcaccaagaacaatccggtgctgatcggcgaaccgggagtgggcaagaccgccgtggtcgaaggcttggcccagaaaatccaagccggcgacgtgccggaaaccctgaagggcaagcaggtctactcgctggacctcggttccatggtggccggctcccgctaccgtggtgatttcgaggagcgcctgaagaaggtgctgaaggagatcaagacccgcggcgacatcgtgctgttcatcgacgagattcacaccatcgtgggcgccggctcggccgacggcgcgctgggtgcctccgacatgttgaagccgatgctggcccgtggcgagctccagaccatcggtgccactaccaccgacgagtaccgcaagtacatcgagaaggacgcggctctggaacgtcgattccagccgattcaggtgcacgagccgaccatcgccgagaccatcgagatcctgaagggcctgcgttcccgttacgagaaccaccaccacgtgaccatcaccgatggcgcgctgcagtccgccgcagagctgtccagccggtacatccaggaccgtaacctgcctgacaaggccatcgacctgatcgatgaggccggtgcacgcctgcgcatcaagcgcctgaccgccccgcctgagctcaaggaactcgacgagaagatcgccaagatcgccgccgacaaggacgaggccatcaagggccaggacttcgagaaggccgccgaactgcgcgacaagcaggagaagctggaagccgatcgcaagcagaaggaagactcctggcgcgaaggcgagtccgacgtcaagatggttgtggacgaggacgtgatcgccgaggtcatcagttccaccaccggtatcccggtgttcaagctgacccaggccgagtccaagaaactgctcagcatggagacggagctgcacaagcgcatcatcggtcaggatgaagcggtttccgctttgtcacggtccatccgacgcacccgcgtgggattgaaggacccgaagcgcccgtccggctcgttcatcttcgccggccccaccggcgtcggcaagaccgagctggccaagacgctcgccgagttcctgttcgacgatgaggacgcgctgattcgcgtggacatgtccgagttctccgagaagtacgcggcttcgcgactcttcggcgcgcctccgggatacgtcggctacgaggagggcggcgagctcaccgaaaaggtgcgccgcaagccgttctccgtggtgctgttcgacgagatcgaaaaggctcatccggacatcttcaacacgctgctgcaggtgctcgatgacggccacctgaccgacggtcagggccgcaaggtggacttcaagaacaccatcatcatcctgaccaccaacctcggtacgcgagacatcgccaaggccgccaacacgggcttcaacctgggtgccaacaacgagtccagctaccagcgcatgaaggaccaggtcagctccgaattgaagcagcagttccgcccggagttcctgaaccgtctggacgacatcatcgtcttcaagcagctcaccgagccgcaggtgcgccagatcgtggatctggatgtcaagcagctcaacgaccgcctgttcgaccgtcatatgtcgctcgaactcaccgacgccgccaaggacctgctcgcgcagaagggcttcgacccgctgctcggtgcccgtccgctgcgccgcgtgattcagcgtgacattgaggacgccatctccgagaagatcctgatgggagatctcgaggacggtcagcgcgtgatggtggatgcggaaggcgagggtatccttggcgaattcaccttcaagggtgagaagttcgaggagccggccgtcgccgataagcccgccgaagccggtgccgccaacgatgccgaaacttcgtccgaagccgcacccgtgcacgctgacgattctggcgacgctgcgcaggagtagcgcatataagtagttgcggagctcccctgtcaaggggagctgctgtttgtgtcggattattgcagcagggcgagtccggtgtcgatggtctcctcgcgggtaaacagcgtgcggccgtctgattgccgaggcgtgcgtggatgcggtagctgagatctgcgccgaggaatttggcgagtaatctccccttgccgacgcattcgtagtgactcgggttgcaaaggcctgaccctgatagtacggggtcaggcctttcccatcccaagacgccgctaagaattcacctgagagtcgccttcctaggcatggccgttcaatcgacgatcctagcgtgactggtgtgagcaggaatatgaagaaccggcggtgggccggcaagcgatcggggatcgcttttggtgcagtagcgcttatccttacggctctggtggttccttatgcttgtgcgggaaccacgggagccgttcctttttccggcgataatccatcttccggcacccgtacggtgaccatcgccgacatcactgattttcacgggcatatcgaacgtggtgcggacaacgccaccgccttcaccgtggccgacagccataatcccggcaatatgatcccggtatcgaccggcgatttggtgggaggttccccgtatgagtcggcggtggagaaggaccaacccacgctggacatggccaaagcgtggggattgacgatttcggcggtaggcaaccatgagttcgaccgcggtgtcgccgatttcaacaatcgcatcgctgatcccagcaatggcatcgactggctgtgcgccaacacgtctgccgccagtaagtcgcctgacggactgctgagccatgtacgtgactctacgattcgaacggtgaacggcaagcggatcggtttcgtgggtgcccttactgatgcgctcggctcggtagccactccgcagattacgcgtgatgccgatcttgacgagcgggcggtggacgcgatcaatcgcgtggcccgtgaactcaagcgctccggaaaggtggatgcggtggtggccttgctgcacgccgatgcctcagccgccgccgatattgggcgagatgttgatgtggtatacaccggccacagtcatgcgatcaagcgtggtacgaccgctggtggcgcgcctatttacgaggcgggcagctttgggcggaacatggccgtgcaggatttgatcatcaccggtgccgggcgtcgcgccacggtgcgagtggccgacgttgacctcggcaatggcaccagccatacggcggttgacggcgtgctgggcgtggaagggcttaatgcgcatccggcgcaagccgcttggatgtctgccggtgctgaggagaacgatgaggtatcgcgcgcgcagcatatttaccaggcggcggcaacatattcgaatcatgccggcagcgcggtgattggcactttggcctccggcgtgaatttcgacaaacaaggttcggataagcacgggaatacggtcggtgtgctggtggcggacgcgaaccgcgagtcaatcatgaagcatgtgtatgccggaaatcgtttgccggtaatcggattttcgaataatggcagtctgcggactccacggcttgatatgaatggcgacggcaaagtcaccgtgcgcgaggtggatagtctcatggccttgcagttcaaggccgcgcatgagacgctcaccgggcgcgatgtgaagagagtgctcgccgagcaattccaccgtgacgatgggcgactggagcggcgctggctcggcatctcctcgaacgtgacgtatcggtatgccgaatgcggtacgaccggtgggagcggcaatgccgatgccgccgctgatactgatgccgccgctgataccaacgctgacgctgacgagtgtgctgccgacgaacatgcggcggttcgtatcgtgaacctcgccgttgacggtcgaccgattgcggacgatgacctggtgattatcgcatccaattcatatctgcttcagggcggcgacagttaccccgccttccgtgccggaaccaattacggcgagctgaatatgccatacagccagccgttgcatgaatatctggccgcacatcaagggctcacggcaattgttgcagcaccggtagggactcaggcgtaagacaccaattgctgggtgactgaggaactatggggtggagttatgagtatagggcagaagaaaacggcataaatatgacgaagctcccctcgctgaggggagctgtcgccgtaggcgactgaggggagcttgcggtataaccgtaaactcccctcagtcagccttgctgccggcttccctcagaggggaacctggcacgagacccttacttgatggcgttcagccactgctccttggtggccttctcggcttcgagcttggccttcttcttcgggtcggattcggccgcgatcttggcgtcgagctcggcgagctgggcgttgagctgctcctcgaagctggacttgcgggcgtcggcctccgggtcggtctgcttccaagcggcatcctcgatggccttgatctgcttgtcaacggcgtcgagacggttctcgatgcggcgcatatcgtcacgcggcacgtaaccgatctgatcccactcttcctgaatcttggccagctcctggcgggccttcttggcctcggcgtcggtcttcaccggcaccagagcctcggccttgaccagcagagcctccttggcagccagattctccttctcggaggagttgatctgatcgcgatcggcctgacgagcgttgaagaaggtgtcggcggcttcgcggaacttggcccacagctcgtcgtcctcgttacggccagcgcggccggccttcttccaacggtccatcagatcgttgaacttgcgggaagtctcaccccaagcggtggaatccttgagctcattggcctcggcgataatcgcttccttggcttccttggcggctgtacgctcgttgtcgcgagcctgagcccacttgcggcgagcctggttgaaggtggtgcgggcggcggagaagcgcttccacagcgcctcggcctccggcttgtcgatgcgcacggtggtgcgctggtggttctgccactcgtcgaacaggttacggaacttgtcggcggtggagcgccagttggtgttgtcgcccagggaggccgccagagcttcggccttctcgacgatggtggtgcgctcggcgacggccttggcctgagcggccttgcgcgcttcggcgatctcggccttcttggcctcgccggcggccttcagttccgcgtaacgggccttgagggccgcgaggtcgcccaccaccgccggttcggcggtttcttcgcccagcagcttcacggactcgtcgatttcacgggtcttgatgttgggggaggtcaggcgcgcggccagcagatcgagcttggccttgagatccaggaagcgacgggcgtacagtgccagcgcctcttccttggaggcgtccgggaactgtccgacctcacgttcgccgtcgccgtccttgacgaagacggcgccgttgtcatcgacccggccgaaagcttcggcggctttgacgtcggcctcggaataggcggcgggggcggccgcgggggcggccgcgggggcggcggcatgctgcttgaccgtgggagtcttcttggcgaaggcggcgggggagggcgcgtgcggtttcggcatggaagcgggggacggagtcggcgccggcgtggccgcgctggcttcgggtgcgggtgtcgttgcctgctcttcgggcgcagcggtgtttacgggttcggtgacagtttcgtcggccatggccagctccttaaagcgtagaatgcataagcgggagcgtctcccatcccgggcgaaccaggaagttttgacgcaaccctcacctattatattgatttcgtggctaaaggtgcatcaatatcaggattcccggagtggctcccctccgaacgtgttgtggagcagcgtgttatcgatacgcttcgtaaggtttttgagctcaacggcttcatcggcattgagacgcgagcggtggaaaccggcgcttctttgttgaaaaaaggcgagaccagcaaggagatctacctgctgagccgtttgcaggaggtcggtcatgaatccgacactccgattgaagagcggttgggcctgcatttcgatctgaccgtgccgctgagccggtatgtggtcgagcactcgggtgcgttggcgttcccgttcaagcgctggcagattcagaaggtgtggcgtggcgagcgtccgcaggaaggccgcttccgcgagttcgtgcaggccgatatcgacgtgatcggtgccggcgacctgcccgaccactatgaagtggaactgccgctggtcatggtctccgcgctggaagagctgcgcgcgtatggcctccccaaggccaccgtgcacgccaataaccgcaagttgtctgaaggcttctaccgcggccttggcctgacggacgtcgaaggcgtgctgcgcgagatcgacaagctcgacaaaatcggtgccgatgaggtggcccgactgctcaccgagacctgcggcgccaccgaagcacaggcacgcgcctgcctcgaattggccgagctcaccgcctccgacggtgctgagcttgccgccaagttcgatgcgctgtgcgagtctcacggcatcgccaaggattccgaggcatacacgctggctcgtcagggacttgataccctggccatgatcgtcgacgaggccgccgccatccgccccggttccgtcatcgccgacctgaagatcgcccgcggtctcgactactacaccggttccgtctacgagaccttcctcgacggtgccgcatcactcggttccatctgttccggtggccgttacgacaatctcgcctcccagggcaaccgcaagtacccgggcgtgggcctgtccatcggcctgagccgactggtcagctacatgctgcacgctgccggcgcgcacgccaaccgcgtcagcccggccgccgtgctggtcgctgtgtggaatgaagaggaccgcccggccgccaaccgtattgcgaaccaactgcgtgcgcgcggcatcgccaccgacgtggcacccaccgcggccaagctcggcaagcagatcaagtacgcggacaaactcggcattccgtacgtgtggttcccggccaccgctgccgaaggtgcggaaggcgcagagcccgctggcgacgaggtcaagaacatcgtcacgggcgagcaggttgccgccgattgcacgtcgtgggagccggatactgtggttgcccagcaaaccgtcgaaatctgacgtattcgcgcgaaaaatcgaggagaaacaagacaatgagccagacggcttacagaacacatcatgccactgaagtgaccgaggccctggtcggccagaaggtcacccttgccggttgggttgaccgacgccgtgatcacggtggcgtggccttcatcgaccttcgtgattcgaccggcctcgtgcaggtcgtcatttacgacgaggatatggcccgcccgctgcgcagcgaattcgtgattcagattaccggcgaagtgcgcctgcgcccggatggcaacgagaacacccatctggccaccggcaagatcgaggttgtggccgagaccattgagatcctcgccaagtccgacgctctgccgttccaggtttccaccgctctcgagaatgagtccgagaacaagctgccgggcgaggacgtgcgtctgaagtaccgttacctcgacctgcgccgtccgtccatgcagcacaatctgaagctgcgttccgacatggctaaggccgcccgccacgcgctggaagacatggacttcaccgaggtcgagaccccgaccttcattaagtccaccccggaaggcgcccgcgacttcgtggtgccggcccgtctggtgcccggttcctggtacgccctgccgcagtccccgcagctcctcaagcagctgctcatggtctccggtgtcgagcgttactaccagctcgcccgctgctaccgtgacgaggacttccgcgccgaccgtcagcccgagttcactcagctcgatatggagatggcctacgtggaccaggaagatgtgatggccatgactgagaaggtcatcgccgccatctggaagtccgccggctatgaggtccagctgccgctaccgcgcatcacctggaaggatgcgatggacaagtacggctccgacaagccggacctgcgcttcggcaacccgctggtggaactgaccgagtacttcaagaacacgccgttccgcgtgttccaggccccgtacgtgggtgccgtggtcttcaagggcggtgccgccacgccgcgtcgtcagttcgacgcttggcaggattgggctcgtcagcgtggcgccaagggccttgcctacgtggtcttcggcgaaaacggcgaactcaagggccccgtcgccaagaacctgtccgatgaggagcgcaacggcctgcgcgaggccgtcggtgccgaggaaggcgacgccgtcttcttcgccgccggttctcgcgagtccgcccagctgctgctcggcgcggtgcgtgtggagcttgcctcccgcgaaggcctgctggatccgaagaagttcgctttcacttgggtcgtggacttcccgctgttcaagcccacggatgacccggatgatgacgatgtggctgtcggccactccaagtggacctccatgcaccacccgttcaccatgccctccaaggattggatcgacaagttcgacaaggaccccgagcacgccatgtccgattcctacgacatcgtctgcaacggtgaggagatgggcggcggttccgttcgtatccatcgtgacgacatccaagcccgtgtgctcgatgtgctgggcatcaccaaggaagaggccgacgagaagttcggcttcctgcttgaggcattcaagtatggcgctccgcctcacgcgggtttggccctcggttgggaccgcaccgtgtccatcctggccggtgccgactccatccgcgacgtcatcgccttcccgaaggccggcggcggccgcgacccgctgaccggtgctccggccccgatttccgacgagcagcgcgccgagactggcgtcgactacgacccggacgccgacgaaaactaatctacggagcgtataccgcctttcctcagcactcgacgcaccttagtgcgccttcggcttcgaacggcggtctccgcatgcgtagattaattttcgaggagtaatgctccggtgctattagccgcaaatggcccttggaataattccaagggccacttgctttttgcgggtggggcccaatgtgccaaatacctgccaaggggtgccaaatactccgcccgatggcacctccgccatgcggcaaacctcgcaccatgcggtgtcccctttggcgtttgccgattatccccccccatggggcggtaacttcctcatggggcggtaaacaacccatggggcggtgaaaaccccatggggcggtaggtcaaaatggcttaattccgcggtttcacaatttcttcaaaccgccccatgggcaaattaccgcctcatgggggaattgccgccccatgagaagtaatcgcaactccgtatttgatcaatgttgtgaggctttgttgtgttttgcttgtttccgcctcctgtattcccctttgcgcgcattgatggtaaggctgccgtctattaatacccggcatgaaggttgaggacggccaggaagcggtatttgcatcgcggtggcaacctcttgtgcgaaggcacgttgtttggcggtattccacaggtcatcggcgaacacctcgatgacggtccagcccaattgccgcagacgtcgacgtttttgctggtcccgcacatattgtttgcggaagcgacggtgatgatcgccatcatattcaatagcgactttgtattgtggataagccatgtcaacggtgtaggtgtatccgttctctgaatcggtaatgccgtattgtgtttgcggtatgggcaggccgaaaagcataagcgccaagcgtgtacgagtttcctgaacggaatccgatggttttacgagcttcagcgccgcctcacaacgcgcacgaccaataacgcggtgaaaggccgttagtcgttgagtgaattgttcaatggcatatccataacgtctgatgagcgcttcagccagcaccactaattcagtgaggttgagatattgggcaaactgtatccacgcatccatgggatgcatgcaggttacgccgtttgaaaaagcgatactgttgaactttgcattccatatgcgatagtcgacattgtccaatgaagagcgggtccccttgctcctcaccgtcacataaaagtccttctgtggcaacgtgctgtgcctcggcaactccacgccgcataattccaatgcggtatacagcgagaaacacaacgtgcgtttcgtgcgcactttgcccagcagattccaacaggccgtgttcttggccgtggctttggcgtcaagatctttgcgcagatagttgttgatttcgccattgtgcggcgcttcgctgtatccgttcatgcgccgagcgtagcgcattccacggtggcacaggggcaaaaccgaaaaatggggataacttaagcggcgcgaaccggttatccaccggcatatcgtgtgccgcgcccggttatccaccgcgcttcgggagtgtcatccaccgtataacaccttcatcgcgtgctaacagctagccacgctcaaaatgcctagcgcatttatacgaatacgacatgggaaacggcgagaccagccccacacaatacaaagtgaccgccagccatgcgcccgactgcggcatgaatggcaacaacaccaacgacaccaaggccaaacatggaatcagcagataggacaacacgtgcccgctctgccatcgcagcaacgtctcggccaccacgcagcaggcaatcagcgcacagcagacgccgagcgatgcgcgattcagcgcgaatgtatgccgatgcccaatgccgttttccccagtgagacgcatgccaccatcgtcccactgctggccccaactcagcctggggcaaaagtcggtcggcctcccgcgatgtttccggaaacgggagacatgccgaagtcgcttatgccgccatcacgatgtctgatgcgaaaatgagacatcgactgagcaactgtgtggacatactgtgtacacattggaaacgtcggtgtgctatcctcccactcatgtctgaaacgaacaatgaaacagcagtgcgttcgcgcacgacaagcacaacatcaccaagcaaggccaaattgaccccgctggttcccgacaaagaggacctgaaccgtccgctagtcgaactgacccacgtcgaaaagcacttcggtgctttgcacgtcctcaaggacatcaacctgactgtcaccaagggcgaggtgctggtggtcgtgggcccgtccggctcaggcaagtccacgatgtgccgcaccattaatcgcctcgagaccatcgattccggcgacatccgcatcgacggcaagcccctgccacaggaaggcaaggagctcgcgaacctcagggccgaagttggcatggtgttccagtcgttcaacctgtttgccaacaaaaccattcttgaaaacgtgacgctggccctcatcaaggtgcgtcacatggacaagaaggaagccgagcaactggccatggatctgctcgcccgcgtgggcgtcgactcccaggccagcaagatgccctcccagctctccggcggccagcagcagcgtgtggccatcgcccgcgcgctcgccatgcgccccaaggtcatgctgttcgacgagcccacctccgcactcgacccggaaatggtcaacgaagtgctcgacgtgatggtcgaactcgcgcatgaaggcatgacgatgatctgcgtgacccacgagatgggcttcgcgcgcaaggccgccgaccgcatcgtcttcatggcggacggccagattctcgaagagaacacgcccgacgagttcttcgagcatccgcagaccgaccgtgccaaggacttcctctcgaagatcctcacccactgaaagacgggtacgcaatccaatgacattcaccaatacgttcaagcggaaggcttgccgcgtgatcgccgcgctcgccgccgtggcctgcacaatgtcgctggccgcctgcggcgcggacgaaaccggcaagatccgcatcggcatcaaattcgaccagcccggcctgggcttcaagaagtccggcacctacgtgggcttcgacgtggacgtggccaagtacatcgccaagaaactcggctattccgaagaccagatcatctggaaggaagccccctccaagcagcgtgaggccatgattcagaacggcgacgtggacatgatcctcgccacctactccatcaccgacgagcgcaagaaggcagtctccttcgccggcccgtacttcgtggccggacaggatctgctcgtgcgcaaggacgacaactccatcaacggccccgaagacctgaacggtaagcgcctatgctccgtcaccggttcgacctccgccgccaccgtcaaggagaagttcgcctccgaagtccagcttatggaacagcccggttacgccgaatgcgccaccgccctgttctccggcatcgtggacgcggtaaccaccgacgacatcatcctggccggcctggcctctgcctcgcgcggcaagctcaaggtggtcggcaaaccgttcacgcaggaacactacggcgtgggcatcaagaagggcgacacgcagctggccaccaaaatcaacaacgccatcgtggacatgattcaggacggctcgtgggagaacgccatcagcgataacaccaagggcgtcgactacacgcccgacgtacgctacaacccgcccaccccgaacgaaggagaggaccgatgaacggattcatggaacttctcggccactatgacgtgttcggcgcctttctggtcaacctcgagctgaccttgtggtcggccttgttctccacggtcatcggcgtggttctcgtggtcatgcgcatctcgccgatctcctcgttgcgcgccgtcgccggcgcatatgtggaactgttcaagaacctgccgctgaccatcatcatggtgttcatggtgctgggtgcctacgcgcagctgaagctcagcttctccgacaccttcaccacgaacttcttctggctcgcggtcaccggcctgagcctgtacacggcggcgttcgtgtgcgaatcgctgcgttcgggcatcaacaccgtgccgattggccaggccgaggccgcacgagcgctgggcttgggcttcatgcagtccgccaccgagatcatcctgccgcaggccttccgaggctccgtggcgccgctcggcaacacgctgatcgcactgctcaagaactccaccgtggccgccgccgcatccgtggccaccgaaacatcctcgctgatgagcgagatgatcgaattccgccccgacgtgatcatccagatcttcctgatcttcgcgctcggctacgtgatcctgatcatccctatcggcatgctcaccacgtacctgtccaacaagctcgccgtaaggaggtgacggatatggccgatacttcgaattccgtgctgttcgacgcgcccggtcccaagggccggcgcaccattcgcatcgtcaactggatcgcaggcattctgttcgcggtggtgctcgtgcttatcctcatgcgcctgcacaacccgccggatggcgagaatcagctcagctgggagctgtggaagccagccatcgaacgtgaagcgtggaccgacttctacctgccaggactgtggatgaccatcaaggccaccgtcgtggccgtggtgggtgctgtggtgttcggcctggtgttcggcgtgggccgactgctgccgaacccgctggtacgtggcgtttccgccgtgatcgtcgagttctgccgtgcggtgccggtgctgctgctcatgatcttcttctggcgatggttcgcgttcgcgggcctgcccagcccgtcctattgggccgtggtgctggccttggtgctgtacaacggttcggtggtcgccgaactcgtgcgctccggcgtcggcaatctgccgggcggccagcgcgaggcctcgctcgctttgggcctgaccgaaacacagtcgctcatggagatcgaggtgccgcaggccgtctacgccatgctgccggccgccgtcacccagctggtcgtggtgttgaaggataccgctctgggctcgatcatcatgtataccgacctgctgcaggaatcgcgccgactcggctcgatgtacttcaacatcctgcagacgctggtgatggctgcggtgatctacttcgtcgcctgctggctgctgtcgaggctcgccgaatggctgccctcgcgcatgcagcagcgtacggccgcacccgccgagcccgagccgctggcgccgatcgccgccggagacccgtccaatgtcaaccagatcgctgtggccaaggaagtcgaagagctgccgtttggtggtgcgccgcgcaaataccatgtgcatcaccgcggcaccaacgcctcgattcgcaactggcagcgcacccgctacgaacagggatatgacgccacccagcccgagtcacaggttgacccggaaaccggcgaattccaggagtctcaaaagcctgaggacaagccagaggcctgacggtcagcccaatcgccgctaagccggcacgaagaatttactgagtgtttgactggggtccggctacgtagatttcacggaggataggttggaacatatgaagatgttccggcgcctatcctccgtttttgctattgcgaccattgcgccgctggcgttggcggccacgctagccgcgacgcccgcaatcgcacaggccgaccagttgcccaacccggattgggtggcattgctctccgactacgaaaagaactattggcaggcccccaccgatgccgaacacggtggcaaggtgctccacgccgataccatgaagctcgacgaagatttggccgtggccattaaccacaaagccgccgaaaatctcgataaggatggcctgaacgtccaacgcaagcgtgcactcgtcgactccgatctgcaagccgaggaaaccatgccggacgcgctcggtccagtgcttggcaaatatatgagcgaagggctcaaatccgggaaactcaacgccgtcgccgatatcttctcctttaacgtggcctccacctacgcctcaaaacgtgcggccatgcatccgcgcccctatctgaaccgtgcggaaagcagctacggcggcactaacgatctcgccggactgcccgccacgctcgatatcaaacaatcgccctcatggctcgaacacatgcccggctactcgaacttgcagaaaaacagttcctacccctccggccacactaccggcgcctattcgtggggtatcgcgctggccggaatgattcccgaacttgcgccgcaaatcatggcccgcacttcggaggccggcaacaaccgcatcgtgctcggcgtgcattatccgcttgacatcatgggcgggcgcattggcgcatccgcccagaacgggcagtactggcataacgaattcgcttcgtccatcgtgcccgcgtcccggcagctgcgcgactatctggtgtcccgctgtgccgcggacggccacggcactaccctcgccgcctgcatcgccaacaccaaggcctccggttcgggcggctacaccaacgattttctggacccagtggccaccgagccggtcgtggaccaagcctcggccgtgcgcgtctacaccgcacgcctgacctacaccttcccgcaagacgccgcccattccggcgctgatctcgtggccccgcgcggggcggcggacgtgctgcgactggcctatcccgaactgcacgccgatcagcgcaacgcgattttgaaagccactgccttggattccggataccccctatggcaatcgagcgacggctggcagcgtatcaactgggccaaagccctgtgcgcccgcgtcaccttggataagcacggcgatgtggccaaggtcgagaccgccgaccaggtggcgcttaccggcccgagtgtggtcaatgcccagtacgccgacgcgggcaatcacccggcgtctgatagctcggcgggtgagaacagcgccattgcggccgggccggatctcgccaccctccatgccgcgcaacgaccggcgttgatcagcgtagccatcggtaccgctgtaatcgcgattgtcggcggaatacggacggttcgacgcaaatccaagaaccagcttcagcagtaattcagccaaagttcagtttggagatttaccgagtttgccttcatacggtgtcggcttcatctccctcccataccctcgggattgccgacggtgccaggtattggcgcaaagccaacaattacggtccgaacgactgcatgcctatagatttgcagtaacaagtgaaatgtgaatgtcgctacgttgctaggtctcctgagttacaagacgtacaatcgggagcatggccaaggacgacgacagaaccaacaagcctgaagaggccggcaagtggggtacagccggaaaatcctcaggaaaaaacaacaagaacggcaagggaaaggaatccaaaaccgatcgacggatcgacaaggtattacagctcgcggcggatagcatagacaccatcgactccagtgccagcgtgcctgaacgactggcacgtgcggcgaaatccagtgaactgctcagcgccgtatggtcgttgccgcctgctcaacgtcttatgttccaccacggcatgcaggtcactgatgtcgaaggcgattccactcccggattcgacggcaataaagaggacgccgagaagttcatttcgatcagcgcctccgaaatcgcccgataccagcggctcatgtacgcgaatggcgtcaaaggctcgacacggcggctgctcatcgtgctgcaaggcatggatgcctccggcaagggcggcattgtgcgtcacgtgttcagccaaggcgacccgatgggcatccattaccatggcttcggcaagcctacggccgaggagctcgaccacgacttcctctggcgtgtgaagcgtgaattgcccaagccggggtggattgccgtattcgaccgctcccattatgaagatgtggtcatgccgcacgtctatggcacctatcccgaagacgtatggcgtgcccgctacgaccagatcaacgatttcgaacgtgaactggccgccagcggatgcgccatcctcaagatcttcctcgtggtaagccaggaagaacagaaaaaacactttcttgggaggctggatgatcccaccaagttctggaaattcgatatctccgacctcgaggcccgcgaccgatgggatgagtacatgttcgcttggcaggaagtgttcgagaaaaccagcacggccgccgcaccgtggtacctcgttccggccgataaccgctggtattcgcgagccgtggtctccgaactgctgcgcaccaccttgaagaacatgaacatgacctggcctcccctcgaacccgaggtggaccccgacgaggtgcgccgccggttggcgggaggcgccgcatagcgacggagggtggctcgtgccgccggaataggccactaggtagactgagcattatgactgacgagaaggaatacggatccctggggcggctggcccccgaatgggacggtaacgagcgcgaacggaatcttacggccgatgacatctacgaacgattcttcggctgggtggaagacgtcaaaggcatcgaaccatggccgcatcaggaagaggccattatggacctcttggccggcgaccatgtgattttgaacaccccgaccggttcgggcaaatcgctggtggcgcttggcatgcacttcgccgccctgtgcactggccgccgctcctattacaccgctccgatcaaggcgctggtgtcggagaaattcttcgacttggtcgaagtgttcggccgcgacaacgtcggcatgatcaccggcgacagccacatcaacgcggacgcgccgatcatctgctgcaccgccgaaatcctcgccaatcaggctttgcgcgaaggcgcccatgccgacgtgggcctcgtggcgatggacgaattccattattacggtgatccggagcgcggttgggcgtggcaggtgccactgctcacgctgccgcaaacccagttcctgctgatgagcgccacgctcggcaatgtggacgccattgccgacaagctctcggatctgaacgacaccccggacgtggatgtaatcgccgacgcgccgcgaccggtgccgttaagctacgaatacacgctcgatccgatggaaaaaaccgtggaactcgccttccgcaacggcgaaaccccgatttatgtggtccatttctcacaggacgccgcgctggagaccgcgcaggcgctcgcctccactggcgtgtccagcaaggaacagcgccaagccatcgcagaagccatcaaaggcgtcaaattcaccacagccttcggcaagattctgcagcggctgctgcgcaccggtgtcggcatccatcatgccggaatgctgcctcgctaccgccgcctggtcgaacagctcgcccagcagggtctgctgcccgtgatctgcggcaccgatacattgggcgtcggcatcaatgtgccgattcactccgtggtgctcacggccctgaccaagttcgacggcaccaagatgcgccgcctgcgcgcccgtgaattccaccagatcgccggacgcgccggtcgtatgggattcgataccgagggactggtgatcgccgaggctcccgaatacgaaatcgaaaaccagaaggccatcgccaaggccgggggagacccgaagaagctcaagaaggtcaagcgcaagaaggctccggaaggttttgtgacctggaatcagagcacgtttgacaagctcatcgacgccgaaccggaaaccctggtcccgcacctgaaaatcacgcattcgatggtgctcaacgaagtggcgcagggcggcgacgcccgtgcccgtatcgacgatctcatcgacgattccgcgcagacccccgaccaaaaggagcatctgcaccagcgggccgacgagatcttccaaaccctgttcgataccgaagtcatcgaaaccgaggaccgcaaggacggcggcaaggactactacataacccttgatatgccggacgacttcgccctcgaccagccgctctccccgttcctgctggccgcgctcgaactgctggaccccgagtccgacacctatgcgctggacgtgatctccatggccgaggccacgctcgaagaccccaagcaggtgctacgtgcccaggagcgtcaggcccgagacaaggcgatggccgatatgaaggccgacggactcgactatgacgagcgtatggataagctgcaggagattacgtatccgaagccactggaagacatgctcgaagccgcgttcgaccagtaccgccacgatgtgccgtgggccaacgactactggctatcgccgaaatccgtggtgcgcgacatggtggaaaccgcctccgacttcaccggatacatcacccgatacaacatcgcccgctccgaaggtaccctgttgcgctacctctcggacgcctaccgcacgctggcgcgtaccgtgccgcccgaaaaacgtgacgagcaactcgaagacatcatctcctggctgcgcgtgctcgtgcgctccatcgactcctcgctggtggatgaatgggagaacgccggcgattccgccgaccagtccgaggcggcggcctccttggcggcgccgggcaagaagaacgcggtggtcgaggaccgacgaggccttatcgtgctgatcagaaacgccatgttccgccgtgtgcagcttatggacctcgaccagccggacaagctcggcgcgctcgacaaagactggggctacggcgtgcacgaatgggaagatgtgctcgacgactactacgacgagcacgagtacgtgggcatcggcgccgaagcgcgctcgcccgaactgttcatgttggatgacaagcatgagaacgacgagcatacgtggaaggtgcgtcagattatcgatgattccgatggcgatcacaactgggccatcgaaggcatcgtggacctcgacgccacccaagacaccggcgaagtagtcttccacgactacaaggtgagtaactgattcctttcctggctcccctctctgagggaagccaaggtgtagctcgaacgtctgttcgaacactgaggtactataggactttatgagtgagaacgatttgtttggggtggctgatgcgccggagtcgatgacacggccgttggcggtgcgcatgcgtccacgcactttggacgaggtgattggccaaacgcaggtgttgggccagggctcgccgctgcgccgcctcgccaatccggccagcaaaggcagtctcaccgcgccgagctccgtaatcctgttcggccctccaggcgtcggcaaaaccacgctcgccaccatcgtggccggccaatccggccgcgtgtttgaggaactctccgccgtgacatccggcgtcaaagacgtgcgcgacgtactcacccgcgctcacgaacggctcgtgtcacgcggccaggaaaccgtactgttcatcgacgaggtgcatcgcttctccaaatcccagcaggatgcgctgcttcccgccgtcgaaaaccgcgacgtgacctttatcggcgccaccaccgagaacccgagcttttccatcatcaaaccgttgctctcccgttcggtggtcgtcaagcttgagtcattggagcctgatcagctcaccgaactggtgcagcgcgcgctgactgatgaccgcggtctcaagggcgaggtcaaagccacggacgaagccatcgccgatatcgtgcgcatggccggtggcgacgcacgcaagagtctcacgattctggaggccgcggctggcgcggtcaccggcgacgaagcccgcaaaaagggcgcacgccgacccatcatcacccccgaaatcgtggctacggtaatggacaccgccaccgtgcgctacgacaaagacggcgatgaccattacgacgtgatttccgcattcatcaaatccatgcggggctccgatccggatgccgccatccattatctggcgcgcatgctgaaagcgggtgaagatccgcgcttcatcgcccgtcgcatcatgattgccgccagcgaggaagtcggcatggccgccccgcagattttgcaggtcaccgtggccgcggcgcaggccgtggcgctggtcggcatgcctgaggcacgtattattttggccgaagccacgattgccgtggccaccgcgcccaaatcaaacgccagctataacgccatcaaccaggcgctcgcggacgtggatgccggcaagatcggcgctgttccgctgtatttgaggaacgcccccaccaagcttatgaaagagtggggcaaccacgagggctacaagtatgcgcacgattggcccggtgccgtggcaccgcaggaatatatgcccgaagagctgcgtggcaccgagtactaccatcccaacgatcgcggctacgaacacgaagtcagccagcgtctcgtccgaatccgcacgatactgcacggtgacgaatccgggcgggaggcgtcgcgggccgcggactgacggtcttaggcgcgccggcgtgaggcgcgaatgcggaacgcggtggccagacagcaccagccaatcaggcagataaccgtcatcgtggcaaacgtccatgtgccgccgacggcagtggcatgagcaaactcagcggtgccttcttctcctgcgccggcctgagccacggaaagaatcgtggagaacagtgcggtaccggcagcgccgccaaactgaagacacgtgttgaaaatggcgttgccgtccggcttgaactcgggagagacctccgacaggccactggtcatcacattcgcattgccgatggaatagaacagaccgaaaatgaaatagaatccggcgagcagcacgggcgtaagctgcatcgagaacaccagcataagcactgggcccaaaatagcgatgccgatcggaatcagaatcggcttgaccgcgccgaacttatcgtagaaccagccgccaagcggggcacagacagcgccgaccagtgctccgggcagcaccagagagccggccacaaatgccgtggtgccgagcgagagctgtgccacattggtgatgacatagccgtagccgatggcgaccaatggcagcagcagatatgcgcaggcgtgtaacagtacggcgggatccttgagaatgccaaggcgcagcagcggggagaaggcacgcttggaactcatggcgaacacgatcagcaaggcgaggcccacaatcagactgacaatggcgataatgccggagcgtgtggctgacttgccggacaccgccgcactgatggacacgccaccttggttcagcgccagcaccagaccgaccagcgcgacaacaatggaccaaagctgaatcgggtcaagataggcagcttcggtcggtgtcttctgctcaatgcacttcatgccgatgaatgctgcgattagcaccagcggaatggcgatgacgaagatcgcgcgccacggcagcactgtggtcaccgcgccgccgacggtcgggccgatggccggagccacggtaatgaccagcgatcctacgcccatcaatcggccgatcttcgaacgaggagactgctccagaatgatgttgatcatcaacggcgtggccacgcctgagccaatgccctgaataatgcgggcgacaatcagcagcgggaaggcttgggcgacgatcatgatcagcgagccaacgatggccagaatcacagccgcaagaaaaatggttttcagtgcgagccggcgcttcaaaaacgagctgatgggcatggtggcggccaccgccaacagataaatcgtggtaatccattgcacagtggccgtgtcgacatggaattcgcgcatcagtgcggggaaaagcacggtcatcacggtttcggtcagaatgccaatgaaggcaagtgagccgacagccacaatcgcgccgataagacgtgtgggaatcttctcgttatcaatatgctgctcaggcatacatgctcctaaacgttcggttgcaatgtatggaatgtaaggtttaccaaccggcgtaggtacctgtgcgtgcggataaaccggcaatcgtactgccttggctgcacgctatggaatcacaaaaccacctgtgagtgtacggttcggggcggacgctacggtcgatgcgcaatgggctgtcccttggttgggtggggtttgatggggcgggttcggcattggtccggcggggcgggttcggcattggttcagcatgaggaaacacgcgataatatccgccctgccgcctagtttggtgagccatgggtattgagaacacgcataagctgattgtcaactgcctgcctctcaacgaaggagaacggcgggctttcgccaaggcggcccgcgatgtgccgcaggaattcgtgggcgacgaagcgcacatcggcgacatggtctggtcggccgctgttcccgaggagcttcgctcccgagctaccgcagtcatcggcaacttcccggtctcgcaggcttcccaatacacccgtcttgaatggttgcagaccttcagcgccggtgtggatgcgtacatccgcccgggtgtgctgcctcgcggcaccatggtcaccaatgcgagcggcgcgtatggccaaagcgtgtcggaacacatgttcgccaccatgtgggcattgatgaagaacctcaaccggtatgcctccaatcagcgtgatcatcagtggcgggatgaaggcccggtattgagcccggaaggtggcatcgcgctgattatcggcgtcggcgacatcgggtcgcatttcgctcagcttgcccaatccgtaggtatgcgtaccttcggcgtgcgccgtcatgcggatgtgccggccaagggcattgaaaagatgtatggcttcgagcggctggaagcactgctgccattggcggacgtggtggcgatggcggtgccgcgctcgccgcagacccatcatctgctgaatgcggatcgtctgggtcgtctgaaatccacggccatcgtgatcaatgccgggcgtggcgacgccatcgatcacgaggccttggccgacgccttgcacaatggacggctccacggtgccgggttggacgtcaccgagcctgagccgttgccggcggaaagtccgttgtgggatgagccgcattgcctgatcaccccgcatgtggccggcggcaatcatttggaaaagacttccgaacacatcatccgcatcgccctcaccaacgtttcccgctatgccaaacagcaggaactgttgaatctcgtgcgatactgattcgcctgtatcaggtgtacatgaactcatgtacacggccggcgtgtcgcatcccacggcggctgcggcatcgagataatacctgcggaggcgtggttgatcagaggcccaatgaacgtggcccgaggtcagtctcagtctgatagttcgtagccgttggcgtctttatgccacggcgagccgggcttgctgcacaggatgatgatgccttcaacaaagccccagatggcggctgcgattgggccaagtccgagcagaatccagccgacaagcgtcagcagcagctgggccacggccttgccggtgttgccgagatagaagttgtgcacaccaagtccgccgaggaagatgcccaacaggccggcagccaacttggacttggatgattgccacaccggggcggcggcatacggagcggcggtgtattgcggctgtgcgtaggcattcggctgctggtaggcctgtccatagccgggctgctggccgtagcccgctacgggctgtgcgggctggccgtactgaggctggccgtactgaggctgagcgtactgaggctgagcgtatgcgccggcgggctggccgtattgcggctgctgctggccgtagctttcggcggcgggttgagcgtatgcggcgggctgtggggcgccatagccctgcggctgctgtgcggcatcttggcagtacgacggctgtgcgggctgtggaacactgtccgaaccgtacggttgttgttgatcatcagtcatgtggatcggtcccttctcaatcgggaacggcagtaccttcttaccgtttctgcacaacatcatctcacgttttgcacaatagtagaacctgccgcgctacgattgggccatgaaaagtttcctgaccagctggttgattatgactatcgccgccgccgtcatggtcgcggtgactcccggcatgaccccggtgggggagcctccgattctcggcatcgccgtgttcgctttgttcatggcgctgattaatgcgtcaatcaagccgattgtgcatctgatcgcactgccgtttgcgattctgtctctcgggctggtcaccttgattatcaattggctgttcatgcgactcgccagctggctggcggtcagtttgttcggcgtgggcgtcttcgtacacggtttctggtggtcggtactggggtccttggttctgaccattgttgcgggaatcgtcgggtccatcttggatcagtgacggtgctcgctgggcgaatatgagtaatggcggttggaatcggactgattccaaccgccattactcatatcaagctacgggatcgagcagagcgaacattactcgcgcaccaagcggatatgctccacatcgtcgcgccgggagcgacggaacagcacgaaacgattgccgatggactgcaccacttcggcgttcagctgctcggcaagcccggcggcggcttccttggcggtcatgcccgaaccgtcctgtaccgcgcacttgatgagctcgtgcttctcaatggtctcatcggcctgattgacggccgactcggtcaaatcgttcttgcccacatagaacaggggcttcagcgagttcgccatcgcgcgcagctgcttgatttgcttcttggtcaatgccatgggaatttccttacatctttcgtataaccacaccagcatagcaaccggtgctgtctgtgctgtttgccgccctacagcgcgatgatggccgcgatgtagacgatgacggcagcggcgaatacgagatctcgcgcggcgatggtcagggcacgccagtgggtgcggcggatgccctcctcatagcagcgggcgtcaagtgcgaggctcaggttgtccgcgtgacgcaacgtgccggcgaaaatcggcacgataatcgcgctcatcgccttgatacgctgggccagcgaaccggtttcgatggaaccgccacgcgcggattgggcatcgacgatggcgcgggtttcatcggtcagcgttggaatgaatcgcaatgccagactcatgaccagcgcgatttcttgggcatggataccgagccggttgagcggactgatcaaggtgtcgaaggcgtcggtcatggcggtaggcgtggtggtagtgaggaacaccgcgcccagaatgattaccaatgcgaaacggcaggcgtacagcacggctatggtcacgccctgatcggtgatgcttagcggtccaagcaccaccaccggcgtgccggtgcgtaccacaaacagattgaccacgcccatcagccccagcaggatcagaatcggatgaatggattcaagcacccgtaacgggttcaggcgtgccgccgcgataacggccagggtgatggcaatgcccagtgcaagctggaggggtgtgttcaccgcgaacatcgtgaacatggcggccaggaaacccaccatcttcacgcgcgggtcaagtcggtgtatcactgagtgcacagggccgttggaggatacggccgtggcggtgacggtggccgtgacggggccgccggatgcgggggcggcaatcggcatacggaccacgcggtcggcgatttgcttggcctcctcccagtcatgggtgatgatgagcacggtcacgccacgtgatttgagcatgcgcaacagctcatggatgcgctccttggcctggacgtccaggctcgcggtcggctcgtccatgatgagcacgtcaggattgcaggccagcacgccggcgatggccaccaatcgctgctgtccgccggacaggtcgaaaggggagcggtcggcaagatgcccgatatgcaacaggtccagtgattcgcgcacacggtcggccacctcggcctcggcgagcccctggttgcgcgggccgtacgccacgtcctcggccaccgtgtccgcgaacaactggtgctccggatgctgcatcacgtaacccacatgccggcgcaattgcgccaattgcctgcgattcgccggcttcggccgtgcgttgctaccgcgtttgccggtcgaggccaccggaacgccggccacctcgatgctgccggcggtcggcgcggccagcgcgcacaacatgcgcaccagcgtcgacttgcccgaaccattcacgcccatcagtgccacggtttcaccgcgcgcgatggtgaacgacaggtcatcgataaccgcccgtttggccgaaggatagcgataggtcagatgcgagacgcgaataatggggtccgtcatatcaccgatgccatcggagagcagcggcagttcggagccgtcttcgcgctcccgctggcgggggctgtcgttcgtaggacgactgggggcggcttctgtgccgatgccaccctcggtctcgctttgcgagacagcctccgccagcgggggtcgattatcgacggctgcagtgacaccaacgattcgcccggcctccatgcgcacgatgcgatcggcatgaacggtctcatccggatgatgcgtgacatgcacgattgtggtgccgcgcgcctgcaaatcatccaaaatgcgcataacttcggcgcgtgcggattcgtccagcatggcggtcggctcatccaataccagcatcgccgggttcatggccagcatgccggcgatggcggcgcgttgctgctgccccccgctcatacgggtcgggtcggactggcgtaagttcgccaaccccacggcctgcaatgaatcaacgatacgctcgctgatgagcccgcgctccagcccgagattctccgggccaaaggccacgtcatcctccaacacggtggtgaccagctgatcctcgggattctggaacaccataccgatgccgcggcgggcagcacgataggcatcggcattcgggccagcttcgtgcacgcgttgccccagtaacgtcacttcaccaccgtccggcgcggtcaatcccgcaatcagacgggccaacgtggacttgcccgacccgttcggaccgaccaagcataggcgctcgccggcatggaccgtgagcgaaacaccatccaaagcccatgaggtgccgcggtcatagctgaaacgaatgtccttgagtacggcggcgggggagacagactcggcggaagcgtgaggttcggcagaatcgtggaactcgtcggcgtcgaaggaatggggtgcaacggtcatgaaacagtaatccgtaactgataggcgaaaacgcagaatcccggcaaaggccggagttctgcgttcttgttctttgagtggtcgttgagtgatcgttagtcgtggcgggcataggcccgtctcaggccagtcactgctgcttggacagcaggttggagaccggcttgtagatcaggaaggtgatcacggcgtgaatcgccatcttagccacgttgaacggtagcagaatcggcagaatcatcgcggccacagcctggtaggtcatgtgcgcgtaaatcggcgtgacgatgaggttgcccaccagcgccaccacgatggccagcaccgcacccaccagaatgccgatggcggcacccttgcgcgtacggatcttacggtagatgaacgcggccggcacagacaggaacagcgccaccagcacagccatcagcgaaccccacgggtcggcgaacatgtgcggcacaaagccgagcacagacacgattgcggcggcggccggaccgtacgcaaagccggcgatcaggcagacgatgccggacgggtcgtacttcagccaagtgaccggcgtaatcgggaattcaatgaagctggtgaccatcgccagcgccacgaacagtgcatacatggcgatacggcgcgtggaccagcggccggaatcggccacgccagtggtgtgtgagccaagtttggcgttggtgctggcggtggacgcgctggccgaaccctcggcctcgggcgccacagaacgaacaacttgcatgcggatacgcgaagatacgctcataatgagccctcgtttctttcatccggactataccgttggctccggaatctcaccggatcagccgcttgcgcgggtcgcgggcttcccgccatccccgttatgaaacccggggtacaggttaccgccagtaaggaattgcaccttccctgaaactgacaggcttattcatacgccatgcgccggacgtacgcaacccgcgtttcactgtgcagaaattcgtcttgtgccggtcaagtgcaacaatgggagccatggctgaagtgaagaaacccaacaacaccatcgacaagcttgccctgatcgtcaccacctacaaacgtcagcagctgctcgaggtactgttcgattcgattctggcgcttgagcaggcaccgtggcgcatcgtcatcgtggacaacgagcagtccgatcagacggcggacatggtcgctgcgtttgccggcaaggtgaccggccaatggggcaccaccgtggccgaccagtccggcaacgaagaacgtgtggtctatgcgccgcagaccgagaacctgggtggtgcgggcggtttctccgccggcgtggccaaagcctacgagctgggtgccgcatggttctgggtgatggacgacgatgtggccgtgctgccggacgccattgccaagctgtccaagtggaccgacaggcacgaggtgattcagggatcccgattcgattacgatggcggcccgttctactggcagtacgacttcattgtgccgctgggcattccgaacccgattgcgcccgccgcattcggcccggccgggtatcgagtgatggacacgctgtgcttcgaaggcggcctgttcaaccgccgtgtggtcacggaaatcggtctgccggacccgcgcttcttcatctactgggatgacacgatgtatggctaccgcgccagcaaggtcaccaacccgattgtggtgcccgacgtgatcctgcgccgtacgcgcgaaatcggcaattgggatatcgccggtgtgcgccagctcaactccacatccgacatgaaccggtatcacatcatgcgcaaccgcggatacatggcccggtacttcatgacctatggtgacttccgtccgctggtgtttggactgggtaccgtgctcaccgcggccaaggaagtcattcgcctggtgatggtggatcgcgagcacctcaagaccggtttggtgcagattgccaagggctggtgggcctcgcgcaagctgatgcacgaccccacctggaagcccatgccgtcgcttgagtgacggccatgccccggcccgtccggcgcgtccgcgtgatggtcgcgttagacttgggcgaaatcgtggatcgatgacatataaggaaaggaagtcaacgatgattgagaccgcacaggcttttggcgtcgacatcggaggatccggcatcaaggccgcgcccgtcgacctcaccaagggcgacttcgccgaaccgcgactgaagattctcactcccgaggtctccactcctcaggccgtggccaaaatcgtcaagcagcagctcgaccacttcgaagtgcctgaatccgcacccgttggcatcgccttccccgcgccgatcaagcccggccagaagctcgacttcatggccaacctcgaccagtcttggattggcgtggacgttactgaggtgttctccgaagcctgcggacgcccggtcgtcgtggtgaacgacgccgacgccgccggcctggccgaagtccagttcggtgccgccaagggccaggatggtctggtcatcgccaccacactgggcaccggcatcggcaccgccttgatctacaacggcgcgctcatcccgaacaccgaactcggacacatcatcctgagcgccaagcatctggacgccgagaagtacgcctcctccgcgattcgcgagaacgaggaactgggctacaagaagtgggccaagcgtctgaccaagtactacggccttatggagaagtacttcaacccggacctgttcaccgtcggcggcggcgtgagccgtcagagcgaaaagttcctgccgtacgtggatatcaagaccccgattgtgcccgccaagctgcgtaaccaggctggcatcgtcggtgccgcctactacgccagcaccaagcagcagtgagctgagttatttctgctggcgcaggagccgtattgaccatatgtaaggccgtccaagtatttcgggcggccttttttaatgagtaattcgttcattaggtcgattttgtgttcattaggtcactcccattccagacctgaattgcaatgggctcggaatggcggcgtttcaagcatcaacaattgtgaggctcgactagcagtgacctaatgagcgcgaaaatgacctaatgaatgtagctaggccgttattcgatgtggattgaagtcatagtatgtctgacgactccgctgccgtgccgcacgattgtcgtagtgctggatgctggtggatatgaggcctcgatatacctggctcggcaggggtggttttatcgtgggaaggtatgagcgtgcatttctcttctcgtgtggatatttctgcgccgaatcccattgcggcggccgaggcggcagccaaggcaaacggcatcgcactcagcaaactcaacgattccaatccgacccgccacgggttggcacccgaattggtgccgagcgtgtatacggccgacccgcgtggaccgcgtgcggcacgagaatcattggccgcattcctcaatacggcaaacgtggtagacgcaagcagccctcagttggcttcgcccgccgccggcgagggcaggaacgagcgccatgccgttttcgtcaatgcgaataccgccatcgagggcgttgacccggacgccctgtacctgctgagctccacgtccgaggcgtattcatggctgattaagttactttgcaacgccggcgacgcggtgctggcacccaaacccggctatccgctgatcgagtcgattgcacggcttgaatgcgtcgacacggtcgaataccagttgcaattcgacggctcctggttcatcgacatcgccgaactcgagcggctactcagcgagcccggtggcgaactcatcagagcattggtgctcatcaacccgaacaatccgaccggttcgtacgtaaaaccaaccgagcgtgcacatatcgtgacattgtgccgtgaacatggcatcgcccttatcgccgatgaagtgttcttcgattactctctcgaacctttccccggcgacgcacggctcgcgggggagcgtggcgtgctcaccttcgccttagacggattctccaagatgctggccgcgccgcacgccaaagtcggatggattcaggtgtccggacccgacgaggacgttgccgaggcccagcgtcgactggacgtcatcgccgatgattatctgccgatgagtgacatcatcgccgaacggattcccgcattattgaacgccgcgcctgcacagaccagacgggtgggggagcgcgtgcgcgataatcttgccaagctgcatacgctgctcaatgccgatcccaacgggctggtcagcgtgctacgggccgaaggcggttggaacgtgctgctacgagtgccctcagtcatcgatgagaacgaaatggtgttgcggctgattgacgagcaccaactcaccggacagcccggctacttcttcgacatgacctccaatggatacctggccgtttccctgctgcccgaaccggacgaattcgagcgtggcatccgcgccgtgctcaataccgtcgccgctttgctgcgataggccggtgtttgccgtcaccgcacctgtactccacgtacaatagcggcatgggattcttgtttagaccgaaagaactgccacgcccggcatcgctgacgttcactttgaatcaggccgggcatacgtatgatgatgggcacgtgggacttgctcccacggacatcaccatcagcgagcggcgggtggccgtgatcggactgaacggcgcaggcaaatccacattgctgggtctgctggacggttcgttgaaggccaacgccggtacggtgaccattgcgggcggtgaggaacgtcttgacccggctgtgaagaaggacgcgaagcgcatcgataatctggtcggcaaagttcgccgcgaggagattccgaacagtttctaccaagcggcgaatatttccgaggctgtttccgaagcgctgaaaaagcacaaggtgcccgagtcagaacgtcatgcgcgcatcggcaatctgtttgcgcattttgatctggcgcaggtatccaaggccaaggccagcgaactggattccgagaaacggcacctgctggccattgcggccgcgctgagctttgagccgagtgcgattgtggcggatgagccgagcaagggattggatgagattggcaccgcgcatgtggccaaggcgttgttcagctacaacaagcaggtgattttcgccacgcatgacacggatatgatccgccggcccgaatacgccatcgaccgcgtactggtactggacgagcacgcggtcgtgtttgacggagcgccggctgaggctgtggcgttttatgaggatctgattcgcctccgatacgagactagagcatcgtgaaccatgcttgaacctgatgccatagcgtcggatcgttgacgatcatggcgtcgtcgcgcgcctgcacgaagcaacccagcacggctatgcccagcgcccacaatacggccagcaccacgacccagcgcatcagccaacgccacggagtgacgcgggcgatgccatcgtctgaagcggcgtcgttggcccccgccaatgaacgtcccggctcgcgcccgttgaccagccacagtagccccggtatggacgccagtgagatcagccagccgaaatcggcggaataccgccatcccagaccgccgacacggctgtcgaacacgatcagcaccgccgccacggccaagcaagacatcagccatggccgcatgccgtgcgtctccaatctgcgcagcaggggcagcgccaaagccatcacggtcagtggcgtggccgtgaaaatcgcgccgaccatcacctcgtaatagccccattgcggcatcggggcgggagagcccgccagccacgggaaacgatccatgaagcgcagcggcaggaacaggtaataccagatgttggcgggcatatccgcggacggggtggtataccgggtcatatcggatacggagaactgatacgcattaccgaaattgaacggggaatcgaaccgaaccatgttccacgccatcagaggcgtcacgacgagaatggcggggatgattaccgcaagcggcgcgcgcaacgcctgcaacggcttgatacggcgtgtgcgcagaccgttgcccagcgcgcgaatctgcggccagaacagggggaacgcaagcaatgcggccaaggtgaacgtcggtcggcatccgaaattcgccgcaatgcacaaggcgcccaaggccagtcgtggcagggagagaggtttggcatcgcccgcctgccatcggtccgatggtctcagcgggcggcgggacgtgtccgcgccgagccatagccatagtcccagcgacgtcaacgtcagcgatgcggcgaacggtatctgatagaagttcgtgcgatacagcaaataccccacttgcgcgctcaccaacgatgagaccactactaacgacgcggccgccaccgaagtcttcggcatcaagcgatggatgacgcgcagcaacagcaaggagaagaagatgatgaacagcagcacgagaatatactcggcgacggatgtcggcagattatgaccggtcagcagacgataggggatgaacagcagcactgcgggcaacacgccaaaataggaataccagtgaccgtcataatacgcgtaatcccagtagagcggactggctccattggcgagtagctgggcacgtgtggctacgtcataggggtgctcggtggcggccagttgttcgggaaccggcaagtcgagccagggccggccggcgaccagcgcatcggccacatgcccatactggtcgaaatcataggtgtaatcgccggaaacgtggaagacgagcggagacgcgtaccacagttcgcggatgatggatgcgccgataagtagggtaggaatcgccataagccccacgaaagcaagtcgttgccgagtgctggacgggtcaagcgtgatacgccacaggcgcgatcccggcctccagacggcaatcatcagcaacaccaaggccatggcgagcacgcgcatccaattgatggcgaacggtacgcgcacgttggcgcgggcgtcggtgaccggtacgatcgcgccgcgctcttcctgaatccaaatacgcacgatgccggcacctggcgccttgacataatggctgcgaatagcgtcgggattcatcgactgggcccggccggtgatgccatcgacatccgcgcgcacatgaatggtcgccagcggtttgaagacttccttatcgtcgttcgcttcggattcggcctcggcctgctcgcgggccttatcgatgaccttgccgctcgcggtatcgatgcgtaggtaatccgacgtgccgtccgcggtcagttcaagataggccttggtcggatcggtgacggtcaacatgccatcattgcggcgcgtgagacccgaacccagcgtgttatgcacggcgttcgtatccgtgctcgctccgagcgtacgccagaacggcaggttgaacacgatgcactccatggcggcgacggcggccagcaaggcgatcagcaggcgcgccaaacgcagccggtgtcgggtatccggacggctggtcatatgccgttcatgtttcgacggcattggacggtctgcgcgagtgtggtctatggaatgcacgcatttattctataggctttattcgggcttgatgtcgggcaaacaagagacaatgtgaatcatgccaaaacgtacatcggaccatgggaagcacaaccgcgcgccactgctgggcgggctgaaggattcgatgaacgcgctcgcggccgatctgggactgtccaagccgaagaagcacgatacgaatccgttcggcgatgccttgcaggagaccagtgagcgtaaaggcggcattatcgacgaactgactcgccatgcagtggcgctgagtcctgtaatcaagcgacgcaccttccctgaattggagaacgtgccggaagggctggtgcttggatgggcgcagctgccctccaccagaggccgtggcttttcgcttggcattttccccgaccgcgatcattttgcgcaggtggcgttcgccgatacgcatggccgcgtattcgtgggcgccgaccccaacatggacgtgcaggatatgcaggcgcgattcatgttcggcaaggaaaaagaagtgactttgccggacggtgagcggctgggcgaaagcgacgagccgcgttcgcgttccggtttctcccgtgcaggccgtggcctgggaaatgcgctgcatcatgggcgtggtttggggcgcggccttggtcatggtgctgacggtgtgaaggccattaccggtggcgtggtgggacgtgacgacaccggacgcatgacatggctcgcctcatggctcaaggccggcaaccggtacacgcttgagcagatgcgtgccaatctgccgcctgcgatgcgtcatgatttggaataccgcgatgccattaccatcgcgttcttcgccacgtatatgttgccgcagatcaatggtctgctcatcggattcggttccggcaatatcttccgccgtctcaaccgcgaggcgccgatcggtgcgattcgccgttcggtgcgtgacactttggcggcacgtgcccacggcatgcgggcctccggtctggaggatcatttcgccgatctgatgcgcgaagccggcgccctcgacaccacgccggggctggaagcggtgcatggcgccgaaccgttgcacctgtacacctcgacgtattcgagcggctatttctttacgtgggataagtccttggcattcgggcaggcgctgaaatccttgaagatcgaaggcaacctcaaccgattcgctgcggtgagcgcttggctggagcgcaacgcttccttggggcgcaaccctacggaagatacggtgacccgtgccgaggccgcgcaaattgacatgaaactcatcgaaaaccctgcgattatggcgcttgacccgtatgatggcgagcaggagcgtcgggccgtgctgagcctggtcgatatcgccgcccgcacggctggacagattcgcagtgaattccccgatcctcgagatgtgctgacccagcagaacgtgccggattcgggtgtgacgaatgctgcgggcgctggaagtactgagggcgctgtagagcgggctgataggagcgacaccaacactcaagccgctcggccttcgtattcgccggcgaggagcgacgaatgggtgtatcgtcagaccctctcttcactgttgcgccggttacggttgccgtatcggtttgatgtggagttccggtcgtgcttggattcgggtgaagtggccattggcttcaccaccgccggcacctcgatgatgcccgatagccggtatgacaccactcgacgtacgtggcgtgcgctgagcagcgccgaacgcgcgtcgatgagcgccgcctacaacctgcgtgtcggcctgatgatggccgcgctaagtttcggcaccagcgaatccgtacgccaggtgtcgttgcacatcgattccattggtcttgaagaggcgattgccgaacaggattccgccatcgaggcgatgatgagcgaggctttaagcgcttttgaacatctgcgcagtggcgatttggggcgtgtgggttccaaagccgaccccaaagatggtgatttccatggcgacccgacccgccccatcacccatgaggagacgttcgggcagatggcgtccggtgacgaacgcggcacgaccgggggaaccggcaacggtaccggaccgtctgcggatgctacggatcaggcctcggtcgaatccgctgacgccgatggcgccgcgtccatcgattcgcagttcgaagatctgatgaagggcgtcgatatcgacgaaatggcgttcggcatgccggacgataccggcgcaggtgacgacctgggcggtatcggcggcgagggcgtcggcactgacggtgctgatggggccgccggcgtggacgatgatccgatgagcgtgctgcgccgcaatcccaccgtgcgtaatatggtcaccgtcaccttcacccgtgatgccttcctcaagcgactggacaccgctgggctcgacaatcccgaggaaacctaccgcatgttcggtgccgtgatggacgtggacggcgaaggtggtctgaaacccatcagcgccgacttcgacttggcggacagccggttctctcccaccggatcccaggaggagcccgaactggccgaccgtcaattcagcccggcgaccgctcacgtgctgggcgcacagaatagtgccggactggctatccagcgagtgggcctactgcagcatggcgtcaacgaattccacgatatcgccaggaacacgtcgctcggctccgtggaaaaggcccagcgagccatgcaggtcatcgaatcgatatgcgatcccgaactgaccggcttggcctcacaggtcaccagtgcgttgatcgatggcaaggacacaccggacttcacgttcacgcttgctgacgatcttgacaaggagcgtctgcgcgcccgagacatgctgttctcgggccaagccgatcaggccatcgaagcggccgaagcggccgtgtcccatctggatcaggtgtatgcggcaggccatggcgtacctcgatacttcaactcctatgccgagcgcgtggtctacaatcgactgttcgccacattggacgagcgtacggtgctcatcccggacaatctgttctacgcacacatggagctggctgacgtgttgagccagatcaagggtgccgaggcggccatcccgcacctcaaccgtatggtggcgtacgcgcccgcctacccgctctcacatctgaagctcgccatccaactggcccgcaatgaggattgggattcggcacgcgccgcctgcctgaatgctctgcgcgtggccttggaccgcgacgatgccgcgttcgcctactaccggttcgcgtacgccgaatggatgcttgaccggttcgacacagccgccgcggcctacattatgagcgatcacatcgctcccggggccattggttcgctggaaagcgaactgcaggaactggtttcccgtgcggactcgcagtgcatgccggtgcctgaatcggtggagacggccgcccatgtgcttgccatacatggtctgccggtctggccgcatatcgaagtggctgacatcgtgcgtgacgccgcccgcgtgtgcgtggatgaaggcatgttcgtgccggcccgcacgctctcggtggccgtggcccgcatgaatgacggtgaaggcgacaacatcgacatcatccaagcccagttcctgcgctcgctatccgcgtagccgcctgaggggagttgacggtatagccggccgaggggagccgagcccgctaggatagacaaccatgagcacgaacgaacaactggcatgggatttcgacgatggggatgtggccgaggtccggcctgataccggtattgcacgttttgcccctggctccgaacaatggatagccgcactgcagcccactgacgacgacgcgatacgcctcgaccgtttcgacgtgaacacgatgaccgctgaggccgccgcccgcctgtgggctcgcgtggccgcatgggtggaatccgatcagatcgcctactacatcgacgactcacccgtcagctccgacgccgcctacgacgcgcgcatgcgttgcctcgaacgactcgaagcggcgttcccctcattggacaatccgcagtcgcccacccatcgcgtcggcggctccttctccaacgacttcgtctccgtgcgccaccccagccgcatgatgagccttgatgacgtcttctccatcgaagagctcaaggattggtacgattcggtgattcgcgacctcgattggcccgaatccaagcccctgcccatgagctgcgaggtcaaaatcgacggcctcgccctgaacctcatctatcgcaacggcgtgcttgaacagggcttgacgcgcggcgacggcgttaccggcgaagacatcaccctgaatgtgcgaaccatcggctccattcccgccaacctcggcggccccaaggaagacgttccggacttcgtggaaatccgaggcgaagtgttcatgcgctgggatgacttccacaccctgaacaacgagcaggaggacgccggacgagcgccctttgccaacccgcgcaacgccgccgccggctcgctgcgtcaaaaagaccctcgcatcaccgccacccgtcgcctgagcttctatgcgcatggtctggggcagctcacctgggggcggaccatccgcgcggcacccatgatgtggtcgccgaccagtcgcaggcctacgatctatacaccaggtggggcgtgccggtctccccgcataatcgtgcggtgacctcattccaggagatcttggacatgatcgagtactacggcgagcatcgcggcgacatcgagcacgcgctcgacggcattgtcgtcaaggtcgatgacctgggcctgcagcgcaccctcggtgccacctcgcgcgcgccgcgctgggccatcgcctacaaatacccgcccgaagaggtcaacaccgaactgctcaacatcaccgtgcaggtggggcgtaccggccgtgtgacgccggtcgccgtgctcaaacctgtctacgtggccggctccaccgtggctcgtaccacgctgcacaacggatttgaagtcaaacgcaagggcgttctgatcggcgacaccgtggtggtgcgcaaggccggcgatgtgattcccgaactggtcggcccggtgcttgaacggcgcaaagggcgtgaggaccagctgcgcgaattcgttatgcccgagttctgcccttcatgcggcgcgaaactggcacccgccaaggagggtgacaaggacattcgctgcccgaatgtggaaagctgcccggcccagttgaccgagcgtgtgatttcgctggcctcacgcaaggcgttcgacatcgagcacttgggcgaacaatcggccatcgctctgaccaacccggaggagaaccggcctgattcggtggcgacctacgcgccgaacatcaccgaggtgctggtcgcccccggcgaagagcctgacccgtatgagccggtggaggggctggaattgccggccgcgcagaagccggtgttgtccaacgaatccgggttgttcgacctgaccgccgccgatctgcgcgacgtgcgcgtgtggcgtgaagccgcaatcgtcgaggtgcatgagacggtcggtgcgaacggtaagaagaaaaaggtgcgtaagcgtgtcggcggctctggcctgtggcatcaggtgcccgccttctggaccgcgcccacgccggccaaaaagctcacggccaagcagctggccgaacgcgcgcaaagggaggccgcaatcgaatctgccgaaacacagggaggtgccgccagcgagacgaccggcgcacctaccggggctgaggctccacttggtaccatgccgggctttgccgcagcctcctatcccgagtatgacgtgccggccgacgcggtcatcgtgcgcgtggatcacaagaccacgcgcactggcgtcacggatgtaccggtgatcattcggcccggcgaaaacacgcgcaagatgttcgacgaaatggacaaggcccgtcacgccgacctgtggcgtgtgctggtcgcattgtcgattcgccggctcggtccgcctaccgcacgcctgatcgcctcggcgatgggctcgctggcagccatcgaaaaggccacgattgaagatctgacggccatcgacggggtgggcccggaaatcgccgaatcggtggtgaactggttcgccgccacccgcgaacccggcgactggcgcggcgcgactttgcgtgcttggcaggctgccggcgtgggtgtcgacgaggccgagaccagttcgttgccgcagacgctggccggcaaaaccgtggtggtcaccggttcgttggaaggctattcgcgcgactccgccaaagaggcgattatcgagcgcggcggcaaggcggccggttcggtgagcaagaagaccgattacgtggtgattggcgcaaacgccggctccaaggccatcaaggccgaggaactcggcatccccatgctgggcgaaatccaattcgcccagctcctagaaaccggtagcatcgactgacttggctcccctctctgaggggagctgtcgccttgtgcgactgagggaagtagtcgtccgcaaaacggatgcgggaatgggagaggtacatccgcagcgcgtgcgcagtgtgacttactccactccctctggcatgccgccgcatcacacgctagggtagaacaggccctaaaggaggatacggatttatgagcgacgcacgtcagatcgaagccgacatctacgaacgcctgagcaaggtcatcgaccccgagctcggtcgttcggtcaccgacctcggcatgatcgccgccatcgaagccgcgcccgcatcgtcggacgccggcacttacgacatcaccgtgcacgttgagctgacggttcccggatgcccactgagcgagaccatcaccaaccagatcaatggcgcggtcagctcctatccgggcgcacagctgctgcctcatatcgaagtcggttcgatgagccgtgacaagctggccgatctggtcgccaacctcaaggccgaacgcaagcggaaccccttcagcaaaccgggtgtcaagacccgcatcttcgccatcgcctccggtaagggcggcgtcggcaagtcctcggttaccgcgaacctggccgccacgtttgcggccctcggcttcgacacggccgtcatcgacgcggacatttacggcttctcactgccgcgcctgttcggcgtgcatacacagcccaccaatctgaatggcatgctcatgccggtcaccgcgtggggcgtgaaactgatctccatcggcatgttcgccggtgctgaccgggcgattctgtggcgcgggccgcgactgcagcgctccttggaacagttcctgtctgacgtatggtggggcgagccggacgtcctcttgctcgacttggctcccggcaccggcgacatggcgatttccgtggcccaggcgctgcccaacgccgaactcgtggtggtcaccaccccgcagccctccgcctctgacatcgccgtgcgctccggactcgtggccctgcaggtgccgatgaaggtgcgtggcgtggtggagaacatgagctactacgagcacaagggcgagaagctggagattttcggtgccggcggcggtcagcgcgtgtctgaacagttaagcgcggcgcttggctatgacgtgccgctgatggcccaactgccgctggatcccgaagtgcgcgagaccggcgaggcgggtcgtcccgcggtgctggatgtcgatggcgccttgcgcacggatggcgtcggtcaggtctttcggggactggccgagcgtctgctggagcggtgctaaggggtgatggtccaggagcggtgccaatcggccaatagagaacggttctcttcgcgcctattcgccggtgtcgtacaatatcccctggcgtgctaacgaaaaccacatgaaaggagtagctgtgcccacttccgaacataaggccgacgacgcaacgcggcatcttaccctgattcccgctccggtgacattggagtacacccatggtacggctttgatcggtcctctggtgacgatcgaggatgccgatcagtcttgggagacgttgccgatcgagcagctgtccgacgaacttcggcaccgctacggcgtcaccgtcctgaggcgccgcacacacggcaccgtcatatccctgggcctggattcacggctggcccatgacgaatacacgttggatgtgtccgaatcggagggcatccgtgtgcgtggcggcggcgaaagcgggctgcggtacggtctgcagacgctgcggcagatcatcgggcagacctcgcgtgccattccctgcctgcatatccaagacaagcccgcgttcgcggtgcgcgcctacagtctcgacgtgacacgcggacgagtgccgacgatggagttcctcacctggttcgtcgaccagctggccttatataaatacaatcagttccagctgtatgtcgagcatgccttcgcgttcgtcgagctcagcgaggcgtggcgcggcaccgatccgctcacggccgccgacatcacgtatctggacgagtactgcgcgcgtcgcggcatcgagttggtgccgtcgttggccacgttcgggcacatgtacatgaatctgcgcacccgtgagcatcgcgggctgggtgagtttcccgaagacgccgaccgcccgttcagcttcatcgaacgcatggagcatcacacgctgaacgccgccgatcccaaggcccatgatttcgcctcgcgcctgattgaggaatacgcgccgctgttccgttcgaagtccttcaatatcggcggcgatgagacgttcgacttgggacgtggcaggtccgcgcaggacgcgccggaagccggccgcgatgaactgtatgccggtttcgtcagggatttgtgcgaaacgcttgcccgtcatggtcggcaaccgatgttgtgggcggacatcgcgctcgaaagcccgcgcacgatggatctgctgcccggcgacatcacgatgctcaactggatgtacgagccgcagatcgacgagagcaagatccagaccatcgccacgcagggccgtcgacagttcgtgtgccccgcggtgcgggcttggagccggttcttccccgattatgcgggtgcctggctgaacacgtatcacatggcgttggcggggaccaagtacgatgcggaaggcatggtggtcaccgattggggtgattatggccatgtcaacgatccgcgtctgagcgtgccgggcctgtgctatggcgctcagaacgcttggaatccgatcgagatcgatgcgcatgagatgaaccgtcgaatctccgctctggtgtatggcgacgaatccggtcgcatcatggattgcctcgcccgcatcgactccgatggggtgtcattcccctgggaccttgccgtgcaggtgctggagctggaatacggttccggcaccggcgcgctgaacatggatgtggcggcgtgcatggaacgttcgagcggcggaaagctcacgctggaccgcacattgggatgcgatgacgcgcgccggcggatgctccagtggaaccgcgagcgtatcgaacggcgtcgggattgcgatcaggtgctgcgtgactgcggcgacgcgttcgccggtctagacaagggaggcctgaccgcggagttcctgtcggtgatgctggacgggcagcgactgttcaacgaacttggcgaggaactgctggcgttggccgacggcaaggacgtcggcagcggggcgaatcgtctcgccgccgatctggagttgtggttcgagcggtatcgcgcacagtggctgtcggtcggacggcatgccgagctcgcacgtatcgcccacgtggtgtggtctctcgcggacattctgcgtaggggcgctctgtaaggagcatgaccgaaggcggggtccatgccccgccttcgctatcgcgcgtactggtcctcggtggtgaagcaggtgcgatagaccatggccatgatcagaccgtcggccagcaaggtcagcgcggcgatggcgccgaagaccacgaactggtatttggcggcgttcagcggatctccgccggctatcacctggcccgccatcatgcccgggatggtcacgatgccgctggaggccagcgaagcggtggtgggcagcagtcccagccgaatcgacgagatgacggatgggcgggcggactcccatgccgtcgcccccaaggccagcatcatatccacctcgtcgcggcgttcctccatgctttcatagaatcggctcagcccgacagcgagcgcggaaacggtgttgcccagcagcatgccggtcaggggcaccaccagctggggcgcataccatggatgcgggcgcacgatgagttcggtgaccaacgccagcatgagcagcatcgtgatgaccaggctcaggaagatcggtccggcaagacctttggggatgccgtgcgcgcgggatatcacgatctgcaccgccgcgaccagcatgaccgtcatcagagcgaacaccatccacacgctgttcgaacgaatcacatagccgatgatgaatcccatggcgcacagctgcacgagggcgcggcatgccgaccacatcagggtcctgccgatgcccatgtgcatgagttcgctgatgatggccgccacggccaccatgcccaacgcgatgagcagaccccagatatcgatgttgtaggaattgcccagatcgccgctcatgactgcgtctcctcattctcatcggcgccggcaggcaccgcgttcgcgtcctgcgccgccgaatccgtcatctcgcgtccggtcagccgccccttgtccagcatcagcgtgcgggtggcccgtccgtccggcggacggtgacggatgcggatgatcgccatgccgcgtgtggcggcatccgccatgatcgtagccaccttggccgcgttgtcgtcgtcgagtccggcgtccacctcatcggccagcagcaccttcggatcggtgagcagcgtgcgggccagggccacgcgggccgcctgaccgcccgacaggtcgtgcggggcgcgctccagatcgatgtcctcgcagcccatcgcgtccaacgtcgtgcggatgcgctcgtcgggcagcagctgctcggccttgccgcccttgccgcgaatcgcgagcgtccagggcaggcggatcgcctcggccacgttcttgcccgtcagaatcggcttctgcggcaggtaggcgacatcccgccgccactgctgcggcgtgaactcgccgctgcgcttgccttcaagggcgaacgtgccgtgcgcatgcgggttgagtcgggcgcatgcggtcagcagactcgatttgccggagccggacggtcccaccagatcgacgatctcgccacgttccatgctgaaggacaggttgtcgaacaccgtgcgttcgttgtccgccggcgattgcgcgggaacgacgcaggacacggatatggcttcgaagaaggatcgcatattcatccagtctagtcggggccacgtgggaaaccccagcgttcacttcctgtatacccggtgtggcataatagccaaggcaatttttgggctttgcctaagctagtttgaatttgaaataggtgaataacgtggcacagactactaacgacatcaagaacggatccgtcctgaacctggacggccagctgtggaccgtcatgaagttccagcacgtcaagccgggcaagggccccgccttcgtacgcaccaccatcaagaacgtgctctcaggcaagatcgtcgacaagaccttcaacgcaggcatgaagatggaattcgagaccgtcgacaaccgcaccctccagtactcctacgaggacggcgacaacttcgtgttcatggacatgaccacctacgatcagatcatggttccgaagacccttctgggcgacaaggccaagttcctgctcgaaggcaccgactgcctggtctccttccacgacggcaccccgctgagcgttgacctgccgggctccgtggtcctgaccatcacccacaccgagccgggcctgcagggcaaccgctccaacgccggcaccaagccggccaccgttgagaccggagccgagattcaggtcccgctgttcatcaatgagggcgaccgcgtcaagatcaacaccgaggatggttcctacaccggccgcgagaacaactgatctccgcatcctcaacagacgaccgaccgtataaaggactaggacagcagcagtatggcacgttccaccgcgcgcaaaagggctctgaacaccctgtacgaagccgacgaaaaaaaccaggatattctctccctgcttgacgaacgcatcgcacatcccggtgcccagaccccgcttcccgactatgccattgaaatcgtcaagggcgtggccgagcaccgtcgtcagatagacatgaccctggacgaacactccacgggttggaaggtccgccgtatgggcgtggtcgatcgcaacattctgcgtatcgccgcttgggagattctgttcaacgatgatgtgccggacaaggtcgctatcgacgaggctctggcattggccaagaccctgtgcgatgacgattcgcccgctttcatccatggcctgctgtctgcggtgtgcaccgccaagaacgcagcaccggcaccggagtccgtggcggaagaggccgatgaggaatcgtccgattccgatgccgccgcatccgatccgaccgatgagggcgatgtttccgattcgtccggtgcatccgacgagcccgctgccccgtccgctgagattcagccgacggtcgattagtcatttgttgttcagcctccccattcgggaggctttttcatgggcggacacttgtgtcgccgtacattctcaagtcggcaccttgccgacagccccgccagcggggtgagactttgcgcccaacggcgtgtgagtctgcgctggccgttaaccttggtacgaatacccgaaaaacataagggggttttggtgagccagaacgagtccgggaccatcgcaattccgatgtatgacaaggacgatgcagtcctcgttttggaagatggacaggtatatgtgggggagccgtatggcgccctcggtgagacgaccggtgagatcgtcttcgccaccggtatgaccggataccaggagacgctcaccgatccgagctacgatcgccagatcgttgtgcagacgttcccgcacatcggcgataccggcgtcaacagcgaagaccctgagtcctcccgcatctgggttgccggatacatcgtgcgtgatccctctccgaacgtgagcaactggcgtgccgaaggcagccttgatgacgacctcaccaagaacggcatcgtcggcctgagccacatcgacacccgcaagctggtgcgtcacctgcgttccgcaggcgtgatgcgcgccggtatcttctccggcgacgccctgaccgaccaggccaccggcgcgctcaagaccatcgagcagctgctcgaagacgtcaggaacaccccgcagatgcagggcctgagcctgtacgacgaggtgtccaccaaggagacctacaccatcgagccatgcggcgagtacgaaggcaaggagccgctgtacaccgtggccgccgtggacctcggcatcaagggcatgaccccgcaccgcatggccgaacgcggctgccgcgtgcacgtggtgccctccaccatcaccttcgccgaaatcgagagcctgaacccggacggcgtcttcttctccaacggcccgggcgacccggaacaggccggccccgaaatcgagctgctgcgccaggtgctcgacgccggctacccgttcttcggcatctgcttcggcaaccagctgcttggccgcgcgctcggcttcggcaccttcaagctcaagttcggtcaccgtggcatcaaccagccggtcaaggatctgaccaccggcaaggtcgaggtcaccgcccacaaccacggcttcgcggtcgacgctccgatcggcaagcaggtcgacgcgccgtttgaaaacggcaagtacggcaaggtgttcgtctcccacatcgatctgaacgacgacgtggtcgaaggcctgcagtgcgtggacatccccgcattctccgtgcagtaccacccggaggccgcagcaggcccgcacgatgcggcctacctgttcgaccgtttctgcgaacttatgaagaacaactccaaggaaggtaagtgatatgccgaagcgcaccgacatcaaatccgtgatggtcatcggctccggcccgatcgtgatcggtcaggctgcggagttcgattactcgggcacccaggcatgccgcgtccttcgtgaggaaggcatccgcgtcatcctcgtcaactccaaccctgccaccatcatgaccgacccggagatggccgacgccacctacatcgagccgatcgccactccgatcctcgagcagatcatcgccaaggaacgccccgacgcgcttctgcccaccttgggcggccagaccgcactcaacgccgccatggcgctgggcgaggccggcgtcctgaagaagtacaacgtcgaactgatcggtgcctccctggaagccatcgaccgtggcgaggaccgtgaactgttcaagaaggtcgttgacgaggccggcgccgaatccgcccgctccgacatcgcccacagcatcgaggaagtcgacaagatcgccgagaagttcggctacccgctggttgtgcgcccgagcttcaccatgggcggcctgggatccggcatcgcccacaacgaggaggagctgcaccgcatcgccggcgccggcatccattactcgcccaccgacgaagtcctgatcgaagagggcatcgagggctggaaggaattcgagctcgagcttatgcgcgaccgcaacgacaacgtcgtggtcgtctgcccgatcgagaacgtcgacccggtcggcgtgcacaccggtgactccatcaccgtggccccctgcttcactctgaccgaccgcgaataccagaagctgcgtgacatcggcatcgccatcatccgcggcgtgggcgtggacaccggcggctgcaacatccagttcgccgtccatccgaagaccggccgcatcatcgtcatcgagatgaacccgcgcgtctcccgttcctccgcactggcctccaaggccaccggcttcccgatcgccaagatcgccaccaagctggccctcggctacacgctcgacgagattcgcaacgacatcacccagtccacgccggcctcattcgagccgaccatcgactatgtggtcaccaaggtgccgcgcttcgccttcgagaagttcccgggcgccgaccccaccctgaccacctccatgaagtccgtcggcgaagccatggccctggccggcaacttccaggagtccctcggcaaggccatgcgttccatcgacaagcgccacatgggcttcaactgggatggcgaaaagccgtccgccgaggaagtggccgaactgcttgaggccatccatacgccgaccgaacaccgttacctgcagctcatgcgcgccatctggggcggcgccacgctggagcaggtgttcgcggccaccaagatcgacccgtggttcctgaagcagatcttcctcatcaacgagaccgccatgacggtgcgcgaggccgagaccctgaccccgaagctgctcaagaaggccaagctcgccggtctgtccgacgtgcaggtggcccacctgcgtggcttgggcgacgaaggcgagaacaccatccgcgagctgcgctggacctacggcctgcgcccggtctacaagaccgtcgacacctgcgccgccgagttcgacgccgccacgccgtactactacagctgctacgccgacgaaaccgagctgcgcccgcgcgagcgcgaggccgtgatcatcctcggctccggcccgaaccgcatcggccagggcatcgagttcgactacacgtgcgtgcacgccgtgcaggagcttggcaaggactatgacaccatcatggtcaactgcaacccggagaccgtgtccactgattacgacatgtccgaccgcctctacttcgagccgctcaccttcgaagacgtgctcgagatctacgaggccgagaagaagatgggcccggtcaagggcatcatcgtccagctcggcggccagaccccgctgtccttggccgcgcgtctgaaggccgccggcgtgccgattctcggcaccaccccggaatccatcgatttggccgagaatcgtgagctgttcggcgaggtgctcaagaaggcggagatgaacgccccgcgttacggcaccgccctgagcctcgaagaggccatggacgctgcccaccgcatcggatacccggtgctcgtgcgcccgagctacgtgcttggcggccgcggcatggaaatcgtctacgacgacaagcagctcaccaagtacgtggaccgcgcgcttgccgaggccaaggccgataccgtggtctccggccgcctgccctccccgctgctcatcgacaagttcctgcaggacgccatcgaaatcgacgtcgacgccctgttcgacggcgaggaactgtacatcggcggcattatggagcacgtcgaggaggctggcgtccactccggtgacgccgcctgcaccctgcccccgtccaccctgtccgacgaccagatccgccgcctgcgcgaaggcacctacgccatcgccaagggctgccacgtgcagggcctgatcaacgtgcagtacgccttcatggccaacacgctgtatgtgatcgaagccaacccgcgtgcctcccgtaccgtgccgttcgcctccaaggccaccggcgtggcgttggccaaggccgccgcccgcatcatggccggcgagaccatcgccgaccagcgcgccaacggtctgctgctgcccaagggcgacggcggcgacatccaccccggccagcaggtcgcggtcaaggaatccgtgctgccgttcaagcgcttccgcaccccggtgggcaagaccgtcgacatcctgctcggacctgagatgcgttccaccggcgaggtcatgggcttcgaccgtgacttcccgcacgccttcgccaagagccagctcgccgcctatgacggtggcctgccgacccacggcaacgtgttcatctccgtgaacgacaccgacaagcgtcagctgccgttgattgccgtgcgtcttgaggaactcggcttcaagatctgggccaccgagggcaccgcctccgtgctcagccggtacggcatcgagtcgaacatcgtggataagatcagcacccgcgtggacaccgatccggaggcgccggtcgaagtgcatcacgccgccggatccgtgggcaagaacgtggtcgatctcatcgaggagggcaagatcgacatgatcctcaacacgccgaactcgcgcggctcccgttccgacgggtattccatccgcgccgccgccattgccgccgatctgccgcagttcaccaccatcaccgagttccaggccgcactgctcgctatcgaggccgtgaagcataatgattatcagatcatgagcattcaggagcattcgaagcagttgttcgaattggagcgacgggagttctgatgactacacccagcagtgaggaattgcaggcacaacgttcggatttcggtctgcgattaagcaattcaatggccaaatacgggccgctgtgtgtgggcattgacccgcatcgcaagctcctcaccgactggggatacaacgtcgacgccgaaggcgccgaactcttctccatgcgtatgctgcaggccgccaacgggcgcgccgcagcagtcaaattccagacgccgatgttcgagcgttacggggccaagggcttcgaagcgctcgaacgcgtgctgtacgcggcacgccagatgggcgtcatcaccatcgtggattgcctgcatggaggcctgtccaccacgatttccgccatcgcggacgcctacttcaagcccggcgccccgatgctggccgacgccatcaccctgctgccgtactatggcgcgcgctcgttgaacggcctgattaccgaagcgttggaaaacggacgcggtgtgttcatcgcctccctgacttccaatccggaaggcatgagtctgcagaccgcgctgcgccagagcggcgactacaaggggcgcactgtggcctacggcatcgcctccaccgcacagaagcacaacgtggatatcggaggcatgggctcggtgggccttatcatcggcgccaccatcggccaatggacgcaggattccggcgtggacccctccaagttcaccggcccgattctttcccctggctacggctggcagggcgccgaggccaaggacctgaaaaccgtgttccgcggtacgcgcggcaacgtgttggtcaccgtgtcccgcttcatcgcctcgcacgggccggatatcgccgcattgagccaggccaccgagtcgattgcgctcgacgtgcgccaggccctgatggaggccaccgccgaaggcgcggagaatcagtgatcagaacggaatcagatgtcgcggcatgcgtacgtgtgtatctcatcgcgtacgtcgcatcacgattcatattcttccctgttcgtcggggctgtaacagttaccggtcatctcgccggtgagccgttaccacattggattcataatcgctgcacaccacatcatctccggaggaacccatgactgaaaacacccatgccggccgtctaatcgtcctgactggccccaccgcagtaggtaaaggcactgtggaggccaagctgcgcgccgaccaccccgaagtgtgggtgtccgtttccgccaccacgcgcgctccgcgccccggcgaggttgatggcgtcaactactggttcctcgctgaagacgagttcctggcccgcgaagcggcgggggagttcctggaaaccgccgtggtgcacggcatggcccactacggtacattgctggctccggtggaggagcatctggctgccggcgtgccaacaattctggaaatcgatttgcagggcgcccgccgcgtcaagcagcgcgccgccgaactcgacttggaagtggtgtacgtgttcatcgcgccgccgagctttgaagagctcgagcgccgtctgatcggccgcggcaccgaaaccgccgaacagcaggcccgtcgcctggaaaccgccaaagtggagctcgccgccgaaaacgaattcgacgtcaccatcgtcaacgaaaccgtcgatcaggccgccgccgacctctggtccgtcatcgccaaggaatacgggctgtaacgtgtgcgaataggttctgttcgtactgagatgtccatgcttggcatggtgtgctcatgtgattatgcgtgttcagtccctgccagtcggccctcacaatagggggagagcctgacggcagggactgattcataccgatacaaaggggcatgcgccaccatttgtgcgtcaaccgtttgatatgcaaatgggggcacatgcatgtgtgcgccatcttccaaaaacgtcgaattatgcaaatgggggcacgaataggtgtcggcgtgatgtggtgtggtgcgatgctgcaggtgcggtgtgacatggtgtgggatgccagcggatttcgggtgtttttcctctggcgtcccacagaacctgatgtacggtgccgtcgccggtttgtgggattggcagaattccaatggttctgtggaatggggtgcgggatgccagccgtgtgcatcgtttgacgtgcgtggcgtcccgcacggttgcgggacgccggccccaaattggccgctaaccgtgtggtatcccgcatttctccgatatgcgagaggaatccgtccactataaggtctctagcccagcgactaatagtttttcctctatgtgcgaataatacgggctgtaactaccgctttaccaccaactgctggtggagaatttcggtgctgtttctggccggcgcctgcttccaacggatcgcttcggattcgtgatgctcggtgacataatgccgcatccattcgaagcactgctgggtttggatggcatcgcttaatgcgcggtgctcctcattgtccgcgatgccgaagcgtacgatcaggtcggccagacggtgatgccgctgcgcggggaacagggcgcggctgatctgcatcgtgtcataatccgcgcaggcaaagccgcagccggcgatatgccgggtgttgtaatccaggaatcgcagatcgaagctgacgttatgaccgacaatcggctcaacggcgggactggcagccggggtagcgagccatgcgatgaatcggggaagcaccttgtcaatcggatcgaggtcggccaccatcgcatcggtgatgccggtcagcgtggtgatctgacgcggaatcggccgcaagggattcaccagctgctggaattgatcgacgatatgccccttccgtacgcgcacggcaccgatttccgtgatggcgcaactgttcgggtaaaagccggtggtctccagatccagcgccacataatcggtggggaagacggcatcgtccatggcgattcgcccgccggcaccatgattgggctgggatggttggccgaaaacggtaatgccggaagtggtcacggaggctcctcatatcagtcggtgttcggtgacttattgtaccggcagcccggtctgacggtacaattttcccctcccggattttctcggatatattggttaggcggccggcaattgcgcggcgcatcgggaagggagcacagctgatgaaacagatagtggcaggcatcgtggcgcatgtggacgcgggcaagaccacgctgtccgaggcgctgctctaccgcaccggtgagatccgcaaattggggcgagtggatcacggcgatgcgtttctggacaccaattccttggagaaggcgcgaggcatcacgatcttcgcgcaccaagcgttggttgaacacggcgacctgcgactgaccttgctggatacgccggggcacgtggacttcgcagccgaaaccgaacgggtgctgcgcgtgcttgattacgcgattcttgtggtctccggcacggatggcgtgcaaggccataccgagacactgtggcgtctgctggccagatacggtgtgccgacgttcatcttcgtcaacaagtgcgacgccgccggattcgcccgcgaggccattctggcacagttgcgcaaacgcctgagcgatgcgatatatccgttgccggcaatggaacagttcactgagggcagcgcggtaccgttggacgcgttcgccgaagacatcgccaccctggacgaggaggcgatgaacgactatctggaacatggcgtgctgtccgtgggcagattgcgatcgatgatcgccgtacgtgagctgttccccgtatatttcggctcggcattgaaactcgaaggggtcgaggaattcctggacgggctggagacgttcacccgcgaacgtgaatggccggccgccttcgccgcacgcgtgttcaagatcgcccacgacggccagcacaaccgtatgacgtggctgcgcgtcaccggcggtgcgctcaaagccaaggagatcgtctcctcatcctcgtgcgccgcggcgtcgacaccgtcgccagcgcaggaggatgatggcatggcgtggtccgagaaagtcgatcaggtgcgcatctacaatggcgccaaattcgagacggtcaccgaagtgccggccggctcggtatgcgcggtgaccggactgacgcggaccttccccggcgaagggctgggagcggaaccggacgccgaatcgccgtcgctgcagcccgtgttgacctacacggtgttgcccgccggagctgaatccgatacggccggcacctcgggagcggccaaacgcggtggcaccggccatgacagcgtgaatcgggacgatgccgagcatgatgccgccaagtcggaaaccggccgcaatgaggagaacgacactgccggccaagacgcagagacggacaatagctcgccggcccttccccagttcgatgatctgaccttgcataaggtcatcaccgcattgcgtgagctggaagacgaagacccgttgttgcatgtggtgtgggtggaacggctggccgagattcatgtgcaattgatgggcacagtccagctggaaatcatccagcagaccctgcacgaccggttcggtctggatgtgtcctttggccccggctccatcctgtaccgtgagaccatcactgcgccggtcgaaggcgcaggtcatttcgagccgctccgtcattatgccgaagcgcatatcctgctggaaccaggggagccgggcagcggagtcactgtgggctcggccctgtccgaaaatgatttggaccgcaattggcaacggctgattctgacccacctgaccgagcgtgagcatctcggtgtgctcgttggcgcgccgctcaccgatatcaagatgactttggtggctggccgcgcgcatctgaagcataccgaaggcggcgacttccgccaagccacctatcgtgcaattcgtcaggggctcatggaagccagagctggagtcagtggccggcccgagacgccggtcgagagccggccggacaccacaggggagggcaactgccgactgctggaaccgtggtaccggttccggctcgaagtgcccgcagacatgatcggccgtgccatgagcgacatccagcgcatggccggcaccttcgaatccccggtcaccgatggcgaatacgccgtgatcgaaggcgaggcgccggtgtccgaaatgcgcgactatgcgatggatgtgaaccagtacacgcacggccatggccatttctccgccaccttcggcggctacaagccatgccatgacgccaaacaggtcatcgcagccgccgcctacgatcccgaagctgatctggacaacacccccgactcggtcttctgcgcccacggtgctggctaccccgtcaaatggtacaaagtccccgaattcgcccacgtagactacgtcatgtgaggtggtgactaccaaatctacggacgaatgaatccgctggcctccaagaatcgctgaatatcgcgcatctccggcatattgatcgaatgggccatgcccggatacacctgttcggtcaacgtgccgtgctcgcgccagaactcacccatcgccgccacctgcgcggcagggaaaatatcatcgatggcaccatgcccgtagaacacgggcggcttcaacgaagccaattcggcatcgcccgcaacggaccccggtgccagccatccagaacaggagacggctgcggcatatcgtttcggattgaaacgcagcagatgcgcggccaagaggccgccctgcgagaatcccatggcaaccaccggccgagtggcgggaatatgctccgcaacccatgcatcaatggcttgggcggcctcagccgcctgcttgtccaatgatccgccctccggcacaccctcatgcgcccacgagccgaaccacgtatatcccatgccataggcgatgggtgcctgcaaactggcgtaatcagccgaaccggcaccgcaatagttcagcaaatcgggcagatcgtattcattggatccccagccgtgcagcagcacgaacaccggggcggtttcaggaccggtcaaacgggtcagagctttggtaatcttcatagcctcagtgtatccaccgtttaggcgacaatattgccctgatgttcgcccatcgagtaacgtcccataagtaatgcatatagcgcagcggccatgccacgtgttctgatactctacgatgacacggcaagggggtcgtggcaggtatgttcggcccccgaaatcgtacatgggcggctaagaccgtttatgcgcaggagaagaaacgagaagcaaaggaaggagcgcgcccgatgacattcgattggtcgttcgtgcagcgttacgcgcctttcttcgtcaatggcacattgatgaccttattcatatccgtgtttggcatactgcttgccgtcgcggtgggtctggtctgcgccggcgtggaaatcgcgcgtatcccggtcgcccggcaaatcgtaagaatctatatcgaactcagccgcaatacgccattgctggtacagctgtactttctgtacttcggcctgcccaaactcggcgtagtatggtccgccgaaacctgcgcgatagtcggcctcggattcctgggcggttcctacatggccgaggcgatgcgcggcggattggaagcggtgcccaacgtgcagcgcgaaaccgcatacgtactgggactgacctccacgcaaaccatcacccgggtcattctgccgcaggcggtgtccaccgccattccaggcgtagtggccaatgtgatcttcctgttcaaggaatcgagcgtcgtctccgccattgcgctcgccgacgtgatgtatatggccaaagatctgatcggcatgtactacagcacctatgagtcgctgttcatgctgattgtggcgtatctggtgattctgctgccgatttccatctttggcacatggctggagaggaggttcgattatggacggcgctgaaatactgctccagccgggcgtattcccacgtctgttgcaaggcctatgggtcaccgtgtggatagccggcgtatccgtaggcgcgtccatcccggtcggcctgttggtgggctggctgatgacgctgaagaaccccgtgatccgggccgcgatgcgcatctacctcgacttcatccgcattatgcctcagctggcgttgctgttccttgcctactacggttttgctcgatggttcgattggaatctcgatgccaccggtgcctgcgtgctggtgttcatcctgtggggaggcgccgagctgggcgatctggtgcgtggcgcattgcagtcgattcccaaagtgcagtacgaatcgagctacgtactggggttgagcccgtggcaggctttctcccgggtgattctgccgcaggcagttcgccgtatgctgccggcatccgtgaacttggcgacacgtatcgtcaaaacaacatcgttggccgtgctgctcggtgtggttgaggtcatcaaggtcggccagcagattatcgacgcgaaccgattccaattcccgaccggaaccttgtggatttatggcgtgattttctttatgtacttcatcgtgtgctggccgctgtccattgtggcccgccgactggaaaagaggtggtcgaatgactgaacccgaaacgacctgcaagggtttcgaggtggatcatctgatcaaacagtatgcgaatgccgacaagccggtgctggacgacatctccttcaaggtggagcatggttcggtgctcgtggtgctgggtccttccggctcgggcaagtcgacgctgctgcgcaccatcgccggtctggaaccgattcagggcggcacgatttccatcaacgatcaggtgatcgataccggaaaacccggcacggaacgagccggacgatccgaccggtccagtgaactgcgcacccgtatcggcatggtgttccaaagctacgatttgttcccgaacaaaacggtgctcggcaacatcaccatggcgccggtgctcgtgcagaagcgagacaaggccgaggtggaggctgaagcaatccggttgcttggccgtgtgggacttgccgatcgcaaggactcctggccgcacgaattgtccggcggtcagcgccagcgtgtggccatttgccgtgcgctggttctgcatccggaagtactgctgctcgatgagatcacggcggctctcgaccccgaaatggtgcgtgaagtgctcgacgtggtgctcgaactggccaagtccgggcagacgatgcttatcgtcacccacgagatgcagttcgcgcgagccatcgccgaccacatcatcttgctggatggcgggcacatcgtcgaggaatcgtatgatgcgcaggcgttcttcgaacacccgcaaaccgaacgtgcgcagcagttcctgcacaccttcgaattcgagtgattcgattgtgccatatcgacgtatttgagaagaaatatcaataacaacaagagaaggagaactcaatgagtatcaaggttgggagatcattcaaagcactgattgccgcaggtgcggcattggtaatggcggcatccatggccgcatgcggtccgtccgcaggcaccccgagcgaagcgaagtcctctgacacaggcaccagctccggcgccaacgccaaggcccgcagcctcgacgagatcaagaagagcggcaagatcaagattgccgtcttctccgacaaggcaccattcggctacgtggacaaggacggcaagtaccagggctatgacgtctacttcgccgaacgactggccaaggatctgggcgtgaagccggaatacacgtcggtcgatccggccgcccgcgtggatgtgctcacctccaacaaggtcgatctggtgctcgccaacttcaccgtcaccgaggagcgcaaggagaaggtcgacttcgccaagccgtacatgaaggtggcgctcggcgtggtctccccgcagaacgcgccgatcaccgatgtcggccagctcgacggcaagaccctgatcatcgccaagggcaccaccgccgaaacctggttcgagaagaacgcgccgaacgtcaagctgcagaagtacgaccagtacgccgatgcctacaacgcactgctggacggccgtggtgacgccttctccaccgacaacaccgaggtgctcgcctgggccaagtccaacaagggattcaaggtcggcatcacccaccttggtgacgacgacaccatcgccccagcggtgcagaagggcaacaaggaactgctggacttcgtgaacgatgagatcgtcaaactcggcaaggacgacttcttccacaaggattaccaggagaccctggcaccggtgtacggcgacgaggtcaatcccgacgagatcgtggtcgaaggcggtgaggtctgacggacgggttccgtccagccgtttgaaccggatggggaactggattatatcgcttcataaccaacgcatatagcaacgccggccttcgggccggcgttctgcattacagtcatatatgtggcgcgggggagtcccgtgcacggatgacgcgacacgtaagggggtgcgcaatgaccagattcaatactcagctcgttcacggactgccggttgacgacaatgacaccggagcagtgaatccgccgatctacaattcgacgacatatgcctttgagagggtcgatgcgatgccccgctacgattacgcgcgcagcggcaaccccacgcgtgatttcctggagcggcagatcgcccagcttgaacagggaaagcgtggttttgcgttcgcctccggtctggctgcgatccatgcggtgctcagtaccttcaagcccggcgaccgtatcgtcgtgggagacaatatctacggtggaacgtactcgcagctcaatgagttcttcacccgttgggggcttgtggtcgaatcggtcaataccagggatgacgccgctttggagtccgcagtgcggggcgatcgcgcgaacggcgtcgcgcccgcccgggccgtctatttcgagaccctgaccaatccgctgctcaaggtcaatgacgtgcgcgccatctccgcgacggcgcatcgtcacggcgcattgtccatcgtggacaacacgttcgcgaccccgtacctgcagcagccgctttccctcggcgcggatgtggtgattcattccgccaccaagtacttggccggccactccgacgtcaatgccggtcttgtggtcgtatccagtgaggatctggccaatcgcgtgtacttcgcgcagaatcgtctcggtggggtcctggcgcccgccgaatgtgattcggtgcgtcgcggcatacagacgttggccttgcgtatggatcgtcagcaggaaaacgcgaacgccctcgcccggtatctgctcgctcacccattggtcaaatccgttcactatccaggattgcccggtgccggcgatcagcggctcgcagccaaggggttgaagggcgccggcggcgtgctgagcttcgaagtggtgcctggcgtggaccctgcggatgtgctcaacaacctgcacatcttccgattggctgtgtcccttggtgccgtggaatcgcttgcggaactgccttgccgcatgacgcatttcgaactgccccgggaggagcgtctgaaggtcggcatcaccgatgagctggtgcgtctcgccgtcggcatcgaggatgcgaacgatctgatcgaagacctcggacaggctttcgatatcgcctatgcccgatacagggaacgccacatcgactccgatgtacttggcgcattgactccgaaggtgttcgcttgacgtgatatggccgtatgtgccgttacgatggatgcgatgggaagccgcggacgaagcgcggcgcgcagaaaggacatggcatggccattgatgtgtacggcgccacatggtgtggtgattgccgtcaggcgaagaacacgttggatgagctgggtgcggcgtatatctggcataacatcgaagaggaggacggtgccgccgatcgtgccgtggccatcagcggccagcagcatattccggtggtgctgtacgatgatggctccttccaggtggagccctccgccaaggacatcaggaacaagctgcgggagttgaatctgctgactgactgattggcagggccctcttacggcatgaggcgtgtgccaccattggattggtggcacacgcctcatgcgttgttgcggttgtgtgtggaccgtacttacaggcttctgaatcgcgcctggccgatggtcacatcgaaggatttgccggcgggggcgtcgtactgcagttcggtgatggcgttgcattgaccctggacgaagcgccagacacgatgccctcccacatcgagatcgaaatagtgctcatcgggccggtcggcgtccccgccttccgtgagacccaaaccaaacacgtcggaccagtgcgcggccaccgccgcggggtcgggcaccgcgaaaatcgcgcgacgggtgtccacttcgcctatggcatgccggtgcagcagtccgccgctctcgtagcgggccagttgctcggattcgctcgcaccccaatcgatgacgaacggatagcgcaggccccgatcatcgcccttgatccagagcaaccgccagcgtatctcctcaccggcggccgtcgtgcgattgcccggaacgatatggccaagatcaaggcctttggccgtgagccgttcggccgcctgttcgatgccatgcacgtgcaatgccggacgatagaatcccacatactcgggcagcagctccccggcttcatggaatatcagcccatggtccggcgtctccgacaaggcttcctcgcggtcgtacaatgccaggaactccagatagttatcggcgaagtaggccaaggagttctccgtgccatgccccacgtgcttgccgccgtattgggaagtcagccctgcgtcggcgaacgtccgttcggcggacttgaggtcattcacgaattcgaccgtatggtcccaggtgaattgttgcgtcatgatcggctcccgtctttactttgcatcgccgccgagcgccgtggtgcgctcgaccgccgccagcaccgcggattgtatggatgccgcgaatccggttttgttcagggtatatgcctcggtgattcccactccgccgggggagttgttgatattgagcagcacttgaggcagcacgtctttctgtttgaggaattcggtgccgccgatgatggtgtcgagcgcgatggctctggccgcgtcccggggcagaccggccagcacaccggcatccacgtaggcgtcgatgaaatggtagacgatgttcggcgggtaaaaaccggtgattacgtcgataagtcgttcctcgacatacagtactttgccgaaagtgttgaggaacgcatccacgtcctcgcgtgccgcggccccattcagcgccacgccgctgtaaccgtaatccacggtggtgagtgtgttcgggatgatgcgggccacacgccacccatggccgagcccttgctcaagcttggcgatggtatagccggctacgatggagatcaccgtggtcttcgccgggtcgaaacgtcgcgccactgaagcggccacgccggcgacatcgtcttgcgggcgcaccgcgattaccacgatgtcggcatccggggcgtccgtcggtgacgccgtctcggtgttgtacgtggatgccagatattcggcgcgttcccgtgagatttcctcaacccagatgtggtcgaccggatatgcggcggccttacgtcgcaccgcttctatgatggcgctcggcatattgcctccgccgatgaaatacaggttcgctcccatcggttcacctcttctgatgatggatacggatgtatgtcagttcccgtaataccgcatggattcccgaaccgtcgtcgttccttccgaaatggcatataggtgttcttgataggcgcttcaaggatgcaatgatttcgcggatggataagacgctataagaaatgcctgtaatacgtgggcggcattccgcttgacatcggcatcgccgatgcgcttcgatgacggataacgttgcgaatcaggagaagggaccccaatatggtcaatcgtcgcgccgacttccacgccatcgtcaatcatcagtcccggacgccgtatctggttagcgcctggcagcatcttgtcggtcatgaatacggtgccgaggaattcgccaaggccaccatcgatttcgtcaatcgctgggattgggaatgggtgaagatcaatccgcgcgccatatactatgccgaggcttggggctctcggtacgatcgcaacgattatgccggattcgtgctgccgaagaagatcggcgccgcaatcaccgaaccggatgatgtgcgtggagtcaaggaactcgacgttcgtgacaatgagtatttcgccgaggctctggccgccgccgcccttatccggcatggccttgaggatcgtgccgtgctgcagaccgtcttttcgccattgtccgtcctgctgcagatcgccgatctgccgctgtacccgggtgacgattacgccaccgcgacgctccgcgtcgaagatctgatcttcaatcagcctggtgtcgccaagctggcgctcgccaacatcgcccgcacactcgcctcctatgcgcgtgcgttggttcgtcccgagtccgaaggcggagcgggactcgacggcgtgttctacgcgctcaccggcacggtgagcgagggttatttcgacgcgcaacgctatcttgaattctccgaaccatacgatcgcatcgtgattgacgcggtgcatcgcgccaacccggacgccgtggtgctgctgcacacctgtcgtgctgaatcccacccgaattggttcgacgtgaagggtgtggacctgctgcagtgggatcagtatcaaccgggaaacccgcaggtggatgccgacctgacggctgtgccggtcgccggtgccccgtacgacctgttcgcgccggacggtgacgtcgaacaggtgcgccgcgaattggccaagaccagcgcgcttcgtacgggcaaaccgtttttgctggcaccaagctgcacggttccgaccccggcgggcgacgaggcgctgcaggcattgagcgacatccgcgtgggctgagccggtccccatttacgcttcatgattattcgaatagagaagggaacatcatgaccatcaagacaatcatccgtacggcgatcgcatccgtggtcactgcgggaacactgattggcgtctccgcatgcggccttggcggggatgccgccagcggttccagcgacgacaccgtgaacatcggagtcatctatccgaagaccgggcaatatgcgcaatacggcaaactgttccagcaaggcttcgatctggcggttgccaaggtgaacaaggatggcggcgtcaagggtaagaagcttggtcttcgatactatgacacgcagtccgatgccaagcaagacgccgcggtggctcccaagatcgtgtcggacaagtcgatcatcgccgtggtgggtgactatgcctcgcccgcatcctcggccgcgtcgcccatcttccagcaggccggcctcgtgcattacggtttcaataattcggcacccacctttaccgataccggggaccacgtatggactccccagatcggtcaggacaagtatcagaagaccaacgcggatatagtggccaaaaaagccaagaagatcgcggtggtctacatcgagaacgactggggcaaacaggcctatcggtacttcaagcaggaggccgagaaaaacggtacccagattgtgtacgagtccagctatctgcccgactccaccgacttgtcgccgattctgattccggcgcgcgatgccaagcctgacgcggtggtcgacatcggctacgggccggacggcgctctggtgatcaataccctgcgcgacaagctggggtacgacggcctgtacttcggtggtcaggaaaccaaggagttcctcgatctcgccggcaaaaacgccgagggttcgatcatcaccggatccttctccgccaccggcaccaaggacgccaaggcccagcagttcgtcaaggacttcaaggccaagtacggcaacaacccgggcaatttcgaagtgaccgcctacgaggcgatcatcgatctggcctatgccgccaacaagaccgaaccgacccgtgaaggcatacagaaggcgctgcagaccgtgacggatttcccgctctaccagggcaatggcggcacgttcaaattcgatcggcagagtcgtcgcgccgataacatcgatccgattctgctcatcgtcaaagatggcaagttcgaacaatacgaaggttgattctccgggctttcccatacaccacgaacgaggtaacgcacacaatgtttgatgttcttttcgccggactgatacacggcagcgcctatgcgctggtcgcagtcggcatgtcgctgatcttcggcgtcaccaacgtggccaacttcgcccaaggttccatcgtggccgtgggcatgatgatcgcctggtggctcggttcgtcatggggatggggaatcgtgcccacattcgtggcggtgctcgtggttaccgcactgctggggctgatcatgaacgtggcgatcatcgctccgcttgaaggccgtaaaccgattgcggcgctgctcgccaccattggcgtcggccaggtgctcgacaatggtctgcaggtcgtcttcgggccacagacccgaccgttcccgaaactgctgcagacctataacctgcaagtcgccggcgtgcgtttcggcacttcggacatcgtgatggtgacgcttgccgtcctctcgatgcttggcttatgggcattcctcaagttcggcaaagcgggacaggccattcgcgccacttcccaggatcccgaagccgccatgcagatgggcatcccggtgaaggccatccgtaacctctcctttgtgatcggtgccgtactcgccggcgtttccggcatcttcgtgggcttgttcaacggcaacatcaatccgatgaatggcggcaccattggtatgacggcgttcgtggcggccacgatcggcggtctaggctccatcccgggagccgtggtcggcggtcttgtgctcggtgtggtggaagcgttcggcatctctctgttcggagacggtgcacatgacctcatcaccttcggcgcgttgatcatcatcctcatcgtgaagccgcagggtctgcttgggccgaagaccgatgtcaaatccgagccgctgaccggcacgttcctgggaggcggcagggcgatcacgctgccctggtggggtaatctcatcggtgccgtggcactcgtatccaccccgttcttcttcaatgactacctgtccggcgtgggcactcaggtcgccatctatgccatcgccgccgtgggactgacgttgatttccggctccgcgggccaaacgattctgggcatggcaggaccgttcgccgtgggtgcctatgcctccgcgattctggccacgcaggcgcattggcccttcctggtggcgttgcccgccgcaggtgtgatcgcggcgcttgtcgcctcggtgctcaccttccccgtatggaggttttccggccattatgtcgccatcgccaccatcggcgtaggtgcggtgatggtggcgatcattcgcctcgccgagccgttgaccaagggttctcttggcattcagggcattccgttcccgaaggtgttcggcgtcacgctgtacacgcagcagatgatgtatctgcttgacgtgatcgtgctgcttgtcacgctggtcatcgtcatgcgtatccgaaccgctcatctggggcgcgtgttcgaggccgtgggatcggatcgcgaggcttcggaggcgctgtccatccgcactggcgcctataaggcgctcgcgtatgcgcttgccgcgtttttcgcaggtctcgccggttcgttgctcgcgcaccagtacacgtacattgatccgacgatcttcaactcgaacatgtcgattctcatcctgaccatcatcgtgcttggtggtatgaactctccgctcggcgcggtgcttggctccatagtgctgatcggagcgcccgagttgctgcgtttcgcttccgacgcgcgcatcctgctgtatggcgtgctgctggtgcttgtcatcttgttccgtccccagggcctgttcgcccggaaaggctgagtcgccatgaccgattccgagaccgtattttccaccgtagacgccgtgaccggcatcgatatcgacaacgaacgcctcgataacgcggatgatctggctgaatattccgaaagacaccgccaggccgtccttgacgcgccggtgatgctgcgcgtgcgcgagctcgacaagtccttcgaggggctgcacgccgtcaacaaggtctctttcgacctgcatcaaggtgaggtcatttccatcatcggcccgaacggttcgggaaaatcgaccacaatcaacctgatctccggttttctgcagcctgattccgggctcatcgatcttgccgacgagccggttgccggtctgagccctgcggacatgtctgaacggggactgctgcgcaccttccagaacggtcgtgtgttcggcggtcttaccgtcgaagaaaacatcaatctcggatatcaccggcgactcgtcgcggcacgcccgttcaaaagcctgcaaaggtatccgatcgcgcgttggctgtcgttgctcgccgagaccggcgtggcgctggttcccggaccgcggactcggcgcgaagccgatgaggtgaacatccgcgtggatcgggaaatcgaccgtttccgtgaacgactgagcgcgcgtcgacgggattgcacctacacgttgtcgtacgcgaatcgtcgtcgtaccgaaatcgcccgtgcccacatcagcgaaccgaagatcctgctgctcgatgagccgaccgccggcatgaaccagtcggagaccgccgaagtgcttcgtcaactgcagtatctgaaagcgcagggacataccatcctattggtcgagcacaagatcgatctggtcactgcattgtccgaccgtgtgcttgcgatggatggcggccgcgtcatcgcgcaaggcgccccggatgatgtgcgcaatgccccgcaggtggtcgaggcgtatctcggcaagcggcgtgaaatgaaccatacccgggtcgccgggcagtcgcatgtgcttgcgatgcagaactccattggcgccgtcgtcgaagtcgaggacaccggtgccggtaccggacgagatgaaaccgggacgttggatgatggcggggatgccctgcttgcgctcgatggagtgaatgtgtattacgggcaggtccacgcgttgcagaacgtgtcgatctgcgtacccaaaggggccatcgtctctctgctgggaggcaacgcttccggcaagtcgaccacgatgaagacgattttgggcatcaatcatccgaagaccggttcgctgtggttccaaggcgaggatgtgaccggactgtccacgcgcagacgggtccaagccggtatcgccgccgtgcccgaggcgaggcgcgtgtttccgcagatgacggtggaggagaatctgttgtctggcgcctatacgcgacacgacagggagggtgtggccggcgatctggaagccatgtacgatcgcttccctcgtttgaaggaacgtcgtatgcagcaggccggcacgatgtccggcggcgagcagcagatgctggcgttcgcgcgagccctgatgagtcgcccgaaaatcatctgcatggacgagccgacgatgggcttgtctcccaaactcgtcgaagacgtactcgaacagatagcgcgactgcgtgacgaattgggcgtttccgtgctcatggtcgaacagcaggccgagctggctctctcgatcgccgactatggttatgtgctgcagaacggacgtatccggctgcatggcaaagccggcgacctgctcggcaacgagcgggtgcaggaggcgtatttgggaggagtgaaacaatgagcgaagccgaagggattgagacgtcctcgcatccgtccgtcatcgccgtcacgcaaaggaggttccggtgaccgcagcaacaacccaatcgggcgcatccccgacggcgttcgtagcacttcccgatgctctgaacgctgatgtgcaggaatggtaccgctggttccatcgtcatcctgaactctcctatgaagagttcggcaccacggcgcgcatccttgagattctggaatcgcatggcgttgaaatcctcgaatcgggactcaggaccggcgtggtggccatcgtgcgcggcgcaagcgccaagcccgtcatcgccctgcgcggtgacatcgatgggctgcccatcactgagaataccggacttgactacgcttcggataatgccggagtgatgcacggctgcggtcatgacttcaacctcaccgtggcgttgggcgcggcgattctgctcaatgaacggcgtgcctcattgcctggtaccgtcaagatcatcttccagccggcagaggaaggtcgtgctaccgcggagcgccccacgggttccgtgcaggtgctgaacacgggtgtgctggacgatgtcgaggcgtttttcggcacgcacgatgcagccggaccggttgggtccatactcatacgtgagggtggcatcaccggcgcggtcgacaaattccaggttgccattcacggcaagggcgcgcatgcagccgaaccggaggatggcatcgacccgatcaccgtgctgacgaacgtggtgcaggggttgcaggcggtcattgggcgcaatctcgaccctagccatccgcgggtgttgtccgtcacccatatagaagccggcaattcgtggaatgtgattccgcaggatgccttcttcgagggcacggtgcgcactaccgagccgcaggatcgggttctcgccaagaagcgcgccatcgccatcatcaacaacacggccgccgcctacggtgccactgccgatgtctcgtggttcttcggatcgccttccgtgttcaacgacgccggatggacccgcatcggacgagaagtcatcgccgagcaggggcttcacgcggatgatgatcatcctcaactgggaggagaggatttctcatattaccttgatcgcaagcccggcctgttcgtgcacatcggtgccggtgagaccggtgccgcgcatgggccgacgttccggccgaatccggccgccatcggctacggcatacgctttctcacggccatcgcgcagaaagcgctcaacgagttacgatgaacgcacccctcctatcattccggttgataccgaacgataagaaatgcctgtacccgcaagcacgtgttacggtgcttcgcttcctacactggtgccgtatcagtatgggcgtccgtcggtgttcccctaagggacggcggcatgacattgaggggataattcatggcgagggatttcgttaccgcggctattcacggcggctatgaccgggcggctcacggtgaggcggcgaacccgccgatttacgccagtgcggcgtttgacatggtcagcgccgcgcatggtgacgcgctgggtgccggcgaagctgagggcttctcgtactcgcgtgtggcgaatcccactgtggatgtgttcgagcgtcgtttggcggaactcgaaggtggtgtgagcgcggtggccgtcgcctccggcatggccgcggtgtcgtatgcgctgttgtgtgccgccgaaggtggtggtcgcatcatctctccgaccaacctgtacggcgcttccgtcgatgccatggagaccttcttcccgcagttcggagtccatgccgatttcgtgcgcgacatcaacgacctcgatgaggtcgcttcgaagatcgggccggacacccgtgccatctacaccgaatccgttgcaaatccatccactgaaatcaccgatattgaaccattggcggaactcgcgcatcgcaacggtattccgcttatcgtcgacaataccgtgcctaccccgtacctcttccggcccatcgagttcggagccgatatcgtggtgcattccaccacgaaaggcatcaccgggcacggcaacgccatcggcggagtggttatcgacggcggaaacttcgattgggccaacggcagattcccgcagttcaccactcccgaactggtcgtcagcgatgaacgcaaaggaatagcgcgcagcttcgccagcagattcggccgcgaggcgttcattcgccgtgtacgcatcaaatatctgcgcactttcggcgcggtgcccagcccgttcaatacatacctgtcgatggtgggattggagacactggctgtgcgtgaacggcaggaagtcgaatcggccatgcatattgccgagcatctcacgcatgcgccgcatgtgctcaaggtcaattattccggtttgggcaacacgggtcagtatgatctggtcgccaaatacttccccaaagggatcggtacgatactgtcgttcctcgtcgacggcgatgagaacaacgtgagacgcattctcgacggaaccgaggtattctcctatgtgccgaacatcggtgacgcgcgttcgctgattgtcgatccggcgcgcatcacccatcgtgaagtgccgttggaatatcggcatgccgcgggcgtaagcgacaaccttatccgcctgtccatcggattggaaaacgtcgatgatttgattgcggaccttgaccaagccattgccaacgcatactgacgtgtatcgcttacgtatgcggataattgttcgttctgagaaaaacctgcgctgttattcttgaggcgttgtgaatttgggttgttgtattacgaaagaaggagcaggacatggctattgacgtctatggcgcaacatggtgcggtgattgcaagcaggcgaagaacacgcttgaggagcttggcgccgaatatacgtggcataacatcgaaaccgaggatggggcagccgatcgtgcggtggccatcagcggccagcagcacattcccgtggtgctctatcctgatggcacattccaggtcgaaccgtcggctgtggatatcaagaacaagctcaacgagctgaatatcaagtaaagacaagagttgtacgagtttgacgatctgctgcatctgtgagcgaacaatacgtcggcgtccgatgtgttattcattggtgtgaatagcactccataggcactggatataaccacgccgaaacacaggtgagcaagcgcgtctacggtaagggattgtgcttcgcgaacgaacgttgacgtgcataacagcagcgaaaagagagtatcgggatgattcggattaggggagtgagcaagagctttgccgacaccaccgtgctggatgggcttgatcttgacattcctcgacaaaatgtggttactgtcatcggcccctcaggctccggtaaatccacactgttgcgcattctggatttccttgagcacgcggattccggtaccgtcgatttcggtgatggtcttgtggatttgaccactaccaaatctgccgacattcacaaggtgcgttcgaaaatcgggttcgtgtttcagaactacaacctgtttttgaacaagacggcattgcagaatgtgaccgaaccgttggtgtattccaagggaatcaagcctgatgaagcccgcaagatcgctattgagcaactcgatcgtgtgggacttgccgattttcatgatcggtatccgagcacactgtccggcgggcaacagcagcgtgtgagcatcgcccgcgccgtggctatgaatcctgagctgttggtgcttgacgagcccacttcggcattggatccggaaatggtcaacggggtgctgggggtcatcaagcaactcggtagcgaaggcatgaccatgctgatggtcacccatgagatgcggttcgcctatgaggcatcgaatcatgtggtgttcatcgaaggaggccatgtggtcgagcagggtgatccgaagcggatcttcgaacatccgcaggaggagcgtaccgtcgagttcctgtcttcaaccaacaatgtgctgatgattccggtgactcggtagaggcgtttcacggctgttgtaattaattgtgacaatatcaagagaggggtttgtcatgttcaataatcaagtgattcgcaaggctgcggctttgctgtccggtgtcgccgtgctggtttcggttgccgcatgcggttcggcttccgcttccagctccagtgcattggagcaggtcaagcagtccggcaaaatcgtgttcgccactgagggcacttatgctccgttcagttaccatgactccaaaaccaatgagctgaccggttacgatgtcgaggtggccaaggccattgccaaggaggtcggtatcaaggccgagtttgccgagggcagcttcgactccctgcttgccggtgtggatgccaagaagtacgatacggttgccgatcagatttccgccaccgacgagcgcaaggccaagtatgatttctccgaaccatacacctactcctacggtgtcgtcattacctccaaggagaacccgaagaacgtcacttcgttcgatgacgtcaaggggcttcgcgccgctgaaaccggtacctccaactggaacaagaccgctcaggagaagggcgctactatcgttcaggttaacgattttggtcagcaggtcgatgccatcacgtccggtcgtgcagatgtgtcattgaacgatggccttgctgcgctcgactacctgaagcagaagccggatgcggacatcaagattgccgccaagtccgagaagactccggccgcctacctgccgttccgcaagggcagcgatgacttggtcaaggaagtcaacaaagccattgtcaagctgcagaaggatggcacattgaccaagatctccgaaaagtactttggcgaggacttctctcaggagtgacatgtttcccggctctcctgtaattaggggagccgggaaatatgagctggcctcgtgaagattacgagcaggtgcaacatataccacacaacaaaggatgaccaatggacgcacgagtatggggaatagtcgtagattcctttgctaagctactgattcccggtatcactgtgaccattccgctgacgctgatttccttcgctctcggtttgatactggcgattgtggtggcgctggtgcgtgtggctaaagtacctgtggcctcccaaatcgcgtggttctacatttgggtgtttcgtggtacgccgttgctggtgcagttgttcgttatcttctttggattgccgtctgttggcattacgattccggcattgccttccgcggtaatcgcgttctcgctgaatgtgggcgcctatgccgccgaaacattgcgtggtgcgattcttgccgtgcctaaggggcagcttgaagctggcttggcggcgaacatgccgtatgtgacgattatgcgccgcattattctgccgcaagcattccgctccgccttccctgcattgttcaactccttcatcgcattggtcaaggacacgtctctcgcggcgaacatcaccgtggtggaaatgttcatgacggcccagcgcattgtggcgatttactacgagccgctggtcctatacattgaagtgggcttgatctacttgctcttctgcacgttgcttggatggcttcaggattactgcgagaagaagctcaacgaacacttctgatgtgtttatatggcggcagtgcttgattcaagtcgggtgtttccttggttgaaatgcccgactttgttgtttctgacgtgcgacttggctgcttcaaataatagtgcacaagatgtggatgccggagtgaacggaacatgaaatctgacgttcgctttcttggacttgcctgtgagagctatcagttaccgggcgtgcgctggtagcatggatggtgttggggcgcggcacaacgatatgccgtgcttgacccttgtgagaggagttttatatgaccatcgcaagtatgttgggcggaaccatgctgttggtgctgattctattagtcgttcttatcgtgctgctggccgccgcattgttcatcgtgccgcagcagcaggcgtatatcatcgaacgtttcggcaagttcttgagggtccagtttgccggtatccatgtccgtatcccgttcgtcgaccgcatcgccatgaaaaccaacatgcgtgtcaaccagcttaacgtgcagctggaaaccaagactcttgacaacgtgttcgtgaccgtcgtggcttccacccagttccgcgtgaacccgaacgacgtggcaaccgcctactacgagctgcgcgacccggccggccagctgaggagctacatggaggacgcgctgcgttccgccatcccggccctaaccttggatgacgcctttgcccgcaaggacgatgtggcgttcgacgtgcagaagacagtgggcgccgaaatgagccgcttcggcttcaccgtggtcaagacgctgatcaccgccatcgacccgagcccgcaggtcaagaacgcgatggactccatcaacgccgcccagcgtgaaaaggaagccacccgtcagcgtgccgaggcccagcgcatccagatcgagacccaggccgccgccgatgcggagaagactcgcttgcagggtgagggccaggccaactatcgtcgcgagattgccaacggtatcgtcgaccaaatcaagagcctgcaggctgtgggtatgaacatcaacgacgtgaacaacgtggtgctgttcaaccagtatcttgacgtgatgcgctcgctgtccgaatcaggcaatgccaagaccgtggtgctgcccgcctccacgcccggcggttatcaggatctctacgagcaggtcaccaaggccatgctcaccgcggccgagacgaagtaatcaccccgtttgcaaatcctcatccatcgatagtgaagcccctccaagcgaggggcttcactgcgttccgcgctgattccgacaagtgcgcaaatgggccgtatacagattgtgacaagtgtgagaatcatctacttatagattgtgacgaatgcaaaaataccccgaattcaatttgtaagtgcaacgctcgtctttgggtggcttgtcttcgggagtaccttgccgagttcgcggtaccaaacctcgttgggtgtttcccagtccaggaccttcatgggggtgtcgttgatctcgtccacgatggcctgcaggtcggcgtccgtcaggccgtcgaaaccggtcctcttgggcaggtagcggcggatgcgcccgttgcggttctcgttcgtgccgcgctggtacgaggagtacgggtccgcgaaataggtcagcatgccgagcgcctcgtccacgagcacgtggcaggaggactccgtgccgttgtcccaggtgcggtcgatcctcgcgggcgcggggatgtccttgtagatgtcgtattcggcgcgcgccgtggccggcgcgctcttgtcggggatgaaccgggcgaacagcctgcggctcctgcgttcgacctgcgtgtcgatgcaccgcttcgacggggaggcgccgatgaccgtgtcggactcataatggccgaactctcggcgcgagtccacgcgtttcggacgttcgccgatcggctgtgtcctcagctcgtcgatccggacacgttcctctgccgacaggtgggaatacactctcatatcgagcgcgacactttctctctggttatgaacttgaacacttccagccatggagcaggtgttgcgcttctatttagaactcgtgcggtctatcattacatattgtggggaggtgtcgtaaatgccgattgtcgcgggattccggccgttttgtgatgcggtggcgacatcgtggcggacgagtgcgtatgcgttgcgtaggcgtccggtgcgtacggtggtgatgtggctgtcgatgttggtgatgatggcgatgccgtcgttgcaggtgtggctgatcggttgggcgtgcggcccggacgggcttggtatggggtcggggctgggcgtgggccggttcgcggtgatcctggcggtgctgacggtgggcgcggtgttgatgtcggtgtcgtcgtcgttggcgcagaacatgcgtgacttgttgcaggagccattgatggccgaataccagtccgatctgaccgacgcgctggcgcgtctgactcccgcgcagacgttggacgacgaggtgacgacgcaggtgcgggccgcgcgcgacgcgatcccgtacaacgtggcctcgcaggccgcggacgcgacctcagtggtgggcgcgctggcgtcgatggtcatgctggccgcgtccttgtggcatatgcatccgttggcggcgctgatgatcgcgttggcgatggtcccggagctgttggcccagttcggcgtggagaagctcacgaacgagttatggcccaagcgcggcagggagtcgcgtcgggcgaactatttcgagcggttgttggattatccaccgtcgagcacggagatcgcggccacggccggttcgttcggcatccctgcgcaggcgcgcgtacgctatttcaatatggccggcatgtgggagcgtatctcgtggcgcacggtgcagttgaccggtgtgagttcgctcgtgttcgccgtgctgacgggcggcgcgttctggctgatcctgacgtccggccatgcgtccgtgtcgagcatcccggccgcgttggtgggcatcatgacgggattgtcggtcacgcgcaccactggcgaggcgttcggcaacctcatggcgtccacgccgatgatccttgcctacgaacggctcatggacctgctgcgcgcgaaccccgcgatccccgagacgaccggtccggtcggcgtgcacgtggagcatctgacgtacgcgtatccgactgttgcaaagcatgacgatgacgcggatgacgcgtcggcagcgtcggttccggccgttcagactccggcgttggacgacgtgtcgttggatgtcgaagcgggatcgatcgtcgcgctggtgggcgagaacgggtcgggcaagaccacgctcgtcaagctcatcgccggcatcctcgacgccccggacggcaccgtgaccctgtcctcgggcgcggacggcgggaacggccgtaccttggggtcgtgggccgaacggttgggcgcgtcgagcatggtgttccaggatttcacgcacatcgaggtgaccgtgcgcgagttcatcgatcccgctctgcggcaatcggatgatgagttatgtgacgggttgcgtcgcgcccgcgcgctcgacatcgtggatgggcttcccggcggcttggatacgcagctcggtcaggagtggggcggcgttggcctgtctggcgggcaatggcagcggcttgcgctggcccgcacgttcctgtccggcaagccgttgtggatactcgacgagccgaccgccgcggtcgacgccaccgccgaggccgcgatctaccatgatctgatcgccaaccgtccggcgggcaccactgtgatcgtcatcagccaccggccccgcgtgctaaccggcatggaccggattatcgtcctcgaccacggccacgtcaatgaaaccggcacctaccgtcaactggtcgacagcaacggcaccttctcccgtctcgcacacgacagcctcgaatgagctcgatggcatatccggttgattgttaaaaactcagtggccggccgacagattcgtccgacgaggctcgcgcgagtgatcatagcgcgggtcgcgtcggacatgcgggagatggcgcgccttatatcaaaagcgatgattttcgaataaggacacggccccatcagccggtcgcgggtactacagtgaaccacaacgttcctcccccgatggtttggggaaacacagaaagagggaggaacgattccaggagcattcgctccgttgccatgcagcagtaaggggaaattcatgactgcatcaaccaccgcggtaccatcaacggtatccgccagcaccggaaagtccggtagcgcaacaaccaaactcagccgcacgctgggcgccgccctggtctgggtggtgttcggcgcggacaactcgttcgccgaaaacgagaaattcaacgtgtccggcgatctgtgcctgcaccttgacacttccgcttctgcattgcgtgccgtacgagcgtgaagcggcgtttctctgctcggtgcatgccaacgtatacatggatgtcggccttgccaatccgcatatgggagcgcaggtgagggaagtgctgcgcaatgttctggcgtggtgcccatttgacaagttgctctatgcgtcggacggcgtcggcatcagttgaattgcattatctggccgcggtgctgttccgcaggtatattgcgcgaatcgccatcgattgggtatcggatggcgcatggaacgcgaatcaggcgaaacgggttatcgacgccatcgcgcatgccaatgcggaatggctatacggtttggcgtgaacgggtacttcgccggtgccgtcacttcccgaggaacgccgggatggcttcagccgccgcgtatcccttgcggtacatcatttccaggccctcgaagttcttcttcagggtgttgagaccatacaggtcttcgggtgcgaggatcagcactttgccttccgcctcgtaatgcttggcgagttcgagttcgtcgttgtaggtcttgtagcgcatgcgcagcttctcggccgcggcggggtgggagcgttcgaggatgcgggccggagccaaatccttctgctgcttgcgcacttcgtcacgcaagcgggacagaatcagaatcacgcgatcatagccgtcatccagcgccttctgtaccgggatcggatcggcgatgccgccatcgaaatacggcacgccatccaccacatacggctcgcaggccaccggcacggcggacgaagccttgatgatgtcgaaatcatcaaaacgcacgcgcgatttgtcgaaatacttggtcgagccgtcctcggcattgcaggccaccacggtgaatccggtcggattggcctcaaaggcctcgaaatccaacggattctcaccgtcatggttgctcagcgtgccatagatgtagtcgaggttggcgaagttgtggttcttgaaatagctctccgcgctcgcgtactccttgcggaaggcgtatttggtgtagaaggtgtggttgcggccgtgctggcgggcgatgaacgaggtcatattggccgcgccggcggaaacgccgtagcacatgtccacgtcgatgccgtcttccatcatgcgatccatcacgccgcagccgaaaattgcgcggaacccgccgccgacatcaatcatcgccgtctttgccataccaaccccctgttcacttgaatttggtatgagcttacgcgcgctgcgcggacagcgatatgggcagtgtgccgtgaatttgtctggttctttcttggctcatacgttcaacaatttgcgtgataactcggcaatccgttcggacggatcggaattggcaagctccacgccgccggtagcgccttcgggcgccagcttgcccagagattccaacaccacgcccaggtggcgcacggtgccctcattgccatcgatgacggcggcccgttcaggcagcagctcgcggaagtagtcgcggtaaaacacgaaatgcgtgcaacccaacaccaccgagtcgatgtgctccatgtcatattgatcgaagtagccgtgcagcgtgcgcatcaccagatcatggtcgccgagccgcccggactccacaatctccaccaagtcggggcaaggctccttgaaaatggtgttctgcgagtcgaatcgatccatgagtgtggcgaacttccgctcacgcaaggtcaggggagtggccgccacaatcactctctgaggaatatgatgcgggtcggaaggcacgtcaccacggtcgcacgccactttcagggccggctccatgccgatgatcggaatatcgtagtgttcgcgcaaatcgttcaccgcggcggaagtggcggtattgcaggcgatgaccacggccttgacgccttgacgcacgaaccgttcgacgatatcgaaactcagggccctcacctgctcaggcgtcttgatgccgtacggggcgttggccgaatcgccaaaatacagcacatgctcggccggcatatccttggcgatttggcgagccacggaaataccgccaagacccgaatcgaatacgccgattggagccgaagagctcatgcctgaatcctccctatagccatgcctgcaaccgtatgttgccgcgaaccgaacataaagccgattttcagcggtgttgtttcgctccctagagtactctgaaagccatgagtcttccgcaacgagtaaccaagacacacgcaaccggcaatgatttcgtggtgtacctcgacaagtccggcaaattcgagcccaccgccgatgaggttcgattcctgtgcgaccgtcacttcggcattggtggcgatggcctgattcgtctgacccgtcctgagttcgtgtccgacctaagcgatgaccaggtttcggctgtgctagccgggggcgcgaaatggttcatggactatcgcaacgcggatggatcgttggcggagatgtgcggcaatggtacacgcgccatcaccttgttcgcccaacgcgagggtgtggccgactccaccgagccgttccgcctcggcacccgtgccggcgtcaagattctcactccacgcagcaacacgaagccatacggagccaacgtcttccagatcgaaatgggggagtggaaggtcggcgaaaccgatgcctacgaggtcaccatccccggcactgagggctcggcgcgcggtacattcgtggatatgggcaacccgcatgtggtcgcggtgatcgaggatgccttcgcgtccctgccagtggttgaatcactggatttggtcaccaagcccgtggtggctcccgtcatcgaatccgatcagaacgtggaattcgtgcggatcgacgagatcgaccagaacaccggcgtgggcgaggccacaatgcgcgtcaacgagcgtggctgcggcgagaccctatcctgtggtaccggcctgtgcgccacaggcattgtgctgcgggccaagaccggcatcagccactgggacatcaccgtacgtggcggcaccctgcgcgtggacgtcaccgacagcgacgtaaagctgaccggagcagccacgctggtcgccgatatcgatttgttgtaaaggaatcaggcagcgaacagggccgcgccttcggtgacgatgatgagtaccacgatcgccacgatccacagtatgtcgaccatgaggtcgatgttgaggcgataatacttattgagtccggccggcaccgccgcgacatcggcctcgctgtcgctatcatcagccgccacagccttacgtgacggcaatccctgcacggccacggtcgcatggctcaacgccatgaactggatggtggtggagaacatcagggtcaggcaccacgggcacagcgcgtgaatcacgaacagcgactgtgtgctcagccagtacgagtaggccaaagcggccagtccgcccagccacgtgcaggtcgcgaaccaacgcggcaccttcacacgagccaaaccgatcaccgcgatggtaatgaacaccgattcggcggcgatgccgaagaacgcgttcggatagctcagcccgccgaacttcacgatttccgcctgccaggactgggccaccgccgaacaggacaccaccgagttcagatcgcagccgagcgcggactccggatgcctagccaactgcaaagtctcggcggacagaatgagcgaggcccccaatgccactgccgaggcgatcagcatgatgagatatgtccaagtggcactgtggcgccatccaatcaacggtcgcgtctccgccaagccaagcggcgtggtgttcgtggtgctggatgatgtgtcggttgcggtgttacgagtcatcatgcccctttcgatagcgctgcgctccagattagcctctgcggttgtcagctgagtgccgaatgtctggtcttggccgttggcagaaggtgacgacctgtctgcgccttgcgtgggaatgctgagatgaggttacgatggaaggtatgactggatatgtgatgcctttggagccgcccgccgtcgggtgggacatccattgccataccgtcttctcggatggcacggaaacgccggtcacattggccgaacaatccaaggcattgggactcaagggcgtggccatttccgatcatgacaccaccgccggctggccggaggccgaagccgcagcccatagggtcggtttgccgttgctccgcggcaccgaaatcaccgccacggatgagaacgtctccgtacacatgctcggctaccagtatgatcccacgaatcagcacatcacggacttgttcgccgatactcgagccgcacggttgcaacgcacgcagcgcatggtcgaattgttgtctcgtgattatccgattacctggcaatccgtgctcgcccaagtcaaagagggtggcaaaaccaccattggccggcctcacatcgctgatgctttggtgagtgccggcgtatatcggactcgttcggaagcgtttgcggatgcggtcagcgcctcatccaaatactatattcccacgccttcgccgacctctcatgaagtggtgtccgccgtcaagggagcgggcggtgtgattctgatcgcccatgccggtgatgtgagccgtaaccgcagactgttgtccgatgaccagatcgaggcattgatcagcgagggattggacgggctggaggtatggcaccgtggcaattcaccggagcaacgagaacggctgctcaccatctgccgccggcaccagctgctggtcaccggtggatctgactggcatggcaaaggcaaaccgaacaaactgggggagaacctcaccgatgaggccactgtcgaagagatcgttcatcgcggcgtgcttccgctatatcggtgattcggcaatagaaaagcgtcctcgaggaaatgctcaaggacgcttatgcgcgattcatggtcacagcgtgccgaagccgacggcgtgcttggtttcggagccgatgatcgcgtaaccgagtgccttggcgggcacgatgatgcgacggcccttgtcatcggtcagatcgatcgtcgcgttgtcggccacggcctgcgcgatggcctggctcacattgtcggctgattcgtcggtgctgaagttcaccggtcgtgccacgttctgaatgcccagttcgatatccatataaggctccttgtcctgccgtctttgtgacgaacatcatggtaagtggccgtcgccggccgaggttctgtactctattgtgccgcgtgtctgcgtcgtcatgtgcggtgttacgcgctcggcgtggcgcggaacaccgcacatgacattattgggatgatgcggatgattcggccagcggattgccctcgctgtcatacccgtccaacccggcacgggcatcgcgcagagcgcgttcttcccgctccagcagcggaatcaccgtggtttgggcactcgaggctccatgctgaacgagactgtccggagtatcgtcattcaccgcatcgtcggtcggggcggcggattgagacgcaggggaagcgtcggttgacgtcgtgccgctatgcccgttcatactgaggagctccttcagcgtgatcgtcaccgaagaatgggaagcgccatgtgagggctgcggtttggtcgatcctgtaccggttgcggtgccggagacactcgcttgcgggtgattggcggtccggtcagcatcgggttcgacttccggggtaagatccacgtcaccagcggccacgatgtcagcggaaccggtgcgatcggggtcgggcgtgtcgtccgagacctcggccgccgcggtaccggtgtcggactgctgcggttgtgcgggtgcctgatggcggtcgtcctgcaacaatgtgccgacggtgattgtggaaggcgaaccgggcttcgtcgacgcggcggcggccgaccctgcggctggggccgatgccggagtgtgcttgatcacgcccaactggtgtgcgagtcgttcgacctgtgccttgaactgcatgatgcgattgttgtccgcacggttcaacgcctgaatgaattcgcccacctgttccatctgcagccacaggttggccctgagcatgatgagatcgtcaagtcgagagcccatcatgcggccgtatgcggagagcacggcgttgcgatgggattcgtcgagcttgccgaaaatccaggcaaggtctcgtgccggatcgttgacctgcatatcctgccagttggtcaccgtggtgatggtggaaccggagaacaggaagtcgccgtcggagaatccgccgtgaaccgtgcaggtggagaacgaccatagtccctcggtgtccatgatgcgcgcccagctgtcggtgatttcttggggaacatggccggcggagcgtaagcggcgaatccaggcggtcagctgcgaacgaatctgaccggtggtgactaccggatatttggcattggccagaaaagtcgaaggcagacgatgaatggctccgatggaggtgccgacggccgcgcagtcatccaatgtcaacaggtcgagaggacgtgcctgaccatcacggtggacggcgatcatcacggtcgtctcgcctgtgggaccgggcttgcgcggggtcaacggtgtggactccgcctgggcctgctgccccacggcctgtgcggtggccgtctggccgggttgggaaacgtctcccgggacgaatgcgaccacacggtccatatcgaagccgaggccaccaagctcgcgcgcggctgccagtgtctgcgccgctttcacacggcgaatcagacgtgtacgcccttccttgctgtcagtggcgtatacgtcgtacaacttgcccgaggcatcttggatcacggtctgatcgatgcctttggcctcgtcggttgcgctggcctgcacgttctcgcgtacaccggccacccccagattcggcaggacggctgaggcgagtgccgccaacatataatcgctacgtttcatcacccttccacactaatacatccgtggcgattcgcaccgcagaatgacacgcaaaacgcatgattctggcgatgttttgtcgtgagcccgattcagccataggcgtgagtcgtgccgtgagcgcgaatcgtgccacaatggacgcatggaacaggcgcaggggattcttgaggggctcgatgagcggcagcgtaccgccgcgactacgttgcaagggccggtgcgcatcatcgccggcgcaggtgccggtaaaacccgcgcggtcacgcggcggatcgcctatgcctgcgccaccggggcatggaagccggagcgggtgcttgccgtcaccttttcggtaaaagcggcggcggaaatgcgcgcacggttgggccagctcggcgtagggggaggtacaggacgctccggttcgggtgcgggaactgccggagtcacggccgcgaccttccactcagcggcattgcatcagctcaacagcgtctggtcagacatatgcgaggctccattcccgcatgtgatcgaagatcagcgtgacgtcgtctcccgcgcgatcatccgcgccaccgcacgtaccgatgccgatccgctgaccgttcgcgatgtgctcgccgaaatcaattgggccaaaatctcgttggtggcggtggaagattatgcacggacctgtgccatcgcccataggcaaccgcccgccggactcgacaccgctcggttcgccgacgtctacagcgcctacgagcaggaaaagacctcgcgtggcgaaatcgattttgacgatattctgctgctcgtatgccatatcatggatgattttcccgaagccgccgcccaaattcgttccaccatcggctggctcaccgtcgacgagtatcaggacgtctcgcccctgcaacacaggctgctgaccctgtggctgggcgggggaggacctgacggcaagagcgcgatgaaccgcaacgtatgcgtcgtgggcgatccggcccagaccatctactcgtttgccggtgcctccagctgggatctgctgcgtttcgccgatgaattcgggccgctcgccgccgatgtcaatctcaacaccgactatcgttcgacgccggaagtcgtgaacctcgccaaccgggtgcttgcggccgcgccgaaccgtgaggattacctgaaactggtttccgcccgcgaatccggcccgcgcgttacccgaaccgcttatgagagcgatatgaaagaggcgcagggcgtggcggcacgcatcgcccggttggtcgccaacggggccaagccgtccgattgcgcgatcctcacccgcatcaacgcccaacagccggtattcggtgccgccttgcgcgctgcaagactgaaataccgcgtccgcaaggattcgggatggcaatcatccgcgctcgccgacgatgccgcgtccaaacgcgcactattggaggcgatgggtttggacgccaccggacttgccgcaaacgacgatcccggcgttacgatttccacgatccacgcatccaagggtctggaattcaagcacgtgttcctgatcggctgttcggaagggctcttgccgtacggttcgccggaaacgggggatgcgctggaagaggaacgccggcttatgtatgtgggcatcacccgagctgaggattcgctgcatctgtcgtatgcgcggaccaaggatggttatggagcgcaacacagacgcccatcacgatttttgtgacgggcgtcgttcatgcatactgaatgctcctgaacattcaggagcgggaattggctgaaggccggttgactatgcctgcgtatcctccgagttgccgttttcactgtcttcgccatcttcgccgagcagcttagacagttcggcatcccaatcgatatcgccggtcttgccgtctgcggcagggtgggaagcggaaccgttggcatcggaagaggagcctgaaggggcgtcggacgacggagacgcgccaactgcgggcttgtcgctaggcagcgaaggcagcagatcgggatgcgaccacttggcgtcacggccttcagggccttcggcggcggtgatcatctcccacaatccggcggcctcgcgcatgcgcttggggcgaagctgcaggccgagcagactctcgaacgtgcgttcggccgggccgcccatcgcccgttctcggcgcagcatctcccgcaactgttcgatatgcggcaggtgggccatgccggcgcgccacaccacgcaatccacccagccctcgaccatcgccagcaacgattccagcgaagagagcgcctcgcgctgttcgggggtgtcggggatgccgaccttggtgaggttcaccgcgccggagatcgactccggatccatcgacgtggcgtcacgcagctgttcctccatcgcatccaggtcgatggagatgccgcgtgcgtacttgccgatgagcgcctcgaaacgcggcatcagccacggtaccgaggcatacaggcgggcgtgagccatttcctgcagggccaggaaggaaagcacttcagattcggggattttctcggtggtctcgaatccggagagcgcagcctcgaacgcggcggcgtcggcggaggcgtcggagccggagacttgggcggtaccgtcagttgccggagtatcgctgttgccggccgaagtgaagccaatgggattggcggaagcgtcggtggaggcggagaacggattggtcgcgtccaccgaagtgccggccgtgtcggccttggccgcagaagcctcaccgttcagcatcctcgcgtattcggtggcgttctgggcaatcagtccaccagccggattcttcagcaatgcgatgccctgatcgaaactgccatgcacttcatggctcagattgccggccgcatgccccagctgcatggcaaaggacgtgtttcccagcagcttcatcagttgggctgggtctttcatgccgtcgggaatcggaatcggcaccggtccggcgaacatgccggcgatctcgccatcgccgaacgcgccgccaagacgctctgaaatcaccgaagccaaagcgtcgttcatcgactcggccacaggagctgcgaacttcgcccactggtcgatggtgccctccacccagccggcgcgggtcagcacatccggatcgccgggcgcgggattgaactcgcaggcggtatccagccacaggttcgcctcactcatcgcgcggcgagccgcctcgccatccacggcggacacgctggacgcggaaccggaggtgttggcctgctgcaaggcaatcgacttggcgagcttgacgttgatcggcccttcctcgacagtgcgctgcatatcgcccatcgtgttgagtccgccggcgctgaacgcggccatcatctgctggacttcggatggattgggcagccggctggggtcctgactcatcagctgttcacggatctcctcaggcaactggctgatctgctgccaggccatctcaccctgaatggggccgaagcatttgatcagccactcgtgaatcgcgttgtcgtccatgcgtatccttctttgccgcggtgtgttaccccaagtgtagggtctgcccgggcctgttcgcttgtggccgagcaatattttcggtttatgttcgttttcggctgatttcggccctccacttacactgtagggtatgtttgcacgccacaggaatcagaaaccagacctcgtccaagagcagaagagcccgactgcggattcggaagcgggggatgagcacatgccatcgttcgaagtgaagcacgattcgcgcctatctcgtggaatcagccgtgctcgggcctatgcggccgctcgtccgaaacgccatttcgtcggtgcattcgccgtgttgcttggtgtggtgattctgctgctgcccagcccgtacgtcatcgagatgcccggacccacccaggacgtgctgggcaaggtcgaggatggtgcggttatcgacatcaccggtaccggcgtgacgacgtataaggattccggcaagctgctgctgaccacggtgaacgcgtccggcgtgcccgggtacccgatcatcaacgcgcaggccgtctggggctgggccaatccgcaggtggaggtcatgccgcgtgaggccacggtaccggtgggccagagtgcggaccagtatcagaagaaagtcgaacaggacatggccggttcccaggattcggccagtgccgtcggtctggcgcatgccaaagcccatgcggacgaactgggcattgacgccagggcattgcaacacgccaaggtgacgatgcacgtggacagcatcggcggaccgtccgcaggcatgatgtacacgctcggtctcatcgacaaactcacccccgccaacgagagcggcggcaagaccatcgccggcaccggcaccatagacaaggacggcaaagtcggcagaatcggcggcatagcgctgaagatgcttggtgccaagcgcgatggtgccacatggttcctggcccccgcgtcgaattgttcggatgtggccggtcgcgtgccggatggtctgcgcgacgtcaaggtcgccacgctggacgaggcgtatcaggcgttggtggccatcggcaaggggcaggccgacgatttgcctcattgcgaggcatgacacgcgcggccagtcgttgtttctggtgagacgactcgcatgggtctgcccacaatgcggcgattttcggccgcgttaacgcatttgttcgcgaagacttgctaatgtgtcccctgtgaatcaaacggcatcacagaacgctgaagaatttggtttcgagcccggcgatatcgtccaggagtggctctgggacgacgatgtggacgattccattcgtgcccagattgaagagctcacgggcgaggatctcgtggacgaggactacgactccgctgtggacggcgtcatcgtatggtggcgcgacggcgatgatgaggacgaattgtccgatacgatcgttgacgcctacgcggtactgggcaatgacggcccgctgtggatactgactcccaagcccggccgcccgggtgccgccagctcctccaccgtgcagtccgccgcacagaccgccggtatgaacgccgccaccccgctgaccgtcagctcggactggaacggcatccgcctgcgcgcattcggcaagggccgctgataagcctcaatcaatacgcttgactttaagcgtgttgaccggcgtcgcgtgctgcgtagtgctgctgggcgtggctgaatgtcattgcgattgagcgctacggcacgcgtatgcgacaccacgtgtcgcgcagtgccggccatacgctattgttgtcatttgcgggcaattagctcagttggttagagcgccacctttacacggtggatgtcgggggttcgagtccctcattgtccactttcatttttcatcacttcatgcaatcccctcattccacggatgtgggctgtgacgatattccctgacagtcttcggcaaaggttctgaaatctcagtgagatgcgtgcagaaggaaaccggcagtactgctacagaatcgtgaatttcggtcttcttggtcagatgcgtctcaatagtcacgtaaagttgtggcagagtgtttatatccagcaggaggtcgaatagccgatggcgcaggaacttcgtgaaggggacggcaagtcgggcatcgcacgtgcgggcaagcgcaagtgggggtatgaccccgctcaggtggacgctttcctggagcgcgcccatgctctgtatgacagcgagggcatgaatctcacccagcatgacattcagaacgtgtcctttgatctgcgcaagaacggctatgtgatcgcacaggttgacgccgcgcttggacgtctggaacgtgccgtggtcgataagcagaccacatgggagatagcacagcatgggcgtgtgacgtggaaggcgaagaccgagaagctgtatcacgaagtccagaaccatgcggagcgtaacgagcgcgaacgcttcaagtccggagcgcccaagcagccttcgtatgataagaagcaggtggatcgtctggtcgaccagattgtggacaaggcggcggccgcattgggcgttgacggcgtgaccgaagacgatgtacggtctttggccgatctcaatgcggatacggtcaacaatgtgatcttcacccagcgcaagggcaagagaggctatgacgagcgacaggtcgattacttcctgaatgcctgcgtgcagttgctgagtcgcttggaatcctatgcccgtgtggccgatttcgtgtccggcgagcccgcggctcctgcccagaccgccacgaacgtgaccgttcaagcgaacggcgtctcgccattgttcgcttccggaacgcagcgcccggcaactgacgaacgttttgcgccgtctgccgttgctcatgacgaatcattcgatgccctgcatcaggccgagcagagcttgttcactgctccggctccggttgctcccgcagcgccggccgcggcggcaccgatcgcctatgcgccggctcctgcatcgttcgatgcttccacaagcaccaatagcaccaatgcggaacagccggtttcctttgctcccgcagcatacccggtgcatgcgtccaacgagtctgcggcgaagcccgtctccgagacgccttccgtggctcctaccgcagctgttgcggctgagcctcccgtcagtgccccgtccgcgccggtttccggtgcgaccgctggcaacgccccctcgtttgctccggcacagtcgtcacacgaatccgcagctccgtcatcgaccccgtcggtgttcgcggaacagcccgtggatatggtgcagaacgattcctctctggccgctctcgcccacatggctgcggtttctcaggaacttccggcggtggatgtaccgtccttcgctcccaagatgcccagccttgatacaccgaatgcgctgaaattgaatgaggtaccgggttcggtttcatccccggcaccttccgccccggcagcgcagcctgtgaatagcactgccgacgaggctgcgtccgctgccatgccggtctcctttgctcccaccagcaagccggatcgtaacacgaactccattccggttcgcgtatccgatagtcagcctgcagacagcacgacctcccgtccggctgcggaatcatctgaatacgttgccgcctcccacgacacggaagcggctcagccgtcacaggataagcacgattccaacgattcgttcccgctgctgttcccgcttgtcggtaacttcgattcggatatccccgacctgtcgttccccacactgaacaatgacgatacgaagaaggaacagtgagcatagcctccaactccaccgtcatcattctcggatccactggatccatcggcacccaaggacttgacgtcatcgcgcgtcaccctgaacgatttaccgtcaccggtctggcggcgggcggagcacatatcgagctgctggcgcaacaggccgcacagttccatgtgtccgaagtcgcggtgtttgatgagaccaagattccagcactgcaagcagctctcgcacaggccggcgcacaaggtgtccgcgtgaccggcggtccggattcggtcatcgccatggccggatccggtgcgaatgtcgtattgaacggcatcaccggctccatcggcctcgaaccgtcgatcgcggcgctcaaggccggttcccagctggcattggccaacaaggagtccgtagtcgcgggcggtcatctgctgttcagcgcccaagtacgcgagaaccagatcaacccggtcgattccgaacattccgccatctggcaatccctgcgctccggaacccacgccgaagtcgccaagcttgtggtcaccgcctccggcggaccgttccgcggttggaaacgtgccgacatggagaacatcactcccgagcaggcgctgcatcatccgacgtggaacatggggccggttgtcaccatcaactcctccacgctgatgaacaaggggctcgaagtcatcgaggcgtcccgcttgttcgacgttccgcctgaacgcatcgacgtgaccgtgcacccgcagtccatcgtccattccatggtcgaatttgtggacggcgccacgatttgccaggcttcgccgccggacatgcgtctgcccatcgcgctgggcctgtccgcgccggaccgcatggccaatgtggccgccgcgtgcgactggacgaaagccgcaacttggacctttgaaccgttggacgatgaggcgttccccgccgtgcaactggcccgtcactgcctggccgcctccgagaagcatacggcggtgctgaatgcggccaatgaacaggccgtgcatgccttcctcgagcatcgtctgccatacctcggcatcgtggacacggtcaaagccgtgctggaccagatggacgccgagcttcgtggtaacccgctgttcacggacgtggaggaaatgaaccaacttgagcttgaagcccgccgacgcgccgacgacctgataaacaagcaatgatgaataccttgaatacggaaaatcccatcgaaaagccgttccgcaaaaccggtgatccggtcgatctgaccagcgaatcgcccttgcacccgcgccgcaagtcccgtcgcatcatggtgggtccggtgccggtcggcggtggcgcccccatctccgtgcagtcgatgaccaacacgctcacggccgacgtgcctgccacgttgcagcagatcgccgaactgaccgccgccggctgcgacatcgtgcgcgtggccgtgccgagtcaggacgatgccgacgcgctgccggaaatctgccgcaaatcgccgattccggtcatcgccgatatccacttccagtccaaatacgtgttccaggccatcgacgccggctgcgcggccgtgcgcgtgaaccccggcaacatccgtaagttcgacgaagtcggcccggacatctgcaaggccgccacagacgcgggcatctcgctgcgtatcggcgtgaacgccggctcgctggacaaggacctgtacgccaaatacggtggcccgactccggaagcgctggtggcctccgccttgaaggaagcgcacatgttcgaggacgtcggcttccacgatttcaagatctccgtcaaacaccatgacgtcatcaccatggtcgaaacgtaccgattgctcgcatccaagggcgactggccgctgcacctcggcgtcaccgaagccggccccgcctggcaaggcaccatcaaatcctgcctggcgttcggcgcgctcttggccgagggcattggcgacacgattcgcgtgtccctctccgcgccgccggtcgaagaggtcaaggtgggttgcaaactcttggaatacatgggattgcgcccccgcaagttcgacatcatctcctgcccgagctgcggccgcgcccaagtggacgtgatccagctcgcctccgccgtcaccgaaggcctgaaggacgtgaccgcgccgatccgagtggctgttatgggctgcatcgtcaacggtccgggcgaggcgcgcgaagccgacctcggcgtggcctccggcaacggcaaagggcagatcttcatcaaaggcaaggtcatcaagaccgtgcccgaggatcagatcgtcgacacgctgctcaccatagcgaacgatatcgccgcccagatggaggccgacggccaagtgccagtcaattccaccggcccggtagtggttccaatccagcatcccggtcactgattcggccgaataggccctcggcataaatatcgcggtcagattacaatagcgcacgtgtcgcaagaagaagagcatcgccgtactgttcgatccaagccgtggaccagcgtccatcggctgatggtcagcctgcccatcttcatcatcctgctcggcgtgatggtctgcatctccaatctgaccacggtcccttggaacatcgagcccaccggtcagtcgatggccacgctcaccgacgacaccaaggtcaccttcgacaacccgtccggagaaacgctgtcggtgcggggcgcatatgaggtcgatgagcggtacgtcacgctgaacatgaccgacgatggcgagctgaccgatgagccgggcgcgcaaggcaaagccaacaaggatggcatccaggccatcagggtgctgattcgggcgccgaggaacgcgccgggcgcgcgaccgggcgtggtgttcatgcacggcgccggcttcggcacctgcgacaattccttcggcgacgtggcttccgacatggcctcggccggattcgtgaccgccgtgattgacaagcccgtgtggaacaccaccgacgtcacgcgcgactatccggcatccgccaaagcctacgataaggtcatcgactatctgcgggcccagaacgacgtcgacgccgccaaggtgggcatctacgccacctccgaatcgacgtggatttcctcgtatctcctgcaggacgacccgaatatcgccttccagatcctcctgagcccgatggtgttcagtccacgtcaatcgctgggattcttcatcacgcaggacttcaccctcgtcggcgcgaacaaaggctaccagtccatcgtccagcgcgtgttcagcgcggacaccgccctgttcggactgaccaatctcgatctcgacacgctcaggccggccgcctacgccgtgcccacctacgtggcgtacggttcgaaggacgtgatgaccgcacaggtcgacggtgtgcgggcgattctcgacaacgcccacaaggccggcaattggaacgtcaccatacgcagctatccggtcgccaaccatgtgctgcgcctgggagacgaatcccaggccggcaccccgtttgccgacgcctatgtcgacgatctgatcgactgggccgtcggcacttcggccggactcacgcagaccagcgagaaggcaggcggcaccgacctgtatcaatcggtcggcctgccgggcgccctgaaaccccgccgcgccggcaccatctacggggtgatcctgcatgccgcagtgatgctgctgctgttggcgtccatcgtactgtcgctggtggcgttgggccgcaaggcctcggcagacatccggtggcggcgggacaggcgtgaggccaagcgtgcgggcatgccggtgccgagacgtcccgaggtgctgggcttcgtccacggtttcggcaatgcgctgctgacgttgaccctcaccacgctcgccacgctgctcatcttcggtgcgggcctcggccaggtgatcatgggcgtggtcagactcgcgtggggcggcgcacccacggagacgccgggcgtcatgtactggagctggccggtcatccaagtggtgtcggtgctggtgttgtgggcgtggtcccgtgtgttcatgcacctgatcgaagtcgcctccatccgcggcttgattcagctgcctcctcggcgtgaatccgtgcgggacatcgtcaccggtaccgatccggtgcttgcctccacccgcctgggccggatcctgttctggctggtggcgttcaccatgctgtgcatactcctggtgttcgccttctggggactgttcgtctactgatcgacgacgccgggtgcccgccgttcaccgggtcccgccgcaaggggaacgaaatgtcactgtaccgagatgaaggcgtggtgttacgcacgtccaagctggcggaggccgatcgcatcatcaccgtcctgacgcgcgaccatggcaagatccgggcggtagccaagggcgtgcgccgcaccaaatcgcgcttcggcgcccggcttgagccgttcatgcgcgtcgatctgctgatcgccgaaggccgatcgttggatacggtttcccaggccgagtcgatcgccgcgtacggtgccgcgatcgtcggggactatgcggcgtatgaggccgcgaacgtcatcgtcgaaaccatcgacaagctcgtcggcacggaacgtgagcgcatgacggaccagtatcggctcctgatcggcgcgttgaacgcgctcgccaaacgcgcccacgccccgcaggccataggctgctcctatgtgatgcgcgccctggcactggccggttggacgccgcgtctgggcacatgcgtggtgtgcggtgcggcggcgccggcgtatctgtcgatcgcatccggcggcgtgatgtgcgaggccgaccacaccacggacgcgcgtcgcatcgcgccgtccgcattgggtcagttcgatgcgctggtccatggtgattggacggtgcttgacgccgcaccggtggagcgggtcgtacgggagttggttgaagattgggggagtattaccttgaacggccgattcgttcgctgcgcttgatagattcgtaggtatggcttttgagaacgttgattacacctcgctgaacatccccgcggccccattcagcgaccccgcccgtattcccgacttccccaagaacaaagtgcctcgccatatcggcgtgattatggacggcaacggccgttgggccaagcagcgtggcatgatccgcaccaatgggcatcaggccgccgaaccggtggtgttcgacacgatcgccggcgccatcgaggccggggtgcgctatttgagcctgtatacgttctccactgaaaactggaagcgttcgccccaggaagtgcgcttcctcatgggcttctcgcgtgagattatccaccgccgcgtggaacagatggacgagtggggtgtgcgcgtgcgctggtccggccgtcgccccaagctgtggaagtcggtgatcgacgagcttgaggccgccgaggagcgtaccaagaacaacaaggtcatcgatgtggtgttctgcatcaactatggtggccgtgctgaaatcgccgacgcctgtgccgccatcgctcgcgaagtgcgtgacggcaagatttccggcgaccgtgtgaccgagaagatgattgccgaccatctgtacaatccggacattcctgattgcgacttggtgattcgtacttccggcgaacagcgcacctccaacttcctgccgtgggaggccgcctacgccgagctcgacttcgtgcccgaactcttcccggactgcggccgtgacgtgctatggcgctccatcgaccattacatccaccgcgatcgccgatttggcggcgtgaaataaagaacagtccggtggactgttcgttcacgccgcctggccgaggccgataggacatgaccaggtaatgatgagtccggcgaagccggtccttgattgctgggggcgtgaaatagtccttgttaggccccctctgacgggctgagccgtaaagcaaacagcctggtctgtttgtaggcgaaggcgagacgagagtcgagccagaagaatgcgagcggcagcttgtccgtaattgcggtcgagctgtccgtgtagcggactgaggggagttaccggcacacctcagccatcctctctgcaaactcatccaaaaaacgtcccgaatccacaccaagtgccacatgcacatgcggcatggaatgattcaccagcccaaccgggtctccggtggtccggcctcgtactccattgaaatcaccggtattggtctccgcgcgcaacgcaagatcaaaacaatcgaccagtgaagagtcaagtgcaaccgccgccgccaacggatcatgcaacggcatgccgccagagaacagtgcggtgtcggcttccaaatttgccttgatggaaaagtccgcgagatcagccaagaaccgcccgcgcttggtccccgttgcacgccaccggtcggccgccgatcgcgttagcaaacactggtgagtcacatcaagtcccaccattgtgatgtctgcgccggaatgaaatacacgattcgcggcctcagggtcttggatgatattcgtctcggccaccgcatcccaacaattgccgggttgggtaagcgtacctcccatcatcaccagcctgagtttcgacgcaatatccggtgcccgagtaatagccgcatccacatccgtcaacggcccggtagacagcacggtaacgtttcgaccaaactcgcgaacctgctcaatcagatactcaatcccatccgcagcatcaacggagcacctccttgtgcccccgctgacgagagctgtcgatgtagccgactgggggcggtccacagaccgaaagcgacccacacgaggataagaccccaacgccggatgagcatgagcgtcccctaccaaatacccgccaacagaaacaaccccatcgggcacatccacagacatgtcatccccagacatatcaccaggcacaccagctccatcagccagagctccggacccagccagccaagtattccccagtccatcatccccatggaactgggcacaccctgcatcaggaatgaacgcatcagcccaagaaggatgctcagagcccaaaaacaccggaatatccgaccgaccaaacaaatcaagcaccgcgcgagtattggcataagccgtgttcgcatccacattgccataactggcgatcacaccgctcagctcgcactcatccgccgaccccaacaaatacgccaacgccaacgcatcatcaacaccggtatccatgctggcaataatgcggtcaagacattggaccatggaatcgcctcctcgttagcgtgatccgctatgaataaccttatcggccgatacacaaaaatgcgtcctttcctcatggaaaggacgcattctttcgtagattcaaactcggaatatcggaaattacttgccgaggaactcgtcggtagcaaggtccttggcctgcggggcctcatgaatcaccttgtcgtgactgtcggtgtaagcgtcttcttcagccaggaagtcgaagtattcctgagtgcccttgaagtcgttggtgccgagcacgaaagagccgtccttgatcttggccggatcgccccagtactggccgtcgacgataacctgcatgctcttcttgacgaattcgggcttgaggttggcgtcaggggcttcgtccacgagaatctgcgcggcgtcatccgggttggcgtacgcgtactcgtaacccttctgagtggcctgagtgaacttcttgaccaggtcgggattgttcttgatggtcttgtcgttggtgatgatgccgatggcgtcggcgttgccgggcacgccgtagtcgggctcggtgaagcagttgagcttcgggccgtacatgtcggcctgcacgccttcccacgtggcgtagaagccgccgaaatcggccttgccggattccatggtctggaaggtggaggtgccgacggtcaccttgtcgaactcgcccttgccgccatcggtttggatcatgcggcgcaccacggcatcggactcgttggagccgaaggtggcgaaggtcttgccatcaaaatccttaggggacttgatggcggcgttggacgccagtgcgcaccaaatggcgctcggcttctgctgcacctgcagcacctgcttgatgtgagcgcccttcagcgtgtagatgcccacgttggtcaggttggacagggcgaagtcggccacaccgttgttcacggcttgttcggcaccagcctgggccacggccacgatatccacgtcaaggccggcgtccttgaagtagcccttgttcttggccacgtacacgccgatgtggttggtatcgggtgcccaggagagcatgaaagtgaccttcttgaggtcggaggtgttggagttggaggagtcggcggtgttggtctggccacatgcggcgaaaccgaaagtcatagcaagggcgcccacgagggcagcggccttggatacaaggcttttcttcataatgatggttccctaattcgttgtctctctatcgttctctgggattgcttcgaacggaagtcggcagaaaacgatatggagggccttgatttccgttcgaccagcgcccccgacattccctatgaaagctcgggaaagccggtttgccacacgctggtaaagctgttccattatagagacagggttggagacctcatgagaagccgccgcgttcagtcggtcctggccgccggctcgtgcctttgacggtaaaaagaactactggtccgcgtcgggatcttcgtcatcgccggccgggccgagcaggatgcgttcgctggcgtttaccaccagcatcagtacgcatgtcatcaggataatgacgatggtggcggagaagatcagcggcgtgcggaacgaattgtaggcagcctgcagccagatgccgaggcccttgcgtgcgccaagatattcagcggtggatgccgtggcgaagatgtatgcggcagatactcggataccgccatagatctgacgtgcggcaacgcgcagcttcacgtgccagagcgtccagaccggggtcgcgccgcaggtcaatgcgacgtcggaatagaactggggcactgcttccagtccgcgcactgtctgcacggcgatggggaagaggccgaataccgccacgattacgattttgccggaaatctcaaaaccgaaccaaatcaggaacaacggggcgatggaaatcagcggcatggtttgtgcggcggcaagcagcggatagaacgccgcgttgaacgtgtgagagcagtacagtgcaatgccgatcataatgccgaagaacacggcgaacaggaagccgaccacgccctcatagccggtgattgccgcggccgggccgagcgtgttccatgtttcgatggtggcggcgaaaatctcgcttggcgcggagatcatcgtgggggagacatgccctagatccacccacgtttcccagactgccagcaatatgatgacggcgatgacggtgggcatgcggcgcttgaggcgcttggcgatggacatgggatgtcaccttgctttccgcgccagtccggtttgctggtggcgcttgcggccggggcgtggaacagtaaggtgaggagcctgcgcgcctgccggccatgtgatggattgtgttatatgccgtccatcagtataggcaaaggcgaacgacaggggcgcacaaaaaacctccctcgtcagagggaggtgagagagctactccagtccgatggacttcatgtggtggagcttcagggaatccaccttgagggagccggactcggcgacgagcttgatggcacgcggtccttcggaggcgtaggagtaggagctcagcacttggtggccaccgttgacgtagacctccacggagccgcgatccacgaacacgcgcaggtccagcttgccggaggccagttcggtgtcggtcagtggggcggcgcggtagccgcgatcgccgttggccatggcctgacgatccaccaccacgcggccgatctggtcgtcataagccacgtaggtgtaggcaccgtcctcagtggcatgaatcttcaggcccgcacgctcggcagtggaggcagccaagtcgatggtcatttcgatttccacggcctcggcgtcatcggcgatgacctgctccccatccatatcgagcgtgatcgaaccatggtcgagggtatcctcgcgcaggccttccatttctgcgaccggcgcggtgaccacgtcgccgtcatcgccaagggtgatctcgcgcggcagggtgagctggccacaccagccgtcatcctccatgggaatcggctgcacgaacgggctcatccagccatagacgatctgacggccgtccacattgaaggactgcggggcgtagtagttgtggccgcaatcccacaggcggaactcggtttccggcttgaattcgccgcccggctcccacgtgccgatcatgtagccggcgttgttgacgttgcggttcatgaagccgctgggcttggaccccatggcggagaagccaatgacccacttctcgttgccgtccttgtctttgatggggaagaagtcggggcattcgagcatgaacacatccggatccgggtgctggaagagcacgcgctcgtattcccagcggaccatgtccttggaggagaacagccacatctggccgcgcttgtccgcagaggagacaccgaaggtcatgtaccaggtgtcgccggtcttccagaccttcgggtcgcggtagtgatggtcgaccttgtcggtcgggcagtcgatgatcatgccgcgcttggtggcgctggtcagctcgtcgttgtccggctcggcgagcatctgcacctgccagtcgccgccggtgttgtcttggccgttggcccaacggtggccggtgtagtagaacttgagttcgccgtcgtcgccgattactgcggaaccggagaatacgccgtccttctcctcttcaagggtcggggcgaacatgattggctcacgtttccaattgagcatgtcggtggaggagacgtgtccccagtgcatcggaccccactgggtgccgtacgggtgcagctggtagaacacgtgccagcggcccttatagaagcacaggccgttcggatcgttgatccaaccgccgttggatgcgatgtggaacttcgggtaccagcggttgttgcgttcggcggccatggcagcaacgcctgcttccgcctgtgccagagcttcgctgtggtccttgatttcgtggaggacgggtgcgtccggagtgaagccagtcatcgttgaatatcctttcttaatgattgatgaatcttgcgattgttgaattgttgcttattgagtttttagataaaagttttaagaatgctgcccgaaacggaaaaaggggaaatgcttcgggcagcacgatttagttgtgttcttgccgattttggcggttgcgctcaggcgtttgctttagctgcggcttgggccttgagctgcttatcggtgtagaacggatcaccgccgacttcctggtcgtccttcttgatcacgaagaagccgtagattagggcggccagcacgatgccggagatggtgaagaaggtcggacggtcgcccatggcgtcatgcagggcgcccatcggggtggagaagatcacctggccgatttgggaagcgatctggaagcccaccatgtacagggttgccgacagtttggtgtcgaagtgcagggtgaagtagcggaatgccggtaggcagaacagcggaacctcgatggagtggaacagcttgacgatggagacactgaccggatcgtggaacacgccgcacaggccgatacgcaggaacatcacggttgcgccgagcagcagggagttgcgaacgccgatcttcttcatgataatcggaacgacgcccatcatggcggactcgaggaacacctggaaggagttcagggtgccgtaggtggcgttgccgatttcggtggtcgggaagaaggaagcgtagtagttagggaacatctgctggtcgaacacggtgtagaaggtgttggtgaacagcatgaagacgatgagcacccacagagtcggcatcttcagaacggagatcatctctttgaaggatgggttggttggagccgcgttcggatcggcttctttcttgagctcttccttttgcttggccggaacccagaaagcgtagacgcacagcatgccaaggccgcagatggagccgacccagaagttcagcagcgggttgatgttgaacaggaaacctgcgcacagtgccacgatggcgtagccgaaggagccccaagcgcgggactggccgtattcgaagccgaacttacgggagtagcgttcggtgagcgcttcgaacagggaacagccggccatgaagcctgaggagagcacgatggagccgatgagcacgccgatgaaacgggtggtgccgccggcagtcagcatcggggcatacacgaactgtacgaacgggccgacgagcgctgcgatggcggagacgaagatcacgagcttgcgcttgatgcccagctgatcttggatggcaccataggcgaacatgatgaccagggttgccaaggagttaatggagtagatctggccctgctctgcggaggtcatgcccagaccgtgggtcgggtcggtgagccagcgggagaagaaggaccaccagatgccccaggagcagaagaacatgaagatgccgaaggagctctgcagataggaaggattcttccatgcagatttggttgcacttgccataatcatcctttgattactacttggttggttattggttatgtgacgcttctgctcgggcggctgtgcctttgtagaagttgttgtgtagtaattactatgcgacgtcaatcgatttacgttaatcgattgacgtcatcggcgtgtcgtacccgttcgacatgcaaaaaggcctccgtgctggacggaggccttgagaaatcgtgtgggactcggctacttcaccgaggccttttcgatcagcgtgcagtggatcttcgccggaatcggcgcgtcgatcggcggcaggggagcggtggtcgctggccgtgagacgtcgtccatcgagcgtccttcgatgatcgacaccagcttggccacggcccagtagcccatctcgaaatgcggcagttccacagtggtgagcatcggttccagcgtctcggcgaacacacgatggttgtccacgccgaccacggagatgtccttgccgaccgtgagtcctcggcgtgcggcgcattcgtacacataccaggcgcgggcatcgttgaagcagaagaatccgtccggatgctcggcgtcgaacaaatcgctgactgcggtcagtgccggcccgctgttgagcacattgacgaccagatgatcgtcatagtcgaggccggcatccctgagcgccgcctgatagccttccaaacgaccgtcctgcgcaatcatcggctccgagcaacccacataggcgatacgtgcgcatccggccttaatcaatctggtggtggcgtcgtagccgattcggaactcgttcggttcgacgctcgggattttgccaagcgagtcggtggcatccaccaacaccagtggcgtcttggctagcgaagaaggcacatgggtgatgcggttcgacatcttggcgtacaggaaaccgtcggtgccgtatcgcttgagtgcggcgatttcctcgctctcgctgttctcaccgtcggtgatcacggtgatgagcatatagccgaactggcttgcggcggtctgcgcgcccagaatcataccgccggcgtacggggtggtggccacctcctcgctgatgaaaccgaggatgtgcgtcttgcctgtacgcagcgaactggccagcggattcgaccggtagccgagcttggtggcgatggcgcgcacattgtccgcaatttcggactttacgcgcccctcgtcgcgtccgttgagcaccagcgacaccgtagagacggaaaccccgccttgttcgcgatttccttcatcgtagccatgcgtcaaacgatacaccctaattgacggactgttgggaaagcatcagttttctccaccgactccgccgaggttgcgcaccgcaccgatgaataatggtatgccgtccggggtgacgtacgaatacaggaatgggcgatccaccgtgaattcgacgttgtccaccggcgcgctagcgaagtctgcgccggctttggtgaaggacatggccttggcgccggcctcgttcaccgcgatgcgcgtgccctgcagaatcgagccgatatacaggttctcgccgtgcgaaccggcgtcgaccatcttggtgaagtcggcgtcgcctgcactgaacgcatcggtcacccccagtttttcgaatgccttgatggtggcttccgagtcgaacatgctgtcgatggtgaatcgcggtagcgtgacgttcaccgtggccgagttgacggagacgccccatccgggcatactgtccgcggcgcaacccattgcgccctcgccaagggatgccgacgaacacgtgccgaacgcccatccgagtttctgagcatcgccggccaactcgtcaaaatgcccttcggccggcagcacgatggccagattgccgccgttgtcgaacggaatctccacccgttgccaagtgttgtactcatcatgtccgtaagccatttggctgaaggcccggtgcatcatcggcacctgagcatctccggcttcgccgtggaaggtgccgtcgccggtggactgctcttcgaacggatccttccagcggccatccgcatagacggtgttgatgatggacaggacttcacggtcacgcagcgtgatcttcggcttgagcgaaccattcgtatgcttggcaatccaatcggacatcttggcggcggcctgatcgtcgaacggtagcgtggtgacttcggcctcgaatatcttcttgacggtggattggtaatcgctggcaagagagtagtcgttatcgatccacagcgagttcgcggcgctcatctcggatttcgcccccgaatattgcccgttgatcgaactcagcagcgattggtagtcgctgtcggccagcgaaccggagtccagcagttcgttcagttgcgagcgggtcgtgccattggcgccctgcgcggcgatggccaacgccatccacatcgaagcaggggagtagttcacattaccggtgcctcggtcgccggctcccatcgccaggaattccggtgcggtgcggtaggcgaaggctgcggtgctgtcgactaccggctgtgtggcaggcgtggccttcggcttgaacatattgcgaaccagtgcgctgccatcgccggccgtccaccatacgccgccggcgacggcaaggacaagcactactgtcacgatggcggcgatacaagcgttacggcgtttgcgttgtttgcgcaaccggtactgttccatcagtttctcgctcatggtcagcccctttgcttggatcggctcgtgcatcattgcacgaaatcgctattttcattatattgctgctttcccttgagcccaggaacggtatgggaaccccggccgtaagcgaagattggtacagccgaatgccagcggtccgatggttgcgctcgccaatgggaagacagactgccggatcgtatcgaaccaagtatcaggttagtgattcccaacaccaatggccagtgcagcaccataccggggaaccatacgaacaggtttttggcagccctgtcaaggacctcgtcgggcatgagatacattgatgagctccactgcagcagcaacaacaccgctatcagtacaaccatgccaatccaatgcgcgcggttccatgtgaacagtcgttgcgtcccgcgctcggcggcggactgccttgcggagttcatactcgttgccattgtggggtggatggcgtttcgtccggtcaccggatgcgtggcggtggctcttcatccagtgggtctgacagcgcagggcggtcgggaagcgacttcaccggaagcgcccatgaatcgagcggttcttctgccgagcatcgcactgggcaagtgattcttggtgcgattgccttctatggtgtgatgccagtggccgtgctgtttattggcttcatgcttggtggcatggcggcgcgatggaatcacgaacgcagcttggctcgagcggagttggctcaccgccgtcagcaggaacgcacagctcaggacattcacgattacgtatccaatgatttggcatacctgattttgcgattcgacaacaatattgccgatggcaagaccccttctgaagaagaattacgcgaactgcgtagcgtggctatgggcgcattggatcgcacgcatcaggtcattgatgttattgaaggcaggggagaagcggcgcacagtgcagtgactccgcatgattcgaccgttgatgccgcttctggcattgcaactgcgcgagcgtttatatgccccacttacgctcttaccctgttgaaagaaggaaaaaggcagagccgtgattcccatggggcggtaaaacactcatggggcggttagcggattttgcctttccgcagaatagagccgttttcgcctaccgccccatgaaggttttaccgccccatgagatatttaccgccccatgggtgagctaccgccccatgaaacgtgtaataacaaagcatgcccttgctggtggaagcaatgctttgctacttcgcccgcttgtcggcgaggatctcgtccaccagcttgggcttttcggtcagctggccggtgaaaccgggacggatatccatgtgcagcaccagagaagtgcggtagccctgctcggcgagcttcttggcggcctcaccggccaccttgagcacgtcgtccagattgccttccacgttggtgaacagggcgttggtttcctgcggcaggccggattcgcgaatcacttcgacggcctgagccacgtatggcgagacctcggagcccacgccattggccgacacctggatggcggccacggtattgaggtacggtttgccggtttccgggtcgatcggcacttcctgggtaacggcattacggtcaagaaccatgattctcctttttcagtagtgttaagctcccctgacaggggagcttaacaaccacacttatgtcagcgatacttccagagatgatccatcgggccggagccgtggccaagattcagctgggccttcagcgcaccggtcaggtacttcttcgcatgcttgatggccttgggcaacgtgtcgccaagcgccagatacgaggcgatggcggagctcagcgtgcatccggtgccgtgcgtgttcggattattgatacgcgcgccatcaaaccaggtcacggttccatccgtctcggcaagcacatcgttggcatcctcggtgccatgaccacccttgaccagcgcggcacagccgtaacgctccacgatgcggtgggcggcggcctccatatcctcctgatcgcgaatcagcgtatcggtcagcacttcggcctcgggaatattcggagtcacgaccgtagccatcgggaacagcttgccggtcaaggccgcaatggcatcgtcactgatgagcttggcaccggaagtggccaccataaccgggtcgagcacgatgttcgtggcgtgatggaaggtgagtcgttcagcgatgacgtcgatgatgtcagtggcagacaccatgccgattttcaccgcgaccggcggaatatcctcaaacaccatgttgatctggtcggcgagaatgtccggtttggtatcctgaatggaacgcacgccggtggtgttctgtgcggtgagcgcggtgatggcgctcatgccgaacacgccgcaagccagcatggtcttcagatcggcctgcatgccggcaccgccggacgagtcggagccggagatcgcgagaacagcgggaagtgtagatgttgcaatctgtgccatagtgttcattctaagtggggcccatgatgtttttcggagcggttttccttgatgttttgccgctcctgtggtgagatgggagggtttgctgattgcgattgattcatgaaatgttcgggaggggacatggctgataacgatgtactgcgccgtgacggcgtcttggtacgcatcaccggttttgacgatgaacgcaccgcatattttggcgtaatgcctaatgggcacaccacacagctcacatttccgcgtcaggaggtgttcgatgtgggcgacgtgttgctcgtcggcacggatttctatcgtaaagtgccgcatgatgtgtggccgttgaagccccgtgtgggcatcgtgcgccgtgcgctcaacgaaggcgtggtcctggagacttccgacggcctcgaactgcttgaaggcgattacccgaattcgatcatgcccggcaacaccgtgcagttcaccgacctgttcggcatcgaacgagtgctgtggcccacggccatccgcccaggcgaatccgatcacgatgacgacatcaagcagtaccgcatcacgccgggcagcgatccgtcgcttaccttcgattcgttcggcggttatgagcaggtgatcacgcgcgccaaggagcttatcgaaacgcagctgggcaacagtgcgcagatgcgtgcgatcggtgccaagcccatcaagggcgtgatcttcaccggtgctccgggcaccggcaaaacgcatctggcccgcatcatcgccaatgtggcggacgcgcagttctatctggtgtctggcccgaccatcgtgagcaagtatgtgggcgatagtgaggaaacgctgcgcatgattttcgccgccgcgcaggcggacaagcgcgccatcatcttctttgatgagatcgattcgattgcgtcctcgcgcgagaacgataccaatggcgtcggcaagcgcttggtggcacagttgctgacgttgatggatggtttcgagtccaagggcaatgttgtggtggtcgctgcgaccaatcgtattgaggacgtggatcccgctttgttgcgtccgggccgtttcgactggcagattcctttcccgatgccgtccgagcacgaccgtttgggcattctgcaggtgcaggcccgttcgttgtcaatcgagggcgaactgccgttggtggatatcgcacagcgaaccgaaggctggagcggcgccgaagtgtgcgccatctggaccgaggccgctctggtggccgccaaggaccgccgcggcgcgatccgtgctgccgacctcgtcaccgccttcgagcgagtcgagcgtcgtcccgaattaagacaccaccgggcataataattggctcccctcagagaggggagccagagaggtttactcctgggcagtggagtagagcttgccgccttgggcggtgtacttttcgctcatcgcatccatgccggcgaggatttcttcggggctgagcacgttggcggacaccacgtcgttatcgacattggccttggccttagccagtgcctcggagtcgatgccagcagcagcctccttcacgatttgctgctgagcggcctcgccaccgaatgccttgcggatgttctgggagatggccatcgagcagaacttcgggccgcacatcgagcagaagtgcgccatcttggccggctcggcgggcagggtgtcatcgtggaaggcgatggcggtgtccggatcgtaggacagattgaactggtcgagccaacggaactcgaagcgagccttggaaatcgcattgtcacgatccatcgcgtgcgggtggtgcttggcgatgtctgcggcgtggcaggcgatcttgtaggcgatcacgccctgcttcacatcatccttgttcggcaggccgaggtgttccttcggggtcacgtagcacagcatagcggtgccgtaacgaccgatctcggtggcgccgatggcggaggtgatgtggtcgtaacccggagcggtatcggtggtcagcggtccgagggtgtagaacggggcgcccttgcacaccgacttctccagttcgatgttcatgcgtacggtatcgaacggcacgtggcccgggccctcgatcatcacctgcacgtccttggcccaggcgcgctcggtcagctcgcccagagtcatgagctcggaaagctgcgcggcgtcgttcgcgtcggccagggagccggggcgcaggccatcgcccagagagaacgccacgtcgtacttggcgaagatgtcgcacagctcgtcgaagtgcgtgtacaggaagctctcctggtggtggcgcaggcaccagtcggccatgatggagccaccgcgggagacgatgccggtcacgcggttggcggtcaacggcacgtaacgcagcagcacgccggcgtggatggtcatgtaatccacaccctgctcgcactgttcgatcacggtgtcgcggaacagttcccagctcagcttggaggcatcatcctcgaccttttcgagggcctggtacatcggcacggtgccgatcggcacgggggagttgcgaagaatccactcacgggtggtgtggatgtcgttaccggtggacaggtccatcacggtatcggcgccccacttggtggcccacgtcagcttctccacttcctcgtcgatggaggaggtgacggccgagttgcccatgttggcgttgagcttggtcaggaaggcggatccgataatcatcggctcggcctcggggtggttgatgttgcagggcatcaccgcgcggccggcggccagctcggagcgcacgagctccacatcgcagttctcgcgggtggccacgtactgcatctccggggtgatgatgccgtggcgggcgtaccacatctgggtgatcgggtggtccttggcgcgcatcggctcatgcttgcgtccacgccattccttggtggcgcggccgcgcttgatggcgcgcttaccatcatcctcaaggttgcggcggcggccctcgtagtcttcgatgtcgccgcggtcgcggatccagtcgagacgcaggggcttcaaaccttccttcgggtcgcacttggggccttcggtgttgtagtcgtggaacggcgggttcgggcccacgccgggcgtgtcgctcagcttgatttcggtgtacggcacttccaggtcgtaggaaccatactgataggtgaacggtacggacttggtcttgcggatgtgcgccttgtcgcgttgcttggaaccacgggcggcgatgtccacgcgctgctgcttggcgagcttctgggcatccttggcgtccttggcgttggtgaacttcttctcagtggcctcggagccaggctttgcggccccttcctgagcagcctgagtatcagcagcgggggtgtgggctacgacgcgcggcgcgtagccgtgcttcttgtcgccgcggacggccttccagccttcgaccatggtgcgcgcggcctcttccgggttctcggcacccgcgatggcggagaccgcgaaccagccggcggccttggtgccggcgagcatggccatatcggctgcggtcacgccgccgcccacgaccaccgggaattcgctggcagcgcagatggtgttgatctgggcggcgtccagtgtcttgccggagccatcgttgccgcccacggaagcctcgggcttggtggtggagacgtgcagagggccggcgccaatgtagtcgatgcagccgtcgggcagctcgttgatgagctgaacgaggctttcggtctcagccgacagacccacgatggcctcgtcgccgagcagggcgcgggcttctcgcggctccatgtcggtctggccgatatgcacaccgtccaccttgatgcccttgcggcgggcctgccacaccacgtcggcacggtcgtcgatcacaaaggccacggaatcggacttctcattgtcctcgatgatctgcgcgatgtcgcgggccatgtcggtcagctcagaggcatcggcctccttggcgcgcagttggatgaaggttgcgccgccgcgcagagcctgatccaccacgtcggtcagcggacggcctttgcagtcctccggccccaccacgaagtacgcggacaagtcgaagttgtctcgcatggaggcgtatgggtattcattactcattattattcctacctttgttgtttcttgtggaagtcttattgggaaaaactgttatgagctccctcatcagagggaactgaaactactgcaccaaaatctcggattccgccacctgttcggcggtaacattccacagcgcgtcaaggaacgcgacctggaacgagcccggcccgtgcgaagtcgtatcggctatctctgccgcgcggttgtacagcagagatgcggacagagcggcggtcaacggatcggaaaccgccagatatgtggcagccacgccgcccagcgagcagcctgcaccggtgatcttggtcatcatcgcgctgccgcccggcagtcggtacacggtttcgccgtcggtcaccagatcggcgatgccggacacagccactgcacagcgggtggaagcgtcatgggaggaatgcttggcgtgctgttcggtcagatactgtgccagcgccaccgccgcaccggttgcggactccacgtcgtcgacggattccactccggcggggcggtgctcggaagcgtcccccacggtttcggtattgagcccccacatgttcgccagcgcgattacctcggaggcgttcgcgcgaatcatggtcgggggagcggccttgaaggtctgaagaatggcggtgcgggtgtggccgatgccggcggccaccgggtcgagcacccacggcttgtccaagtagttgagtcgctgggcgatttcgggcagcgcatccttatagaacggcagcagcgtgcccacgttgatgtagttcgcgcccgcgattttcgcggtttcgatcacgtcgtccggcaggaaactcatggccgcagtgccgccggccgccagttgcgcgttggcaaccaaattgatggtcacaaaattggtgaatgactgggccaatggagtcgtctcgcgtacgcggcgaacggcatcggcgatattatcgcggatgggtgaatcggctggaaccggagtcccggcggtacaaccgctggacacatcggcaaacgatgatgcactattgctcatttactgctccctacgatggtcttaaccaacaggttctaagggtcaggctcaggcctttctcaactcgcgaaccacatgcgagtccccctgcactacagtgccgacgctatgcgccaacatggacattatcgtgacggatttgttcgatacgtgtcgtcaggtctggcgcgtcccgtccattcgtgatatgtggacgcctccgccgagcaacatctcccggatttgtgacgctaacgcgatgtcagtggtacaaattggggaagggcaaaacaacaggaacaatatggaggtgtttgcgatataggaatcgctgcgaacggccgctcgtgagacgcggaacatataccggacaatgccgcctgacctgtcaccgtatacggctatcctgaagcggttgttattagaccccaaaccgttcaaaccagaaggtgcattgtggctcagtccaaactcgatgaagtcgtatcccttgcgaagcgtcgcggcttcgtgttccccgccggcgaaatttacggcggcacccgttccgcttgggattacggcccctcggcgtcgctctcaaggacaatatcaagcgtgaatggtggcgctccatggtcgtcacccgtcctgatgtcgtcggtgtcgacacctccatcattctgccgcccgaagtgtgggtggcgtccggccacgtgagcgtgttcaacgatccgctcgtcgagtgcctcaactgccacaagcgcaaccgcgccgacaagctcgaggaatcctacgccgagaagcacggcgacaagatgccggaaaacggcatgaaggacatcgtctgcccgaactgcggcacccgtggacagtggaccgaaccgcgcgacttcaacatgatgctgcgcacccacctcggcccggtcgaggacgagaacagcctgcactacctgcgtccggagactgcacagggcatcttcgtcgacttcaagaacgtgatgacctcctcccgttccaagccgccgttcggcatcgccaacatgggtaagtccttccgtaacgagatcaccccgggcaacttcatcttccgcacccgtgagttcgagcagatggagatggagttcttcgtcacgcccggcaccgatgaggaatggcaccagtactggattgacgcccgcacccgctggtacatcgacctcggcgtcaagccggagaacctgcgccactacgagcacccgaaggagaagctctcccactactccaagcgcacagtggacatcgaatacaagttcggcttccagggttccgactggggtgagctcgaaggcatcgccaaccgtaccgattacgatttgagcgcgcactccaagcactccggcgaagacctgagctacttcaaccaggccaccggcgagaagtacgtgccgtacgtcatcgaaccggccgccggcctgacccgctccctgatgtgcttcctcgtggacgcctacgatgtggacgaggccccgaacaccaagggcggcgtcgacaagcgcaccgtgctgcgtctcgacccgcgtctggccccggtcaaggccgccgtgctgccgctgagcaagaagcctgaactgcagaccgtggcccagaacctggccgacgacctgcgcttcaacgaatggatgatcgactacgacgagtccggtgccatcggccgtcgttaccgtcgtcaggacgagatcggcaccccgctgtgcatcaccgtggacttcgacaccctcgaggaccacgccgtgaccatccgtgagcgtgacaccatggcccaggagcgcgtcgctcttgacaaggtggccgattacgtggccgcccgcatcggcgagaagcgcacccgcgtgcccctgaagcccgtggaaatgggcggcgaggcttggcctgagtccggcgttcaggaagccggcggtctgtactaagccggagtcgcacaacttgggctcccctctgtgggctgagccgtaaggaagacatcccagtgggctgtttgtaggcgaagtggcggcgatagacgccggggctcctctctcaggggagcccctacttattttcttaggaatcacatggcacaatccgaatccgaaacagtgctcaccgagcatcacgagaccgacaacctcgacccacgtacggacgcgccggcgcgccccgggaccccggtgcatatcgccccggtccaactcggcaacatcaccgtgccgaccccggtggtgctctcgccgatggcgggagtgaccaactggcccttccgcgtgatttgcgaggaatatggtcccgatggactctacgtggccgagatgatcaccgctcgagccctcgtggcgcataacccgaaagcactgcgcctctgtcatttcgccaaaagcgaaaaaatccgttcactgcagttgtacggcgtgaacccctccatcaccgaacaggcggcgaaaatcgtggtcgacggcaacatggccgaccatgtggatctgaacttcggttgcccggtgcccaaggtcactcgtcgaggcggtggttcggccttgccttggaaaaccgacattttcactgagctattacagcgcgtggtcgccgtatgcgagccggcgggcatccccgtcaccgcgaagatccgcgtcggcatcgaccataaccatgagaccttcctcgaagccggacacatcgcgcaggaggagggctgcaaggccgtaaccctgcatgcccgtaccaccgccgaatactatggcggtcattccgactggtcccgcatcggcgagctcaaggaacacctcaacattccggtattcggcaatggcgatatctggggtgccgaggatgcgctcgaaatggtgcgcgagaccggctgcgacggtgtggccatcggccgcggatgccagggccggccgtggctgttcgccaacatcaaaaacgccttcgagggcaatcccgaacggctcaacccgaatctgggcgaggtctgccgcgtgattcaccgtcatgccgagctgcttaccgagttctatgagggcgatgagatgatggccgtccacgatctgcgcaagcacatcgcctggtatctgaaaggattcccggtgggcggctccacccgcaaggcctttatggaatgcgagagcctggccgatgtggaccgcgagatcggcaagctcgacccgactatcgaatacccgccacgcgtggtcgacaaaccgcgcggccgcgtgcgtttcgccaagaaggtgcacttgccgtatggctggttggaatcgcgtaccaccacccacgaagagcgtgaggcgctcttcggtgacgacccaatggacgccagttactgagaaaatactgaaaatacacgcaacacgcgccattctgcgcgtgaatttccctccaagagtagcctgtttgcgctactcttgggtgtaaccgtgaagtgacaggagccaaacgtgagcgagatcgcgcagaatgagttcaacgacaagaccaacatcaaggttgttggcgtcggcggtgccggcggtaatgccgtcaatcgcatgattgccgagggactgcagaatgttgaatttgtggcggtaaataccgatgcgaaggatcttctgcgctctgatgcggatgtcaagatttccctttccgataagtccagtcgtggtctcggtgctggtgccgacccggagcgtggagccaaggcggcccaggaccaccagtcggatatcgaagaggcgcttaggggtgccgacatggtgttcgtcacctgcggcgagggcggtggcaccggtactggcgccagcccgatcgtcgctcgtgcggctcatcaacagggtgctctcaccatcgcggttgttactcgtccgttcagcttcgaaggccctcagcgttccgcttccgccgaatacggcatcgacaacctgcgcaaggaagtcgacgcgctgatcgtcattccgaacgatcgcctgctcgagctttccgaccgttccatcggcatcattgaggccttcaagaccgctgataccgcactgcttgccggtgttcagggcatcactgacctgatttcgatgaactcctatattcacgtcgacttcaacgatgtgaactccattcttcgtggtgctggtactgcgctgtttggtatcggttccgcacggggagaggatcgtgccacgcaggccgccgaaatcgccatcagctctccgctgcttgaggaaagcatcgaaggcgcacacggtgcgctgatcaacatcgccggtccgaccgacctgaagttgcaggaggcctctgctgccaccgaactggtgcgcaaggccattcaccctgaagcccagattatttggggtcttgctctggacgatgcttatggcgatgaagtgcgtgtcactgttattgctgctggttttgaccccgtcgccgctcaagatgacgacactcagagcacggtgacgccggttgtgccaaccgccgccgatcctgcgactcccgtggcacagccagctccagcaccggcaccggctgcacagcccgctgccactgcccaaccggcattcacaccggctaccggtgactccgcatcgttgccttttgatgatccgacttccgctcatccgaatatcgccgtgaacgatccggctggcgatctcgacatccctgacttcctgcgctgaaaggattgatccatggctgggttcatgaaaaacgcgatgtcctatctgggcatgagtgacgttgtggacgatgaggacgactacatcgaggaggacgaggagcagaagccggcttcgaagtccgcatttgattccgaccatacggtcacgccgctggcgtcaaccaccgcgcctgccgcatcgtcgactaccaagccgttccccggtggccgtgtgaacagaatcaccaccatccatccgaagtcatatgaggatgctcaactggtcggccgcgcattgcgtgacggtgttccggtcgtactgaatctcaccggtgtggccgaagccgtggcatatcgcatcgtggacttctccgccggcgtggtgttcggcgtgcgtggttccctcgagcgtgtcactccgcgcgtgttcctgttgagcccggcgcaggtgaacatcaaggtcgaagagccgacaaaaccagcctcggcacacgatttgttcgctgactgaccggttcagtagttttcgcattcgacgttatatcggtattcggccgactcccagcaaggagtcggccgattcttattgtgctccgagcaaacttttcatgcgcggttgttagtctgtcagcatgctttccttagtgttctctctgatcggccgcattcttgcatggctcattaacgcgtatatcacggttctgttcgtgcgcatgattctggactgggtctccgttctcgcacgaaactggtatccacgtggtgtggtggcccagctgatcaatattgtgtattccatcaccgaaccccctctgcgctggctacgtcgctatattcgcccattgccgctcggttcgatttatcttgatgtcagcttcattgtgctgtattttgcgctggtggtactggaaagtgttgttctgatagtgttctgaggccgtttttgacccgccggaggcatatatctggcataaaaacccacgtcgaatgttctgaaacgatggggtcgtgatagcattctgacttgagaccaacgtaagtgcgggcgatgccccaaagcgaggtgcaagatttatggctctgttgacgccgaaggatattaaggagcacaccttccagactgttcgattcaaggaaggttatgatgtcgacgaggtcgatgacttccttgatcaggtcacggaaaccgtcgaggctcttggacgtcaggcggtagccggcggtcaggccacccagactctgggtcctgacgtgaccaaccttaatgcgaagatctccgatcttaccggtcaggtgcagcaactccagtcggagaatgctggtttgaagaacgctgtggctcaggcccagcaggccgctcaggctggcaatgatcaggcggcacagcttgcctctgccaagctcagcgaagccgaggaatccaaccgcgcgctgtcctcccagaatgagcagctcaagggtcaggtcgatcagctgaacgctcaaatcgatcagctcaccgcccaggccgctcaggcctccggtaaccaggaagccgtcggccagcagatcgccgccattcagcaggaacgtgatcagttccgcgcggccaacgaggagctgtcccgtcagctcgccgctgctcagcaggagggttccgccgctcagcagcagtccgctcagatcgctgaactgtctcgtcagctcgaagaagccaagcagcgtgaaaaccagcttcgtgcccaggtttccaaggtcgagccgagcactgagaccggttctctgcagaagatcgctggcgtcgcttccatgccgggcaccgagcccgagcgcgccaccgccatgctgaccctggctatgcagctgcacgatcagtacgtggagaagggcaagaacaaggccaaggaaatcaccgaggccagccagaacaagtacaacgatttggtcaccaaggccaacaactactccgagcgtacccgctccgaggccgacgactactccactcgtactcgttccgacgccgacacctattcggatcgtacccgctccgaggccgacgcttaccgtgaccagattcacgcggatgccgagacctactcccagaacacccgttctgaggccgacgcatactccgtcaagactcgtcaggatgcggacaactactccaagtctcagcacgatgacgctgacaactacgagaaggaagtgcagcagcgtgccgccgagtacgacaagaacactcgttccgcagctgatgcgtacgacaagaacacccgctctgcagccgatacgtatgccgagcaggtgcgcgacaaccttcaggctcagtccaaggtcgtcgagggcaacatccagagcctcaagcagttcgagactgaataccgcgcccgcctcaccgagtacctcggccagctggcatcgcaggtttccgagtcgaacaactacgtcgaccagacctcgtccaagaccaactgagcgtaggcaggtacaggtcgtatgacgaaccaacagggacggctgcgcactcgcgtggccgtctttgcatgtgtggccgcggctgcgctgattgtcgatcagctcaccaaggcttgggcgatggccgcgttatccaacggtcagaccattcgcgtgattcccggactgctgtccttcaccttggtgcgtaatccgggcgcgtccttgggcatggggtcaggcgctacttgggtaatcagtctgttggccgttgtggcttgcgtggcccttgctgtggctggggtgcgcactatctccatgaaatggtcggtggcgctttctttcgcgtttgcaggcgctctgggcaacctgattgaccgtgttatgtacgctgacggcttcctcaacggcaaagtggtggatttccttaactatggctggtccgttggcaatgtggcggatatctatctggtagtcgccggtgtggtcctggtgattctgattcttatgggggagccgttctcccacaaggatcttatcgagcaatccgacgaatccctacagtctgagccggaggcggacgccaagtaatgagtcgaatggtccctgctcccgatgcattggtgggtaagcgtttcgacgtagccgtggccaaaatgctgggtatttcacgatctaaagccgccgatctggttgactccggacaggcgcgcgttttagggcgtgaagttgcgcggtccagcacgttgcaggcgggggagaccgtcgaatttgatttggcggaggaacaggccgggcctgagcctatcgcaactgatatggctgttgtctacgaagatgatgatgtcatcgtagtcgataagcctgtaggcgtggcggcgcatgcctcggttggctggaccggtcccacggtattgggatcgttgcgtgatcgtggcgtgcatatcgcttcctatggtgcggccgggcgtgaaggcattgtttctcgccttgatgtaggcacttccggcttgatgttggtgtgcaagtccgaccttgcgtacaccgagatgcgtcggcagttcgccgagcatgaggtaaagaaaacctatcatgcgctcgtgcagggcggtcttaaagagaacaaagcgaccattgaggcaccgatcgggcgcgccaaagtgtccgatttccgcttctgcgtgactccggccggcaaaccggccgttacgcattgggatgtgttggagcgtttcggccatgaggccacactggtatccgtgaatctggagaccggacgtacccatcagattcgcgtgcatttctcctcgattgggcatcctctgtgcggcgaccccatgtatggtgccaatccggtgctgtctgaagctttgggacttgaccggcagtggctgcacgccatgaagctcgaattccgccatcctcgcacccgcgtctggaccacggtccggtcccagtacccggccgacctggccgccgccctcgatgccatgcgtgcccgtcacatcgaacccgctgaacctgccgagcatgccgaagttctggtggactaattccgcaacgtgtgcatcatgcgttttaatatttagattcagttccagcctcgccggattcatcccagaataacgagagatcggtcatgatggctctccgtcatgaccataccccaagtgactgcggatgctgagtacgagtattcgtggccgtcatcaatcgatggtggtcattgggattcgcgccatgtactacgcagtatgttgtacgctctgcctggctgttgaacgaagtccacaagaaacagtagatactagggcggccagcggattagcaagacatcggttggtgaggactgctgacattgaactccgacggatgaattgaatactcatatggtatccgattctgaacaattgagtgggggcgttgatggttgccatcgtttgagctggctaaatgcgatttcgcgccacgctgtttcaacaacggtaacaacagctacagttgaactatgcatgggttgaagagtgcgattgacaggggagcggacgcgtgggcgcgttcgctgcctgggcgcgtgctcgaccggtatgtgtcgcggcgcggccccctgctggcgaatggtctggcatatggtctgctgttcgccttttttgccggcgtctggattgcggtgagcgtgttcggccttatcatggtcggcaacattgattggcagcagatgctgattgacgcggtgcgtgaagtcattcccggtgtggccgactcgtttctgacgtcttccgcgctaggcgccatgtcaagcgcattgacgtggaccggtctggccacgttggccatattctggtggacagtgaccggctggatgaactcgctgcgccacgccgtacgggccatgttcgacgactgcggcgacgagctcaatatcgtcgtcgcaaggttacgcgatacgcttgccgccatcgccatcgcaatactgttcattctttcgaccgcggccggtacggtgtccggcggcatcgtacgccgactgctgcaatggggcggcatccccagcagttcgttgcccggcatcgtgcttttggagatgaccggtttcggtaccggtgtcgcgctgaatttcgcgttgttcatgttgctgctgcgcgtggtctcccacatcaaagccggacgattcacgatactcggcgcgttactgggatctctgacggtttccgcaatgcagcttctcggtgcgcgactattagccggagcctcccggaatccgatgcttgccccgttcgccgcgttgatcggcgtgctcatttggttcaacctcgtcgcccaggtcattttgctctgtgccgccctcattgccgagtgccgacaaaagagctgagcgttggtgagaatatagcgggactagctagtctcgatacttttctagcaaagattcgccagtatctcgcagcataatgcgtaaggattgtggttcaaggacttcaatgaggcgcgaatcggcatattgcaatgcccaccacaaggtcgctaattcgttggccatgatatgcacgtcgtattcgttggcgctgatttgagtgaccttggcgttgtcgaaccagtcgtacaagggctccagcgtgccggtaatacgcaggtgaatcggtactgctgcgccgtccatggggtaagggcgttcgtccatatgctcttcgatgttgaacggcgttcccggaatcggactgaagctatccagtgagcgattgagcgcatgatcagtctcctcgacgtaaaggttgcggaaacgttctacgtgcagatacgagagactgtcatgctgatgcatgtggcaaatcagatagtatttgttgttcttgtacatcagatggtacggatcggcttggtattctttgatttcacccgcattgtcgcggcgaggaaccagattgccatcaatgtcataggtgcagtaacggaatcgaattactcgttcgtgttcgatggcatcgttgagcatttcgatattgttgagaaactcggtgttgtaattctttggcgtagtgagctgcctcagaccgcgcaattggcccgacttgcccgcgaacgtatagattttggcgataaggtcgctcagatattcgctgtcagaccgtgatattaccgcgccgtccgcaagcagacgcatctgggccgtatcaaacaccggttcaatgtaccatcccggctttggatcagcgctttcagcagagagcaggtctcgacgctccagatgctccacccgacggccgaatggttgcatgtcacgcaacgccttgagatgccctcgtacggtcttttccgaaacgctgatgcgcttgctgatctcagtggcagtaatcccgtgctcgcggtctgtatgcgcatccagcagttcgagaatctcgatgacaatctgcgcagtggaaggtgttgcttgttgcgatgagacggccatcatgttcctctcgctgagtatcgagactgcttcaagaaccagtagataattaccgttgattgtagcgcggcaggaaactgaacatgcagccgattcgaattcgaagcaaccatgactatggaggcggtgctcttatgcgggatttcgttaatttgcatgtacatagtgactattcgctggcagatggtgtctctactgtgagcgagctgatgagtgaagcgcaacgattaggtcagccagcaattggtctgactgatcacggcagtgtcggcggtttgatggagttctggaaagcaggacgtcagcgaggcattaagccgattttgggtgttgaagcatacgtaacgccagaaactggccgcacggatacgagatgcgtatcttgggataattcgtggaaagagaggaatactcgaagaagtgttacttgtgtgcctcatgatccttatgatgtcagcggtggtgggctgtttactcacttgacgctatgggcagagtccgatgaaggtcttgtcaatctcatgaaagcatcttccgtggcgaatctcgaaggtctggtctcgcgttatcctcgcatggataacaatgtcttgtcatcatttgcaaaaggacttatttgtgggtcgggctgcatgtctggagccattccgacaagattgttgcttggacaatttgatgaagcgttgcgaatggccggtgaactacaggatattttcggtcgagataatttctttatagaaatcatggatcatggtttgtccattgagcaccaaatcaggaatgatctagtggaactggcgaaacgaattaatgcgccgttagtcgcaactagtgatgtgcattatgcaaagcgtgatgacagtctaaaacatgatgtgcgtatatgcattgaaacaggtgatgtgatggatggtcctcatcgtttcaagtttgaaagcgaggagtattatttgcgttcatctgcggttatgcggtctctgttctccgatgtgcctgaagcctgcgacaatacgttgctcatagcagagcggtgcgataccggattttgtgtagcggaagatggctcattaatgccgcagcatgttggtgctgatggccgagcgtcgagtgaaattcttcaaggggaagttgaaggatggctgcaaacgaagtatggaagcataccggattcagtgtggaatcgtgctcaacacgaaatggctgtgattcgtgaaacccatgctgaagaatacttgatggccgtcgcatattgtacgaatcgattgcgagaagaggggcatttggtcgggcccgggaaggggatattggctcgcagccttgtcgcctatgcgctggggattagtgagattgatcccatcgaatacgatttaccctttactgattttcaagattcagtctttcctacagctgttttgcaaacggaacggggactgtccaggcgggtattgcaatatctatgtgaccgatatgggaatggttatgcagctgctgtaattgcatacagccgttttaacgatgccaaggcagtgaaagatgtgtcgcatgtatgcggatatcaacggttctgggatgcatcctcggctgaggtttggttgcaggataacgccaagaagtctattgcggatgggttgaaagactgtatatatgactgttccgttcgcagtgatgtgttggctctttgcaacaagccccttgccgaagtaacgtccattgttcgttttccttcgggggcagaaagcaccgcgtttgatgcaaaaggctgtgatgaacttgggcttcctcgtctccgtattgcaggttcgagagttttgcaggtggtgcaggatgcccttcgattcataccggattgcaatgtgccgcaagtatgggacgattcttgcagttcgttggatgagagccgtgtgtatgacttactgtccgcgggctatacggccggtattccattcttggatggaatgaagagcgaactgatgcagcagaagcttacctcttttgcggagctaattgacatatgccatagcagaggtgccgaccgcgcagatgctgttgctcgtgcaatgttcgcataccgtgtcgcctatgtgaaaacgttatacacaatcgaattcatgaccgcaatgttgaatagttataacgaggatggcgctagagcgaaactggaaagtatatttgaagaaatgtactgtttaggtattcatgtaagaatgccaaacattaatcaatctcaatattatgcgacagcgtattccagtaccggtgacgatgagaaatcggcatatggaattcagctcggttttaatgcgatacggggcatttcggaacaattggcagaagaaatcgtttcaacccgtaataagggcagtgcctatcgcagttttaatgattttatacgtcgtgtttcattggaacattgcaatgcagggaatgtcaattacctcattagagccggtgcttttgattgcgtcaacccctgcaggaaggctcttgcccaatgtggcaatgaccttatcgaggcggaaaggcaatacagagcagcacaatcccatggacagggtgatttattgcaggatgtaatggatgcaagtccttgtgcgcaaaagagtacagatgaagtcgtccctaatggttcggattgggatcaaaccactcggcaacagctccagtgtgagtctttcaaatggccaataggacgtgcgattgaacaatatgtgtgtgcttagacggcaatgtgatactacgaaatcactaggcttgcgtaagagtgcaaagtgtcatgcgcgaagtcccggatatttgttgcgtcagttatatgctgagaacagatacaactcactggggagggtaaggtatgagtgtcatggtgatacggcccgagcgagggtgtgatgacattcatgccctgattgatcatgtcctttctgatggtgccggatgtacggaagcagattttccggatagttgccgtgggcgattcgttattctgacaccggcaagcttgcgcgcatatgtggaaaagcaagtactgcagtcgatggtccgaccggaattccgcgaacgtctggaaccggggatgaatgtgggtgtccattctctggcaagcatgatgagctcgattatcggcaaccaggattatggaaggtacattcgcccatcaatcagcatgatgtcgctgagaaattacgtagcgaagtgtctgaatgataatgaatcgttgcgtaatcaggttggtgactcgtttgaggctattgaccagttcaccaagcaaattgttgaattgcataatgatggggtcagtgctgaagaggtgcttgctctggccgctcatcagtcgaatgctcgactttcggtgcttggctctttgctgcaactggtggagcaacggttaggtaaacggtatacattccccggagccgcccatgaaaccatatgtgcatgggcacagcggcatgggagtaatcgctggttctatctgtacggtttcgcacacctcaacgcttcggagatgaggatagttcatacacttgcgcaatacgtgcatctgacggtgatggttggtgccggttctgatccggattatctggaagcattgcagagacgcgatgatggaaaccgaaatacgctgtccagtattttcgcttcatccgcttctacatcagtgtgtgcgatgccggatactactgccgaagtgcgctatgcggcagcgtccatcaagaagttcatcgcggacaatccagaaatttcatacggtgatgtgctggtcacctcacgagaccttggttcatatcaagcccaaattgcatcggaattcacgtatcaggggataccgattaatattgccgcgtccagtacgatgcttgaccatccgttcgctgatgcgattctgggactgcttgattccgcgacctacgaacttcaaccccagtccatcctgcgcatactgcgttccggtatcttcagccggtatctgaacttgactccaacggcaatcgatgacattgaaaatcagctgaactccaacaatccggcaacggtatggatcgatacagacataccgttcgctgcacatttgcagaagattcgttcgctgattcagcaagccgctgatgtgtttcggccgcggcctagcgcaaccgtgcgggaggctctaggcgggatggttggttttcttaccgaatacgcccaaaccattgaaggatccgcgccagtttggaccgtcatcatgaatgcgtttgacgacatggttcaacagctcggtaacgattattttgctgaatatgtaggaatctttgctagaaatctagcttcgacgctcgccgcgcagtcaatcgattcgcgtccggtctccgccagcgccgtggacgtattgccgatgtcatcgcctttacatccatacagatatgtgattgttctgggttgcagtgaatctcaattgcctgcgattccgcatgagaccggtctgctcgatgacggcgagcggctggatttgtcacagttcctgacttcccaaggcaagactttggaagcgtggaatgtactttccggtacggtggaacgtaggtccgggcaagaaccgctatggtttaacggtgttgttgccagcgcaacgcagcagttgtctatgacctatccaaagagtctgcgtaacgctgcacaagcatgctcgccatatatcagccaatgggagacgggtacatcggatacgagcgaaatcatcggagcgagcaaacgcgctgtgccgaccgttgaaacagagtatcgtccccttgaccgcgaactggcatatcggttgttcactaggccggattatgtgcatcgcgtttatcgcactcatggtgcagatccttcgatctcgactcgtgtgttcaatgcatcggtttcggcaatagaaacgtactatcgcaatccgtatgagtatttcctgaaatacggattgaaagttaacgtggcaaatgcgttcgcttttgatgccgcgcttgaaggcacgttctatcatgcagtgctggaacatgcggtcaatgcctggatcgagcgacacaagaacgaacgagatttgaacggcttaccacctcagcccactgcaccagacatgcaagagcttatcgccgactattccagactggatcgaggctgcaatcagtggacggtgctgaacgaagacccgcgtatggaggtgctgcggtccagtaatcgtatgcgtatgattcatcgtcagctggtcgatacgctgatggattttgccgtcgatgctgctgcgcaacgtgaggcattatcgtccgcacagacgatgcttacgcctacgtgtgtagagcaagtatttggcaacgttggaggaacgaccggtgcatggcagtcgccatattcaggggaacaattaatcggtagggcgagggacaaggaaatcccggttgcattgcgtatcaatggcaaggtcgaccgcattgatacggtaattcgcgataccaatatttcgcgagagagcgccggcattgttgtgctggactataagtcttctgcccgtacgttgttcggcaaaccgtctcgcaatgatggcggccgcgcttcaaatgtgtactacggccatgaacttcagctgtttacgtatgcttctgccgcccagcacaactccggaatgccagtagcaggcatgttctttctcccgattaaacccagcgcaaccattcgagaacgcatcgcgctgaataaccaatacaacatgttgccgagcgcagacgatggatcaacgagtctgttcgatgagccaagtgacgattcaagtgctcagaacatgcgcatcagaaacgtatggcgaggctttgatatgccgaacagtggcgtgcttataggagaatccgacgaaaccggcatcggtatcgaacaactgagtgcggaagaatttcgtggcatagcggattatgtgcacgggaaaatagtgggtgcctgccagaacatattggacggcaaactgccggtgcgcccttatcgttctttggttgacggccgtgatggtcttgcctacagcgatgtggccgacatcatggcgtgggatgtgttgaatagcaacatattcgaggtggagacagcagtgacattgctggagctcaaagaagcggctcttcatatgaataatacatctgaaggaggcaaggcatggtagaacatgttgatgcattacctaggtcggaagatgcggataatctctcggacgattttccgacaaacaccatgccttacgtcatcagcgcatccgcaggcaccggcaaaaccactcaactcttgcaggatattctgctggacttgctgaaccgtaatgcagacgaagcgcattcatccatccgcgaatcgttaattattactttcaccgttgccgcagccgcagaaattcgccggcgcttggaacagaacctgcagtacgccattctgtatgcgcggcgcaatcatggatgccagccgggttcactcgtgctcttggatacggactatcaattaggtggagacgacagcgaactggcgcgtacgattctgcacgattgccaccatgcgcaaaccgtattctccgttgccttgaacgatctgccaaccgtgcaaatcagcactattgatgcgctctccaaaagaatcgtggatcgcaatgccgatacattgccggtggctccaggattccagattcttgctgatgatgccatgaagaaccggctgagaggccaaacactcgacgcgttattcgaatcgtggtatgacgagcgcaactcaatgcacgcgcggttcatggatgtgttggacaacatgcaagggccccggcatgatggtgacttgcgcgccaccatgatgagcctgtatgacaaggcactcaccaagcccaaccgcatcggttggcttagccggctcgccgaaccataccggttcaacattgcgtcgctgaatcaggtcgttggtggtgaatacggcaatgaatatttggaccgttattttcgaggctggattgatatggcagaacatcctcttgccgaattgcgatcgtgtcttgatgaggcgctcgccagctgccacgatgcgcacaccgcgcagcaagatacggtagtcaaatcattgcggatgatatgcgatttgcctcagtacttgcgtagcgaatcatggaatgcagttcgtgctcgtgttatcgatgccaatccattggacgtactgcccaagcgcattactgtcggcaaaactgccattcttaagagtacggcaatcgccgtacccaaagacagtgaactgggccgtcgattggcggaaacggtgcggggcattaaagggatcgtttctgatttgcaatcgaaactggcctttaccgctgaacaagtggactcgcttgatgaggtcgctgcgcgaagactcgaaggattgattgcgctcatcaccacgttcgaccagcagtatgcgcttgtgaaacagcaggagtccgtagcggagttcagtgatgtggctttctgggcattggatgccatgcagcagcctgacgtggccaagcgtatcggtgctcagtggcgatatatttatgtggatgaatgccaggataataacgccctgcagaatcgattcattcgcgaaatcagccgaaatgcagccaaacttaccatggtcggtgatgtgaagcaaagcatttatgggttccgtgatgcctcgccggaggagttcggcgatatctgcaatagtgttacggatgcgagccatcgccgggaattgtgggtgaactatcgatcggtgccggaaatcatcacttttgtgaatacggtatttgcccgactgatgacgccgaatatgggtgcgaccgattacctgaaggaacagttgcaaatcggctcggcaaagcaagctggtaaaccattcgatgcagaagccattgaattgttggtgagtaacgcggcacctgacttgagtgctgatgttgtggctgatgaaaacggcactgacactgcaccgacagttcgcgccggcaaggacgaattacaggtggacatgatagtgcgccgtgtccaggagctctgcgaggggcctcgcgcgcagtattcatatggggatatcgcggtgctggctcgtggcgctactcattttgccgacctggctgaccgactatatcgtgtcggcattccagtcgaagtacagggcgttggagacctgtatcgtcagccggagatacagatcgccttggattggttgcgtattatcgccaatcgtcatcaggatgtgccgttggttgcggtgctacggactatggggttcacggatgatgatttggcgcggattcgtctgcataacagaggctggctatttgacgttatgcggcggattgctgagagtgggggagaagctgatgaatcggctgttctttcttctgatgtgttgcttgcaaagatatcggcattcctgcgaatctatgatgccgcatgcgattatgcgcgagttcactctctgtctgattcgttgtggcatctctatgccgtttctggcttgttcgatttcgcaggcaatatgcctgaaggtgagcgacggcaggcgaacctgcgcttgcttgtagaaaaggctgatgcatttgctgtagctcaggagcgtggattgcaaccattccttgatgccgtaacaatgtggtccgcgagtggctccggtgaagaagcttcaacagtgcctaccaaaaacgccgtgcatatcatgacgattcataaatccaagggattgcaatggcccgtcgtgatactcatgggtgccagcaataatctgctgaccggatcgagaaccgctgtcgttcgcacgattgctcatcagacaaggaatgaggatggggctgttgccgaatatggcgaaggtgccttatcgttggttgaccaacgtaaccatgttcgagtggatactttccagcgcgcagtgattgattcgcgggccaaggagttggaggcggcagaggaacttcgtttgctctatgtggcgatgactcgtgccgaacgcaagttgattatcgcgggatcgtaccgtccaggaaagaacgatgatggcaatctgaatttgcgtacgatggctcaaggcatcgcgctaagcggcgatggacgcaccatagatccacgaacggtggtcaagaatagtggtagccccaattatctctattggattctaggatcattgctggcgtctggagatgcggatgatgattcgtctgcgattcttcgccctaatgaggtccgtgcgtggaatcttgctgcgggactacaggaaacagcgccggctatggcggcgacgggcagggccattacgattcgattctgcagtgctgcgcctgagccgacgaccactatgaatgagcgaacggacgggtatggctatatcaataaacgtattgatgtgactggtttgcgattgcctgatgagcctccgcgcatgccagtggtagtgagttcctccaaggctcgcagctggatgattgatgatgcggaatctatatctgatgacactgattcgctggctgtattgccgtctgatgacgcggctgcgccaattgccatgctggaagacaatctagatgattggaagcaaaggcgggaagcgcatagtgggttctttattcctgactttatgaagaaggtatccgacgttgagccatctgcttcggaggtgggtactgcggtccacaatgtactggaactctttgattggggtactgagccgttccgtgagcagtgcgaagccgagctgagaaacattgttgaccgtctggaagcgaatcatgtcatcacgccgcaagtggctcatattgtgctgactcgcgagctggaaggcttgctctggtttgtcactggagaaaattgcccgctatcggcgcaaatacgagctcatcgggatactctgttccgggaagagccattctcgatgttgattgaacgtaaccggcttaatgccaaggtgaacggtagcggcatggctggtggcgtgcccaacacgaagaatgacagcggcaacgttgctgagcaatgtgacgacacaatcgtggtccgaggtatcatagacggctatttccttgatccaaccgccaagaccatcaccctcttcgactacaaaaccgacaaaatgcgcccgggtgaaacagtcaaagactggtctcagcgtctccgcaccgaatacgctcaacaacaagctctctacgccgaggccctagaacatcgctattctggatatgctgtagtacggcgatggcttgtagggctcattggacacaggattattcacatttcgtgatcaatgccggggcctcggtaactgactcgttttcagctaaacgttagtagcttgttcatcttcaatattccggtagatatctactgttgattgcttgtcgtgcatattgtgaggagtattgatagctctcgataaggagtcaaaatggacaagcaagagttgcagatggcgaaaaagttaaacgctggttttcgggtattggatgatatatctgatatgaattcttcgtacatacatgttgattggtccgatatcaaagcggcgatgggcggcaacgatctggcttggtccggcgctggccaagcagaaggtacggatggaatagttgaggccgcgaagcgcgcaatggcatcattctcaaatgattcgttgaagatgatgaacgccgtctgcatctctttcgcttgttcggctcatgaaaaactccagaaagtaacgcgtgctgtggatgagatacgtgcctgcgttcaacctgatgccatgattgtttggggcatgatgttcgatggccaaattgattcgggcggagaggtcacagtaatcggattcggtcgatgctcggacagtgtttgattctgcagctgctgattgcctaatgaaggagttgattagccgtgtccgtgaccatgaacgtaatccgggatgaaggtaaaagaattcccattgagcttgcgcgaacgctttatggcgaaatcggtgttgcaatagagaagtattttgagcacctgacatatatggagcattttggtgtggccctatgtcagtttaatcttcgtccttctgacagcgcgaatgaatatgttgctgattgctgcgtgttgcaggccgatgtgaacggaaaggcgactgctgattttcaatctgcttatgaccgtgcggccatcgccattttgatgtctttgtgctatgcgtttcaaagctatctaaatgagagtaatggtcttgatctgcaggatgagaatgggagaggggttggctgctgtcctcttgaagttggaggtgacgttggtgctaggtcattgcctcctggcactttcgctcgctttcaatcttggtctgaccgcttgtgttatgtatttcctaaatatgggatatcgacaatacaatttagttgtggaagcactcattgccgcattggattagatgaattaaagatgctcgctcagttgagtagtgcacgaagaaatatagatgattgtatgcttcgtttctctgagtataagataactggcgcgcgttgggtgaatcatatattcacggagaagacggattgcgatattcatatacgagtgctcagtgatttgacgaaggatgtgtctgagttctgtatcaatgagattattgacggtctaaaccttttgatgaaagccaatcggagctggcccaaagtggataccgaaagacatgagcttcggattatacattgtgaaggtggtgaaagatctgggttcgctagcgcggctctggaatgcgataaagggtccaagaaacgcctttatgatatgttggagctaatccgatgtatcctgcatgatccgccatacgcatatgtttggcatatagcggatgcctccaaagaaacgggcataaagaaggcggaaatagtcagagcttcacagtgcatacctctgtattcggataaaagatatatgactgtgtggaatatggcgtcgccgagcaacctgatagagatgcttagccggtggggcggtttgttacagagattgttcgatcattatggtttagaacgaattaactttgattgtatgatacaggatcgcagaatttgtagtttgttgaccctggacagagaggcccttacgatcctgaggtctttacaattccagactgtttctcctattagccgcgttcaatggcgcacgatgatcagaaatagcatcaccgccgcataatttcctctcgcaagattggattttctcagtagttagttgtacttgatggttcatgatagttcagaatgttgctgacatataatggaccgatacgttgttggcgagtggctggcccggattcaatttgtaagtgcaatgctcgtctttgggtggcttgtcctcgacattagcttgccgagctcgcggtaccaagcctcgttgggtgtttcccagtccgggaccttcatggggggtgtcgttgatctcctggacgatggcctgcaggtcggcgtccgtcaggccgtcgagactggtcctcttgggcaggtagcggcggatccgtgtatgtgttcaatagggagttgaggtttaggtgttgcgcttctatttagaactcaggaaaacagcagaagcctcaaaatcttgtttagagggagaaaacagaatggcgaaaccatcacgttcttcacccctcagtcgaagatgcatccgcaaggtttttattgggttgatattacagaagaacaagcccatgttctgagcgaaaccgataaagcccttgttgtgctccgcttgaagagtaggaacatcctcatggtaaagtgggaggttctgaaatcatatctaactcaggaatgtaaaagatacaacgccaatgagtacaaccattggaaattgaacatctataccgaccacattaagatcagcggcaacaacagagaaatacccgccaaggtttggcatttcaacgctgaagtgtaaagaaaagccatagctgtcactctctcgcctggagttgtcgctatggcttctttgcttactcaatgttgcaagcttttttcaaatggccaagcatttcttcttcatgcgccttgtacgccctttccttccagtaaaggctggctggtttgtcgccgtttttttctgtcagttcactcataatgcgaagtttaatactccccttgactatcatatccttaaatgtacttttctttgcttccggagacatattagaaaatttggagttcacatttctctgaatgatacagagatttccaaactggtcaacaccatccttccattgctcgaatgttccctcagatggattctgcggataccaatgctctacggaatttctaaattcaaaaacaaagtcgctgtatttcttcttctttccgttccggtcgtcattccacagcaagtaatccaggtagttaaagacaatatgcggagtattgacacccatcgcatacacgccgttcgaacaaacctgaaagaagttttcccttactgcatcaatagcgatgttttcggcaactttatcaaactttgtaatggcatcatttttgatattcttgcaatcagcttccgaaagccatatcaagagtttggtaatccagtgcattacctttggggaagtgtaggaaacacgcaaggcggactgcatcataatattggtcttggttcgccaatcatttgtccattcgccggaacgggtgaactcggagttcccgtaatatgctttcttcttcgattgctgtccggaaacatacaggctcttcaagctccattcgccatcagcgctgtcatttgcgtactctctctttatgatgtacttatcgaacaggtatctggttctgagcaggcaaataataaaccctctggcaaaatcttctttgctgtctgcgatcctgccggtatccgttatgccgcaggatacaactctgttgaacgcatcaaggagcttcttatcatccaagagttcatccacgatttttgaagttgctatttcatgggtgacaccgtaaagactcacatagaccttcagcgtatgcagcaggaagtatggaaactcaataacactttcaaagcgaacacgcacatcaccatccacatagccttcatcatcttcaaccttgaagttcttttcgatcaggtcacagattttatgtccggtggtttcctgtgtcgttccacttatagcctttttgtatttctgccagctgttaggcggcatactgttccattcggagccgaaaatagcctctcttaccgcattgttcttgctgatgaagtgcatctgcacatagccggtcatatcgctacaagcatcccatatctttgcaaacaagcccttctcagaatcatcactcaaatagctcataagcgtggcctttagaatgtcgtgttgctctaattgctcacctctggtgttcattatctcataatagcggttcagatcggtattctccggaacctcaatccgatagacgataattttagccagcttttccataaagctttccctgtcgaaatgatcctttgtcaattcgtgagatagtatcctgatgcccctttggattcccggttcaatccgatccatatcgatcttgctgcggttttcgagcagtagttcttcaatgtttcttagggtatagttcgatttttctctacacgcaaatgtgagtgtgggctttgttttgattccaaggcagttcagcagcaaatacagcgaggtaagccgctgctggccatccactacttcatatcgtccgaactgcttggaaacgatcaaggagccaatgtagtaattggagtcctccgcaacatcgttaatatcctcaatcagctgggtgagttgcttgtcctcccacgcataggctctctggtatagagggattatgtactccatatctgtgtcgaacatattgccgttttcaccaataatatgaagttcagttactaatttgctcattccgcacctccatatccattgatttctttgatcgtgtcatacaacaagtctatcctattggatgggctgtccggtcctctccgtacctttatctgcaatccggatatttcgtggtgcatccgggcaaagctgatcttggagaaaataccgattgtgtttgtatatctggaattttcgtcaccgatagcgtacttgtttacgctgtcaaaccccagggtcttcatatctacacggagcataaacgcccaggaaaatagcttcttgactgccatttcatcgaagttatggaacttgtcgtaatagcaaagcagcgcacaataaaacagattcttcgtgtatccgaaaccggcagagccgaactttactttgtccatttcttccggtgtttctacatccttgccgccgcagataaccagcttaatctccttgaaacggggattgttgcagatctccgacttaatatcctggagcagatacatataatgctcgaccatttcaaagaagtcgttgccggaaataaatggctcggtaatctggaaatacggcatagctcggcttgcccgtcgtgcgtaagaataggttgagctttctgcgatacctttataggtgtcgatttccttggctatgaacggtttgcttttaatgcctcggctccaattcaagattggaaacaaatatagatcaaacagctctttgatcttctcagtatcctttgcttcccattttgtaacagcgtgttccatttcatagggatactttttcatttcacggaggtggtacgctttcagaaggtcatgcgggtctaatgccttacctcttgtattttgtgaatcgaaaagctggaacgcttcggttactttgtctacgcaaacaacgacgacctctaaaatatgctcaaaggcatggataaagtcccgttttacatcttcgctctttagggagaaccactctctgataaacgcatagttcctgtgaatgttgaactggctcaccttgttggtgaaatctatctggagaatcgaacactcaaatcccggttcaaggcattgctttagaagcaccagagaaatgattctctgctgcccatccaccacatcgtaggtgtcattctttgttctgtgcaggatgatcgttccgatacggtatttgaactcagttctgtatctgtccgcatcactaattgcattggtgatgtctaggaataaatcgtcgatgttttgaatatcccacttgtacggcctttgatagtccggaatattcagattcatgctcaacagttcatttacgctcttaatttcagccatgcctttatctcacctcggttccgctgccattatcaagttctttcagtcgctccagccatttccggatactgccatctttgaaaaatccaagcaaagcaccatcacagaatcgttctgcccggacagctccggtgatcaatgccatgatgcactgtgcatccagattcgatacatctgcggtgctcatagacttgcttccccatttaaggccattctgattcagaatgtcaccgtaacggttcagctccatgtccttgttatggtcgataaaatcatatatatcatcgataaaatgatgcaccatatcagagtagcttacatatggcatctgaattggatgttcgagcgttccatcgttttcacggtcaataacccaagagccaaaactatctccgtcaaggatacatatatacttgaccagactatcatatttactcattacttttgaggcttctgctgttttcgtgggttagattgcgggttgtgggagtcggacgtcgagtccgccgcaacggagcatgacgagtgctatgaggttggtgacgtggtggaagccgtaggccatgcggatggtgaccttgatgcggttgtcggacgcctcgagcctggcgttggagtagccgagttggatggtcctgaggatgtccgggcgccgtctcctgatcctcctcgcgagttcgactatctcggggatacggttgtgggacgcccagaacacccaatggttcaattccgtcttggcttggtcgctcatcagccacgcgcactcggactcgaagtcgcgcgtgaaccggctgcccggttccgcccacggcacggacgcgaccacgaccccgcacccgggacagtccacgcgcggcatcatggcgaccagttcgacccgccagcagccgaaatcccgatgacgccaacgacgcacgccgccaccttggtcgtaaccatgacgacgtctgccacagcggtgagcatcggagcatgcccctgcgcgggcgcacacgaacctcgagcacgggctcggggcgcaggggcgaatcgacgatccgcacggtctcgaccaccacgcctttgacgttgaggagctggttgaatatgctgttcatcaggcgctttgcggttgtttgtttatcttggtcgaaaacatcctacccggaaagcgctcttcacttactccctcaacggctcaacgacgaaccaccacccacaaaaacagcaatagcgccttatagtacgtatcgataaatatttcccgcccagaccacacggtatggtggagcgcatggctgattacgggaacaactttgtgcaactgcataaccacacgcactattcgctgctcgatggtgcgtcgaagatccctgatttggccaagcgtgcggccgaacttggcatgcctgcggtcggcatcaccgaccatggcaacatgcatggcgcctacgagatgtacaccaactgcgtggccaatggcgtcaagcccatcatcggcatcgaagcttatgtgaccccggaaaccgcacgtcaagacaaatcccgcgtgcattggggcactgaagcccagcgccgtgacgacgtctccggtggtggtcttatcacccacttgaccatgtgggctgaaaacgacgaaggcctggtcaacctcatcaaagcttcgtccgtggccaacctcgaaggtcgcgtcatgcgttatccgcgtatggataaggaggtgctcgccacctattccaaaggcgtgatcgcatcctccggctgcccctcgggcatcatccagacccgtctgcgtctcggtcagttcgatgaggccctgcgcgccgctggcgaattccaggacatcttcggcaaagacaacttcttcatcgaactcatggatcacggtctgcccatcgaaactcaggtgaccggtgacctgctgaccatagccaagaaactcaacgcaccactgctggccactaacgattcccactacgtacacgccgaagatgcccaggcacaggacgccatgctctgcatcaactccggttcccgtcttgacgatccggaccgattcaaattcgacggcaccggctactacatcaaaaccgccgaagagatgcgcgaactgttcaaggaccatccggacgcctgcgacaacaccctcgtcatcgccgaacgctgcaacgtgatgttcgacgaccacgaagacggcgcgttcatgccgaaattcccctgccccgaaggctgggatgagacctccctgttccttaaaaaagtcgaggaaggtctggagaagcgttacgacggcaacccgccgctcgacgtattgaagcaggccgactacgaatgtggtgtgatctgccagatgcagttctgcggatacttcctcgtggtcgccgactacattcagtgggccaaggaccacggcattatggtgggtccgggccgtggctcggccgcaggcgccatggtcgcctattccatgggcattaccgagctcgatccgctcaagcatggcctgattttcgagaggttcctgaaccctgagcgagtgagccttcctgatatcgatgtcgacttcgaccctgaaggtcgtgcgcgagtcatcgaatactgcggcgaaaaatacggcaccgataaggtcgcccagtgcgtgatctatggcaccatcaaaaccaagcaggccttgaaggactccgcccgcatcatgggctacgagttctcggtcggtgaaaaagtcaccaaggcgctgcctcccgcggccaccggcggcaaggatatcagcctgcatgacatcttcgacccgacagccaaacgctacgccgaggccagggaattccgagaactctacgattccgacccggacgccaagcgcatcaccgaagaagccaagggtatcgaaggcctgatccgacagaccggtgtacatgcctgcgccaccatcatgggtagcgcgcccatcaccgacacctcgccgttgctggaacgcaccgatggcaccatcaccaccaccttcgaataccacacgtgcgaaacgttggggctggtcaagatggacttccttggcctgtccaatctgacgatcatccacgacaccctgaagaacatcgtggccaacggcaaacccgccatcgactacaccaagattccgctcgatgacgccgaaacctacaaactcatgtcccgaggagacacgctcggcgtgttccagctcgattccgacggcatgcgttcactgctgaaaaccctgaagcccgataacttcaacgatatttccgcacttatcgccctgtaccgaccgggcccgatgagtatggattcgcacaccaactatgccaagcgcaaaaacggcctgcagaagatcacgccaatccaccctgagcttgaggagcctctgaagcaggtgcttgacgagacctatggcctgatcatctaccaggagcaggtgcaatccgccgcccgaatcctcgccgggtattcgctgggcaaggcagacgtgctgcgtcgagccatgggtaagaagaagcccgaagtgctggccaaggagaaggtgccgttcttcgccggtatgaaggagcacggatattccgaagaggcatcccaggccgtgtgggatattctggtgccgttctccggctacgctttcaacaaggcgcactccgccgcatacggtctgatctcctactggaccgcatatctgaagacgcactacccggtcgagttcatggccgccttgttgcaaggtgccgccaccaacaaagacaagaccgcattgtacttgggcgaggcccgccgcatgggcatccaggtgctctcgccggacgtcaacgaatcggtgtacgagtactcggcagtcggcgacgtcgtccgattcggtcttggtgccatccgtaacgtgggtgacaaggccgtggccgatatcatcgccgaacgcgaaggcccgcgcggcaagttcgtgaacttcatggacttcatccgccgtgtgcccttgaccgcgctgaaccggcgattggtcgaatcgttgatcaaggccggtgccttcgactcgattgacccgaaccgtcgcgcgctgttcaccgtgcacgaggccgccatcgactcggtggtgagtctgaagcgcaaacaggcggagggccagttcgatttgttctccgatgccgaggatgggggagcggaggccatgggcgacgcttccgtgaccgtacccgatcttgaggaatgggacaagaagaccaagcttaacttcgaacgcgaaatgttgggcctgtatgtgtctgatcatccgctctccggtatgcagtcgattctcgcgtccttgcgtgaaatgtccatcgcgcacttggtcgatcgcgccaggacgatgggtgaaggacagcaggtcacgttggccggtctggtcaccaatgtggaccggcgcgtatccaagaagggcaacccctgggccatcgtgaccatcgaagacatggaaagctccgtccaatgcatgttcttcggcaaggtctatgaagcggccgccgccgaacttgccgtggacgccatcgtacagattcgtggtcaagtggagttgcgcgacgaaaccgtttctctgagagccacggaaatgcagattccgaccttggaggccgaggatgaacgtccgttggtcatcacgctgccgccggtggcgttggagcgccaacgcatgatgcaactcggtcaggtgctcgctaatcatcctggttactgcgaagtacatcttgcggtgctggatgagaagggtaacgctcaggtgctcacgtttggcgatcgtttccgcgtcaagcgggatacttcgttgtttgctgagatcaagattctgtttggccccagctgcttgcctgccgcctgattggcgggtttcgcccctggcctctccctcacctggctttgctggggagggctccttcatcagaggggctaaggcatgtgccaccatacgatgtgcgcgactattgtggaacgtatgggcatggagatggcggatactggtaacaacgatgacgagcaacaatggattgccgcgatgctggaacggctgtctcattcgcagttccgcgccaaattcgatttgaccgacaaagaccgagcctatgcccgcaccaaaggcaaggcgaccatcgatcgtcatgcgcgagaaatgttgcgagaccgcattggcgcagccgaaccgaagaacgacggcaggcagacgccatggcgcggccatccggtattcaccgctcagcatgctaccgccacatgctgccgcggatgcatcgaaaaatggcatcatctgcccaaaggccgtgaactcaccgaagcggaggtaaaccgacttgccgatttggtcatggcatggattgagcgggaccttatcaatcatccggttcggtgaagcaccccgcatcctcagtatgcctgtataccttcaatagttatgagccaacagccaacacaggcctcgaaaaccgtagacgcaaggtattggcgaatacggcagaacgccgaacgttgcctatggcgcgttcggcaataatgcgacataatgtctattcaagaagagctgacgaagtgtcaactctaccccaaggaggcggaatatgtactacagcagcggcaattatgaggctttcgcacgcccgaagaagccgtccgacgtggacaacaagcatgcatacatcatcggtaccggactggcggcattgtctgcagcctgttatctggtgcgtgatggtcagatgcctggcgagaacatccacatccttgagaaggacccggtacccggcggcgcctgtgacggtcttgatattcccggcctcggctatgtgatgcgtggcggccgcgaaatggacaatcatttcgaggtcatgtgggatctgttccgctcgattccctccatcgaaaccgagggcgtcagcgtactcgacgaatactactggctcaacaaggaggacccgaactactcgctgtgccgcgccaccaagaatctcggcaaggacgcggggctcaagggcaagttcggcctgtccgacaaggcttcgatggaaatcatgaagctgttcttcaccccggacgaagacctgtatgacaagccgatcaccgatttcttcgacgatgaggtgctgaactccaacttctggctgtactggcgcaccatgttcgccttcgagaactggcactccgcgctggaaatgaagctgtacatcaagcgctacattcatcacatcggaggcctgccggacttttccgcgctgcgtttcacccgctacaaccagtacgagtcgatgattctgccgatggtcaagtatctggaatcgcacggcgtcgaattccgctacaacaccaaggtcgagaacgtggaattcgcgattggcgggggagccggtcccaagcgtgagtacaccggcgtaggccaggacaccatccagaagattcaggccacctccggtttcttcaagcgcaaccctgccagcacgcccaccaagaagcttgccgtgcgcatcgacgtggatcacgagggtgataaatcctccatcgacctgaccgagaacgatctggtgttcatcaccaacggcggttgcgtggagaactccaccatgggttcccagaactcgcccgccgcatggaacccagacctgaagcccggtggcggctgggatatgtggaagcgtatcgccgaccaggacccgagctttggccatccggagaagttctgctccgatccgaatgccaccaagtggatgagcgccaccgtcaccaccctggacgacgagattccgccgtacatccagaagatctgcaagcgcgacccgttctccggcaaggtcgtcaccggcggcatcgtcactgtgcaggactccaactggctcatgagttggaccctgaaccgccagcagcagttccgcgaccagcccaaggaccagttgtgcgtatgggtctacggcctgttcccggacaagcccggcaactatgtgaagaagccgatgaccgaatgcaccggtgaagagatctgcgaggagtggctttaccacatgggcgtgccgaccgacaagatcgaggcgctcgcaaagcaccacgccaacaccgtgccggtcatgatgccgtacatcaccgcgttcttcatgccgcgcgcggccggcgaccgcccggacgtggtgcccgatggtgctgtgaacttcgcattccttggccagttcgccgagaccccgcgcgacacgatcttcaccaccgaatactcgatgcgcaccggtatggaagctgtctacacgttgctcggcgtggaccgcggcgtgcctgaagtgtggggcagcgtctatgacgtgcgcaacctgctcaacgccaccgtcaaattgcgtgacggtgcaccggtcaccgatatgaagctcaacttcattgaaaaggccgtggtcaagaaggtgctcaagaaactcgacggcaccgatattgccaccctgctacgcgaataccacgtaatctgacatctatctggctcccctcaaggtgaggggagctggcacgcgaagcgtgactgaggggagttgaacgtggaatgaattgtcgcgacacgccagtgaacatctgatttcgttacgtgagcctataaaaagccggcgtatcctgatggtaacggcgtgattcaagttgatttcgacacgccgatagaacgccgtcgttgcaacgattctggcgtgccttttcatgcccgatttgcgtgtgttcgtgtgttcgtgtaagttattcacctgttgccgctcagcgcggcgggttccttcctctggttggttttccgtcttgctggtgtggtggtggtttgagaactcaagagcgtgtttgtactacttctttatagtcaatgattgccagttcatttctcgcctgatcgcctgtcgtggtggttgggtacccgggagggtttgatgaggggtgaggttttttgagggcgtccttccttaaggacgtgctcgtcaatttttgttttgagagtcatctgtcgatgtctcttcgcatttttttgtggagggttcgattctggctcaggatgaacgctggcggcgtgcttaacacatgcaagtcgaacgggatccatcgggctttgcttggtggtgagagtggcgaacgggtgagtaatgcgtgaccgacctgccccatacaccggaatagctcctggaaacgggtggtaatgccggatgttccagttgatcgcatggtcttctgggaaagctttcgcggtatgggatggggtcgcgtcctatcagcttgacggcggggtaacggcccaccgtggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttatcggggagcaagcgtgagtgagtttacccgttgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacgatcccagagatggggtttcccttcggggcgggttcacaggtggtgcatggtcgtcgtcagctcgtgtcgtgagatgttgggttaagtcccgcaacgagcgcaaccctcgccccgtgttgccagcggattgtgccgggaactcacgggggaccgccggggttaactcggaggaaggtggggatgacgtcagatcatcatgccccttacgtccagggcttcacgcatgctacaatggccggtacaacgggatgcgacgcggcgacgcggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggcagcacccgaagccggtggcctaaccccttgtgggatggagccgtctaaggtgaggctcgtgattgggactaagtcgtaacaaggtagccgtaccggaaggtgcggctggatcacctcctttctacggagaatacaggatgccgttcggcgtccggtgcggaccctcccgcgcgatggtcgcgtgtggacgggttgctggtgtggaagagatcatgggctttcggttcgtccgtcgtgggatgttccgcgggggtggtgcggatgcgcttttgggctcccggatcgccaccccaggcttttgcctggcgcgattcgatgcccgtcgtgcctgcgggccggccgtgtgccggtctggttggcgtggcggtgcgtggtggcttgagaactggatagtggacgcgagcaaaacaatggttttgaatctttgttttgctgttgatttcgaatcgaactctattgttcgtttcgatcgttttgtgatcatttttagtgtgatgatttgtcgtctgggaatttgctagaggaatcttgcggccatgcaccttcatggtgtgtgttgcttgcaagggcgtatggtggatgccttggcagacaggaccgatgaaggacgtttgaggctgcgataagcctcggggagccgcctacagggctttgatccgaggatttccgaatgggggaacccaccggccgtcatgggtcggtaccggcttcggccggggggtacgcagggaagtgaaacatctcagtacctgcaggaaaggatattccgtgagtagtggcgagcgaaagcggatgatggccaaaccttgcgcgtgtgatacccgtcgggggttgcgtgtggggtgttgcgggatcgcgtgtgccggctccgacgggccggccggcagttgtagaaaaccatgtgtcaggggaaccgggttgaataccgggccgcagagggtgagggccccgtacctgaacgcgcatggtctgccgatcgcgtctcccaagtagcacgggtcccgtggaaccccgtgcgaatccgcccggaccgtcgggtaagcctgaatattcctgtctgaccgatagcgaacgagtaccgtgagggaaaggtgaaaagtaccccgggaggggagtgaaacagtctctgaaaccgtgcgcctacaatccgtcggagcctctttgtggggtgacggcgtgcctatcgaaaaatgagtctgcgagtcagtggcatgtggcgagcataacccgtgtggggtatgcgtagcgaaggcgagtcttaaaaggcgtttaaagtcgcgtgtcctggacccgaagcgggatgatctagccctgagcaggttgaagcgcgggtaagaccgtgtggaggaccgaacccacctgggttgaaaaccgggggatgacttggggttaggggtgaaaggccaatcaaattccgtgatagctggttctctccgaaatgcatttgggtgcagcgtcgggtcattgcgtcccgggggtagagctactggatgcttgcgggcccgtatcgggtaccaacagcaaccaaactccgaataccggtgacgtgtatcccggcagtgagtcggcgggggataagcttcgtcgtcgaaagggaaacagcccagaccgtcgtctaaggtcccgaagcgtgtgctaagtgggaaaggatgtggagtcgcatagacagccaggaggttggctcagaagcagccatccttgaaagagtgcgtaacagctcactggtctagtggttccgcgccgacaatgtagcggggctcaagcacaccaccgaagacgcggcagtattttgtactgggtaggagagcgtcccatgaggggcgaagcggccgtgtgaacgcgccgtggacttcatgggagtgagaatgcagacatgagtagcgaaagacgggtgaagatcccgtccgctggatgaccaagggttccagggccacgttcatcgtccctgggtgagtcgggtcctaaggcgaggccgacaggcgtagtcgaatggatgaacgggtcgatattcccgtaccggctttcagccgccagaaccgaggcttggagtactaacctccgggtccgggcttgcttccccttcgggggtgggatgcctgggcctgttgggaccgatccttgtagtaggtcagcgcaggagtgacgcagaagggtagccggccgcggaggtggttttccgtggtcaagcacgcagcccgtcccgtaggcaaatccgcggggcgtgtgggcgaggtgcgatggtgggggccttgtggcccgatatccggtgatcccggctgccgagaaaagcttcggcgtgaggctcgaagccgcccgtaccccaaaccgacactggtggtcaggtagagaataccaaagcgatcgagcgaatcctggtcaaggaactcggcaaatcactcccgttccttcggtttaagggagaccccgatggtgagccgcctcgcgcggggagcttttgggggtggcacagaccagggggtagcgactgtttaccaaaaacacaggtgcatgcgaaggcgcaagccgctgtatatgcactgacgcctgcccggtgccggaaggttaagaggatccgtcagccttcgggtgaagcggtgaattcaagccccggtaaacggcggtggtaactataaccatcctaaggtagcgaaattccttgtcgggtaagttccgacctgcacgaatggcgtaacgacttccccactgtctcgaccaggagctcggcgaaattgcagtacgagtaaagatgctcgttaagcgcagaaggacgaaaagaccccgggacctttactataccttggtattggcattcggtgtggattgtgtagcataggcgggaggccgagaggcatggtcgccagatcgtgcggagccgcaaggtgaaataccgctctgttcgcattggatgtctaacctcgaacagtgatcctgttcagggacagtgcctggcgggtagtttaactggggcggttgcctcccaaagagtaacggaggcgcccaaaggtccgctcagcccggttggcaatcgggtggcgagtgcaagtgcacaagcgggcttgactgcgaggacgacggtccgagcagggacgaaagtcgggactagtgatccggtgccggtgtacggacgcggcatcgctcaacggataaaaggtaccccggggataacaggctgatcattcccaagagtccatatcgacgggatggtttggcacctcgatgtcggctcgtcgcatcctggggctggagcaggtcccaagggttcggctgttcgccgattaaagcggcacgcgagctgggttcagaacgtcgtgagacagtttggtctctatcctctgcgctcgttggaatgttgaggaggcctgcccatagtacgagaggacctgggtggacgaacctctggtatgccggttgtcacgccagtggcacggccggttggctacgttcggaagggataaccgctgaaagcatctaagcgggaagcctgctccaagataagcattccgtgcagcctcgggctgctgtagtccccatgcagaacacgtggtcgataggccggacgtggaagccccgcgaggggtggagccgaccggtactaacggacgaaaggcaacactattattcccctgattcgttcggggaccgcatcatcctcctgcaaaccatcccgtatggcaatgagcacgggatgaacacaagacgaaacatcaacgaattcgcgtcccctgtccggttcccgggccgccacaggccggcagaccttggtgtctgaccgtataagagaagatttgcggcggtcatggcccaggtgagacgcccggtcccattccgaacccggaagctaaggcctggcacggcgatggtactgcacccgacagggtgtgggagagtagcacgccgccgcaccacacgtacaggaagccccgataccttgaaggtaccggggcttcccgcatatccgaaaccaacaagacaagacaccgacaagatataggctctcgcaactagggtgcggccgaatcgtaagcatatagaagagggaaccctcaagtgacggagagttccctctttgcgtatctggacctataaaggtctagaaattgaaattgtcaggatcggcaccgttgcgcttgccggtgttgatggcggaaatggcggtcatatcatcgactgttaggttgaagtcgaagacctcgaagttctgcttgatacgctcggcatgggtggacttgggcagcacgacgatgccgcgctggatgtgccagcgaatcaccacttgggcaggtgacttgccgtacttggcaccgatctcggccaatactgggttgctcagcaggttgccgccggtaccgccgagcggactccaagcctcggttgcgatgcccttggcacgcagctggccaatgagctcttgattggtgaattgtggggaagactcaatctggtctacggcaggcaccatatcgctgtgggtcagcagctcatcaatatgatgcttttggaagttactgacgccaatggccttggcacggccagaggcataaatctcctgcaagtcatcccaggcctgctgccagccgtctgccggccagtgaatcagatacagatccacataatccacgcccaagcggtcgaggctttcttggaatgcatccttgccgtggcgtgcgcgaatatcgtcattccacagcttggtggtcaagaagaaatcgctgcgcggcacaccagcacggcgaataccttcacctactgaggcttcgttgcggtaaatcattgcggtatcgatatgacggtagccattctccagagccgtctgcaccgcgttcactgtagtatcaccatccggtgtctggaatacgcccaagcccacctgcgggatgacagtgccgttgttcagcataattgtcgattgaattgccataatgcctcactattcgtagtgttcattcaatttcctattttagaaacaagacgatgcaatgagccgcgtttcgcgggcaaagaattgcgtaatgatggcgtgattctcgttcattaggtcattattgcattcattaggtcaatgggtccagggtcttcggcatcagaacccagtcattacgccattcctgaagagccgtcttacggcataccgacctaatgaacgtgaaatcgacctaatgaatgcaacgagtaagcggctacgataataaccagtacaatcacaacccagattgaaggggagagcacgtggcagaggaatatgtggctgcattcgatgcagggaccacggcgttgaagggtgccttggttgataggcaaggccgtatcgtagccagtgcgagtagtgagcttaaccttattatcaacggcgactatcgggaacagagccccgatcaatggtggcaagctttctgctcggcctccaggcacatgattgagcaggcgcggcaatccgagtcagaattcaatgtgactcgcattcgtggcatcattttcagcggtcagatgcaggatgttattgctttgaacggcgagctcaatcccgtccgcaatgccattctgtattcggatggccgagccgaggaacaggccaagcaactcgccaagacatatcagggtggagtagaacgtttcctgaacaccgttggtaaccggctcgaaggctgcttgccgttgcccaagttgatgtggctgcgtgaacacgagccggaaacgtacgcgcgcattcgtcatgtattgatcagttccaaggactacttgatcgcccaattgaccggcgaatgcgtgggcgatgtggcggcttgttccacagccggtgccatgaatatccgtaatggccaatgggatgccgaattgtgcgaggccgcaggaatcgacatggccatgttgccacacctgcacaatccgcaagacaacattggcacagtgacggaatccgctgcacaacgcaccggtttctccgccggaactgcggtatacgcgggcattggcgatgcgggtgccaccacgctggccagcggtgtcagccgccctggtcaatacaacatcaatatcggcacctcaggttggatcgccaccgtttcgcccgaaccgttcaccggcaaacccggtgctgcgaatctggcatttggtgtggaagaagtcttcgtgaatgccgtgccattcctcaacgccggtgacgtgcataaatgggttaccggcgtattcgctgatggcgattacgcggaagcacatcagcttatcgaaacatccaaacccggctccaacggtgtgatgtgcctgccatatctggtgggggagcggttccccgtgatgaacccgaatattcgcggggcctatgtaggcctcgatccagacaccaccaaggcagacatgatgcgtgccgcgcttgagggcgtggccttctccattcgtcaaggtatggaaagttctgacgccaaacccagcgagatttccctgattggcggcggagccagagaaaatgcgtggtgccagattctggccgatgtgttggagcatcccatcgaagtgttcgccaatgccgatattctgccagcagtggcgatggcctcgttggtgttcaatgcaccagacctgctgcaatccgtatgtgaacgcaccgtatatcagccgaatcctgacaccgcacgcacatatgccgacgcataccggcgattcctgagcctctacccgatgctgcgaacgatggattaggaactgagcatcatgaggcaatcagcgaatttggtccgcaaacatatagcggtcaccggactggtgcaaggcgtgggattccgttattttacggtgactcaggcacgtcgacttggtgtacagggctgggtgcgcaattgccgcgatggctcggttgagctggaagcacaaggcagtagcgacgcagtgcaagccttggttgagcaattagccattggtccgcgatggtccgaagtgagtcacgtcgccgtacatgacatgccgattatcgatgagaccgctcgggcatttggcgtgcgtcaataacctgcatcacgaatccacatcacgcacgataatctcacgatacgggtgaacatgggcgttcctcgccgcttaggcccctcacgttggtacgatggggctttatgagtgagaacatcatgcgaatcattgacctgcgtggtcagcacctgtcccgtgccgaactgctcgccgcgatgccgcgcgccgcaatgggcacttccgaagccaccgatctggtgcgtccgattctggacgatgtcaaggaacgcggtgccgcggccctgcgcgacttcgaggagaagttcgatcacgtgcgtcccaagaacctgcgcgtgccggtcgaggcgatcaaggacgccctgaccacgctcgaccccgaagtgcgcgctgccatcgaggaatcggtacgccgcgcccgcgccgtggccgccaaccaggtgccgaaggacttctacaccgacctcgccgaaggtgcccgcgtggccgaacgctggattccgattcagcgcgtcggcctgtatgtgcccggcggcaaggccgtctacccgagctccgtcatcatgaacgctgtgccggcccaggccgccggcgtcgaatcgctggccatcgccaccccgcccgcccgcgacaatgaggaaggcctgccgaacaagaccatcctcgccacctgcgccatcctcggtgttgacgaggtatacgcggtcggcggcgctcaggccatcgccatgttcgcatacggcgccaagggcagcgagccacaggacggcgacatcctgtgcgatccggttgacaagatcaccggcccgggcaacatcttcgtggccaccgccaagtcgctggtctccgcattcgtgggcatcgacgcggtcgccggccccaccgaaatcggcatcatcgccgatgcaaccgccaacccgagtctgctggccgccgacctcatcggccaggccgagcatgatgagctcgccggttccgtgctgttcaccgactccaccgagattgccgacaaggtgcaggagaacctcaagtaccgcgtgccgcgtaccgagcacgccgagcgtgtccacacgtcactgtccggcacccagtctgccatcgtgctgaccgacggtctcgaccagtccatcgacgcggccaacgcctacgccgccgaacaccttgagattcagaccaaggatgccgatgctgtcgtcaagcgcatcaagaacgccggtgccatcttccgcggcccgtactccccggtgccgctgggcgactacatgtccggctccaaccacgtgctgcccaccggcggcaccgcccgcttcgccgccggcctcggcgtgcacaccttcatgaagccggtcgaagtcatcgaatacgacgaggaaggcctgaaggcactcgccgcccgcatcaacgcctttgcggtgtccgaggatctgcccgcccacggcgagtgcgtgctctcccgcttcgtcaaggatccgtatgacaaggccaccctgcgcgagcaggagaagggagccggtctgcgatgagctcgattcccgcaaacctgccgttgcgcaacgacctgatcggtgaggagccgtacggcgctccccagctggacgtgccggtgtgcctgaacgtcaacgagaacccgtatgcgccggacccggccgtatgcgacaccatcgccaagcgtgtgcgtgaaatcgcccccacactcaaccgatacccggaccgtgagcacatcgaattgcgtcaggcattctccgattacctggcccgcgaatccggtacccgtctggacgtggacgagctgtggggcgcgaacggctccaacgagatcatgctccagctgttccaggctttcggcggcccgggccgcaccgcactcggtgccgacccgacgtactccatgtacccggagtacgcccgcgacaccttcaccggttggaagctcgcccaccgcaacgccgacttcacgctgaacgtcgacaaggtgcttgaggccatcgccgaggtcaagccctcgatggtgctgctcaccagaccaaacaacccgactggcaccccgttgccgatggaggatatcgagtgtattctcgccgcctgcgaaaccgctgaagtggccggcgcgggcgagggcgtgcacccgattctcgtcatcgacgaagcgtacgtggaattccgcaagccaggcaccccgagcgccgtgagcctgatcaaggaccacccgaacttggccgtcagccgcaccatgagcaaggcctttgccttcgccggagcgcgagtcggctacctagccgcatccaagggcatcatcgactgcgtgcgcatcgtacgcatgccgtaccacctgtccgccgtgacccaggccgccgcactggctgccttcgaacacaccgatgaacagctgagccgtgtcgagcacctgcgcgaaacccgcgaggccaccgccgcatggctcaaggaacagacctacaaggaccagccgcttgaagtggccgaatccggctcgaacttccttctgttcggtgggcacttcgacaagcgcgaagccatcttcgacgagctcctgaagcgcggcgtactcatccgcgtggtcggaccggacggttggctgcgcgtgtgcatgggcaccgacgaggagatggagaccttccgtaacgcccttgttgaagtgcttcgtatagtggaagcagcataagggacgtttctttccgattgcggcgagacccgaagcgattcgagtcccgccgcaatccaatatgacgaatcacacaggagacatgatggcaagaaccgcgcacatcgtccgcgaaaccagcgaatcacacatcgacctcgaactgaacctcgacggcaccggcaaaaccgatatcgatacatccgtgccgttctacaaccatatgatgaccgcgctcggcaagcattcgctgatcgacctgaccatccacgcccacggcgacaccgacatcgatgtgcaccacaccgtggaagatacggccatcgtgttcggcgaagccctgaagcaggctctcggcgacaagaaaggcatccgccgcttcgccgatgccaccgtgccgctcgacgaggcgctggccaaggccgttgtcgacatttccgggcgcccgtactgcgtgtgcagcggcgagcccgaaggctacgaattctgcatgatcggcgggcacttcaccggctctctggtccgccacgtcatggaatccatcgccttccacgccggcatctgcctgcacatgcaggtgctcgccggccgcgacccgcaccacatcgctgaagccgaattcaaggcgctggcccgtgcgctgcgcttcgccatggaaatcgacccgcgtgtagacggcgtgcccagcaccaagggagccctgtgatggccgacgacaagttcgatccggacgaatcgcacttctccgacgaggagcttgaggccgcgctcgccggattcgagaaagaattcgcggacgattcggcatccggcgatgccagtgataccagtgatgccgctgaaacagcggacgctgcttcagcgaagtccgattccgacgcgaatgatgatacggctgataaggcttccgctgattccggccagcctatgaccgacgacgtcaccgggtccgttgcggatgcggtgaacgaggccatggccgacgtggtcgacccctcgctcggcttcgacaacgaactcgctggactgttgggtaacaaggcgaaggtggcgttgatcgtcacccgtcttgcctccgccgaactgttggccgcgttctgccagctgtcagatatctccgccgcatgcatcggtgccaatcagggggccgtcgcggtgctgaagaatctggacggcgacggcccggaagccgcagccaaggacctgaccaccgtggtatccggcatggccgtgattcttgcagtcaatcgtgccgacaagctcgaagtggccatgtacgtgcagggagaggccggacagagtttcgcgccgcccgtgctgttcacctccacaccgcgcttcgtcgaggacctgatgctcggcatcgtaactctgaaccaactcaagacccaagggtttgaagtggtggattccgctggactcgaccatgaccaggcgatgcagattctcgccaaccacaccagacgcggacgtggcgggcgcggctcccgcatcgaatagacgccaaccaaccagtaggggataggagagaatatgaccacagcggttgttttcgattacggtttcggcaatgtacgttccatggtgcgtgcgctcgccaatcttggcgtcgacaccactctcacctccgattatcgtcaggcgctggaggccgacggtctggtcgtgccgggcgtgggcgcgttcgccgcatgtatggagggtctgaagaaggtcgacggcgaccgtgtgatctatgatcgcatccgcgccggccgtccggtgcttggcgtgtgcgtgggcgagcagatcatgttcgaacacggtctggagcacggggtccatgccgcgggcatcgggctgatcggcggttcggtgaacctgctggacgccgacgtggtgcctcacatgggatgggacacgatcgaggccgcccccgattcggtgctgctcaacggcgtggagaacgaacggttctacttcgtgcactcctacgccgcgatggaagtgaagccggtggatacgtctcgtttcgacattgatctgagcggtgcgcccgaacgcgtgagctggtgctcgtacggccggtcgcgtttcgtggccgcctatgaacacggcccgctgtccgccacgcaattccacccggaaaagtccggagacgccggtgcccagctcctcaagaactggatcgccacactgtaaaaagcatgaagctccctctgacgagagagctcaaatcgtgtatatgtaactgaagaaaggctcttcttatgtcgttgactctgctgcccgccgtcgatgtacgcgatggcaaggccgtgcgcctacgccagggtgaatccggttccgaaaccgattacggttcgccgttcgaggccgcccgtacttgggttgaggccggtgccgaatggattcacctggtcgaccttgatgccgcttttggtacgggcaacaatcgcgatcagctgcgagaaatcgttcacgagcttggtgaccgcgtgaacatcgaactgtccggcggcgtgcgcgatgacgcttcgttggacgcggcccttgaggccggtgccgcccgagtgaacatcggcaccgccgctttggagaatccggattggaccgcttcggtcatcaagaagtacggcgaccgcgtggctgttggtctggatgtgcgcggtcacacactggcggcgcgcggctggacacgcgaaggcggtgacctgtttgagaccatgaagttccttgactccgtgggctgctcgcgttatgtggtcaccgacgtggccaaggacggcatgatgtccggcccgaacatccaactgctgcgtgaagtcgccgaacgcaccgacgccaaggtcacggcttccggtggtatctccaagctggacgatttgcgcgccatcaaggaactggctgaaattggtgttgattctgccatcctcggcaagtccctctatgcacgtgcgttcacgctccaggaagcgctcgcagtcgcgaagtaggcaaaggactcgccttggcgagactgttaatctgccttcgctcagctatcgcttcactcaggtctcgcctacggacagcccactgggctgtccgcttaacggctcagcacgggaggtcgccggatttgaggagtttcttgaagacggcgtagtcttcatcattctgttcggcgtagctgacggcgaatgaggcgatggcctgatcgaattcgtcggtgccacccatgtaattggcgatcgcgatcgaatcgccggttcgctcatagtcactaccatagtgccgtgccggcatgggcccgagccatgcctgacatgcggaccggggcatgttgatgaaatatcgcgactcgctggtgacgaacagtgagatgttaacgcccctcgtaacacggttatggaacgataggcgactatggataaacagcaggagtttgcgctgcgcacggtcgaagaacgcgacgtgcgctttattcgtctgtggttcacggacgtgttgggaacactgaagtccgtggcgattgctccggccgaactggaagccgcgttcgaggaggggctcggcttcgacggctccgccatcgagggcatgacccgtgtatccgaggacgacatgatcgtccagcccgacccttcgacgttccagattctgccgtggcggggcggcccgcaaggcacggcccgcatgttctgcgacatcctgaccccggacggcgaaccctcgctcggcgatccccggcatgtgctgaagcgcacgctcgccaaggccaaggacaagggcttcacgttctacgtgcatccggaaatcgagttctacctgttcgaaagccaggacgactggtccaagaccccgaccccgatcgacgagggcggctacttcgaccacgtgccgcgcagcccaggcatggacttccgccgcgccaccgtgaacatgctcgagcaaatgggcatctcggtggaatactcgcaccatgaggcggggccaggccagaacgagatcgatctgcgatacgcggacgcgctcaccatggccgacaacatcatgacattccgtacggtggtcaaggagatttccttggagcgcggcatccacgccagcttcatgcccaagcccctggccgacgcgcccggttccggcatgcacacgcacctgagcctgttcgaaggcgattccaacgccttctacgaggccggtcaggagttcaacatgtccctgaccgcccgccagttcgccgccggcgtcctgtaccatgcggccgaaatctgcgcggtcaccgaccagtacgtcaactcgtacaagcgcctgtggggcggcaacgaggcgccgagctacatctgctggggccacaacaaccgttccgcgctgctgcgtatcccgcagtacaagccgggcaagggcaactccgcgcgcatggagttccgtgcgctcgacccggtggccaacccataccttgcctactcggtgctgttggccgccggtctcgatggcatcgataagcagatgcagttgggcgagcccaccagtgatgacgtgtgggagctcaccgacggcgaacgtcaggctatgggcattcagccgctgccgcgctcgctggacgaggcgctgaagatcatggagaaatccgacttcgtggccgacgtgcttggcgaacacgccttcggctacttcctggataacaagcaccaggagtgggaggactacaatcatcaggtcacgccgttcgaactgaagaagtacctgccgaagctgtgatggaggagagtgtcccgagatgaacgcaccgatggacggagcaggtgccggtcgtttcttcaacccgcaggtcgccgtcctggtgaccgtcaccttcatgctgggcatgagcgaattcgtggtggtcggcatccttcccgacatcgcctccggccttcgggtctccgaggtgaccgcgggcaatctggtggccctcttcgcgttcgtgtacgcgccctgcacgccgctcggctccgccctgtcggcgcggttcccccgcttcgccacctatatggcgctgatgggcgtgttcctggcgggcaatgtcctgtgcgtcctcgcgccgaactatccggtgctgctggtcgcccggctgctcatcgcgtcggtgtccggcacgctggtggccgtttccatgaccttcgcgcccgacgtgaccgaggacagataccgcaccaagttcatcgcctgggtgttttcgggattctccatcgcctccgtggtcggtgtgccggttggcacctgggttgccgccgccttcggctggcgggcctccttcgccctgatttcgatcctcaccgccatgctgatggcgctgatggccgtggtgctgccgcgtaattcccacccggcgcgaatcgggttcctccggcagttccgcctgttcttcgaccgtcgcatccagcttggcgtggcggacgtggtgttcggtgcggccgcatcctatgtcttctacacctatctgacgcctatcatgcgcgacgagatcggtgtgcccgagcacatgatcagcatcggcctggtgatatacggttgcgcctgcctgtggagcaacctgtacggcggcacgttggccgacaagggacatggcgtggagccgttgacccacatgcgcccggtctacggcgctcaggccgtctgcctgtgcctactggcgttcgcgtcgctggtgccggtcgccggagctctgctgctggtggcgctcggcatgttcatgtacctgcagaacgcctcctcccaggtgctgtacatggacgtggcgtaccagtcccaccccggttcggtgaatctggccgcttccctgaattccatgtcgttcaacatcggcatcgccatcggctccgcggtcggaggcatggtcaacgacgcccttggtctggcttggcttggtccgttcggcgcgatattcgcgctgctcgcggtcggcaccacgaccctgctgcgtccgtacgtcagcccggtcggggaatgacgggtggcgtgacgcgcgggaacgaaggttttttcccgcgtgtccccgcggcatgccttatccgccgattgccgtccattgataacctgctatccaaataaccgataaggccacagcatgtcatcctgctgcgaaaccttaatgttaggacaccggctgcagggggacccggctcacgggcgcccacctgcgcggattgatgattatcggcatgttcagcgtgaaaatggggatgacaatatgacggatgcgactgcgaaagccgcgccgaaggcggaaagacggcggcgcgttctccgttccggcgctcgctcatcgatagtggtcggcggcgccatcgtgctgttcttcgtgctgctggcggtgctggccgggccgttgtcggccatcaccggcaacgacccgtacgccgagcatcccgaggccttgggtgccgggtcggtgccggccggattcggcggcggcatcagtgcccggcactggttcggcgtcaccccgctgcgcggcgtcgacctgttctccatcgtggcgtacggctcacggatctcgctgggcatcggcgtcgtctcgtcggtcatctcgctggtcatcggcgtggcgctcgggctgctggccggctatttccccgggttggtcgatgcgctgatctcgcgcacgatggacgtcttcttcggcttcccgttcctgatcttcgcgatcgcgctgtcggcggtggtgccgcagagcttcccgaggccggtgctgctgacgctagtgctcggattcttcggatggcccggcatcgcgcgtcttgtccgggggcagacgctgacgctgagcaagcgcaatttcgccgtcgcgtccaaggtgatgggcgcctcgcctgcccatgtgctgtggcatcagatcctgccgaacctcatgccgctgctcatcgtcaacatcacgctgtcgatccccgggcgcatcggcgccgaggcgggcctgtcgttcctcggcgtcggcatgaacccgccgacgccctcatggggccggtccatctccgacgccgtgcagtgggccctggtcgacccgatgtatctgatcttcccgggcgccgccctgttcctgctgaccttcggcttcaacctgcttggcgatggcctgagcgacgccatcgacccgcgcaagggggtgcgtgcatgagaatcctgcaatacatcggcaagcgcgtggcgagctcgatcgtcgtcatcctgctcatcacgctggcgctgttcctgatcttcttcctgctgccgaccaatccggcgcagctgtcgtgcggcaagccgtgcacgcccgagcagctgcagcgggtctccgccttcatgggcaccgacaagccgtggtacgagcagatgggcaattacgtggcgggcatcttcgtcgggcgcaccttcggcagcggcggcggcgccgtggtctgctcggcgccatgcctcgggtattcgttccgtctcaacgaatcggtgagccagctgatcctcgaccgcttcccgatcaccgcgtcgatcgcggtcggcgcggccgtgctgtggctggtcatcggcgtggcgaccggcgtgtgggcggccctcaagcgcgatacgctgatcgaccgcacgctgctcgggctgtcgatcgtgggcgtttcggcaccgtcatacctgatcggcctgctgacggtgatcgccttttcgctggtgctgcagatattccccagcggcgggtacgtgaacttccacgacgaccctgtcggctggttcacgcatctgctgctgccgtggctggtgctggccgtgctcagcgccgccggctacaccagggtcacccgcacgcagatgatcggcgagctgagccaggactatatccgcaccgcccgctccaagggcgtgcccgaatcggtgatcgtcttcaagcacgcgctgcgcaacgcgctgctgcccgtgatgaccatgttcggcctcgatctgggcgggctgctcggcggcgcggtgctcaccgagaaggtgttctcgatgcaggggctcggctcgctgctgctcgattccgtgtcgaacctcgacctgcaggtgctggtcggcgcgacgatattcgccgccgtactggtcatcgtcgccaacctgatcgtggacatctgctacagcctgctcgaccccagggtcgcgctcggcacgaagtagtgcggctgcggccgcaacacgcgatacttgccggtctgctccacggaccggcaccgatagagaggaaaaccatcatgaagaacaacgcatggcgcgtattcgcggcgggggcttgtgccgcggtactggcgctgtccggctgcggcgcgtccaacgacaacgccgccaccggctcggcgagcggcaccaccgtcaagggcggcacgctgaacgtgctgctgtccagcacggagatggatctggacccggccaagagccagggtctgccgaccaccacgaacggcaacatcttccgccgcctgaccgcgtggaagatcaccgacaagggcgagacgaaggtcgtgcccgatctggccaccgacaccggcaagtcgagcgacgacggcaagacgtggacgtacacgctcaaggacgggctcaagttctccgacggcacgcccatcacctccaaggacgtcaagtacgggctggagcgttccttcgccgactcgctgaccggcggcctgagctaccacaagacgctgctcgagggcgcgcagggctaccacggcccgttcgacggccaggagctcagctccatcgagacgccgaacgacaagaccatcatcttccacctcaacgcgccgttcggcgactggccgtgggtcgtctcgctcgccgcgttcacccccgtgcccgacggcaagggcccggcgtccggctacggcaagctgccggtggcctccggcccgtacaaggtcgagtcgaacgaggctggcaagcaggccgtcttcgtgcgcaacacctactgggacaagaagaccgatccggtgcgcaccgcgggcccagacaagatcgtgttcaagatgggacaggacacctcggtggccgcccagtcgatcatgcagggtaccggtgagggcaagaactcgttcctgtccggattcgtgccggccgcgcagctcgcgcaggcgcaggccaacccgaactacaagaagctgctgaccaccagcggcgacggcgcgctggaatacctcgccatcaacacccaacacgtgaagaacgcgaagattcgccaagcgctgcagtacgcggtcgacaagaaggcctaccagacggcttccggcggcgagatcgccggcaacttcgccaccacgctcatcacgcccggcatcgagggccgcgaggactacgacctgtacaaggccgatccgaccggcgacgtggacaaggccaagcagctgatcaaggagtcgggcgagcaggccccgaccctcaagctcatcgccacctccgctcaggccgaaaccgcctcctcgatccagacgagcctcaaacgggccggcgtcaaggtggacatccagacactcaacgacgatgtgtattccgatacgctgaccaacgacaagggcgactacgatctggccatcagctcgtggcagcccgacttcccgtcgccctacgccaacatctccccgctgttcgactcctcgcagatcggccacggcaactacaacctggcccgttacgcgaacccgaaggtcgacgagctgatcaagaaggccaccgagaccatcgatcagaccgaggccggcaagatctgggccgaggccgacaagacgatcatggccgacgcgccggtcgtgccgctgatctattcgaagaacacgttcatccacggatcgaacgtgaccaacttcgtcatcggcaacttcccggcgtacccggactacacgcaggtctcgctcgccagcgcgaactgagccggcatccgcatccggcgcgcgccggcggcatggtccgctcgcgcgcgccggacgcattccaacgcttgtgcatccaaggagcttccaatgagtgaaccacgcgcgatcgtgaccgtggacggtctggccgtcagcttcgacgagcgggaggtgacccacggcgtcagcctcaggctgttcccggggcgcatcaccgctctggtcggcgaatccggctccggcaagtcggtgacggcgatggcactgccccgtctcgatccgtcggtggccagcgtgaagggccacgcgtaccttgacgacgcccttgtggacgacgggccggactccggtccgggcggcgacggcaaggacgccgccggccgcggcatcgatctgctggccgccgacgcgccgctgcaacgcatccgcggcgaatacatcggcacggtgttccaggaaccgtccaccgcgttcaatccggtgttcacgctcggcgtacaggtcgcggaatcgctcaaataccaccagaagcagctcagcgccgccgagcgcaaggccaaggtgctcgaacagctgcgcgaggtcgggctcgacgacgccgaacgcgtgtggtcgtcgtacccgcatgagctgtcgggcggccagctgcagcgcgtgatgatcgccatggcgatcatcaaccgacccaaggtactcatcgccgacgagccgaccaccgcgctcgacgtgaccacgcagaaggcgattctcgccctgatctcctcgctggcggtcgacctcgatctggccgtgctgctcatcacccacgacatgggcgtggtgtggcaggccgcgcaggacgtgtacgtgatgcacaacggcgtgatcgtcgagcaggggagcgtcgcgcaggtcttccgccacccgtccgacgactacacgcggatgctgctcgacgccgtgccgcgcctgcgcatcgacgagcatgcggcagacggcgaacatgcggccggcggcgaacgcatcacggaaagcgacgcgcccggcggcggcaggcgcatcacgcaggtgaacgacgtggccgtgtcgtacaaggccggcagcttcgccgtcaaggacatctcgttcgatttggtggccggcaggacccgcgcgctggtgggcgaatcgggagccggcaagaccacgatcgccaaggtgatctccggccagctcgcgccaacctcgggcacggtgctcatcgagggggaggatctcgccaaggcgcatggcaggcgcaagcgcgagatcctgaagcatatgggctatgtgttccaggacagcggatcggcgctcaacccgcgcaagtccgtggcatggagcatcggcgagccgatgctcgtgcagggcgggctcagcgagacggaccggcgcaagcgcgtccttgaattgctcgatcaggtggagctgcccgccgatgtggccggccggttcccgcaccagctgtcgggcggccagcgccagcgcgtcggcatcgcgcgcgccttggcgctcaacccgtcgctgctcatcgccgacgagccgacgtcgtcgctggacgtgaccgtgcagcgcaaggtgctcgacctgctgcgccggctgcagcgcgagcacggtttcgcatgcctgttcatcacccatgacctgggcatcgtgcaggaggtgtccgacgtgatcacggtgctgcgccacgggcgcgtcgtggagagcggggagaccggccgtgtgctcaaccatcccaaggccgagtacacgcgtaccctgctcgacgcctccccgaagatcgacctgtgagccgtgccgcccgtcatccggccggctctccggccgtgcggcggggcggcgacgacgcggatgacacctagccttaccgtggtttcggttttttgccgttcccgcccctatcggcgcgcggcaccgaaccagttggtgtatatgagggcgaagttgcggttgccgtagctggagcatgagtcgccctcgccgaacccggccgccagcgaggcgtcgttcggctggtagggcgtgtagatgtagagcagcgcggtcgccgtgttctcgatgtacacgttggtgccgccgcacccggcatccgggtggtactggatgtagttcagcgcgttggcgtgatagccgtaggcgctttcatgtgccacgtagtattggtagcggtgcgccgccccgtacacctgtctgaagaagccggcataggccggatcgcagttcgcgtcgtccgggcagctcagccccatggcggccttgtactggaagcccgtcggatcgacggccgtgaccaggtgctgctccttctgcatcacggtgagcagcaccttctggctgatgccgcacgcgcgcgccgacttgtcgatgatcgcggccgcggtctcctttctcgcgccctcgtacgccgcgcaatactcgttcgccgcctggtcctcggtgtcgaaggtcatggttttcaggcaccgggaaccgctgcacgccgcgccctgcttgtcgaggaacgactggacctcggcctcgctcatcgcattggcgttgaagaactggccgtccgagatgatgtcgccgggattgaaatcgtattgctgcgtcagctgcagctgacgggcctcggcctcctgcacgtcgcgacgccactggacgacccgcacagtgcccacgaccagcgcgaccacgcatgcggccgccaccacggtgaccagcgcagccgtgacgcgctgcgccaacccggcccgcttccaccagcgcgccgggctgagcggatacctgcgattgcgcgggcgtttgcccgggcgacgtttgcgattgccgcctgacacgccccgccccgcgacaatcacgttcgccctgccgcgcggattggccggcttgcgccgttgcgtcgtcgccatcgctacgccagcgccttcttgatgcgctgcaggctcaccggcttggcggtgccgagttcctgcgcccacagggacacgtagaattcctcgagcatccagcgggcggcggtcgcctgcttcatcagcgtctcgtggcgagggccggccggctccgccttggccttggccatcgccttgtcgaccagcgtgcgggcctcgtcggcctcccacgcccatcgcacgtcgcggttcttgtcggtcttcgccttggccaggcgcatgagatcggcctgcaggtatcgggagatgttcgccagcgcatccgggggagtacgcccgacgaatccggggaacaccagcgtggcgatgtgctcgcgcaccgactgcagcaccgacagcatcggcaagtcggccttgccgccagtggccttgtcgacttcggcataagccttgagcacggcgatcacgtcatgcgccacctgatagacggtgtcctcgtacacttcgcgcacatcgagcaccgcattggccaacgcctcatcgtccgagagcctgtcgacattcggcatcagccgtttgaccgtggccagctgcaggtcttcgaccagatccttggtggacttgtacggagcagaagccagcatcaacgcctcggtacccagccagcgcgacgaaatgcgttcggccggcaaccgcagcgcatccaatgcgccacgccagagcatcgtggcccgggactcggtggtggcacccgccttatgcaacaggttcgcctgactgaccagcttgccctgctctccagcctgatcggcctgcttcttgaccatttgacgggccgacgcctccgcctgcgcggcgaacttgcgttgcagcgccttcagatccttggatacacccagcaccttgacggggccgcgcgcatgccggcgtccacgagggtgcttgccggccggcagttgctgctccaccgagaacgtgaccctgagatacggggaaagacgctcgaccagttccggccccaacacttcgggatgaatctgcgcacccttggtggcgatggccgccttggtgaacacatgtgccagatcgggccagccaacggtcgtgccatcctcatccaccggcggcagattcggcttctgctgcgagcccgagcccggcagatccgggtaatgctcgtcgatccagtcacgaatcgcacgcgcggcatccggggccggcacgaactggacgcgcagctgcttgggcagcgccttgatcatcgacaggatcagctcatccaacaggcccggcacattccatgtgaactggtcgggcgtgatacgcgagagcgccttcaacggcacatgcacggtgacgccgtcggccgggtcggccggatcgtacacgtagctcaaacgcaggtcgatgggttggccgtccgatccggtcgtatgccaatggtcggggtaatcgtccagactcaccgaatcgctggatgccagacgctccaccttggccgggtcgaaatcaagcagattcggctgacggtcatgctcggacttccaccatttcgccagatcggccacgctggtcacatcgttgggaatgaccgcgttgtagaagtcgaacagatcctcgtcggacacggtatccgccagctggcgagtgcggctcgcatcatcggcggcatcctcgagaatgtcgcggtttttgcccacaaagtcgtcgtaactgaaacgctgctgaatatcgccctcgaccagaccctggcgaatcaggaagtcgcgcgcctcaagcggattgatgcgtccccactgcacggcacggtcctgtacgatcggcagaccatacagcagcacgcgcgcggtggccacagccgagccacgcgaacccgaccagtgcggctccgcatacgtggtgcgggtcaattggccggccagcggttcggcccacgtcgggtcgatggccgccgaatagcgggcccacaggcgagaggtctccaccagttcggtgctcatcacccatgacggggtcttcttggccacggcggaggcggggaacagggcgaaacgggtgccgcgcgcgccctgataatcgttcttcgactgcttctgggcgcgtttcatcgcacgggcgcgcgccgcaccggtcagccccgcgaaatcggatgccttgggctcacgcaccacctgcatgcccatcatcgacagcaatccggcgagcatcgacttgtggatgccatccgcatcccacgagcagcacagcgaatgcgcggcctgctgattcaacggcatctggcgaatctccaagcctgggcgggaggcgggcagcgggtcgccgaccttgaaccgcagctcccggcacatctggcgtagctgggagacgagatccttccactggcgtatcctcagccagctgagatactcggttttgcagatacggcgcagcgcgttattgctcgggtcgccgtccgcctggaacacgcggtcccagatgttcagggccgtcaggaaatcggaagtctcatccgcatatcggttgtggatacggtcggcatcctcacgcttgtcgtccgggcgttcacgtgggtcctgcaagctcaggaacgccacgaccacgagcacctgggccagaagattcggcgaaccggttttcgcggcctcgataaccatacgtcccagacgcacgtcgatggggatgcgcgccagctgacggccggtatgggtgagcgtcacctcgccgcgctttcggccgatggccttgagctcggtgagctcattgaaaccgtccgacacggccttcatatccggcggatcgatgaacccgaagttcgtgacgtcctcggccgtgcgggccacgcccaccgacagcatgtgaagcaccacggcacccagcgaggtacgcaggatttccggctccgtgaagcgcggtcgggtctcgtaatcctcacgcgaatacaggcggatcgcgatgccgtcggccacgcggccgcatcggccggacctctggtcggcactggcctggctgatcggctcgatcggcagacgctggacctttgcggtcttcgaataccgggagatacgggcggaaccggggtccaccacgtagcggataccgggcacggtcagcgaggtctcagccacattggtggcgatgacgatgcgctgatgcaaatgcgattcgaacaccttgtgctggtcggcggcggacaatcgcgcgaacagcggcatgatctcgatggcgtccggtcggcgcatgtcgtcggcgcgcggaccgtaatgatgccgcagtgcggcctcgaactcgtggatgtcgcgctcgccggaagcgaagaccagaatatcgcggggaccgcgctcatgggaggagtggatcaccagttcggcgcaggctcgagccacggccgtgggcatgtcggtgatgccgtcatcggcataggagtcgccggaccggccgcggggccggtcggaatcggattccgcgatggcgctggccagctcgtcgtaatcggcgtcgccggggcgggcgcccaccgcgaatcccggcacttcgcgcatcaacgcgggcgcggtgccaagcggctcatagaccacctgcacggggaaggtgcggccggaaacctcgattaccggcaccttctcatgcaaggcgtgctcgaaatgctcctggaacttgaccgaatcgatggtcgcggaggtaatgatgagcttcagatcgcggcgctgaggcagcagtgccgtcagatagccgagcagaaagtcgatgttaagactgcgctcatgcgcctcgtcgatgatgatcgtatcgtattgggtgagtttcggatcgcgctggatctgggcgagcagaataccgtcggtcacgaccctcaatcgtgtgctgggcgagctttcgtcggtgaaacgcacctgatagccgacctcgtcaccgagcttcacgcccatctccgaggcgatacgttcggccaccgtacgcgcggcgatgcggcgaggctgggtgtgcacgatctgcttgccgtgcgtgccacggccaagctcaagcaggattttcggcagctgtgtggttttgcccgaaccggtctggccggacacaataacgacttgggaacgtttgaccgcgctggctatctcatcacgcgcggcagatacgggaagttctgcaggatactcatatttcatgacgaacttcaatgatacggaagcccttggagctcgcgtatttgctcgcagtgaacccctcgccgagcgcatcgtccagccaggggatcagcgaatcggagccgagattcttctgcactacgagataggcggcgccgcccactttgagcttcggcagccaagccataagcaacgtatgcagcgcttccttgccgactcggatcggcggattcgaccaaatcacatcaaacgtgaggtcgcccggcaccgtctcgcagaacgccggctggttctcggcgggcaggggagtgctggactcgtccacctgagccgtatgaatgttcgtgcggccgttcgcctgtgcgttggcatgggtcaggtccagcgcgcgctcgttgacatccaccgcccacacgttcgcttcgggcgactcaaacgccaatgtcagggcgatagggccccagccgcagcccaaatccaggaaatcgccggcaagcggcggctcgggcgcatgcttcagcaataccgacgtaccgaggtccacgcgcgagccggagaacacgccgttcgacacctgagcggtcgtctcatggccgcgcaacgttacgttcaatgtgcggcgcacatccttcgacgcgggttccgcagagaaatactgttctgccatggtcgctccatttctgcgggattcgccgctctcgtatgccgacctgtatcagccggcctatgccggtacgtgccgatctatgccagcatgtcacctcatgtgatgataataaaggaccatagaagaatcgtgaaccattccaaccaaacgaggcgcacttgaccgacaacacccagtacaccgacatcgaccgcggcaacaacgacgttacccctgaaggtgtgctggccgggcagtccgaagtgctgctcgacgacagccagcgcgcgaccggctggcatgaggacgccaaccaggaatgggaggagcgcgaggcccgcaacgagctcaagcatgtcgccggtctcggcgagctgcaggacgtcaccgaagtcgaataccgcaaggtgcgtctggaacgtgtggtgctcgtcggcgtctggtcgtccgccgtcaccacgcaagccaaggccgaggaatcgttgagggagttggcggcgctcgccgaaaccgccggtgcggtggtatgcgatggtttgctgcagcatcgctccaagccggatgcagccacgtacgttggttccggcaaagccaaggagattgccgacatcgtggcgcgtgaggaagccgatacgattatcgtggacgacgacctgccgccgtcacagcgccgtgcattggaggacgccgccaaagtcaaggtggtggatcgcaccgcggtgattctggacatcttcgcccagcacgccacctcgcgtgaaggtaaggcgcaggtggagttggcgcagctcgaatacatgctgccccgactgcgtggttggggtggttcgctgtcccgccaggccggcggtcgcgcggccggcgcggatgcgggcatcggatcgcgaggcccgggcgagaccaaaatcgaaatggaccgtcgtgtgattcgcacgcgtatcgccagactgcgccgtcagattcgtgagatggccccggcgcgtgaggtcaagcgcggttcgcgccgtcgcttcggcctgcccacagtggccgtggtcggctacacgaacgccggcaaatcctcgttgaccaaccgtctgaccggctcggccgaactggtggaaaacgcgctgttcgccacattggacacggccgtgcgccgcgccaaaacccgcgatggacgcgcttacgcctatgtggacacggtcggtttcgtgcgccgcctgcccacccagctggtcgaggcgttcaaatccaccctggaagaggtggccgaggccgatgtgatcctgcacgtggtcgatggctcacaccctgacccgttctctcaggtcgatgcggtcaacgatgtgttggcggacatcgaaggcacggcctcgattcctcgtattctcgtattcaacaaggccgatcaggcggacgagacaactcgtgaacgacttgccgcactgcagccggatgcgttcatcgtctccgcctataccggtgagggattggacgagctgcgtaccgcggtcgaaagtctgctgccggtcccgcatgtgcatgtcaacgctctgctgccgtataccgctggctccctgatctctcgtgtacgcgaatacggcaaggtagacaaggtggagtaccgcgatgatggcatactgcttgaagcggacgttgacgcccatcttgccgctcaggtggtcgaacagtccattgactaacgtgataaacatcacagtttgtttgggagcgctaacaaccgttgagaacattaccataccgttatcaaacagggtggtgcgctggtagcaaaacgtcttagcgggtttatagagtgaagacgttagttacaaggcctgccattcatcagcagaccgcctttgaagagaggttcatccatcatggcggaaactaccgttaagcccacgaagcttgctgttattggtgccggtgccgttggctccacccttgccttcgccgccgcccagcgtggcgtcgctcgcgagatcgtgcttgaagacatcgccaaggagcgcgtggaagccgaagtgcttgacatgcagcacggctccagcttctacccgaccgtgtccatcgacggttccgacgatcctgagatctgccgtgacgccgacatggtcgtcatcaccgctggtccgcgtcagaagccgggccagtcccgtctggagctcgttggcgctaccgtcaacatcctcaaggccatcatgccgaacttggtcaaggtggctccgaacgccatctacatgctcatcaccaacccggtcgacatcgccacccacgtggctcagaagctcaccggtctgcccgagaaccaggtcttcggttccggcaccaacctggactccgctcgtctgcgcttcctgatcgcccagcagaccggcgtcaacgtcaagaacgtgcacgcctacatcgccggcgagcacggcgactccgaagtcccgctgtgggagtccgccaccatcggcggcgtccccatgtgcgactggaccccgctgcccggccacgatccgctcgacgccgccaagcgcgaggagatccaccaggaagtcaagaacgccgcttacaagatcatcaacggtaagggtgccaccaactacgccatcggcatgtccggcgtcgacatcatcgaagccgtgctgcgcgacaccaaccgcatcctgccggtgagctccatgctcaaggacttccacggcatctccgacatctgcatgtccgtgccgaccctcctgaaccgtcagggcgtcaacaacaccatcaacaccccggtctccgacaaggagctcgccgccctgaagcgctccgccgagacgctgaaggaaaccgccgcccagttcggcttctgataaaaatcgctgtacggagcgcctttcgcaccgcacaaggctcgacctattttgtaggccttcactttgtgcggcacgaaggtcgcgcatgtgcagcgattttctataccctgctgaatgctcccgttgagagcatttttttattcgtggaattcgttgggggagtgggagctatagccctcgggctcgagctggaaggtggtgtgggggatcgagaccgggaagtgctcgcgcaggcaatcctgcagttgggtgaggattgtggcggcatcttccatggtgaggtctttgtcaactaccacgtgggccatcagaatcggcatgccggtggacaccgtgctggcgtggaggtcatgcacggcaagcacatgcggcatgctttccagatgttcgcgtaccttatcgaggtcaagtccatccggcgtttcctccagcagcaccttgaccgcgttgtgcagcaacttgatggcgcgcggaatcatcatcagtgcgatgacggcaccggccacggcgtcgaagccattccatccggtggagatcattaccagggcagaggccaccacggccaccgagccaagtgcgtcattcatcacctcgaggaacgcggccttcatattcatgttgtcttcgcgctgcgaggcaaggatgaaaatcgagatgatatttgcggcaagacccagaatgcccacgaacagcagcaagccgatatcgtcgatttccgctttggaaccgccgaacagacgcatgccggcctccaccaacgcatagatgccaacgacgagcagcaccacggcacctgcggcagcggtgagcacctcaagcctggcccagccccaagtacgagtgttgttgggcttgcggcgcatcagtatggcggtgattgtggatgccaccagcacggacatgtcggtgagcatatgaccggcatccaccagcagggccagtgagccggttaaaacggccgacaccacttcgatgaggaagaccgaaccggtgacggtcaacgtggcaatcagcctgcgctgatgcgcggcagggtctacggatgtggatgatgcgggtgcatgggtatgagccatatgtactccttcgctctatcgagttgaaaccgcttctcaataccatttgcgatatggtctgaatacgacgaaaccccggcgcgaggccggggtttcgtaagctgtgtgcgactatagcacgaccagcgcgattcagcgcacgctgatcagctggtggcgaacaggctacaatttgcgcagtacggtgaccaccttgcccataatcgttgcatgtgtgccgtcgatgggcgagtatgcggggttgtgcggcatcagccagacatggccgttttccttgcggaaggtcttcaccgtggcctcgtcatccagcagagcggcgacgatatctccgttgacggcggaattctgttctcgcaccaccacatagtcgccatcgcagatagcggcatccaccatggaatcaccgtggacttccagcatgaacagggtgccggagccggtcagccgttccggcagacgcatgacgtcgtccacatgctgttcggcggtaattggcacaccggcggcaatacggccgacgagcggcacatcgtgtgattcggcaatggcttcggcggggaattggtatatctccgccacattactggtgctggttgcctcttcgctggcttgggagggcttttcgggattcggggcggatcctgccaccacctcgatggcgcgacccttgttcgcgttcatgcggatgaagcccttgtcttccaaaacttgtagctgatgcttgaccgaagacggacttttgagcccggcggcatttccgatttcccggaaagagggagcgaagccttgttcgtcgatatgcgtgcgaatggcgtccaacactttgcgctggcggtcggttagggtggactcgtccggcttctgcttgggggagaagggaatggtgctcacgtcagggctcctttcgttatgccaccagcataacgtgttgttcgcgtgaaatcaaacatctgttcgagtttcgacttgaccgtgtcgaacatttgtgccattataagaacagttgttcgatagaacatctgttcgagagaggtggtcgtgatgactggttcaatggtgatggccccggcctgtagcgcacgtgtagctatgcagcatgctggaacgtcccgccggaatgtgcgtgggaggattatcgcagtgatggtcgccttggcgcttgcctggtgtggtttcggcgcgtttaccgctcagcgggcccaatcggatacgggggccacgcaggtgaccggttatatcgtgcggccgggggatacgctctggtcatatgcttcggctatcacgcctgctggtcatgatgtatcggaaacggtggatgaactgattgcgttgaacaatcttgagtccggatcattgcaggccgggcagcgcattattgttccggctgagtagatgaaacccgatcggcatggtttttccgcccgtacacgttattctggggagcatgcattgtcctttttgccagaaccccgacaccaaagtcattgatacgcgcattagcgatgacggtcattccatccgtcggcgtcgcgtatgcccgaaatgcaacaagcgttttaccacggtggaaaccagtatgctgctggtcactaaacgttcgggtggcgtggagccattcagcagagacaaagtgatttccggcgtacgcaaagcctgccaggggcggccggtcagagaagaggatctgaagctgctgggacagaaagtcgaagaggatcttcgctcccgaggccttgccgaagtcacctcagacgaagtgggcaaagccatcctgaaaccgttgcgtgacttggatgtggtggcgtaccttcgattcgcgagtgtgtaccagaactttgcaggtctggaggatttccaaagcgccattgatggtttgcgtgaataatattcgaatgccatgcaccgtgatatgcgagtgattcgcaaaccatggtgcgcgccaatcatgaagccctgcacttatgaaagagacccgtcaacgacgggtctctttcatatcaatcgaggatgagctgcgtcagctgatgacacgcatgcgaatggtgccctcgatgctgcgcagtgcttcaagcgtggcggcgctgggcttctgagccacgtcggtgaccacatagccaagttcgccttcggtggccagcgactggaaggaaacgttgatgttctcctcgccgagcacacgattgacatgagccagcacaccaggaagattgtcgtgcagatgggcgatacggcacacaccctcgcactcaccgaggttgatctgcggtaggttcacggacaaggaggtagaacccctgaaccagtaatcctcaagacgctgagagacgaaatggccgatggattcctgagcttccaaggtggagccgccaatatgaggagtcagaatcatattgtcttcattggccagtgaggtctcgaacggatctccgctcttcttcggttcaacggggaacacgtcgaccgccgcgccagacagatggccggaatcgaggtgctgcttcagagctcccagatcggcgacgaaaccgcgcgaaaggttaatgaaaatcgcgtcctgcttcatgtgggcgaattggtcttcgccgaagaagccggtgttcgacttgcggccatccacgtgcagggtcacggcatcggactgctccagcagttcgttgagggtgtcgcaacggtgggcgttgcccagtgccagtttctcctcaatgtcgtagaacaccacgcgcatgccgagggcctcggccagtaccgacagctgggagccgatgttgccgtagcctatgatgccgagggtcttgccgcgcacttcatgcgagccggaagcggacttgtcccacaggccatgcttgatgtgatgcgtgtgtgcgggaatgcggcgcatcaagcagatgatgtcgcaaatcaccaattccaccacggaacgggtgttggagtagggagcgttgaacacggcgatgccacgcttgccggcgtactccaggtcgacctgattggtgccgatgcagaagcagccgatggcgctgagcgtaggacgcgcatccagcacgcgggctgtgacgttggtcttggaccgcacgcccaccaggtccacgccatccagcgcgtcgatgagctcgtcctcgctcaaggcgcccttcatggtctcgacttcgaaaccgtggtcacgcaacgacttggccgcgtcggggtgaatgttttccaataacagtgctttgggcatgcttcataccttagatgttcagggacttctcgtctgtttttgtccgaactataaccagtttctgggtcggcctggtcattgccacgtacaggtccgaagcggcgaccgggcggctcggcgcgtcatccccgatgagaccgggctcgaccaccacgacggcatcgaactccagacccttgaccgtttcggtgccgcagacgctgatttgctcatcccattcgggctgctcgatgagccttgcgtattcggccgggtcaagaatggcggccagtttgcggcgcacggcgtcgcgcaccggggcgatgagatcatccggacagatgacggcgatgcggccggtgccgtctgccgaaacgaattgttcggcaagctgcgccgcctgctcggccgtcgtttccagcaaggacgacatgtcgggcaccacgttgcgggacaccgaatcggggatggtgcgcaccgcattgaccgtggagatatagaggccttccttctcggcgaatcgtgaggcaagttcggaaacttcctgcggattgcggtagttgatggtcaactcgttcagatcccagtggctttctccgaacaggcggttcatcgatttgctccagcgtcgggtgccacccagcgccgaagtctgcgccacatcgcccacgatggtgaacgagcgggaggggcaacggcggatcaacatacgccagtccatggcggtcagttcctgcgcttcatcgaccacgatgtgcccgtaggtccattcacggtcggccgcggcccgctgcgcggtcagctcagcgtcgtccccgttcatctggtcgagcagcatctgactggagacgatgcctccacccagaccggtcgcggccagcgtgtctttggcatactgctcttcggcggcacgacgtgcgtcggcggcggactggcgggccaccgtcttgggatcggggcccagcatatccatcgcttcgtcgagcagcggaatatcggaacgggtcagcggggagcccttggggcgggcaagtgccgcgatgtcgttgtcggtcagccaaccagccagagacttcagacgttcgggatgggcgaacagctgatcgatgagccatggggcggtcatcggcagccagcacaggttcagggtcttgcgcacctgctcgttcatacgcagcagcgacatcgcgcggttcagctccgcctgatccggcgtgtaatcaagctgttcggcataacggttctgcatgctggtcagcatcgaacggataaaggtctcgcgggccttgttatgaggttgccgggtgcgcttcgcgtccgcctgcgcctgttcgatatcagtggccagcatcggtacctgaatgccgctaatggttactgtcggcagagcagcgggaacacgcacgcgtgcggcgatggcattggccactacggaggtcatgcgtcggtcgcctttgagcttggctgcataaggggagtcgaccgccgtggcggtgatgccgggaatcagatcgctgatggtgcgtgagaccacgccggtctcgcccaaggagggcagcacctgatcaatgtagtgcaggaacgccgagctagggccaaccaccagcacgccggaacgttccagcgtgcgccggtgcgtgtacagcaggtaggcggcgcgatggagcgccactgccgtcttgccggtgccggggccgccctgcaccaccacggcgcgattcatgtcggagcggatgatgcggtcctgctcggcctgaatggtggccacgatatcggtcatcttgccggtgcggcgtgagctcaacgaagccagcagcgcaccctcgccggtcaatgtgccggcggaagacgcctggccgacctggtctgaatgcacgtcgagcacctcatcctcaacgcccacgacttcgcggaaactcaaggtgatatgcctgcgcatcacgatgtcgccgtgattggagggggtcgcctcatagaaaggacgtgcggcttcggcacgccagtcggtcagaatcggctcatggtccgggctcgacaggccgatgcggccgatgtaatgacggtcgccgttcttggcatcgaggcggccaaacaccagccgatcctcaacgctgcgcaattgcgtgaggcggttttcgtacattgtggcaaaggagtctcgttcgctgcgttgcgtgggggatccgtgggagccggcggcgcgtacggtgtccaggcgttgccacatttcggctcgcagatcgtccaatcgtccataggcgcgatcgacggcctgctgctcctcatgcagctgggaggcgtaactcgacatgctgttctcttcgttccatttccgtggggcagaaaaacttaaggcattcaaatttaccgcacaccccctacgtcagtgatgcggacaacccggaataggtgaattcagcgtgaattcaccatgctgcttggtcggtggagtgcacaacgtggattggatgtgcggagcgtccattcgtgcgacagtcgtggccgacacgcgcaatccatcggtaatcgccctaaaagggtgagcaaatcgtgcaggagtggggagaaatggggaatcgtggggtagagtggtgaaccagttggccgaagtgtatcccacgtaacgatgaaggaggtggagccatggttgccgatcagccgattcgcgacgctgatgccaacgcacaaggctccaccactatggccgatctcatggctggtctgccgccattgcttctcggcacatatacgccgaagatcgatgccaagggccgtatggcgcttccggccaaattccgctcccagctggggcagggtctggtcatggcccgaggccaggaacggtgcgtgtacctgctgccgttcgatgaatttcgacgcatcgcctcgcagattcagcgtgtgtcggtgggaaacaaagccgcccgcgaatacctgcgtgtgttcctttccggtgccgtcgaccagcagccggacaagcagggccgcgtactggtgccgcagatgctgcgtgattacgccaatctgggttccgacgtcgtggtgatcggcgttggcacccgtgccgaactgtggaataaggacacgtgggagtcctacctcgccgagaaggaagagggatattccgacattgctgacgatgtgttgccggaggtggaattctgatggttgatgtggcgaatattcatctgccggtattgcttgacgattgcgtgaacctgatggcgcctgccctggaacatgagaacgccgttgcagtggattgcactttgggccttgccggccattccatcgccttcctcaaaaccgcgcctcaggctcggctcatcggcattgaccgtgacagcgaagcgctggggctggccgccgaacgcatggaacgggaggggctcgccgatcgattcatcccagtgcatgccgccttcgatcagcttgatcaggtgttgacggaccgaggcatagaacgtgtggacgccgtattcatggatctgggattatccagcctgcagatcgacgaaaccgatcgtggcttctcctattcgcatgatgcgccgctggatatgcgcatggacgtcagccagccgttgacggccgaacggattcttgccacctatgatgcggcggaactggtccgcatattcaaggaatacggtgaagagcgtttctcgcgtcagatcgcccgcgccatcgtggcgcatcgagacaaggagccgtttaccaccaccgcacagctcaaccgtctggtcgatgaagtggtgccgcaagcccaccgcccggcgggcaatcccgccaaacgcgtcttccaggcgttgcgcattgaagtcaacggcgaattagacaagctcgcctccacattgccgcaagccgcgaaccgactgcatgtcgggggacgactggtggtggagtcctatcattcgctcgaagacaaaaccgtcaaatcgttcatggcacaagggctgcgagtggatgttccggctggcctgcccgtcataccgccggatgcccaaccgtttttcacggatctcacgcgaggtgccatcaaggccgacgaacatgaaatcgcagccaacccgagatcggcttcggtgcggttgcgggcggtggaagtcagccgtgatattccgtcacgatggaggaaacgctttacgcaaaccgcgcagggcctgaatgacatcaatatacaaggctccgcgtctccgggcagggccaaaaacacagcacgaattcgtacaaggaggggataacagcatatggcaaccgcacgtaacattcgatcgaacgcggctccggcctcgaaccggccgcacaccaagcatcagtcctcctcccgacctgagctgcgggtggtctccaacccgcgtggagacgagcggggcaatgtcgtcggacgggtcatcgaatggaccagaacaagaagcgcaccgctggtgcacgtggccatcgcagtgatcttcctcgtcggcaccttgttcggcgcgctgatgctgcgtacccagatggtgcagaactcgtttgaggcggcacagatcgaaaccaatatcaacagacttacccaagatatcgaagacgatcaggccaaactcgatcaattagtcgcgaacctgcccgacaaggccagcgacatgggcatggtcccgcagcagggatcagtgtccatcgacttaagcggataccagtccaacaaaggcggaacccagtgaacaccattcgtcgcatcgtagagttcgccaaggtcaagaccttcgcgttcaaatgcattgccatcggcgccgcattggcgttggtggcgtcggcatgcgtgattcagctggcctccatccagctcatcggtggccgtcaaaccgcacaagcggccacggctaaccgcaccctgaccgtgacgttgagcgccaagcgtgggcgtatcctcgacgccaacggctccgtgctcgctcaaagcgtggagcgttatactatcgtcgccaatccggaggctgcacaggagttcgagccgattacctgcaatgacaacacccgtgattactgccacgaaattgacggcaaacccgtgggcgctaccggagcgtcggccgtgggccgactgctggccaaagtcttggatatgaacgccatggaactgggagctgatctgtccggtaccgggcagtatgtgattctgaagaaagacgtgaccccacaggtcaagcgcagcatcgaggcgttgcacctgggcggtattgtctggggtgagctgagcagtgaacgactgtatgcggatggcgatctcatgggcgcgctgcttggcggcgtgaacgacaacggcgatggcgtcgccggcatcgagcaggtcgagaacaagacgcttaccggaaccgatggccatgaaacctaccagcgtggtaatggcggcgaagagattcccggcaccatgaccgaatcggtggcggccaaaaatggcgacgatgtcaccctgaccattgaccgtgatgtgcaatggtatgtcaaaaaggccttgaaggaggccgagtccaagtatggtgcagcgtgggcgatcgccgtggtgcaggatgtccagagcggggagattctcgcactggccgatagcgatgaagtacaggctggtaccgatgcggcgaagatgagcccgtctcgggccgtgtccgaaaccttcgagcctggttcggtgggcaaggtcatctccatgtccggctatctgcagacgggactgcataagatgagcgatcaattgtcggtcccggaccacatcacacagaagggccagacctacaaggactcattcgaccacggcactgagcgctggacgctcgccggcattctgcagaactcatcgaacgtcggcatgattatggccggggagaactatccggatgagcaacgctacgagtacctgaccaaattcggtatcggacaaccgaccggactgaacctgcccggtgaatcgagcggtctgctcaccagcccttcggcatgggatctgcgtacgcgcaacaccatcctgtttggtcagggctacaccgtcaacgccctgcagctcaacaacgtggtggccaccatcgcgaacaagggtgtcaagcagcagcagtcgatcatcagatcaaccaccgatgccaatggcaagaccactgagaccaagaagggcgaagccacccgcgtggtggatgaaaaggtcgcatcggacatgatgaatgcgatggaatcagtggcggagagctacaacaagttcgtcaaggtcgatggttaccgcatggccgccaagtccggtaccgcagaggtgcagggttcggatggcgcgctctcgtccattatctccgattattccgtggtgattcccgcggacaacccgcgctatgcggtcaccgtggtaatgaaggatccgaatggtgtgttcggcggtctgacggccggccctgtttccgcacagatttgtgagttccttatgcagaaatacgaggtgcctgtctccagtccacgaaaaaatgctattccagtcacgtggtaaggatcaggggagaaaggcgatagcccatgagtgcagtgagcgaatccatcgcccagcgggtgaccttgggaatgctggtcgaacggtacggttttgaagtcgatccacccttcgccaccaatgtcaccattacctcactcagcgatgccgtggataccgttattcccggctcgctgttcatctgcacgcatgagcaggaacccgatgtactgcatgccgcacaggcaggtgcctatgcggcgttgctgccacgcgcgtccaaagggcagatcgccaatgccgatataccgttgctctacggcgattgcgacgatcgcgtactcggcgatctggccagcggcctggccggcggaccatccaacgccatggcggtgttcgcggtgaccggtgcggatgagcaggccgtcgacgcaggcgtgtcccagctctccgaattcctgcacatgctgggcaatccggtggcggtaatcaccgcatccgggtccacgtcgatgacacgtaccatgaacctgaactatcctctgggcatcctcgatatgcagcgcgcgctgtccgtgtgcgccgaagacggtgtggcggccgtgatcatcgccatggatgaccgcacattggccgagcatgcgttggaatcggtgaacgtggatgtgctgggcacggaagatgtcaacgcaagcgcaagcttggacgaattgaagacacgctacgcattcgttgcggaacatgacatgtccatgacctcgtcgacacccgaatcggatgaaatggctgcggattcaccggccatgtacgaccgcgtccgactcgggcacatgtccttggccatcgccatggtactggccgccggcgtgaggaaaaacaacatacgcagtgccctgcatgtggccaataatctcaattaagtccgtggatgcgggacgaagcgtaatcgtaaaggagtttgaaacaccatggttccgatgagcgtggaggagatcgccaaggccgtcgatggtcgattgatcggcgacgccgattccgagtctcgatctaccaatacggtcagtgactcgcggcaggccggccccggatcggtgtttgtggccatccgaggcgagcatgtcgatgggcatgactttgtggcgaaaaccgctggacaaggagccacggtggccatcgtcgaccatgaggtggagtccgatggcctgccgcagatcgtagtgaaagacacggtcgacgcccttggcgagctcgcccgacacaacatcgttcgccgccgcgagctggacggcgacttcgacatcatcggattgaccggttcggtgggcaagaccaccaccaaggatctgctctcctccctgcttgccaccgtaggcccgaccgtggctccggtgggatcgttcaacaatgagatcggcctgccgctcactgcgttgcgggtcgatgagcacacccggttcttcgtggctgagatgggtgccagccatatcggcgaaatcgcgcgactgacccgtatcgcaccgccgaacacggcaatcgtattgaaggtcggcgtcgctcaccttggagaattcggctcccgcgaacgcatcgcacaggcgaaaagcgaaatcgtgcaggggctgcttcccggaggcaccgcggtactgaacgccgatgacgaacacgtggttcccatggccggcttggccagcggcgatgtgctgtggttcggcttgggatcgtcgcaggagcccgaggtgcgggccattgatgtcactgccgaccggtccgatcatgctgaattcacgttggtcgatgcggacggcaaccatacgccggtgcatctgggcattcctggacgtcacaacgtgatgaacgcgttggccgccgcaaccgtggcgatgcgttacggtatggcacccgaaacggtggcgcggattctggcctcgcagcacaccatcagccctcatcgcatggcattgtccacggtgaatcgcgaggggacttccttcacactgatcgatgattcctttaatgccaatcccgactccatgaaagccggcctgaacgggttgaaggcttggaactcaaatgacggcaaggatccgttccgcgtggcgctgctgggtgccatgctggaactcggcgccgatgagacggcattgcacacctctatcggcacgtatgcggccgaattgggcatcgacgcgatcatcgcggtcggttccgcccaagaccaacatctcgatgcactggcacaggctctggcggacggtgcccgtcagagcccatccgcgtcggtggattgcgtacacgacatcgatgcggccgaacagctggtcatcgacttggcgcgcaaccatcccgacgctgtggtactgctcaagggatcgcacgcgtcaggcctgagcgctttggctgaacgctgggcaaagaactgacctgataaccatcccaagaaaccgacaagaaagagaagctgcacgtgattgctctgatcattggaatgctggtgtcgctcatcgtcaccctggtcggcaccccgctgctgattcggctggtccacaagctgcactatggccagtacatccgccaggatgggccgcagtcgcatctggtcaagcgcggcacccccacgttgggcggcgtggtcatcaacttcgcgattctgctcggttgggcatcctccgcactgtaccgatacctgcgttcggacgatgtgccctcctggtccgcggtgctcgtactgttcgccatgctgtcgatgggtctgctgggctttatcgacgacttcgccaaggtgcgtaagaagcagaacgaaggcctatcggtgaccggcaagttcatcggccagttcatcttcgccaccatatacgcggtgctggcgctgctgattcccaccaaatcgggtttccccagtgcgcaggcgggcatcagcttcatcgaacggccgttcttcaacttcgacttcgccggtcgaaccgtggccatcatcctgttcgtcatctgggtgaacttcctgatgaccgcatggaccaacgcagtgaatctgacggatgggcttgacggtctggcggcaggttcgtcgatgatcgccttcaccggttttggcatcatcgcattctgggaaagctaccacatcaagggcggcagccatggcggatattcctatgccgtgtccgatcctctcgatctgaccgtcatcgccgtatgcgcggccgtcgcctgcttcggcttcttgtggtacaactcgaaccccgcatcgattttcatgggtgataccggttccctggccttgggtggtctgttcgcagccctgtccatcgccacgcacaccgaattcctggcggtggttctgggtggactgtacgtcatggaagccatgagcgacgtcatccaggtcgggtacttcaagatgacccacaaacgtgtattcaaaatggcaccgatccaccatcatttcgaactgaagggttggaccgaaaccaaggtggtggtgcggttctggatgatcgaactcatcttcgtgctgctcgccctgacgattttctacggcgactgggtcacccgctccggcctgctgttcagctagcggaaatctgggtggattatgctcacccacggaattcctatatcaggaggaacaatgcaagtagcggataagacagtggtgatcgccggactgggggtatccggcacctcgttggcggaggtattgagggaacgcggcgcccacgtgattggcgtcgacgagaggaagcccgaggctgatctccgctcctttgatgacgtggactgggaccatgtggactacgtcatgtcgtccccggtgttcaacccccgcaccccgttcgtgctggaagcccaacgccgtggcatccccgtgatgagcgaggtggaattcgcatggcagctgcgtgtgaataacgagcgcaccggtactccggctccatggatcggcatcaccggcaccaacggcaaaacctccaccaccgagatgacctcggaaatgctcaccgcctgcggactcgacgcgccgaccgccggcaatatcgcctccggagacatgagcatgagcctgtctcgttgcgccaccaatcctcagcacgacgtgctgtgcgtggaactgagctccttccaattgcacttcaccgattcgctggcacttgactgcgcggcgatcaccaatatcgccgacgatcacctcgactggcatggcgggcgcgagaattacgccgccgacaaatccaaggtgttccacaacgccaaacacgccatcgtctacaatgcgcaggacgccaaagtcagcgaactggcggccgaggcccaaaccgctgaaggatgccgcaaggtgggattcacgctcgaggcccccaggccggtcagatcggcattgaagatggctggattgtggacaggagcggcgtggccggcggcgcagtgggggagccggtcagactggccgccatcaccgatttcacgcatctggcagagccggacggctcactgtacccgcatctggtggccgatgcattgacggcattggcgttggtgctgggacttggcgctgatcgcgataccgcgctgaaggcgcttacctcgttcaagccgggcggccatcgcatcgaaaccgtggctgaggccgtagtcgagggcggctctgttcgtttcgtggacgattccaaagccaccaacggccatgcggcacgcgcctcgctgtccagcttcccggccaagtctgtgatctggattgccggaggtctggccaagggcagtcgattcgaggacctggtcaaggaccaggcacataccatcaaagcggccgtcatcatcggcaaagaccagcagccgatgatcgaagcgtttgccagccaagctccggacatcccggtgaccatcatcgatcccgaagacaacgataccgtcatggatcgtgccgtcgaagcctgcggcacgtatgccgccgccggcgacattgtgcttatggctccggcctgcgcctccatggaccagttcaagtcctatgcggatcgaggcaatcgattcgccgccgcagccaagacgtggagcgaggtgcatggcctccactgatatccataagcgtaaggcatacagagcccctgacaagcccgcactcgaaatcaccgactacacgggttggcgaagcttgctcaacccgctatggtgctaccacggattccgcatggccgtggtggggctgacatgcttcggcctgatcatggtgttctccagctccacggtcaccatggccgcactgggcaagtcgccgttccttcagcttctgaaccagggcgcgttttgcctgatcggcttggtgctgggcttcgtggcattgacgatgccggtgacgttctggaaacggaccggcgtgttctttgtggtgggtgcctgtctgttgcaggcgctgacctttactccgctgggtctcgacgtctacggcaacaaaggttggctgaacctcggcttcaccactatccagccggccgaattcatgaagttcgcgatatgcatatggctgccctcgtcgttgcatgcctgcagcaagatgtaccacaagaagggaatcaaagcatatgccgcgccgttggtgttgtatgcgataggcgtggcgctggtgatgggcggcaaggacctcggcacggccatgattctggtcttcatcggaggcgtggccttcctgatcgtcggattccccagtaaatggatgggagtcggcgtattgggcgcggtggttatggtcggtgcattggcggtttccagcccgaaccgcatgcgtcgtattctggccacatatggcgattgctcggccgctgacgcgcagagcgtatgctaccagtccattcacgccaagtacgccatcgcctccggaggctttctgggattgggcatcggcaattcgcgagagaaatggaactacctgccggccgcccataacgatttcatcttcgcgatcatcggcgaggagaccggattcgttggttgcgccatcgtattgctgttcttcgcgattctcgcctggtgcatgatcgtcatcgcattgcaggtcaccgatcgttatgttgccatggtgctgatgtgcgtcaccatttggattgtgggccaggccatggtcaacatcggcgtggtcgtgggtgtgttcccggtattgggcgtgcctatgccgttcgtctccgcaggtggctcatcgatgatcatgtgcttgacggcggccggactggttgtgggacttatgcgctctcaaccgcagataaaacagtcgcgtcagagcgcgtaagtagactcggtaatcatggatcaaggcacaccacatatcgttcttgctggcggcggtaccgccggacatgtcaatccgctgctcgcggtcgccggggcgattcgcgacatcgaacccacggcacaggtcaccgtcatcggcactgcggtgggtttggagaaggacttggtgcctgaggccggctacgagctcgacaccatcgaaaaagtgccgttcccgcgtcgccctgacctgtacatgctgcgcttcccggcaaaatggaagcgagaaaccgccaaggtgcgctccattcttgaaacgcggcatgcggatgtcgtggccggattcggcgggtatgcttccgcccccgtctacgccaccgcacataagatgggcattccgattgccatccatgagcagaatgcgcgtgccggcatggccaataaactgggcgctcgttgggccgatttcatcggtaccgtgtacgagggcaccggtctcaaaccgcgtgccggagccgacgtcgagcgcgtcggtctgccgttgcgcccggccatcgcctccctgaccaaacgcattggtgacgaccgtgccgccgtacgccgtgaatcggccgcgcagcttggcgtcgatccgaaccgtccgctggtgctggtcactggcggatcgctgggagcgcaaagcctgaaccgcgccatcgcctcctccgccgcagacctgttggcccacgcacaaatcatccacttgaccgggcgaggcaaaatcagcgaagtacgcgaactggtcacggcctcggccggcgcggacgtgcttaccggcatcggccccgaatcggccggacaaggtgactaccataccgccgaatatctggaacgaatcgatatggccttcgcctgtgccgacttggtgatttgccgcgccggagccggatcggtatccgagctggctgcactgggtctgccagccatctacgtgccgctgcccatcggcaacggcgaacagcgtttcaacgccgaaccggtggtgaacgccggcggcggcctgctggtcgcagacaaggacctgaccccgcagtgggtgcatgagcatgtgcccgatctgctcgccgatcacgaacgacttgccgaattcggccgcaaggcatgggaatacggcatcagaaacgctgccgaaatcatggcccggcacgttctgcaattagccgaaccatccaaatagtattcagatatcatcccgtgcgcgatacgggccaatcccgtcccgcaacacgagatacggtcataatatagggtgctggaatccccaaaggagttttgaattgtctcaagatcagcccatcgtgcttgaccccacgtatgcctcattcgatgctgcggcccgccccgcggatctcggcgccacccatttcatcggtatcggcggtgccggtatgagcgttctggccgaaatgctgcacgccgaaggagtctcggtggacggctccgatcgctcacacagcgccaaaaccgaccgacttgaaacgctgggcatcaccgttgaattcgggcagcgagccgaaaatgtcgcccaggccgagaccgtggtctactccagcgccatcaaaccggacaatccggaaatcgtcgcagcgcacgcggcgggcaagcgcattgtgcatcgcagtgacatcctcgccctgctcatgaacggcaaacgagccgtcaccgtggccggagcgcacggcaaaaccaccaccagctccatgctgtcccacattctggtgaacgccggtgccgatccaagctacgccattggcggctttatccaaggcccggacggcaccacgctggacggcggacacgcgggcaaaggcgatatcctggtggccgaagccgatgaatcggacggcagcttcgccaaatatcatccgaccatcgccattatcaccaactgtgaagccgatcatctcgaccattacggcgacgaagcccactaccgtgccgcgttcgttgcccacgccggccgggccaccggtcacgtgatcatcagcatcgacgaccctgacggacttgccgtgctggaggccatgcccgccgacgtgaaatcccataccgttgcctacggcactaccgcgcgtgaatccctgcccgatttgggcggtgccgcgtatgtctggatcgcttcggaaagtgagaccgcaggcagcggcgtcgaacagctcaccctgcatctgccggccgcggtgacggcgggggagccggtgtctcagagcgttgccctgaaggttcctggcgtgcacaatgcgcgcaatgcggccgccgccatcagcgctgccgtgctgctgggcgtgagccccgcagacgcggccaaggcggccggcacattcctcggtgcggcacgccgtttccaggtgcgcggcacggtcaagcaggtcactgtagtggacgattacgcccaccatcccaccgaaatcgcggccctgctggatgcggcccgacgccggtaccccgattcgaccattcgtgtgatcttccagccacacctgttctcccgcaccaagttcttcgcgcaccagttcgccgaatccttggccaaagccgatgacgtcattatcaccggcatcttcccggcccgtgaaaagcaggctgatttcccggacatcagcccctccaccatcgtggacgcggctgcgggactcaaggatgcttccgcaggcacgtggattcagccggtcgaggatatgtgcctggccgccaagatgatggccatgcgcgcccaccacggcgacgtgatcttcaccgtgggcgcgggcgacatcaccgacatggatcaggtgctgctcaccgcacttgaggcccatcgggaaagctgcgagtgatgtccgggcgcacggtcagatccgggggcaatgacaacggctcacgtcgttcgtccggaagtccccgcaagccgcgcaccatcggttcacgcggaaacacgggtcactcgtcgaagtctcgcgctccccggtccgtgtcttccgggcatgagatcgacgagccggagatcattgacgatgtgacggtagccaagggccaggccggtgccttcgtcgatgcacgacggttgcgcagcgaggattacgttgccgaaacgctgcaccagaccaccggctccctaggagtcgtatcacgcccgaaagtggtgaatttcaccgaacgcgccaaagaacgcaagcgtgcgaacgtacgtgtcgttgcgttacgcgtgttgattgctgtcgtcagcgtggctgtagtgacggggctaacgtggctgctgctcttctcgtcggtgtttcgtctggaaaccagcgagatcggcgtatccggtgccaacgaatgggtgagcgcgcagaccatccatgccatcgccgataagcaggctggaaagtcgttgttcctggtctccacccatgaggtcacagagcaactcaagtccattcccggcgtcagcgaggccaaggtctccaaacagttccccaagtcgatgagcgtggaagtcaaggcgcaacggcctgcggccatgctgaaaagaggcgataccctgaccgcggtggattcccaggcgcgtgtgttgaactcggtgaagaacgccaacgtggatggcattccggtgattgaggtcaaggatatagacgccagtctcaagaaccgttcggtgaaggaggcgctgacgattctgggcgcattgccggaatcgatgcgtaagtccattaccaaggtcaccgctgagacgcaggattcggtgaccaccacgcttaacgacggtgaccgcgtaatcatttggggtgactcctcgcaactgaagctgaagctggcggaagtcgaggaaatcgacaagaacatcaccgctggcacggctggctttgccggcaaacatcagattgatgtttccgcatcccagaagcccatcatcaaatgacggcgattccgttggcttcgttggttccggggcggcgttcgctccgttggtcctgctgacaacgttggtcccgtcaatgccggggcgatgttcgctgccggcgatttgcgcgagtagcgccatagggtgtatgctgaaaagtccggccgaaaagccggaagtttgataactcaagattgggggcgatcggtttcgacggtgacctgttcgctgcagggaagcgtgccgagaacgccgggtccgctcgtggatgaccccggcaaaagaataagtgctaaatctaaccgcactgagtttgctctcgctgcctgattttagtcaggattaaccagtgagcagccgctccgttcactcctcctcgtctttgggaggatgctgagcgtcgtttagaagacttgctgatgcagttgagcctcagggctgcatcgggactttaactgcggatatgctcgccatcagttgtctgcgacatcgatgggggcagaaaaatcgccaacttggccagcagactacgcacgtagaagactgtgggctcggtcatcggaccggggttcaattccccgcgcctccactaactgcctgctggtgttgatacaatttcgcgccagcaggttttgtttttgagttttgctccaaaatttgctcgtttgctccaaaataggggttacgtgaaattgttgtgttgagctgggtaaatagaaagccagcaaccgaaatgatcggtgctggcttttggatgttgagctttgctgctattgctctggtgggctggttccgtctttccagatcacggtcgctttgccatttggtgttatctcgatgtgttggcacagggcgtggaaggtggcgggtgatgtgaactgatttttgttccgtatttcctctcacttgataggagatgatggaatcatggcaaagggcactcgatatacgccggagttcaaggcgaaggcggtcaggctgctggcggaatcgcgttcctcgtattcgtcggagacgaacgcgattccgcggtggcgaaggatccggggatagcgccggaatcgctgcggcgttggcgcaaccagtcggacgcgacggtcgcggaggagacgaggcagtcggccgaggacgcgatggcggagctgaggaggctgcgggccgagaacgcggaattgcgtcgggcgaacgagattttgacgacggcgtcggcttttttcgcggccgggctcgacccgacacggcgttgatggccgcgtacatcgacgagcatgaaagccgtttcaaggtcgggccgatccgcggggtcctttccgaatcgttggactgcgggtttctcacgccgcgcggctaccgcatgttcagaacacgtcccgtcagccgcatgcgggcgggacatggggcgccggcccgcgacatcctccagatccactcggatttcttcatggccgtgtacggttacgggaagatgcacgcgcagctggtcgcccagggccgggatccggccaaggtcggccgcgaccaggtgatgaacatcatgcgcgagcttggcatccggggcgtgcgccatggccgtgaacacgcaggagctgccgttgcgggcgttggagcaggcggtctcatgggccgcgtcccgcggcggcgcggatggtcttatccaccacggcggccatggcgcgcagtgcaccggcacggtgtgcaccaccagggttatgggatatgggatgctgccgtcgaccggcaccgtcggcgactcgtgtgacaacgccatggccgaaagcgccgacggcgcgtacaggaccgagctggtatggcggcgcaagcccttcgcggatctgaaggacctggaattggcgacgttccggtgggtctcgtggcggggactcgaagcgcctgcaccggtccctgggctacaggacacccgaagcggtggaaaccgagtattatcaacatcaagcggcacaagccgcctcactataagggcggaacaaaaatcaggccacttcacgccgcaacagcactcgagaaaggtcacacttgactgactatgcagttgacgtacgcgacgtaagcgtcgtcattaaggggaagacgattctttcccacctcgacctccaggtggaagaaggttcgttccacgggatcatcggtccaaacggggcgggcaagacgacgctctttaacgcgatccaagggtttcgaaagccgacggaaggaacgatccgagtcctcggccagtcgccctatccgcgcaatctagccctgctgtcccagatcgggatccagccccagcagtcggcgttcttcccgaagacgacactccgcgagcaccttcgcgcggtctgtgcgatccagggcgcagagcactccacgatcgacacgctcatcgaggccctcaacctcgcgaaggcggctgacaccaaagtggagaaactctccgggggcgagcgccagcgactcgccgtcgccaccgcgattgtgcaccggccgaaagtcctcttcctcgacgagccgacggcaggtctcgatcccgaagccaggtactcgttggtctccctgctccagtcgaccaatcttctggagatgaccaccctttatacgacgcactacctcgacgaagctgagcggctatgtgacacggtgtcgatcgtcgaacagggcaagattctcacgacgtcgagcccgagccgcctcgtcgccgaggccgatctcggctcgacggtcattctccccaatgctctccaccaggcggatgcggtggcgacgcttcttggcccggacgcggtgcgggtcaccaaagacgggctcgaggttcggtctcacgacacggccgctctgttcgcgcgcctcgctgaaggcgggatcgatacacggcacgcccaagtccacgatgggcgcctcgaggacgtctatctccagctcaccggaagggattacgtagcatgaccagataccgcgcattaaccaatgtccttcttcgctacgacctacgcgactgggcgacccttatctttacgttcctcttcccggcgggcctactcgttgcgctcgtgttgacgatgggtgacagtatcgaaggaatggacctcaccgggccgatcagcgcgaatgtcatggccttcggcgcggccttcgtgggaatcttcgcgggcgccacccaccttgcgctgtggcgcgaaaacggaatgttcgtcgtcctacggagcttccccatctcctcaaacacggtcattgccgcacaggcgacggcgggcatgatcttcctgataacgcaggcccttgccctcttcggcatcgcgatggcactcggcatgactccggaggcgaccgcgccgattgcactcctgcccttgatcctgggcttcctgcttttcttcatgcttggggtactcgtcggaatcattctgccgtcgatggccggcgtctccatggcagcggtcgccatcatcatccccttgggaatgatcggtggagccatgatgccgattgagatgcttccgagctgggcgcagacggctgcaccgtacactccgatctaccacatgcgcgaggccgtgacgatgccgctcattggcgaggggacgtggggtgacgttggaattgggctcggctatctggtcgctgtgaccgcgatactcacgttgatggcgcagcgagcgatgaagtggaagtagagctgtgcctcccggattcaatttgtaagcgcaacgcttgtgttcgggctggctgccttcgattgtagcctggcgatctcctcgtcccacacctcattgggcgttttgtagccgaggagcttcatcggggtgtcgttgatctccccgacgatcgcgtcgagctcgtcctgcgtgagatcctcgaaactggttcccttgggcagatagcggcggatcctgccgttcctgttctcgttgctgccacgctgccaggaaccgtacgggtcggcgaagtacgtgagcatgcccagcgcctcgtccaccagcacgtgcagggacgcctccgtgccgttgtcccacgtgcggtcgacgcgcgcggccggcggcatgcccttgaagatctcgtactcggccctggccgtggcggacgcgctcttgtcgtcgacgagccgggcgaacagcctgcggctcctgcgctccacctgcgtgttcacgcagcgcctcgacggcgcggcgccgaccaccgggtccgactcgaaatggccgaaccccttcctggatccgaccgcctcgggccggtccgcgactggatatgagtaaagcccctgagatgtatgtcccagaggctttcacactaatcctgatacggagtatgccacggggtggattcaccctactcccgcttgtgttttgttttttcaggcggcttggatggtgaggcgtccgccgagggcgtggattaccttggcgatggtttggaagctggggttgccgtccttgctgaggctcttgtagaggctttcgcgccccacgcccgcgtccttggcgatttgggtcatgccccgggccttggcgacgttgccgagcgcggcctgcatgagtgcggggtcgtcgtattcggctatggcgttgaggtaggcgatgatgtcctgttcgttttcgaggtattcgctggtgtcgtagtcggtgaattcggtgctcattgtcgttgttccttgcagtcgttgaggatgtcgtgggcttgtctgatgtcggtctgctgggtgcttttgtcgccgcctgcgagcttgcaggcatcgagccgggcttggatggcggccttcgctttgtggtccctgagtttcttgaaccacttgcggtattcggcggattgcttgatttctatacctctattgtagcctacagactacatcatgtcaagccggacggccgctggagcccatagccaacgcaagaatctcccgtatgttgaactcccagtagccgtcatcgacgggtctcgagctggggagtttgccctggttgagccagttgctgatccgcttgcggctgacctcgtacccgtagtttcccttgagccattggcttatgcctgccggggttttggtcaggtgggttgattcggcctcggcttggctttgctcgcgcagctcggccacgttgacggggttgccgcacctgcacaggcgcagcgcctcgcccttcgcggccatcacttcgcgtccgcattcggggcatacgccgattatccggcgcgtgcgcggcctgcggtcaaccttggcagagcgtccacggtgcctcgacctgctggttgccgcagtattggcatggttcggtggtggtgactgcacacgttgtactgtagggaaccatgaaagtcgtattgcaacgagtatccgaagcgtccgtggacgtggtcaatgaattgggcacgctggatcccacgttcgagccgcagcagattggcccgggattcatgattctggtgggcgtcaccgatgaggacggcgacaagcagatcgcctggctggcccataagatcctgaatctcagggtgttcgaggatgcgcagggcaagatgaaccgttcgattcaggacatcggcggcgagattctctccatctcgcagttcacgctgtttgccgacgtgcacaagggcaatcgcccgagcttcatcaaggccggcaagcccgagcatgccgatctcatgtggatcaagttcaacgaggcgttgcgctccgggggagtaccggtgaaggaaggtcgtttcggcgcgcatatgcgggtcgggctggtcaatgacgggccggtgaccatcgtcatcgacaccgagcatgacatgcctgacggaacacgctgaattgcgataatgatttgacatcatatcccgttccctccaacatgttactaaagcgctttagtctcctgcgggcgagggcgcatgtcgatatgtttcccatgaacgggcagcacaatgatgtggcctcacaagcggcggagataaggggagtgaacagcagatgttcctgaaacctgaacagcaactggaacggtgcaagcgcatcgtgcgccagcgcgtggaccctcatatccacccatcgatcgcacagctcgcggtggagtcctttgacattcccggagagccgatgcccactggcgagttcttcgcgaagctcaatggaggtgacatcgatttcaagccgtttacgctcggcagcgaatggggcaccacatggggcacggtctggttccgcctgaccggtactgtgccggccggctacccgaaaggcaagccgctggagctcatcctcgaccttggctggtacccgcactcctgcggcggccatatcgagggcctcgtctaccgtgccgacggcaccgccatcaaagccgtacacccgctcaactattgggtgccgttcatggatgccgagggcaacgcgcaagtgccggtcgccgaagacggcagcttcaccctgtacctcgaagccgccagcaacccgctgctgctcggcgtgcctccgttcattgagaccgaactgggcgaccatgccaccggcaagccggacgagccgtacgtattcaagtccgccgatctgaccgaattcgatgcccgtttcgagaactactccgtggatctcgacgtggtgagctccctgatggaattcgccgacaagcagtcgccgcgctactggcaactcgccaaagcattgcagcgttcgctgaacgcctacgacgagcgtaactccgaatccgtggaagccgcgcgcgcagcactcgccggcgtgctggccaagccggccaatgcctcggccatgaacgtcagcgccatcggccacgcgcatatcgactccgcatggctgtggccggtgcgcgagacccgccgcaaggtggcccgcaccgtatccaacgcattggtgctgatggacgccgaccccgacttcaaatacgcgatgagctccgcccagcagtacgcttggctggaagaggatcatccggacatcttcaaacgcatgaagcagcgcatcgaagaaggtcggttcatcccggtcggtggcatgtgggtggaagccgatggcatgctgcccgccggcgaatcgctgattcgccagattgcatatggccgcaaatacttcaaggaacatctcggtgtggagcccaagggcgtatggctgccggacagcttcggctacaccggcgcatggccgcagatcgcccgccgtgccgggtacgaatggttcctcacgcagaagatctcgtggaacgataccaccaagttccctcaccactcgttcatgtgggaaggcatcgacggctcgcgcatcttcacccacttcccaccggcggatacctatgccgcttggtgcaaggtccaggaactcgattacgccgagaagaacttccaggacaaggatctcgccgacatctcgcttctgctcttcggtttcggtgatggcggcggcggccccacgcgcaacatgatggagcacctgcaccgctacgagaacctcgaaggcgtttccaaggtgagcgtcgaagagccgaatgacttcttcgacaaggcgcatcagcagcttgcagagaacgccggcccagaaatgcccgtctggaagggcgagctgtatctcgaactgcaccgtggcgccttgacctcgcagcaggacatgaaacgcggctgtcgccaagaggaatcgctgttgcgcacggtcgaatacctgggcgcagccgccgtgttgtccgatccggagtacgtctacccgcgcgaggagctggaccgcatatggaagacgctgctgctgaaccagttccacgacatcctgcccggctcggccatcgcatgggtgcaccgcgaagcccgcgaggactatcgccgcgacctgaagcgtctcgctgaaatcgcccaagacatgtgcgccgtgctgcgcaaggccaacccgcaggccgacttgctcgccgaagcccgcatcagccagttccgtaatgacggcgcgtcttggcgtgccagccgcatcaacgaaccgaccaacgcgctttccgtactgacccaggcattggagaacggccgtgtactgctggccaacggcgtactgtccgtcaccatcgaggccgacggtacaatctcgtcactgcttgacgaggagcatggccgtgaactggttccggccggcacccgattgggccaatacgaactgttgaaggacgaacccgccgtttgggatgcgtgggagatcgaacgcgaatccctgctcatggcgaatgccatgaccggatcaatcgaatcggtcgataccgaaaacggtgcggcacgagtccgcgtgcgtaccgccgacgatgacaccgtcatcaccaccaccatcacgttgcgccccggttcgcacacgctcgatttccacgccgacattgactggcatgaacgtgaacgcttcctcaaagtcgatttgccgctgggtatcgtggccgatcaggcgacatacgactgccagtatggtctggtccgccgcccaattgtcaaaaacaccgcatccgacgaagccaagtatgagagcagcacgaaccgcttcgcccttatcggcgacgccggttacgcggcggccgtcatcaacggatcggtgtacgggtccgatgccacgccgatctccgggaacgccgccgaaggtcgtgactcgggcaccatgttccgactgtcgctgctctccgcgccgaccttccccgacccgcgcaccgatatcggtgcgcatgagttcgactggtccgtggtggccaacgccacggtgggcagtgcgcttgacgccgcttgcgcactcaacgcaccgacgcttcatgacatgcccgacttggcgccgctcgcctcgatcgagtcagcaaacggcaccgtggtgttggactggatagagctggccgacgatggctccggagacctgattgtgcgcgcctatgaggcggccggcggcagggccgatgccacgctgcatgtctgcccggcgctcgcaggcgcttcggtgcatgagaccaacgtgttggaaggcgacgatctggccgccgacctgccggtcgcgctgcaagacggcacacagaacgccgaaggcgccacactgcacttcggcccgttccagctcgccaccctgcgcgtcacgcgctgaattctcgcctgacgcttctgcctccttgtaccatgaggggacagaagtatgtcgtattacggtttctccaattaccatcactcccacccctaccaccagacacagcaaaggagttgaactctccatgtttcttctgcccaatcagcagttggagcgctgcgaccgcgtcatgcagcagcgtgtcaaaccgcatatccacaccacactcgccgcatgcaccttgcgttcgttccacaatcccggcgaaccggtgccctccagtgaatttctagccaaagtgcgcaacggccaagtgcccttcgaacctttccgcgttcccggcgtctggggcaccacatggggcaccacatggggcaccacatggttcgaggtgaacggccacatcgacatggcggcggtcaaaggacgaaaagtcgaactcatggtagacctcggctggctcgatcaccgcggccccggattccaatccgagggacttgtctatcgtgccgacggcaccgccatcaaatccgcgaacccacgcaaccactggattccactcgtctacgcggacggtagcagcactgtcgaactcgatgagcatggcgacttcaccgtctatatcgaagccgccgccaacccattcgtcgaaggccccaccccgttctcacccaccgaactcggcgaagaggccaccggcacctgtgacttcccatacacactgagtcgtatggacgtcaccatcttcaacgaagacgtgttcgcctactacatggatctggaaaccgtctcctcgctgattcgtgagctcaaagacgacgacccacgctactggcagctcgccaaagcactgcaacgctccctgaacatctacgatgaacgcgacttggaaaccgtgtcggcagcccgtgcggcgctcgccggcgtgcttgctgaaccggccgcctccagcgcaatcaaccacatcgccatcggccacgcgcatatcgactccgcatggctgtggccggtgcgcgaaacccggcgcaaggtggcccgtaccgtatccaacgtgctggctttgatggacgaagacccggacttcacgtatgcgatgagttccgcccaacagtacgcatggctggaagaggagcatcccgacctgttcgcacgaatgaagcggcgcatcgccgagggccgcttcatcccggtcggcggcatgtgggtcgaatccgacaacatgattcccgcgggcgaatcattggtgcggcagatcacgttcggccgccgatatttcaaggagcatctcggcgtcacgccgcgtggcatctggctaccggacagtttcggctacaccggctcctggccgcagatcgcccgccgtgcaggattcgactggttcctcacgcagaagatctcgtggaatgacaccaccaagttccctcaccactcgttcatgtgggaaggcatagatggctcgcgtattctcacgcacttcccgccttcggatacctactgctcgtggatgagcatgcatgagctgatgtattcgcagagcaacttcctggacaaggacctctcccgtaacgcgattctgctgtacggcttcggcgatggcggtggcggccccactcgtgagatgaccgcgcgcatccgccgcgaccatgatctcgccggcgcgccgaagatcgaattcggtactcccgaccaactgttcgaccgcgtgcgtaaggatatcgtcgacgatgcgcaaggagagaccccggtgttcaagggcgaactgtaccttgaactgcaccgtgccaccctcaccacccagcaggacatgaagcgcggctgccgccaggaggagtcaatgctgcgtgtcgccgaatacctgtgcgccgtggcccgcatcaagaacccggactatgtctatccgcgcgaagagctggaccgcatatggaaaacgctgctcctgaaccagttccacgacatcctgcccggctcggccatcgcgtgggtgcatcgtcaggcgcgggcggaatacgagcgggacatcgcccgactggacgggatcatccttgacgcggggcgcgccatcgcggccgtgaaccacgatgccgcgatcatcgccgatgccatgatcgtcccgtattcccggcgtgccgaggatgcgtgggtggtgcgtccggcgtcggcgctggccgaagacggtgccacgaccggggcccgggtcgccgtcggtcatgacggcgatgcgctcgtgctcgacaacggccgcctgcacgtgcgcatcgaggccgacggcaccgtttcgtcgctcgtcgatcaacgcaacggccgcgaactggtgccggccggcacccgattgggccgttacgagatgctcaaggacgaaccgtcccactgggatgcctgggatgtccaacgcgatgcgttccgcaccgcttccccgctcgccgaagcttcgatcgaaagtctcgacgagaccggctgcggcggggtcgtcgtgcatgccgtcgcacgctcggagggcgtcgatattcgcacgtccatcaccctgaacccgggttcggccacgatggacttcgccgccgacgtggactggcacgccgtcgagaagttcctcaaggtggatatgccgatcagcgtgcaggcgatgaacgcgcaatacgaatgccagtacgggctggtcgaacgtccgatcgccaagaacacgcgcggcgacgaggccaaattcgaaagctgcacgcatcgtttcgtgcgcatcgccgacgccggctatgccgcggccgtggtcaacgcctccacgtacggatccgatgtcagtccgatccacgccgccgcggcgcacggcgccggccgcggcaccatggtgcggctgtcgctcctgtccgcgccgctgtaccccgacccacacaccgaccaaggcgcacactccttcgcatggtctctggtcgctgacgccgatatgaatgcggtgctggacgaagcggcgcgactcaacagccccgtaataggggagttgcctgatatggcgccgctggtctcgctcgccgacgccaccggcgtcatcgtattggactggatcaagctcgccgatgacggttccagcgatctgatcgtgcgcctgtacgaggccgccggcggcaatgccacggccacactgcgccttgactccgccctcatgggctccgacgcttccgtgcgggaggtgaacatcatggagtcggcggaattggacgccgaactgccgcgcgcgcttgccggcgatgagccggtgcccgcggacggcgcggtcatcgcactggcgccgttccagctcgccacgctgcgcattcgccggtgacggcatgtcgggaccgtggggccgatggcgagacgcgacggtttgtctcaccatgcggccccacggggccagatgtcacaggaatccgataaaccgctcaataccgccgaaaatcagccgccatgcgtcacgagtggaatgaaagaagtccgattcggaaacgcacggttaacaaaccggggcgatagtcggcggaaaggccgtgtccacagcacaggcgcggcgatgccattacagagagaggactcccgtgcattccaagaagattctggccgccatcgcttccgtggccgccatcgcgtccctcgccgcatgcggcggcgtgaaggatgatgccgccacggccggcggcagctccgccgtcaccatcggcaccaccgacaagatcaccagcctcgatccggccggatcctacgacaacggctcctacgccgtgcagattcaggtgttcccgttcctgtacgcccagaactacaacacctccgaactgtctgccgacatcgccgccgacaacggcacctggaacgcggacggcacccagttcaccgtcaaactcaagaagggtctgaaattcgccaacggcaatgacctgaccgcctccgacgtgaagttctcctacgatcgcgtcaagaagatcaacgacgagaacgggccgagttcgctgctggccaacatcaccgacgtcaaggccgtggacgacaccaccgtggtgttcaccgacgccgtgcctttcgacgtgaccctgaagcaggtcatgagctccccggccggtccgatcgtcgacgaggactccttcgccgccgacaagctgaccgacgccgacaccatcgtgtccaagaaggccttcgccggcccctactcgttgacctccttcaaactcaacgagacggccgcctacgagaagaacgccgactatcaaggcctgacccccgccaagaacgccgcggtgcaggtcaagtacttcgccgacgcctccaacctgaagatggccgtgcagcaggggcaggtcgatgtcgcctaccgctccctgaccccgaccgacatcgaggacctgtccaaggactccaagctgcaggtcatcaagggaccgggcggcgaggagcgtctgctcgtcttcaacatgaagatccagcccttcggcgaatcccagcccaacgccgacgccaacaaggccaaggcggtgcgccaggccgtcgccaacctgatcgaccgtgacgaactggccaccaaggtctacaagaagacctacaccccgatgtactcctacatccccgatggccttgccggccacgaggacacgttgaaggccgcctacggcgagaacggcaagccctccgtcgacaaggccaggaaggcgctcaaggacgccggcgtgaccactccggtcgacctgaaactgcagtacaacggcgaccattacggttcctcctccgctgacgagtacgccgcgatcaagtcccagctcgaggagggcggcctattctccgtcgacttgcagcagaccgaatggactcagtacaacaaggaccgtgtggtcaccaaggattccgacggcgcatacccggtctaccagctcggctggttcccggactactccgatccggacaactacctttccccgttcttccgcgacggcaacttcgtgaacaacggatactccaacaaggagatcaacgacctcatcgtcaagcaggccgtccaaaccgacgagaacgcccgagccgagaccctgaagcagattcagcggctcgaaaccgacgatctgtccaccatcccgctgctgcagggtgctcagaccgccgtcgccggctcgaacgtgaagggcgtcgtgcttgacgcatccttccgcttccgctactcctccgtcaccaagtgacctgcatgctccccgacgggagccatccgccgcaaggcgggagaagggagagcgcgcgtaacgggcattcgcccggcgcgtctctcccttccggcgttgcgtcccacctccccgcatagggaaggtgcgtgtcgtgacgcgactttgtcatcgcctcccgtgccgggaggaacaatcgtttccattggcctttaccgtaaggagcgccgcgtgtccaacacagcagctccggccgccgcacctgatgcggcgaagccgaaacaagccaaaaagaaccgactgtcgggtggattcttccgtttcgtcctcactcggttccttttgatcattcccaccgtcttcattctcgtcaccatcgttttcttcgtgatgcgcgccaccggtgacccgatctccgccgcgatgggcggacggctgaccccgaggagctgcagcgacgcatccacgccgccggttacgaccggcctctgatcgtgcaatacgccgattatctgggtgacctgctgcatggcgacctcggcaccacgctgaccgacaaccagccggtgagcgccatcctcgcccactatggcgccgcgacctttgaactggccttcctcgcgctgatcgtcgcgctgatcgtcggcatcggtctggggcgtcttgccgcacgccggcgcgaccgcgcggctgatgccggcatccgcaccttcgcaatcctgtgctacgccacgccggtcttcttccttggcctggtcctgaaactgatcttcgccatctggctgaacgtgcttcccgcttccggccgatcgtcattggcgtccgagatgcagttctcgagactgatctcgcccaccggcttctacatcatcgacgccctgcagctgggcaacatgaccgtgctcgccgacgtgctgcgccacgccgtgcttcccgcgttggcgttgggcctgctgaccgcaggcgtgttcatccgtctggtgcgcaccaacgtgatctccacgttcaacgcaggctatgtcgaggccgcccgttctcgtggcgtgagcgagaagcgcctgttgaacacgcatgcctggaagccggcgctgattccgatcatcaccgtcatgggcatgcagatcgccctgatgctcgccggcgcggtgcttaccgaaacgaccttcgagtggaaagggctgggcttcatgctgtcccaatatctgaaagcccgtgacttcgtggccgtgcagggcatcgtgatcctgatcgccgtcatcgtggccgtcgtcaacttcgtcgtcgacgtgatcgccgcgctcatcgacccgagagtgaggtactgacgtgtccaacgcatccgcaaacaaagtcaccgtgccgggcgacgaacgcctgaacaagctcaacgtcaacgccggcgcgccgttatggtccaagatcccgatcatcaaggagctgcgcgtcgcggtcggatggcagaaagccatgctggtcaccggcctgtcgctgaccgccttcttcctgctggtggccgtcttcgcgccgctgatcgccccctacggccatgcgcagatcaaggacgccaacggcgtctccttcccggcgcaggccgcccccagcgccgaacacatctggggcaccaccgccggtggcttcgacgtgttctcccgtgtggtgtggggcgcgcgcaccgccgtgatcgccatcgtcgtggccgtgctgctttccatcttcgccggcgtgatgctgggcctggtctcgggctatttcggtggctgggtggaccgtgtgttggtgatgatcgccgacgccgtctactccttcccctcgctgttgctcgccattttgatggccatcatgatctcccacgggcagtccggcctgtggagcggcatcctggcttcgggcatttcgatcaccgtggtctacgttccgcagtacttccgtacgattcgcgccgaggtgatccgcatcaaggaatccgcctatgtggaatcggcccgtgtggtcggcgcctccacctggcggatcatgaccaagcacctgctcaagaactccacccgcacgttgccggtgattctgacgctgaactcgtccgaagccatcctgaccctcgccggtctgggcttcctgggcttcggcatcgagccgacggccgcggccgaatggggtatgacctgaaccgctccgtctccgacgtgaccgccggcatctggtggaccgcggtgttcccgggcatggccatcgtgctgatcgtgcttggcatcacgctggtgggcgaatccctcaacgaccttgccgacccgcgcctgcgcgcgcgcaagtccgccggcgaagtggtgggatccatcgaagacacctccgtggatcccaccgagaaaccctccgtgcgcaatgaagtgatcgccgaattggattccaacgtcaatccgccgtccaccgtcatcgatcacgacccggacttcaccgcatccgagtggaccggcgaaggcaccgtcgcgccggcgaccaagggcaaggaatgagcattatgagtgaacagcgtcaacataatctggccgacatcaaggatctgtccgtctccttcatgaccgatgcgggctccatcaaagccgtagagaacgtgaatttcacgatcccacgtaaaaccgtggtcggcgtggtcggcgaatccggctccggcaaatccgtgaccgcccgctccatcatcaaactgttgccggaaaccgccaccacgtcgggagcggtgtacctttcccggcgtgacggctccgatggcctggacgtgctctcgctttccggcgaacagctgcgcgacatgcgtggatccgaagccgcgatggtctttcaggagccgaactcggtgctcaacccggtgtacacgatcggatggcagatcgaggagggcctgcgcgcccacgggctgaaggacaggaagaagctgcgcgccaaagccgtcgacatcctgaacaaggtcggcatccccgacgccgagacccgcgtggattattacccccatcagttctccggcggtcagaagcagcgcatcgtcatcgccatggcgttggtgctcaaccccggcctcatcctggccgacgagcccaccaccgctctggacgtgacggtccaggccgagattctcgacctacttcgtctggcgcgagacgaattcgatgcgtccgtgctcatcatcacccacaacatgggcgtgatcgccgacatcgccgaccaggtggtggtgatgtaccgtggacacgtggtcgaacaaggcaccgtggagcaggtgttctacgacccgaagaacgactacaccaagcgcctcctgggcgcggtgccgcgtgtcggccagaagctggtcgtgcgcgatccggacggtcgcgtgatcgaacgcaaatccgattggcgcgagcagccggtggccgtcgaggccaagggattgacgatcacgtatcccgggcatctgatgcaacccgatttcaaggccgtggacggcgtggacttcacgattcaccgttccgaagtgctcggcctggtgggtgaatccggttccggcaaatccaccaccggtcgtgccatcgccggcctgcagaaagtgtccggcgggtcattgaacgtgcttggcgtggagatgaacggtgtcagggagcgggacttcaaacccaagcgcgccgacatcggcttcgtgttccaggatcccggctcctcgttcaacccgttgatgaccattgcggaaaacgtggccgaaccgctgatcgtgcacaggaagtatggttcggtggccgaggctagggactatgtgggagatctgttggagatggtgcagttgccgcgcgcctacatgaaccgtttcccccacgagctttccggcgggcagcgtcagcgcgcctcgctggcacggggcctggccctgaagccctccctgctgatcgcggacgagccgacatcggctttggacgtgtcggttcaggccaaggtgctggagctgttcaagcggctgcaggcggagatcggcttcgcctgcctgttcatcacccacgatctggcggtggtggatatgctcgccgaccgcgtcatggtgatgcataaggggcggatcgtggagcatggcgacgccgatcagatcatgcggcatccgcgcaacgcctacacgcagaagctgttggcctccctgccggtgcccgatccgcgcgagcagaggctgcaccgcgcgcatcttcacgaactgctcgccagcgggaagtaacgagtcaccccgcacggcggcatggtgtgcttcgtccatacggcgaggacgtcgaggcttgcttcgcccgcgaacccacactcatggttgtccgcttcggacatccggcgcgacaatcggggtgtggtgcgcggcgggaagcataatgtgttgtagcgtggtattcgcatcgtggctgcaaggaggagtattcatgggacctgctcgcggggcgtcatcgccggcgtctacaggtgcgcagcgtgtgagcttgaaggacatcgcggacgagctgggcatttcgcagaccgcggtgtcctttgccatcaacgaccggcccggcgtctccgagcagaccaggcggcgggtcaaacaggtcgcggcggaactcggatggacgccggtctacgccgcgcaggcgttgggttcatcgagaaccatgaccataggcttcgcgcccgcgcgatccgtgcagggactcaccgatgaaaccttcatgttgcatttcatggccggcgtgcatacctcgctcagtcccaagggatacggtctattgtaccgaccatgccgatcgttgaacgaggagatgagcgtctatcggggctgggcgtcgagcaagcgcgtggatggcgtgattctggtcgacctgcgggccgatgatccgcggcccgcgctgttgagggagttgggggtccgcgcggtgttggcgggcggacccgatccgaatgattacgttccctccctgtccatcgatgattcgcgcaccatgggcaccgtgctcgaacatctgtcgtcgttggggcatcgccggatcgcctacctttccggcgacgccaatctggattattcccaggggcgtgtggcggcgttccgctcgttcgccaagagacgcagactggagtccatcgccatcgagttcacgaatttcgccgccgaacgggccgtgacgctgacgatggggatgttgcgctcgccgcagccgcccaccgcgttcatctatgagacggagattcttgcggcggcgagtctgcatgccatggccaaagcctatgccacctgtgccgccaccattgggcgattggcgtcgggggaggggcggttcgcggcatatcccagcggattgcccgccatcgtcagtttcgaggacagcttcatctgcgagacggcgtatccgtcgatcacttcggtgcaccgcgatgccggcgaatacggcgtcaaagtggcgaggctgttgctcaaggtgcttgccggcgagcaggtgggtggcaataggcggattctcaccccgaaactggtggtcagagacagtacgtccgaaccagtggatccgtcatgacgcgggcggggcgcatcacgggacgatgtgccgtgatgcgccccgcccgcgtcagcgattgccggcgtgaggacgccacggcgatggtcacgccgcgtttctgaccgcggtggcgatggagacggccgggtcgaggaacggaatcaacgtggactggaaggcgtggtacaggtcggacttgcccggccagaccgtgccgatcacgcgattgtcgccgtcaagctggtggaaccaggagccgcccttatggtcgatgacgtgctcgtcaacgtactgggcgaacgtggcataccagtcgagatacgcgctctcgccggtggccgcatacagcgtggcggcggtgttcaacgattcggcggccgtccaatgcatgcggtcggtgaccaccggtgtgccgttccagtcggtcgtatagacgagcccctccgcgccgtccgcgttccacgcatcgtccaccgcccgcgcaaacaggtgctcggcggcgtcgatgtagggccgcgcgccgtctcggttggcgaaggagctcagcgcccactgcacgatgaggcgggcccattcgatgccgtgacccggcgtggcgccgtacggcttgaactggtcatccttcttatcgacgttgcattcgaggtccagtgaccaatcggacttgaaatgttcggggatgcgccaccggttgtgtgccgcccattcgatgacgtggtcgatgatgcggccggcgcggacgcgataggtgttgttcccggtggcgtcggccacggccaggaacgcctcggtggtgtgcatgttggcgttcaggccacggtacgggtcgagctcggtgaattcggtgttccaggtatcgacggccaaaccggtttcgtcatcccagaaatgcttgtcatacgtggcaagcgcctcagcaagcagttccttggcacccggacgtccggccagcagggcagaggatgcggcgagtatcacgaaggcatgcgcatagcagaccttgcccggagcatgggtgccgtccgcgaacacctgcgcataccaaccgccgtgctcgtcgtcatgcaggatgccggtcaatcccttgagcgctgcatcggccagctcgcccgcacccgggtatccgagcatgtcgccaatcgaatacacatgggccatacggctggtgatccacgtttcgacgccgtgggaggggtcaagggtgccgtcggcgttcagccagccggaaccgccgttcggcgctggaaagcctttgccgaacttcagcagctcgtaggtttcggaagccatgaaaatgcggttggcttcggtgccgagcgtataccgtgggttattggtcataatgattgttcctttccttaacaagaacatgcggtgggtgcgcaatgagcatgcggcgggcacgtcttagtgcttcacacgaatgtcgaaatagtccatgaccagttcacaaaacatcatattcgaccagctgaaccattcgcgcgtgtacttggtcggatcatccacgtcgatgccttcgtgcatgagatgcgtaccggcgtcggtggctacaagacggtcgaggatatgcgccttgaagtccttgctgtcgctggtcatcgcctcgatagacagggcgatgggccacacatagcgcggcggcgtgtgcggcgagccgatgcccttgagatgcgtgccctcgtagtagtaggggttctcgtcgctcagcagcgtgcgtctggtcgccaggtacgtcgggtcgtccggtgcgcaatagcccaggtagggggccgccatcagcgagggcacgttgctgtcgtccatgatgatggcatggcccaggccatcggtttcgaacgcgtaaatcgtctctccattgcggttcgtcgtcttggcgtggttttcgatgccttcggtgatggtgcggcgcagctcgccggcgcgtgcggcgatatcggcatcatccagaatctcaccgccgaagatgcgttccagatagcccatcaccacggcggcgaacatgttcgagggcaccagatagtggtaggtgcaggcgtcgtcgctggggcggaagccggaccaggtcatgccggtgtacgccaccggcgcccccttgccgtcattgctcagcgattcggtggggatgtccgtgtcgcggatgaagaaatacggggagcgttcatgatgctgctcggtctcgaagacgtcaagaatcttcttgacgccggcaatgaattcggcatcgaagtgatcggcgttgccggtgttcgcatacagcatccaagccaactggatggggtagcacagcgaatccacctcgtacttgcgctcccacagccaagggctggagaagtcggactgatcgttgtcccaggaagcaccgttcggttcttcgttgaaggcattcgcatacgggtcgatggtgatgtagcggaactgttgccgtaccaggccggcgatcatgtttgcgagatcgccgtcttcgacggcaagggccagatacgggcgcaattgcgcggtcgaatcacgcagccacatggccgggatatcgccggtgagcaggaatgtggtgccgtcgtcatgccgtttgaccgtggtggtcagggtgttggcaaagcaggcgttgaagttctcggcccaggcggcgtgttcggtgccgcacaggtccgtgatgtgctgcatgaaatccgagaccgacttcggtatcgcggtggtcgccataaattcaacttctttgttttgggggatatgcatatcaagggaacagcattattctaaaccgctttagttcatgacacgcgaaaggacgtgaagagcatgagtgtgagcgcaccatatgaaaaaaccggtgagatttcctgttcggagaatctcaccggttgcgatcagtcgattcgtgaagtcgcacgaatggcggataaggggatgggtggattacttgccgatttcagccagatagtcgggcatctcggccgggtaatcgggccaggcgccggcctgggtgcagacgtaggcggcggtgttgacggccttgcggtgtgcttctgccagcgtgtcgcccagcaggatgcgggcggtgaaggtgccggagaaggagtcacccgcacccacggtgtcgttcacctcgacgtgcggggtgtccagcgtggagacctcgcccttgcgggagatgatggtggagtaggcggagccggcggtcaggatcacgtagtcgaggctgaattcctcgatgaaccagcgggaggcatcttcgccggaggtgccgcggatgtcgaacatgtcgcgcagcagcaggagttcctcgtcgttgatcttgaagacggtggcggccttgagcagttcctcgatgagatccttggagtagtggtcgccgcgcaggttgatgtcgaagaacttcatcgcgcccggcttggtgtgcttgagcagctcggtgatggtggcgtgcgattcgggagagcgcagggccaaggtgccgaagcagacggtgtcggccttggagaccacgtcgatgagctgacgggtgtacaggatgtggtcccaagccacgcccttgacgatggtgtactccgggatgccgttcttcagcgcgacctcgacggtggaggtcggccaggcgttgcgctggatgacggtgttgatgccggcctcgttggccttggcaatcagttcgtcgccgagttcatcctcgccgaccgcgctgatagcccagccttcggtgccgttcttcatcgcgtggtaggcgaagttgacgggggcgccgccggctcgcttgccgctcggcagcatatcccacagcagttcaccgaggctcagaacgatcggggtagtcatggttggttcctttcctttgtttcctttatcgggtgtttcgtatggaaaatcttgtgatgtcggcgtttgttttaggagacatcgaagaatactgaggggtgttcgaggaattgggtcaccgccactgctgcggcaccggagaccgccgcgtcggcggacagggtggataggctgatggaagtggaggcattgatttcggggatggcccgttcggccaccgtggcgcgcacctcatcgagcagtatcgggccggcttcggccacgatgtcgccgatgatgatgtgctcgggattgtatccgttgaagatggtgacgcatccgtagccgacatattgggcgacttcgcggacaatggcgattgccgcttcgtcgccgtcgccggctttggcgaacagggcgcgggcggctgcggtgttggtcatatcggccgcgccgggaaccacggtgccatcggcgatgagcatgtcgtgaatggcgggggtggagcagtagcgttcaaggcagccgacgttgccgcaatcgcaggggcggccgttgacgtcgatggagatgtgtccgatttcggtggcggcaccgaggaagccgttgatgaggcgaccgttgtcgatgacgccgaggcccacgccttcgccgaccagataataggcgaggttgccgtcggcgtgcaccgacgggtcgaagagataatgtgcgagggcgccggcgcgggcgtcctgttcgatgaatacaggcacgcggaaagcggtggcgaattcgtcgatgaagttgattttgcgccagccctgcatgctggacaccacggcggtgcggcctacgttacgcagataggggccgggcaccgccatgccgatggccacgatggacgggtcgttgtcgagcaattgttcgacgcgctggtggatggtgacgatggtgtcgttgatggtgttgtcgtacaccgtgggcaggttttcgaagctcagggtgttgccgcacaggtcgaacacgccgatctgcaccagcgagcgggcgaatttgatgccgatgatgcggaaccgcgtggtgtcgagtttgagaccgatggaacggcggttcttggagccttccaaatcgccggtctcttcaatcataccggcctcgataaggcgtgcggtgattttggtgatggccgcgggggtgagttccagtgccttggcgatttgcgcgcgggagctgatgccgttgtgatacaggtgcttgacgatgcgggagcggttggattcggagacactggcctgggaagtggcatgggcggtgtttgttgccatcggtcttaagtcctccttgtctgcaccgctgcgagttgttccgctcgtctttgaatctgaacttgattaagatattaacgctgttaattaattgacgcaatcaatatgtcattcggcgtgtcgtgtatgtgagtgtcgccttgggtgaatttgttaagatagttgtcaatagtcggatgcacacttataccaagcgaaacgttcgatgaagaacaggggagggctgatgtccgaaaacattatgaacaatctcagaatcggtgttgacgtgggcggaacaaaaatcgaagctgtgctggttgacgcaatgggcacggtattgggttccacccgcattcccgccagacatggcaacgatgccgtgatcgaagacatcgtcgctgtggcacatcaggcggcgggtgagcgttttgacgaggtgagcgccatcggcatcggcactcctggcacggtggattcagccagcgggcatgtgggcaatatcgtgaatctcgacgtggtctcgctggacatggggccgttggtctcgcagcgttcgggcgtgcaggcccatgtggaaaacgacgtcaacgccgccgccgtcggtgcggccaccgtgttgggcggtgcggatggcatggccggtaccattgcgttcctgaacttcggcaccggactggctgcgggcattgtccaaaacggcgtgctgatgcatggctatagcggtgcggccggcgaaatcggccatatcccagtcgaacctcatcgcctcaagtgcccttgcgggcaatacggatgcttggaaaccgtctgctcgggcgcatccgtggggcgtctgtggcccaacgccgacccgccgatgcccgacctgattcgtcgcgcgaaaaagcgggaggccgaggccgtcgatgtgctggacatggtagtgcgcgccatcggcgacactatacagattctggcccaatccgttgatccgcggctgattatcttgggcggcggcatggccaagaccggcgaaccgttggtcgaggtgatcacggctgagctgcgccggcgcgaatcgcaatgccgattcctcgaaacgctggacctgccggcccggctgcgtctggcacccgtcggccaaccggttggagccatcggtgccgccatggcggcgtagcactggcatagtgccggggcatggaagatgaggcgtcggatttgtctccgaggccccatcttccacgcagtcctatatcgctttatatcgtgctgtgccgcgcttggtcttgcgcgtttcgttgccggggtgaccggcttttatttggtcaagtgttggaagaccgcggcgatggcctcgccctgcacggtgatgtcgggtccgcattcgcagcgccggattaccgtgtgtttgtggaaggacgaggacgtggcggcatccagatatctctgggccgcgtcaacgaacgtctcgttgatgatgttcggctgcccatagacgcatacgtctgccatatccaaaaggcccacaggcatggacagggcctggccgagatagcggcccgcccgagcgaggatattctgatgctgctccacgtctgccgtgctgagctgcttcttcaatgcggttccggaaatcatcgtctccaggcagccgcgcttgccgcaagggcatagcggcccatcaagatcgatggaaatatggccgatttcgccggctgcatgcagttcgccgattaccggcgtgtccgagagcagaatcgccgagccgatgcctctttcgatgcatacgaagagcatattcggcccgccttggccgaagaaacgttcggtgagcatggctgcggtggcgtcgttgctgacgtttacttcaagtccaaaatgctcggcgatcggtgtggacaggtcgagattgttccagccgcgcatcgtggaggagcggaccacgccgttgtctaccacgccgggggaggagactccgatgccgatgacatcgccgtcggacatgcccagcatcttctcgataagttcgatgatcacatccacggaaacgaatgagccggtgttcagggtgacttcggcgtggcgtagcggctgtccgagcagattggtgactgcaccgtgcagcaggtgctcctgcgtcaggtcgatgctgatgatgcgcagccgatcggtatcgatgctcagcagtgtgcctcgtttgcctttgccgccgctgggtgcctgaccggtctcgcgcagcaatccttcctccagcatctgaccgaccacatcggaaacggccgcgcggctcaatccggtgcgtcggccgagctcggcgcgcgaatactggttggtggggaacaacaacctgaagatgagttggcggttcttgcggcgcacatcggcgggggaggccttggcctcatggtcgtcggtcgttgtgttgagaccgagatatggcatgtttcctcctgcctgatggcgagcgaatggacggtgattgttgttccgtacacagtttagacggtgaagcacaatttcgtcgttgaaattgttatgaaacttcaccaataaattccagtgtacctgtgcgaagcgtcaggaaacaccgtgagtgttcacaaggtccaaaattgttagtatcattaacaaatagcgaatcgccaatcggcactatgccgaatggtggttggaacgccgcacatcacccggacgtgacaaggatgttgccattatccgcaagacgggcggcagtacagcgactcgcatcgggcgggccgcacggaactggaggaaaccgatgccggaaatcatcattgtcaagaacgaagccgaggccggtgagatctacggccgttgcgtggcggacctgatcaaagcaaagccggacgccgtgctgggcctggccactggttccagcccgctggccgcctatcaggcgctcgccaagatcgtcaaggacgaggccattgacgtttcgggcgtgcgtggtttcgcgcttgacgaatacatcggactgccgctgacccatcctgagtcctatcatgcgaccatccatcgtaccgtggtcgaaccgctcggcctggacccagccaaggtccatgtgcccggcgacgtactcaacggcactccgctcgaagacggcgacaaagtcgcgctggccggcccggcctatgatcgtgccatcgaagccgctggcggcatcgacgtgcagattctcggcatcggcaccgacggccacgtcggcttcaacgagcccggttcctcgctggcctccggcactcgtgtcaagaccctggccgagcagacccgcgtcgacaacgcccgcttcttcgacaacgacatcaaccaggtgcccacccactgcatcacgcagggtattggcacgatcatgaaggcccgtcacctcgtgctgctggcgttcggtgccggcaaggctgaagccatcgaggagacggtggaaggcggcttgtccgcgttctgcccggcttccgcgctgcagatgcacccgcacgccacgattatcgtggatgaggaggccgcctctcgtctgcgccacaaggactactatcgctacgcctacacccacaagccggcctggcagggcatctgatccgatccgttcgccccattgctgagctttcgagcctgcaagcggtccatcgggccgcctgcaggctcgtcttgagcgcaagacgagcggacgggaaaccatgtggaggagttgaacatgtctgatagggaagagatcgtttcccgcgtgaccacggcgttgaatggcaggccgtccccggtggccatccgcaatgcgcgcaaggtggatgcgcgcggcgaacagcgtggatattgggtcgtctccgacgcctcgggcgtcatcgtggcctcgggcacgggggaggagaccttcgaacattactgtcgtgcggtggggattgacccggccgatcgcaacgcggtcatcgatgccgaaggccgtattctgacccccggctacgtggacatccacgcacacggcgcatgggagaagagcttcgatgacgggtcggatggcatcgacgtggcacgggccggccacgccgtgcacggcaccacacgtcaggtgctctcgctgatcaccaatccggtggatgtgatctgccggaacatccgcaccgtccgcgccaagatggagtccggccgccccgacatcctcggctgccatctggaaggcccgttcctggctctggcccgcaagggcgcgcatgacccggaatgcctcaaggacccggtgcccgacatcgtcgataagatgcttgaggtctccggtgccgaccccgcctccggtgggcttggctgcatccgtcagatcaccatcgcgcccgaactaccccacggcatctccgccatccgccagttcgccgcggctggcgtggtgccggccgtgggccactgcgacgccgactacgagaccgccaaagccggcttcgacgcgggcgcgggcatcatgacgcacatgttcaacgcgatgaacggtctgcatcaccgcgaacccggtccgatcccggccgcggtggaggatccgcgcgtcaccatcgagctcatcaacgacggcttccacgtgcagaatccgatggtcaggctctccttccggttcgcgccccaccgcacggccttcgtgaccgatgcgatggccgccaccgactgcccggacggcgcctacaagttgggcgcgctggacgtgaacgtggtcgacggccatgcgcgtctggtctccaacggcgccatcgccggctccaccctgctactggaagtcgccgtgcgtcgcgcggtgtgcgaactgggcttcagcccggtggacgcggtcgaggcggccactctgacgccggccaaggcgttcggcttcgacaagccgaatccggtgaccggggcgccgctgggcctcatcgcccccggctatgccgccgacttcaacctcgccgacccggccgattggacggtcgaacaggtgtggtgcgcgggccgcaagttgcgctgaggccgattgcgcgcggtgcgcgcggaaggcatgtcggaagttcgtcgacgattcggcggaccgatggcatgacgcccgcgcacaccgcgcttatgcgtatgccgtgaatccccgttcggcttgacatgcgcgatggcagtgccgccatcgcgcacaccgtcgcggatcgcgcgtctgtgcaacaaagctaacatattggaaacgctgaccgtgtcgtgtcacggtttccgaaaccccagtgattgcaaggcttatgacgatgttcttcgttgtcttgcagcgataatcccgcggtgatttcatttgccgagaaacatagtgtacattaagaaaacgtacagagaagtacagaagcgcattcgcgcaggagagtgaagtggcgtccgtcgcttcggctctccatatgacggacaacaaggaggttcgtgatcatgactcacttcagcactgtgaaacgcgtcatcgctctcgccggtgccggtgccatgctgttttccgtggcggcctgcggtggggtaaccgcttccgatggcggcaagaccacactcaaattcgcggcgttcgagggcggctacggtgccgacatgtacaaggaggtggtcgccgcatacgagaagctcaatcccgacgtcaagatcgaactgaccacatccaagaagatcgaggacgagatcacgccgggcatgaaggccggcaactatcccgacatcgtggagctgggacagggctcgacctccggactgaccgagacgctgctcaaggacaaggccatcgaggacgtgaccgatgtgcttgacatgaaggtccccggggaaaacaagaccgtcaaggacaagctcgtcgacggcgtgatcggcctgtacaccaacccctacggcggagacaagacctacctcatgcccatgtactactcaccctccggcttggtgtacaacaagacgctgcttgaacaaaacggctggaagatgcccaccacatgggacgagatgttcaagctgggcgatgaggccaaagccaagggcatctcgctgttcacctacccgaccgcaggttacttcgacgccttcttcaacgcgctgctcgccgacatcggcggcgaccagttctaccaggacgtgatgacctacaagaaggacgtgtggaagaccgacgaggccaaggaggcgttggagaccacctataagctggtcaccgaatacctcaaccccgacaccgtgggctacgccaacgcccaggacttcaccaagaaccagcagtccatcctcgacggcaagtccctgttcatgcccaacggcacctggattgtcaacgagatgaaggatgcgccgcgcaccagcggcttcgagtggggcttcgccccggtgcccaccgtcaagaatggcggcacccgctacatcaacaccacaatcgaagccgtgtggattcccgccaaggccaagaacaaggaagcggcgaagaagttcatggcctacctgtactccgacgaagccgcgtccatcttcgccaagaccggtgccatccagccgatcaagggcaacaccgatgacctggcctccgacatgaaggtgttctacgacgcctacaacgaggacaacgtcaaggccgtggccggctcgttctccgcaaccgccaccgtggaaggcaagaacatcaaggacgacctgtacaacgcggtcgactccgtggcctccggcaagaccacgctccagcagtggcaggacaagctcaacgagaccagcaacgcactgaacgcggcggccaagcagtaacctcgccgtcgaacaacggccggagcagatggtcccacggtccggcccgtcgcaccgatgcattcatcggcggcgggcggggcggcggaccgctccggccccgctttgcctcagcgccatacaggcaacgcttttcagggggaacgatgtcttcaacgaaacatacaaccgaccttggcaggatgcgcagccgtttcggcattctttgctcgctgcccaccgcaatcctgctcatcatcttcatcttcatacccacggtcaacgtgttccgcatgtccgtatacaaatggagcggctactcggacgaacagaccttcgtggggctttcgaacttccggaaactgttcgtcgatccgaacttcatccacgcgttccagaacaccgtgctcatcctcgtgctggtcacctccgtcaccatgccgctggccatcatcttcgccgcggtgctcacgcagaaccgcatcatcggaggctcgctgattcgcttcatcctctatgtgccctcggtgctgtccatcgtggtggtcgcggccatattctccgccatctacgatcagaacaacggcctgatcaacggcaccctgagcttcctgcacctgaacgggctcaagcaggtgtggctgggcaatcaggacatcgtcatcttctccatcgccttcgccatgctatggcagtcctgcggatactacatggtgatgtacatgtcgtcgatggcgggcatcgacccgagcctgtacgaggcggcgcagctggacggcgccagcaagactcgacagctgttctcgatcaccatcccattgatctgggcgaacatccgcaccacgctcaccttcttcatcatcagttcggtgaacctcagcttcgtgctcgttacggccctgaccaacggcgggcccgataacgcgtctcaagtgctgctcggctacatgtacgaccaggcgtattcgaactcgtcctacggctacggcatggcgatcggcgtggtgatcttcctgttcagcttcatcatgtcgttgatcgtgaaccgtgccaccaagcgcgaagtgctgcaatactaaaggagggcgagatatcatggcttattcatcagtttccggaagaccggcccactccaggcgcgtgcgtccggcggccgatcgaggttcggcccattcatggacggcgggccgcatggttggccaggtggtgctggtaatcgccgccttgggcatcgccatccccaccctgtgggtgttcgtggcttcgttcaaggataaaagtgagttctacggatcaccctggacctggcccaagggcctgcactggcagaactatgcggatgctttcgtggacgccaagctcggacagtacttcggcacatcggtgctggtcaccgtcatgtcgatggccatggtgctggtgatcgcgctgccctgctcctacgtgctcgcgcgcttcgattttccgggcaagaagattcttaaactcgccgttcaggccggcctgttcatcaacgtgaactacatcgtcgtgccgatcttcctgatgcttgtggacgccgacaagctgctctacaacatcatgccgaacgggttcttcgtgaacaacgtgttcatcctggcgctggtctacgcctcgacgtcgctgccattcaccatcttcctgctccaggacttcttcgcctccattccgaaggactacgaggaggccgccatgattgacggcgcctcgcaaaccaggatcatgacccgcatcttcttcccgatggccatgcccgccatctccatgtcgatgctgttcaacttcctgacctactggaacgactacatcatctccatgaccctcatgaccggcaacaaccgcaccgtgcaagtgggcctgctcaacctcatgcagacgcagaaggcggccaccaactacgggcgcctgtacgccggcatggtgatcgtcatggtgccggtgctgatcttctacgccgtcgtgcagaagaaactcctcgaaacctcgaccatgggaggaatcaaatgagcgacaggacgaaaagcgtgatcgccacgacggtcaaagtgacgctgtatgtctgtttcgtggtgctgaccatcgtcggcgtcggtcgtgacggatgggacgggctctgcctggaactcatcggattggccggcgtgatcggcgtggtgtggtggtacaacgcgcataaccgatgatccggccggacggtgtgaggcaacggcctggtcacccaggccgttgcctcacaccgtttctcgcccctcccatgaaaaagggcaagaaacgaaggcgcacgagccgcggctagtgcatccggccgtcggccatgaacaaggcatgggcgtcgcccttcgccttggcctcaagatagcggcggaacaccgacaggcgttccgtggtgctatgggctaggggagagggcaattcgttcaatgcgaaccagccgacgttgaggctttcgtcatcccccacaaacggttcggcattgccgccgggcttgagcgcgcacaggaaggaatgatccatatactgcgcgtggtcgccgttggcataggtgaggatacgctgctcggaattcacggacaccaagtcggtgaccacgacgtccacgccggtctcctccttcacctcgcgtaccgcggcgtcggcaggctgctcgcccgggtcgatgatgccgtacaccatcgcccactctccggtgtcggcgcgccgacccagcagtatgcgtccatgttcgtcaagtacgcatgccgtcacgccatgcagccacaacaaatcatggccgatcttcttacgcagttccagaatgaacgggggcgtgctcatgcgttggcccgttccgacatccacgcctcgactccctcgatggtcttcgggatgccggcggaaatccattcggggccgttctcggtcatgagcacgtcgtcctcgatacggatgccgatgccgcggtattccggcggaatcagcagatcatcctcgcggaagtacaggccgggctcgatcgtgaagatcatgcccggacgaatcggcgcgccctgataggactcgaaacgagcctgcgcgcaatcgtgcacatcaagacccaagtggtgggccacaccgcaggcgagccaacggcggtgctgctggccttgcggagacagcgactcctcgacgctcaccggcagcagaccccaatcgtgcagacattcggcaatcacgcgcatgcaggcgtggtggatgtcggagtaggtggcacccggcttggcggcttcgaaaccggcctgctgcgagtcgagcacggcctggtacagacgcttctggaagtcggtgaacttgccgttggtcgggaaggtacgggtgatgtcggccgtgtacagggaatcgacctcaacgccggcatccaccaacagcatgtcgccgttcttcaccacaccggtgttgcgcatccaatgcagaatcggagcgtgggggccggaggccacgatggagtcgtagccgacggcgttgccgatctcgcgggatacagcgttgaacgcgccttcgaggatacgctcggagcgcggcttgtccagcgcgtccggcagtgcggacagcaggcggtcgaagccatgcttggtggcgtccacggccttgcgcatctcgttgatttcgtagccgtctttgaccatgcgtgcctcggcggcgaactcgtgcagcttgtcgtcggatgcggagttcttgtccggatcggcgaaaccgttggcctcgcggatggactcgaccatcgaagtgatttcggggtcggtctcgctgaccacgcgcacacgcacggcaccggcctcggcacccacgtccttggacagggcgtcagccagctgggcgatgtcgtgggtttcgatgccggtcatcgcctgcatctcctggaggccagcacgcgggccaacccagtattcgccgtagtgggcggacatgaagaagtcctcggtggagttgtcggcgcgcggtgccacaaacagttccggggtgtgggtcttgccggcggcagcttcggggagtcgggatcgaccgggttcaggaccagcacggcaccagcttcataatcggaacccaggccggtgtagtaggcgaacgtggtgtccgggcggaacatgtaatcgcaatcattgttgcgcaccttcggctggccggccggaatgaccagacgctcgccggggaatgccttgcccagcgcctcaagacgggctggcgtgaacttggaggattcgagaggcttgatctccggatcgtcatcggcccagccggacttcatgaactccttgaatgcggccgactgcgggcgcagcgagcggttgttcacgcggtcgctcatcgactggttcgcgcccggcgccgtagcgcgctcttcggcctcatattccttgtccttggcggtgatcacttcacccattgccactctcctgtatgtagttgttgtcgaatcatcgattcccacttcatactagtcggctttatgcgatgtgccacgattgacggctgacggtaaaaccaagtacggaatttggacggtcttctggacatgcccatattgcgagtgcatcgggctggaatgcgggcccgtttattgttctcggcagggaaggagaggggcatgggcttgagctggagcttgtcgattgatattgacatattttgcgggctgaatccatgtgaacccatgcgatgaaggtttatcgcgtcgcgggactcactgctatgcggaggtctccacctgaggcaccccggctttgatcagttttacccgcagcggagtgcgttcgatgacgtcgacgtatgtgaaatggacgatttcggtggcaccggctcgtttcagtccttcgtcgcgtgcgcgttccttggccaccacctcctgaatgctgcggttatcggtcatggctgggtccacgtatttttgtgtgccgtcgtattcggccactatcacgcgcccgtcatcgagcttccatacgaaatcaacgcggtgctcggtattcgtctgtgggtcggtcaccgttacctgaatacgcggcgtgaggaagcgatcttcgatgatggtgcctcgcgcgagggattctccaccattctcgctcctttcgtttgcatagcgcagcaggcggaatactcgggcataatcgattctccattgaacgcagtcggcggctatcccttccttggttattcccttggcaagggccgagtcaaagatcggcaacgcaaaccgaaaatcaaggtctatagcggcctcgaccaaggttctagccggtgatatcagggataggccggaggcctcgtgatgtgtcttcggattgttcatatcgggcatatagacatgtcgtaagcgctgatggcattgacgagatccatgatcggaagtcacgatggttatgcagccatcatgcaaatgccattgatgttcgaatccataggcacttactgccaccaagccgccaaaaacccactgaggatgctcttgcgcaagagcgcgggccatatgcaacgttcgctccggcggcgtcaaaccatcccagtatgcggtatttgcataaagactgggaatgccgtcatacactttcaacaactcaccactctgggcacggcggcgtagagcggtctgttccgcttcatttcttgaatagacgcatctcagctcattctgcgcggctgatatgagcgaggccactgctttgtgtgtcttcatgacgtcgagcgtagccggaacgaagcagcgtaagtatgaatttcagccattgtggttctagcctcggagcttggctgtcttggagtgagacattcccgataatttcaaggtattaggccactaattcggaatagtggataacatacaaaacttatccaccatcagtaatgtcattcgaacaacgtgctttggggattcgaacaagatatcatcggcgaaggcggatgtagctggtagagggcggcgaattgacggttaacagtgcttatgctttgtacgccgtcggtgctgattcagatattggctggcttctgtctgagtgtggaatctagcgtcggcgtgagtccaatggttgtatcgtggccgacgattcgctgcgatttattggcgacatagatccagggcttggacggctgccgacggtgagagcagtcataacagtgaatgagcctctgcgagttcaaaagatgatgtagcggacgtttgtgagagtcgtttccggggcaagacatggtcgattgacgatgttgaaatttctcagcgacggcagaatggcatgccttggcgaggaggcgacactgagaggcgatggagtcgggattaatccaggttttggccagctaccgactcgcaagagcatcatagcgtcggtgtaccgccagaagctggcactgtaccgacgctgaatagcatcagcgtcgccggacatacaagttttggattgcagccgactaagaatgggatgccgacggcaagagccgcattgcaactatatgagacggcttcactgtgcgcgctgcaggaaaaggccgcccgcgcggcggcgacatatgaggcggtttcactgtgcgcgcacgataaaccaccccggcggctaggatagagggaattgaggagtgtgactccacgcgtgaaggcaagaatcccgaaccatgcagggcaaacctgtgcgaggggagcttcctgcgcatgcggaagcggaatatatgcgggcatgcgtagacatgacgagaatggcgcgaacacgtaagtggcatacgcactccgaacggtgcaacagcaacacgagcagaggttagaagagaatatgtcattcgagcatccgaatcggaacaatgagagcatgcgggacgtcgaactggacatcatgagccgcccgccggagcataacaccaccaatctggatctcgaccggatgaacctgatgctcgacatcctgggccacccggagcagtcgttccgcgtgattcatatcaccggcaccaacggcaaaggctccaccgcacgcatggccgaggccatctgccgcgcctacggtatgcgcaccggcctgtacacttcgccgcatctggagaagatcaacgagcgtatcgccatcaacggccagcagctgtccgacgacgatttcatcgacatctgggaccagaccaaggatctcgtggccctggtggacgccaagatggaggagcaaggcaagccgaagatgagcttcttcgaggtgctcaccgccatggccatctggaagttcgccgacacgcccgtggacgtggccatcgtcgaggtcggcatgggaggcctgtgggacgccaccaacgtgctcaacgcggatgcggccatcatcggtccggtggacatggaccacatgcagtggctgggcgacaccgtcgaacagatcgccaccgagaaggccggcatcatcaagccgaactgcaccgccatcatcggcccgcagccgcatgaggaagccgtcatgccgattctcaccgaagccgccgaacgcaaccacgccacgctcgtgcgcgacggttacgaaatgaccgtgtccgaccgcatggctgcagtcggcggacaagtcgccaccctgaccacgcccaacggcacttacgagggcgtgccgatcgccaagttcggcgagcatcaggcccataacgcacttgccgcgctcgtcgccgccgaagtggtgattccggtcaatggcccgctggacggcgacttggtggccgaggcgttgagctcggtcaagattcccggccgcatcgaacagatccgcacctcgccgaccatcattctggatggcggacacaacgtgaatgccgccgaagccctacgcaaggccatcgaggaaagctacgacttcaagcagctggtcggtgtggtcgccatgatgcgcgacaagcaggtcgaggaatatctgggtgttctggagccgatcctgagctccgtggtggtcaccgagaactcgtggcgcgagcgtgtgatgccggccgatgaacttgagaagattgccgtggacgtgttcggccgtgaccgtgtgatcaaggaagcgaacctgcccgacgcgattcagactgccgtcaacatggtcgatgccgaagacgagctgggcgtgggctacggccacggcgtgcttatctgcggcagcttcgtcaccgccggcgacgcacgcctgatgcttgaggaacacgccagccccacgatgaggcaggccatggccgtccatcagccggcggtcgacccggacgattcggatcggccggcagacaaggccgaggatgaggccgccgacaacctcgaggattcggtaagcccggacgacttcgacgtattcgacgtcctcggcctcggtaaggaacaggccagtgacgccggtaacgccggcaccggcacggccagtgccgacacaggcaccgacgattccgccgacgcccggtaacccgaatccaaggcatatcggatacccggacacacggaaaacaatctcacgccatgtatctcaaggaactcaccctccgcggattcaaatccttcgcctccgccaccacgttgcgcttcgagcccggcatcacggcggtcgtcggccccaacggttcgggcaagtcgaacatcgtcgacgccctgacctgggtgatgggtgagcagggcgccaaaaacctgcgcggcacttcgatggaggacgtgattttcgcgggcacgtcctcccgcccgccattgggccgtgcacaggtgagcctgaccatcgataattccgatcacacgctcgatatcgattacacggaagtcaccatatcccgcaccatcttccgcaacggaggctccgaatacgcgatcaacggctcgcaatgccgtctgctcgacattcaggaactcctctccgataccggtcttggccagcagatgcacgtgattgtgggtcagggacgattggatgcgattctgaaggccgacccgtccggccaccgcgcgttcatcgaagaggccgccggcatcctgaagcaccgcaagcgcaaggaacgcgcgttgcgcaagttggccaataccgaaacgaacctgagtcgacttgacgatttgctgggggagattcaccgccagctcggccccctcggacgccaggcacgcatctcccggcgcgccgacgcgattcagatatccgtacgcgacgcccaagcacgcctgtatgccgaagacgcccaacgctcgatgagccgccgcgacacggtacgtcaagagcttggcgatgtgcgcaaccagctggccgtcgcccaacgtgaactcgcccacgtcaaagtacgcatcgaacaggtcgaggcgttgagctctgaatccagtccggccatcgccaaggccaaccaatactggcatgaattctcgcagacccgtgaacgactgaacgcgctcgcccagttggccgaagagcgtagccggtcactcaccggccagatcgtcaccaacttcggtgaggatcccggcatactcgtcaaacgagccgaggaactggagtctcaggccgcggcacaaaccaaggccgtggccgatgcgcgcatcgcacttgacaaggccaccgaggaacgcgccgacgacgagaagaagcttgcctcagtccgccagaccttgacagaactgcgcaaaaccgcacaggagcgcgatgcacaaatcgcccgactgcgcgaactcatcgcccgtgaggaatccgccgtgcaactggcgaccagccgcgccaaggattatgcctcccaacgcgacttgctgacttcccagcgcgacgatgcccagcaacagctggacgcattgcgcagcgaagcagactccattgccgacgatgacggtgccgcattggacgccgcgcgtgcaacgctcgccgaatgccgcgaacgactgaacgaactcgccgataagcagcgcgagatacagtccaagatcatctcgctcaaatccaaggccgatgcgcttgccgacacgctaggcagccgcaatgcctccggatcattggaacgcgacacggacgtggcctcgcttggccgactcaccgacttcatccatgtggccgaaggctgggaagaagctgtggcccacgcgctcgaccagtatgccagcgccatcgtggtacccgaggcaggcaacatgttgcacgccctcgaacgcgctcgggaagataagctcggcaaagccgtggtgctgaccgcgagcattgccggcgatcccgtcacagagccaggcacggagtcggaggagagtagcgccgagaacacggcggccgccccgcaatcgggcaacgcgctggcagcattcgtcaccgcgaacccggatgccgagaaccaggcgcaggccgaagctgtcgtgcacaccgtgcgtctcctgctggctgatgtagccatggccggcaccgccgacgaagcacagcacatcgtggcatccggcgaagccatgcgggccgtcaccaagaacggcgagaccttcacacacggcgtggcggcggtcggcggctcttccatctctcaatcggacctgtctctggccgcccgtcgagacaaagcattggcacaggtcaaacagttggccgcccaagacggcggaatggctgagcaagtggccgaggccaaagccaaacgcgatgaagcggcccgactcgtcgaccaggaatccgccaaacgcaccgaagcccggctcaaagcccaacaggcggagaaatctctgaaatccgccacagaccgcgtcgcatcgttcacccgtcagctcgagcagctggataggaaaatcaccgagacccaagagaatcgcaacgagcatcagctcaggctcgacgatctcaatcgcgctttggcatcggcccagcaatccacagcggaacatgccgatttcgacgaacttgatgaacgtgaacgcacgctggagcgcgaactgaacctgactcgcgagcatgaggtcgccgcgaaaatcgcgtggaccgaagcaagccgccaaggggagtcactgagccggcaggccgggctgctgcgggacaacgccagagaagccgctgaacgccgcgcccgcatcgaggcgttgaacgatcgcagacgcgagcaggcctcacacctgcaaggcgtggccgatgacgcgcgagcagtggccgccatggtggaacatacgctgcatgacgtggccgccaaacgagacgagctgcaggccgccgcctccagccatgacgaggaactcaaggccctgcgcgcgcagcgcaaccagatcgagcccaaggtcaccgatctgaccgggcgcgaacatgccttggatgtaaaccgcgaacggttggccgccgaatccgggcagctcatgcaaaaagtgtccgacgaactcggtctcactttggaggaattggttagtggttacggccccgaacagccggtgcccgtgctggatgatgagggcaaccctgtgccgttggatgagacggaagctgaggctgggaccgaagagggagaaaccgggggagaggccggcaccaacggcgattccgccctctttaagaccgtgccgtataaccgtcaggagcagaagaagcgtctcgataaggctcgccgcgatctggccgcactcggtaagatcaaccctttggccaccgaggaattcgaagcgcttgaggagcggaacaagtatctcaatgatcagcgcaacgatgtggtcaaatcacgtgacgatttgatgcagctcatcaaggatctcgattccacgatggtccaggtgttcaaatccgcgttcgacgataccgccgaggcgttcgagcagatgttcgccacgctgttcccaggcggcaccggacgactgcgcctggaaaacccggaagacatgctcaccaccggcgtactggtcgaggccagcccggccggcaagcgcgtcaaacagctgagcctcctgtccggcggcgaacgttcgctgaccgcgctggcgctgctgttcgcgattttcaccgcccgccccagcccattctatgtgatggacgaggtcgaggccgcgttggacgacgtgaacctgacccgtttgattaatgcgttcaatgagctacgcgcccatgcgcagctcatcatcattacgcaccagcaacgcaccatgtcgattgccgacgcgctttacggcgtaaccatgagagccgatggcgtaacagccgtggtgagtcaaaaactcgaacgataaacgaatggttcccgctggcaggaactggtaccacaggtgacagagggcggtccatatcgaaagaccgccctcagtctcgcttcgttcgacagctcccgccagcgggagcggggcggtattagcgcaatgccttgcgcacgccctgtacagtctgcagcgtcttgtagaagaccttcttgatgggtacgtcgcgggcgggggccaccggggtgatttcctcggtgaacttgcacttgaactcgttaaggcccttgagagacggcgcgaagtcggagccaatgcccatgagatcgtattcagtaataccctgcgagcctaggatgcagcattcggaatacagcagcttgtcggtcacatgcagacgcataacctcgttgcgcatgccggcatagtagcgcaccgcatgtgtgccgttcacggtgacaatcgaccatgccaccacacggtcttcaatacgtgcggcgaacacacggcaatggtcggcacccaacgcgccgatcatatcggaatagtcgctcatcggagcaggcgtgaatccatcgcgctggccggtctcgaccatcacatcgtaatattcggagaaatcggccagcgccttatccgtctcatcggcaacctcggccgggcactcgcgcagagacttgcgcacgtcacggcgtccacgacgcttcatccgagccagaatctcatcatcgccaccggtgacgtcgatgatcacggtctggtcgtacggcactgtggagagcaccttctccgtaccatcggcgaaccaggtgtcgatacgcaggaacgcgatgttcttgtcggccttcttgacggtgtccatgatggcgtcgacgacctcgcgctcctcagcctcggtgggcttggcgacccacgccggcccatgcatcgagcgcagataatgataaccgtgcgtctcaaaatcgataaaggagatcacggcgaccaattcaccatcacgcttgatcagataatcgccccatggtgtgcgtccgtcgatatccgcctgaaaaccagaccaaaccttggtctgttcgataggcaacgtgatgccggccttctcggcttcggcttccagtgtggctccgtcaactttctccaacgtgatcattacgattcagctatcctttttcgttcgtatccgtatgtcgtgtttctggtttggtcgtattgcgcgtgatctgatgtgggccaatcgggatccgatcaggatctgattggccggaatcccgtcacaagccaaacatgcgttcgacgacgtgatcgtcgccgtcgaacggcacatgcttgtgatggtccttgatccaacgctcgttgcccttgccgataatcagcaggatgttgaatcggtcggcgtgcgcacgggcatcgtaaatggcgttggtgatggccgtcggacggtcggaaatcaccgtggaggccacatccttgttcgtgatgtagccttgcatttccatgcagatgtcgatgaacggctcggtgtccgtatcttcggcggtgaaaatgaagttcgcgatacggttctcggcagcctcgacgatttccttacgacgatcgtaggccttgttgccggccgatccggtcaccagcgtgatacgcgggttttcctcgccccaacgctcgtagacgaagtcaagcagcgcggtgacggatgcgtagttgtgcgcataatcgacgatggcgagcgtgttcgactgcggatcgcggaactgttccatacggccggcgatacgtacggattcgatggcgtgcagtgcgccggcgtcatcgagcgatacgccagccgcatgggcgatggcgatggccgccgccgcattgaggtagttgaagtcgccatcgatggacagatggtagtcgccaagggtctgatctccgtcggcgatgtggaaggaggcgtgcgccgtgtcggcgggccaggcgacgacgtccgcactggtgccggcattatccgcgtcatgcagggcgaaggtggttgcgccgatgccggctgccgccgcgtcctcccgcaacagatcggcgtgcagactgtccgcgccgagtaccagcgacttcgcgttggcgatgatctggcgcttgcaatacaggtaatcctcgaacgtggggtgttcgatcggactgatgtggtcgggggagatgttgaggaacgcggccacatcgaaagtcaggccatagacgcggtccaccttgtacgcctgggaggagacctccatcaccagatactccatgccgttatcggccgcctcgcgcatcatgcggaaggcgtccatcgattcgggcgtggtcagatcggactcgacgtaggtgtggccgtcaaggcaattatcgaccgaggagaacaatgcggccttgccaccggagacggcgttgataagcgcctgcgtgaagtacgaggtggtcgtcttgcccttggtgccggtgacgccgatgaccgtgagctcgttctgcggatatccgtagaacgcggcggacagcaggctcatcgccttgcgtgcgtcgttgacgatcaggccgggggcggcggttgcggctgagtactcggtttcggccacgtatgcggccaggccggcttcgtcgatgccgttcagatactcggccttgaatcggcccttgcagcacagcagggtgcccggcgtgaccttgcgggtgtcgtaggtgatgccggcgaacggttcatccgtcgaagcgatacgggccgggtcgtcggtccagacatccccttggatgatttcacgcagcagatggtgttccttgagcaggtcagcggccgaagccaaagtcaaagccataattgtttctccctattatctagccgatacgccattctacaggtggggtgcagcgtgttgtggctcacacgtcatcgaccacgatatgggcacatgatttgattagaatggtgaaccgtgacgacaagcgaagcaactacgcaatccgggcagtcggccggatcgggcgagtccatggcagccaagcgcgccagattcgagcagctcgccatgcccgccgtcaatgcactgtaccggcaggcgatgaggctgaccaacaatcccgatgacgcgcaggatctggtccaggacaccttcgaacgcgggttcaaggccttcgactcattccagccgggctccaacttcgaggcgtggatgaccaccatcgagcgcaatgcctacttcaaccagtatgccaaggccaagcggcgcccgcagcgtgccaacgactccactggcgaatacgacgattgggacatctacgatgccgccgaacatacgtcggaggggctcaagtccgctgaagaggaatatttggacgccttcgcgcccgaggaaatcatggccgcgctcgccaaactctcgccggaacgccggcaggtgttcatcgacgccgccatcgacggcaagtcctaccagcaggtggccgatgagcagggcgtgaaaatcggcacggtaatgagccgcctgaatcgcgcccgcacgcaactcaagcgtgagctcgcctcgtatgcgaaagagcgcgggtacgtgactggttcgtcggctggttcaccatccgcgaagttgagcgaaaacgttggtcgaatcgccgattccggccataatgaaagtagtggacaaactgttggcagcaatggcgacacgcaagccgtagtgagacatagtcatgcgactcacgcccacacgccacaacagtcaagcaagctttcgggaaaggagatctgatgaacgatcagccggtagagcgtactcgccatatctccataacccgtacggcggccgatggcacggtaagccagaccgaagtgcatatcacggcggtgcatcatcgttcagtagataccggctcggccgctgcgtcggtccagacagacgtgcatatcgttacggagggcgactgttttgacccccgtacctgctgcgacgagcgtgaacaggcgttgattgccgcgttgcgtgcctacttgcgcccggatgtggcgcccgaatgtctgatggcccggctcaaggccacgcttgatcactgctgcggcgaagataagtaacgacatatacaacaaggcccgtctgatgtatcatcagacgggccttgagcgttctataagaaacgcgaagaatcaggcgttaggacgcttgccgtggttggcggccttcttacgacgatccttgcgcttacgtccgcgcatgcccatgatggactcctttgctgcagtaaaaaaataagccttcggaattatgccacataagtacgacgtgatgcaacacgggtgtccatgtggcgatgatcgtcaggcttggttattcggtttttcagatttgttcggcgtggaaggtgaccacggtggtgtagtcatcgcccggctcgagcacaaccagatccttgccggtgcggaaggcgtcggcgtaggcggtcatcggttcgacggccacgccggcctgacgagccttctcgccgatttcgttgccggtgcacacctgccaggagttgatggtcttgtcgccggtcagcgtgaccttgatgccgtcggggcgggtgaacacggcggaagtgctgccatcttcaccgcggttggtgatatcggtccaggcatcgtcgaagccacgtccctccagcgtggggttatcgcgcaggtcgaagatgccggaaaccggctcttcaccggtgggcagcaggtgttcgtctacggtcacgtgggtatcgcagtgcagctcaagacggcaggactcgttgtcggcggtaatggcctgaccggtggcgtgcttgccgtttgccagccacgggtggatgccaaatgcccatggggccttcacgctgtcgttgttgtgcacggtgaaggtttccgtgagaccgttctcgtcaagtgcataagtggcggtgatggtgatatcaaacgggtagccggcgatgtcgggggagcgccaggagagcgtcacatgtgactcctgcaaatcaacgagctcccacatgtagcggtaggcgtagccgtgcagggaggattggcggtcgaactcgtcgatcggcatctggtagtcttcgccatcgaaagaatactgaccattggtcacgcggttcgggtacggtgccagcacccagccgttgcagcaggggatgaccttgttcgggtcgaaggggacgatgaggtcttcgccgcgccacttcagctcgcgcaggctggcacccatttcggtgacgacggcaccccattcgccggccgagatgacatattggttaccagtgcgaggcttcaaagccatagtgcacactccttggtgaaacagattgttaccgctcacaatcgtatcgcacaagtcccaagacgcggcggcacataaggataaataattggctcccctctggcggggagccaacgtaacggaactacttctgggctacttcgtagcggaccacagtggtgtagtcgccgttgggggcgagcgtcaccaagtggtcaccagtgcggaaggcattggccggggcggtcatcggttcgacggcgataccatacggatgctcggagaacggcgcgccagtggcggtgtagcactgccaagcattgatcgtctcatcgccaatgagcttcacttcaataccgtccgggcgggtgaatgtggtggtggtcgtaccatcggcggcacgctccacgtcgacccaggcatcatcaaaggcgcggccttcgagcgtcgggccatcgttcaggtcgtagatgccggtaaccggttcggtgccggtgggaatcagcgcctcgttcaccgtcacatgactgtcggccttaatctgcaggtggcaggcggcggagtcggcatcgcgttcggcgacagtcgcgccctgcttgccgttggccagccacggatgcaggccgagagcccacggtgccggctcgtcgccatcattgcgggcattgacggtcacggtcatgccgttgtcgccgagttcgtaggtgacggtcacggtcacatcgaacgggtatccgtccaggttggggaagcgcagcgaaagcgtcacggcgctatcggtcaacgattcaagcttccacatgtagtggtaggcgtatccgtggttcgcattgttgcgcggtgcgggatgatattcgttaaccggcgcgcagtaatgcttgccatcgaaatcgtattcgccgttttcgatgcgattcggccacggggccagcacatagccgttacaggtgggggtcaggtcgttgacgccgaacgggcagaaaatttccttgccttgataatcgaatcggcgaatcttggcaccgagttcgcagatgacggcggaataatcgccatagtgaatcgaatactgatttccggtgcgtggtgttttactcgtcatggaatcactcccgtagtgaggttggtgagccggtagctcctgctatcgctggctccagtctagcgcgtctcctctatcgaggcggggattggcgatagccggcatataataaacaattcgtacagacacggtagcaatacgtggagtgacgagtctcacaccatcatgcgagaagcacgtggattccttggaaaccggtgattcgtgggagacacggaatagttgtgacggcagattcctgtaatccctgccttacactggaaaacactattgacgttcaggaggttccgatgaccaaaagcgttgtgctcgctgatccgcgaggcttctgcgcgggtgtggaccgtgcgattcttaccgtacagaccattctcaaagccgcggaggcttccggaaagcggacgcgcgaggatgggctgcccccggtatatgtgcgccggcagatcgtgcacaacaagcatgtggtcgaggacttggccgggcaaggcgcggtgttcgtccaggaattggcggagattccggatgctgctgcccaagcgggtattccggtggtgttttccgcccatggcgtatctccggtagtgaaggcggaagccgaacgtcgtggcatgcatgtggtggatgccacctgccctctggtgggtaaggtgcaccgtgaggtgctgcgtttcgtgcgcaaggggtatgaaatcgtctatatcgggcacaagggccacgatgaagcagtcggcgtggtgggggagaaccccgaacatgtgcacttgatcgagcatgaatcggatgtcgattcgttggattttgcgcccgacaccaagttggtgctgctctcgcagaccacgttgagcgtggatgagaccgccggcaccattgccgcgctgaaggccaagttcccgtggattcaagagccgccgagttcggatatctgctatgccacgtcgaatcgtcaggctgcggtcaaactggtggcccagcagtccgattgcgtggtgattgtcggatcggccaactcctcgaattccgtgcgactgatggaggtggcgcaggagggcttggggaagcgcggcaaagcgtatcgcgtggatgatgccagcgagcttgatccggcgtggttcgtcggactggagtccgtgggtatctcctcaggtgcctccgtgccggacgaactggtgtccggtgtgattgacgctctgcaaaacttgggtttcaccggtatgaagtccatcgaaaccatcaaagaaaacatgcacttcgtgttgccggcggagttgcgtaggaagaaatagtcatccttggctcccctcaccgagggaagccaagaacggtcaccacgtgccgattggtgcggcaatggcgttcatcaccttcagcaggtcctgcgggttcacccccacggacagtccgcgtttgccgccggagaccagaatctggtcgaattgcagggcgctttcatccaacacagtcttatgacgtgtcttctggcctaacggcgagatgccacctaccacatagccggattcacgcatcgcgaccttgggatcggccatagaggccttcttggcacctacggctgcggccaatgccttcaggtccatatgtccgctgactggtaccacgcctaccacacgctccgaaccggtgtccgccattagggttttgaacacctgatgctcgtcgaagccgagcttggtggccgcttccacgccgtagccgtcatccatatggtcgttggagtgctcgtattcgtatacgtggaattccacgcccgccttctccagttggactgtcgccggagtggaacccacgcccttatcatgcttgcttttctttgccatgattaccgttctactacgaagagacccccgcacaaggcgggggtctcacagcttagttctcaaacgaaccgtagcggcctagaccgcagtggttcactcggagatctcagcgaagtacagcagggtacggatcatgttggaggtgaagccgtactcgttgtcgtagaaggacacggtgcgagccagggtcacgccgtcaatggtgttgacgtcggtctgggtcgggtcgaacacgccaccgtgggtgtcgccgagaatgtcggaggagacgatgccctcatcgttgtagccgtagtactcggtgtcggagaaggcagccttgaaggcttcgttgatctcgtcggcggtggtctcggtgttcagcacggtggtcagctcggtgacggagccgtccgggacctggacgcgctgggcgtggccctgcagcttgccgttcacggacggaacgaccttgccgatggccttggcagcgccggtggagtgggcgatggtgttgatggcggcggcgcgcaggttgcggccggtcttggtgccacgcgggccatcgagcagcatctgggtgccggtgtaggcgtggatggtggtcatgaagccggccttgatgccgaacttctcgtccagcagcttgaccatggcggccatggagttggtggtgcaggagccggcggagacgatcacgtcggaagccttgaggatgtcgtggttcacgccgaacacaacggtcggggtggtgtcatccttggccggggcggagatcaggaccttcttggcgccagcgttgatgtgagcctgggacttctcggcggaggtgtagaagccggtgcactcgagcacgtactcgacaccgtcgttcttgacccacggaatgttgttggcgtccttctcggcgtagaccttgtattccttgccgtcgacgatgatggagtcttcggtggccttgacgtcaaccggagtgccatcgtcatgacggaaggtgccgtgggtgctgtcgtacttcagcaggtaagccagggtagccggggtggtcagatcgttgatggcggcaacttcaatgtcaccagcctggccgccgcgagcctgcagctcgaagatgcgacggaaggcgagacgaccaatgcgaccgaagccgttgataccaatcttaactgtcatgtaattctcccttgtagggtggccttggcgcgctttggcacaccgggccattgtttaccaacagttgctactgtaatgccgactctgtacacatggcaacgtttcagcgtgcgttttgggcaaaaatgccgtattttttgtgagcgctcacaattcggattgcccgcaaccggcatgtgattttcctctcctttggaggaatgtcttgaatcatcacgagcaagcgcacgatacacgagtcagcgaaccagcagcttggacactgcggtgtccagctcgccgatatcgccgccaaattcgtgaaatcggctcacctgaggcaatgccacctcgatggggaaagtgacgatcagtgtgccgtgttccacgctgatggccgcgtccacgccgtcgcggaactcgttgctgacgccttgcaccaccgtattggtcagcgtgccgttcttgagctcgtatttcagccccggttcgttcacgccaagcgaaacatcggagtgggagaacgccgacaccatacggccgtcctcgggcactggatgcgcggggaacgaaagcctgccatcggtgatggccgtgacgatgagcccgtcaccatacaggtacccgcttgccccatgccgggccaataatgccatcagttgaatgccggaaatcgtatggtcaatgcggccgcccaaaccgccatagacatggaattcgcggcaacccgccgaccaaccgaccttcagcgcggaaagcatgtccgggtcgtccttcaacgcgggcagcgcgatggtgcgcacatcagtgcgaggcggccggccctccagcgaatcgaaatcgcccaccaccacatcgggcacgatgcccaactcgcgcgtatggtcgagcccgccatcggccgccaccacatacgcgccggccggcaccacgggcgtgcccgcatagtattcgcccgcaccaaaaatcacgcatacctgagccatgatgcccactgtagccggtatccacccaccgacacacgggccgcgaatgtccgggcgtgtggtaggattcctatttggcttgagaaatcaagaaagcggggcaaccccacctggaagcctttcaaggcctcgggttcaaggcaaacagcctagcgattgcgatatacaacgcgcaatcaggaatgacgcaaagaactgatatgtgtctgcagaagctgagcgcatattggcgctggttttggcttgccatgaacccaaagcattgaacaggactccagcaaaggacctcgccacggaattaaagtagaggattggagtcatcatcagcgacgaaccacgtattaacgacgagattcgcgtcccgcaggtacgcctgatcggcccgaagggcgagcaggtgggcgtcatcgcgacttccgtcgcgctgaacctggccaaggaggcaaacctcgatctcgtcgaggtggccccgaacgcgaagcctccggtcgccaagctcattgattacggcaagttcaagtacaacgagaagatcaaggctcgtgaggctcgccgcaaccagagcaccgcggaaatcaaggagattcgtttccgcctgaagatcgacgaccacgatttcgacgtgaagaagggccatgtgacccgtttccttaacggaggcgacaaggtcaaggtcaccatcatgttgcgcggtcgtgagatctcccgcccgattggtggcgtggaactgctgcagcgtttggccgacgatgtcgaggaatacggcaccgtcgagtccaagccgaagcaggagggccgcaacatcatcatgacccttgcgccgaagggcaagaaggtccacacccagtccgagcagcgtcgtcgtggcgccgagtcccgcgccgagcgtcaggctcgccaggcggctcgtctcgcggccaagcaggagtctcaggctcaggccgcggccgacgcgcagtccgcgatttctcagaagacttccgacaagaagcaaaccagcaaggagggcagcaatgccgaagatgaaaactaattccgccgcttccaagcgcgccaagatcaccggcaccggcaaggtgaagcatgtcggttccgccatgcgccacaacctcgagcacaagtccgctcgcaagcgccgtgaactgtccgccgacgatgtgctgcgcggcggccaggccaagaagctgcaccagcttctgcagaagtgaacatagggcttacccggaaataataagactttagaaagctgaggaatagattatggcacgtgtcaagcgcgcagtgaacgcccacaagaagcgtcgcgttgttctcgagagggcttccggctaccgtggccagcgctcccgcctgtaccgcaaggccaaggaacagctgctgcactcctttaactacaacttccgcgaccgcaaggctcgcaagggcgatttccgcaagctgtggatccagcgcatcaacgctgccgtccgcgctgagggcatcacctacaaccgcttcatccagggcctgcgtctcgccggcatcgagctggatcgtcgcgctctggctgagattgccgtctccgacccgaacaccttcaagaccatcgtggacgccgccaaggccgccctgcctgaggacgtcaacgctccggttgaggcctgattgcttgaagtcgtgacttcacactagaaaccccgcttccgagcggggtttcctattatcagtcccctctgacgaggggctctcgcgcagcgggggggagagaacaaactcatgaccaacggattcaccagactcaccgagcagttcctcgtccacatcggtgtggagcgaggactcgccacggccaccgtcaccgcctacgaatccgacatcgccaaatacattgattggctcgaaacccgcggcatccacgaaccggacgccataaccaaacaagacgtcgaagactacatcgccgcccttgaccaggcgggggagtccgcccgctccaaagcccgaagactggcctcgatccacgaattccatcgcttcgcgctcggtcagcacgcggtgactgccgacgtttctgccgcagtcaaggcacccaaaggtgccagcaccctgcctgacgtactcaccgtggacgaggtaacccgtctgctcgacacggcggcagtcggcggatcaaccgatccggtggtattgcgggacaaggccctgctcgaattcatgtacgccaccggctgccgcgtctcggaagccaccggcacgaatctggacgatatcgacctggacgagcacatcgcgcgactcatgggcaagggctccaagcagcggcttgtgccattgggcagctacgcatgccgggccatcaccgcatacctcaatgcggggcgtggcgagctggaacggcgctccagcgccaagattcccgagagacgcgcactgtttctcaacaaacgtggcaagcgcatctcgcggcaatcggtatgggaaatcgtcaaagcaaccggggaacgggccggcatcaccaaaccactccatccgcacaccctgcgtcattcgttcgccacgcacctgattcagggtggcgcggacgtgcgtaccgtgcaggaactgttggggcatgccagcgtgaccaccacgcagatctacacgcatgtcagtcccgaagcgcttatcgaaacctatctcaccgcccatcctcgggcgcgatgaccgatgtctggcgaggtgatgagacgggttgtccgcgatatgtcgaagcaacgtgtttgcggcgatattggcgaacggataagagtacgctggtcaggtgagatcaggattcgacggaggtccaggcatggcagatcggcgtggcgaccacgggcaagacggcgcattccgtcaaggcacgctgcccatggacgaagcgtatgtcgttacaccaccccggaacatggatattgataaggtagacagtatgcctaccgatttgcttggacgtgaatacgaaaccttccccgcacccgaaccgctgcaacagcacggtccggcgcgcgtcattgccatgtgcaaccagaagggcggcgtaggtaagaccaccagctccatcaatatcgccggtgcgttggcccagtatggccgccgcgtgcttatcgtcgatttcgatccgcagggcgccgccactgtgggactgggcgtcaacgcgaataccgtggagaacacgatttacaccgcgctgttcgatatttccgtggatccacatgatgtggtgcagcacaccgcattcgagaacatcgatgtgattccggcgaacatcgatttgtccgccgccgaggtccaactggtcaccgaagtgggccgagagcagatcctgaacagcgtgctgcgcaagctcaagtcggaatacgatctcatcatcgtcgactgccagccatcgctcggcctgctcaccgtgaacgcgcttgccgcagctgatggcgtgatcattcccgtggccgccgaattcttcgccttgcgcggtgtggccctgctgatgcagtccatcgaaaaagtgcagtcccgcatcaatcccgcattggaagtggacggcgtgctcatcaccatgtacaccaagacactgcactgcgaagaggtctgccagcgcatttacgaggcgttcagcgaaaaggtgttccacacgttcatctcccgctccatcaaactgcccgattccacggttgccgccgcgcccgtggtggtctatgcacctgagcacaagacatcaaaggaataccgtgaggtggcacgtgagctcattgctcgcggcatcgtggcgtaacgattgtttcgataaacgatgaatgagacttccctttctcggatcccctctctgagggaagctggctcgcgtagcgaggctgaggggagctccgcggaagccgaaatcagcacggaggaatccgccacctccggcttccaagtcaacctcgaagtctattccggtccgttcgatgccttgctcggcatgatcgccaacaacaaactcgagctgaccgaagtttctctctcctcgatcaccgaggaattcctgacatacgtgcgggggctcgatttcacgaaaaacatggatgaggccagcgcctttctcgatatcgcctctattctggtcgaggccaaaagcgtggcgattctgcccggcagcgaagacagccagcacgatgagcaaagccttgaagcactgcgcgaacgcgatttgctgttcgcccgactcctccaataccgcgcctacaagcaggccgcaggtgacttccgggcgcgtatcgccgccaactccggccgattcccgcacccggcggccatggacgagggcattgccgccatgctgcctgagctggtatggacgctgaccccgctcgaactcgcccaactggccgcccaggtcatcgccaacgcgcccgcctccgaagtatcgattcaccagctgcacgtgccgctggtcgatctgcgggcccaatcgctggtggtgcgcgaccgactgatcgcggcactggaattcaagggagaccagtcgatgtcgttcagcgaattgacccgggactgcacttctcgtattgaggtggtggctcggttcatggccgtgctcgtgttcttcaaacaaggtgtgctgcagtatcagcaagatggtccgtttgccgaactgcatctgaggtgggtgcccggcgtagacgaaacgatgagcgacgtgaacatttccgaaggcgattttgcgtaaggacggcgactggtgactgagcggattgacgcaacgaatgcaaccgaacacatggcggatacggaatcgacggctggatccgcaaaggccgcggtgaggggagtggaggaggcgcgtccccaatacgtggatttcacggtagacgtttttcccggcgggctgcccgcatgtctggaagcgattctgatggtctccgaccagccgcagaccgccaccgagctggcccgtattttggcattggaccgcaacacagtcgaaggggcattgcaagccctgcacgatgactatgagggcgatgaatcccgtggcatccgcccgcgcggcttcgaactgcgccgcaccgctcgtggctggcagttcgccagtcgcgccgcgttcgagccggtcgtctcattattcgtcaccgacggccagactgcgagactcagtcaggccgcactggaggcgcttgccatcgtggcctatcgccagcccgtcacccgagcccaagtggccgcgatccgcggtgtcaactccgatggcgtgattcgctcgctcacggtacgcggccttatcaaggaagacggcgtggaccccgaatcccgcgcggcccttttggtcacctccgagttcttcctcgaccaaatgggactgaagagtctcgacgaactaccctccctggcgccgttcctcccgcccgtcgccgaaatgacacagtcgaaatcggaagacgcggacgtgatttcgtagcgattggggcccgctacctgaccaatattcgtgcgctagaccatccaatatgtgatttatggtcattgtgactataagtagtgctatgctctcaatgcagggagaacaaccggtatggaaagaggcatggcatgggattcggcaatgtgtccgagcgccgcagcgcaccgccacaggtcggcgtgtcagtggtgattctggcactcggcccgaaaggcgataccggcaacagtgccgccgattccggcaacgccgcgaactcggcccattcccgtctctggttgcccttggtcaagcgcgtccgtcagccgttcctgggctgctgggcattgcccggcggcgacctgcgctccgaccggtcgttggaacagtctgcctacgcggccctcgaatcgaccacagacctgcacccgcgatacctcgaacagctgtacacctttggaggcccgacccggtctcatggcggattacccatggtatccgtcgtgtactgggcgctcgtcggccagaccgaggccgcgggcttcgaggatggtgacaacgtacgatggttccccgaagacgaactgcccgagctggcgttcgaccatcgccagatcatcgactacgcgctgctccgcctgcgctccaaaatcgaatactccgacgtggccacccgactgctcggccccacgttcaccctgcgccaactgcacggcgtctatgaggcgattggcggcgaaaccctcgacttggcgaacttccgccgcaaaatgcttgcctcgggagatcttgaagacaccggggagaaggtgcgcgaaggccgccaacgaccggccaccgtctaccgctacatccccaaacgacttgtcgagaacggtacgccccacgaatccgatggcgacgacatcgtggaactgtccagacaaggcgagcgtgaagacgctctcgacgcgctgatcccatccgcgcgcatctgatttttcccgccgacccgcttcgggccggcatcacagacgtatataggaaaggaaccgctatgaccgcactatccactgcgccgtccgttgacgagatcatcgccaagctgggcgcgcaaagcacctgcgatgcaggactgacccaggacccatggcacttcgacaccaccacacccagctacggtcccggtgcctcgatgctcgaccgtctgcccgccaacgcgccgcgtcagcaggtgctgccggacgaataccgcaaggcctccgacgaggagctgcagcagcgcatcaccgacgccaagcagcgtcttggctccaaactgttgattctgggccacttctaccagcgtgacgagatcatcaagcacgccgatttcgtgggcgactccttccagctggccaagaacgccaccgaacgcccggacgccgaccacatcgtgttctgcggcgtgcacttcatggccgaaaccgccgacatcctctccacgcccgaacagagcgtgaccctgcccaacctgtccgccggctgctcgatggccgatatggccaacatcgaccaggtccaggaatgctgggaccagctcggcgagatctgcggcacccagccggactccgatggcttgcagcagatcatcccggtcacctacatgaactcatccgccgcgctgaaggcgttctgcggacgcaacggcggcatcgtatgcacctcgtccaatgcgcacgccgtgctggaatgggcgttcgcccgcggcaagcgcgtgctgttcttcccggaccagcatctgggccgcaataccgcccgcgcgatgggcattccgctgaacgagatgccgctgtgggatccgttcaaggcacagggcggcgccgccgatccggccgactacgcccgcgccaagatgattctgtggaagggcttctgctctgtgcaccagcgcttcaccgtcgaacaggtcgaacgcgcccgcaaggcatacccgggcgtcaaggtgatcgtgcaccccgagtgctcgatgcaggtggtcgacgccgccgacggcactggctccaccgcgtacatcgtcaaggagattgccaacgcacccgccggatccgccatcgccgtgggcaccgaaatcaacctggtgaaccgtctggccgcgcagtacccggacaagaccgtgttctgcctggaccccgtggtctgcccctgctccacgatgtaccgcatccacccggcttacctggcttgggctttggagaacctcgaagccggcaacgtggtcaatcgcatcaccgtggacgaagacaccgcccgcgaagccaaggtggcgctggagcgcatgctgcgcgttcacccgtgacatgcttctagctccccctccctgaggggagctgtcaccgtaggtgactgagggggagcggatgacgcaaaaacagaggaaagcaacacaatgagcaacactgaaatcgtcgtcgtgggcgcaggcgtcgccggactgtccgcggcactggccgtggccggcaccggacacgacgtgaccttggtaaccaaggccgaactggtggaatcgaacacctatcatgcgcagggcggcatcgctgcggccatcttctccgacgacgacccgaagctgcacgccgccgacaccatggccgcgggccacggcctgtgcgacccgaaggccgtggacatcctcacccgtgagggtgcggagcgcgtccgcgagttcgccgcggccggcgtccacttcgaccgcgacgcgcagggacacatgctgcgcggcctggaagcggctcattcgcgcgcccgcgtggtgcatgccgggggagacgccaccggcaaagtgctcgaactggacgtctccgccatggtgcgcaagaacccgcgcatccacatcatcgagaacgcattcctcaaagacctcatcgtgcgggacggccacatcgccggcgtccgcctgctgatcgacgggcaggacaaggatctgtccgccgaccgggtgatcttggccgccggtggagcaggccgtatgtacccgtacaccaccaatccgccggtcgccaccgcggacggcctcgccgccgcatggcgtgcgggcgcccaggtcgccgatctggagttctaccagttccatcccaccgccatggccgtgggcgagcacttcctcgtctccgaagccgtgcgcggcgaaggcgcggtgctgctggacgaacacggccaccggtacatgagggacatcgatccgcgcgccgaactcgcaccgcgcgacgtcgtggcccgcgagaacttccgcgtgatgcaggcgcaaggcggcaagcccgtgatgctcgacgtgtcgccgatgacccgcgagaaccccgacctggccagcttcctggcccaccgattcccgaccatcgacgcctatacgcgttcgcttggcttcgactggagcaaggagccgatcccggtggcgcccgccgcgcactactacatgggaggcattcgcaccgatctgaacgcccggacctccatccccggcctgtacgcggccggcgaatgcgcccgcaccggtgtcatgggctccaaccgccttgcctccaactcgctgctcgaaggacttgtctacggacgccgcgccggtcttgccgccgtcgcggacggtgacgacgcggtctgggcacccgaaccgttcctgaactccgccaccggtgccgtgttcgaccatgcgccgatcgcgctggccgctcctgccgctacggctgctgctgacgataccgccgccgacaaggtctgggaccgtacccgcatccagaacaccatgtggcatggcgtcggcgtgctgcgcgacgaggccggactgaaaaccgccatcgccgaactcggccaaggcctcgccgccgcaaacgcccaggctgatgtaaacgccgatggtgctgcaagcagcgttgaggctttggagaaccgcaacatgctcaccgtaggctatgtggccgccatcgccgcgctcgcccgcaccgagtcgagaggcgcccacgcccgcaccgactacagcgagccagtcgacaactgggcccactccgtcgcctacatcaaggactaacccatgctcacatcacacatcatccgcgtcgccgtcgaagcggcgctcgccgaagacgcgccctacggcgacatcacctgcgagaccaccatccccgcggacgaaaccggctcggcccacctcaccgcacgcgaaaacggcgtgatgagcggcatcgacgtgttcgccgcagccttcgccgcgcagaacccggccgtcaccgtcaccgccgccatcaaggacggcaaacgattccagcgtggccaggtactcgccaccgtggaaggtccggtacgcgacctgctcaccgccgagcgcatcgccctcaacttcacccagcgcatgagcggcatcgccaccatgaccgccgccttcgtggacgcggtgaacgccatctacggcgatgactatgacggacccgtcacccggccacgccgctacgagcgcacccgcatcgtcgatacgcgcaaaaccacgcccggcctgcgcccgttcgagaaatacgccgtggtctgtggcggtggccacaaccatcgctacggactgtccgacgcggtcatgatgaaggacaaccatctggcggcgctcgccgcgcgcggcatcgacctggccggcgcgatccgccacgtgcgcgaacaggtgggccacaccacgcatatcgaagtggaagtcgaccgccttgaccagattcccgccgtgctcgccggcggagcggacaccatcatgctggacaatttctcgctcgacgacacccgtcgcggcgtggagctcatcgacggcaaggccatcgtggaagccagcggcaacatgagcctggagcgagtgccagccgtggccgccaccggcgtggacgtgatctccgtgggtgcgctcacccactccgtgcgtagcatcgacctcggattggattggaactagtcatggccgatacccccaacacgtccagcgaagccggcgaactgtacctggacgccgccgccaccgaaccagtgagcccggcagtcatcgaggccatgaccccgttcctgactgaggcctacgccaatccggccagtgtgcaccagcctggcaaaaccgcggcccgcgcgctggacgcggcccgcgcatcatttgccgcggcattgggcgcccggccggatgacgtgatcttcacctcaggcggcaccgaatcggacaatctggccatcaaaggcattgccatggcccgcatgcgcaagctgggcctgcggccggtctacggactcgacgaaaccgatggcaaacagctggcaagcagccgcccgcgcattatcatttccgctatcgagcacccggccgtggcccaatcggcggcatggctgcacgaatggttcggtttcgaagtcgtgcgcattcccgtggatgcgcaagcacatctcgatctcgacgcacttgaacgcgagctcgacggcgaggccagcgaacgtaccacgatggtctccaccatacttgccaacaacgaggtcggcaccgtggaacccgtggaggaactggtccgcatcgcccatgcgcacggcgtgcccatccatgtggacgccgtacaggccgccggccagattccgattcgttttcgtgactgggatgtggacgctctgtccgtatccggacacaaattcggcacgcccaaaggtctgggcgcactgctggtacgcggccgcacgcccatcgaaccggtgctgtccggcggcgggcaggaacgcggcctgcgctccggcacacagaacgtggccggtgccgtggcgctcgccatcggactcaatgaatcgaatgcgcgcatgcaggcgcagtaccgtgaattggtcgcgtcccgagacatgctcatcgatgcggttcgccgggtcgtgccccgcgccgacctgaccggcgaccccgtgcgccgtctgcccggtcatgcctccttcgtctttcccggcgtcaccggcgaggcgctgctcgtcgacctggacgcgcgtggcatcgctgcctcatccggctcggcctgcgccatcgggcgccacgagattcctgccacgttgctggcgatgggcctcgaaccgtccgtcgccaaatcggcattgcgcatgacgttccgcaggccattggcccgcgagcagatcgaacgggtcagcctggccctcgaagagtcctatgccggcctgacccggcgttgacccggcaccgtcgggtccggcccggacaatccgcgggggagcgctcgccgtgtggtcaagccgtgcaagtatcatcgtgacggtttgtgtgcaggtatacataacacctcagagtagatactcaagtactcgagaacgcaagtaccgaacgattacgcaaaagaatcagcattaagagaggtttcgatggcggttcgtggagatatccgtaatgtggcgattgtggctcacgtcgatcacggcaagaccaccctggtcaatgccatgcttcagcagtcgcacgtgttttccgagcgtgaggaagtgccggatcgtgtgatggattccaacgatctggaacgcgagaagggcatcaccatcctcgccaagaacacggccgtggaatacaccggtccgctggccgccaagtacggccacccggagggcatcaccctcaacatcatcgacacccccggccacgccgacttcggtggcgaggtcgagcgcggcatctccatggtcgacggcgtcgtgctgctcgtggacgcctccgaaggcccgctgccgcagacccgattcgtgctgcgcaaggccctggaggccaagttgccggtcatcctgtgcgtgaacaaggtcgaccgccccgacgcccgtatcgaagaggtcgtcggcgaaacctccgacctgctgctcggcctggccgacgacgtgcagcacgagggcatcgacctgaacctcgaccagctgctggagatgccggtcatctactgcgccgccaaggccggctacgcctccgtgaaccagcccgccgacggtggcctgccagacaacgacaacctcgagccgctgtttgaggccatcatctccaccatcccggcccccgaatacgaggaaggcgccccgctgcaggctcacgtggccaacatcgattcctccgacttcctcggccgactcggtctggtccgtatctacaacggcacccttgagaagggcaagacctacggcctgtcccgtgtggacggctccctcgagaacttccgcgtctccgaactgctgcgcacgcagggcctcgagcgcaccccggtcgagtccgcgggccccggcgacatcgtggccgttgccggcgttaacgacatcatgatcggcgagaccatcgtcgaccccaacgacccgaagccgctgccgctcatccatgtggacgatccggccatctccatgaccttcggcaccaacgactccccgctggccggcaccgagggcaaggaccacaagctcaccgcccgcatgatcaaggatcgtctggaccgcgagctcatcggcaacgtctccatcaaggtgttgcccaccgaccgccccgacgcctgggaggtccagggccgtggcgagctggcgctggccgtgctcgccgagcagatgcgtcgcgaaggctacgagctgaccgtcggccgtccgcaggtggtcaccaagaagatcgacggcgtggtcaacgagccgatggaaaacaccaccatcgacgtgccagaagagtacatgggcaccgtcacccagctcatggccgaccgcaagggacgcatggatggcatgaccaaccacggctccggctgggtccgtctgcagttcaccgtgccgtcccgtggcctgatcggcttccgcaccgcgctgctctccgccactcgcggcaccggcatctcctcctccatctccgccggctacgcgccgtgggccggcgccatcaccatccgtcagaacggttccatggtttccgaccgcaagggtatcgccaccccatacgccatgcagcgtctgcaggcccgtggcaacttcttcgtcgaaccgcagtccccggtgtacgagggccaggtcgtgggcgtgaacaacaagcccgacgagctggacgtgaacatcacgctggccaagcatatgaccaacatgcgttcctccaccgccgacgtgctggagaccctgaccccgccgatcaagatgagccttgaggagtccctggacttcgccaacgaggacgagtgcgtggaggtcaccccggagtccatccgcgtgcgcaagatcatcctcggccgtgaggactggtacaagtggcgcgccaagcagcgccgccagaacgccgcgcagcagggtaagtaatctggtgcggctgtagccaccattctctctagctcccctctctgaggggagctaagttataagagtttacgggtggaaggttggatgctcaaacgtccaaccttccacgcccatagacctcataatagaggccatttcatagcatctatttcacacttaattgatctcatcgagagatgagtcaacccacctgctttttgttattggttgatggagatttgataaataggcgcataattattacaccaactgcacttatcgaaccaacgatccaccatcctatcatggaaaatgaagagcataatggtgtagtaatataaggatataaaataccgaaagcgccgtcgataaaattacttgacgcttcgtattctccttgctttccttgacgacgtaaagcgtatgataccgtccaagccgcgccattcatagcaatttcagtcaacgctagcagagcagtgatgacacaaaaaacgaaaatagcagcaatttcgtatccatattgagataggaataaagagaccggaaccaatactactgcgagtgactggattaaagcagcacattcgtaatccttaacaccttccaagaaggttgcatttttacgcgttaaaacggtatgcaatatcgtgccggtgagatttaccattgccttatgaactccaactaaaactgttggaaatgcagtgaactttaccagccatactggcatgccagtattaaatgcgtacaaagccaatacgggaatattcatcaggatacaggtcatgatgaaccgggaatcacgcatagcaccttgagcattaagatgcagcattttgaaattgatattacgaatagagttaaaagatttacgtaaccaataaaatgcattgcgaacagatttattctctgaatgatcacggatcctaggcagtcgtaaagcgcttaccgacactaaaaaactgcttatagcatttacagcaatggcaacgatgtaccaagaacgcgtattccccgacaatgcaagcaaagaaccaatcgtaccaagaatcgtgccaagataaccgtatgacgcagtaactgatcgtgttgtagcaatatcgtcggacggtgtataccgtactatcaaaatgcttctagccggatgatagaatgaagatgataatccggacatcgcaagtaaaattgtgatcgctgcaggatcagtaataaagcataacaaagccatgcacatgccgaagcaaatattagatgcacaaataacagatcgtggttccaaacgatcggtaatcgtaccgcagcatgcagagccgatcatcattcccgcagccattgcacatccgctcacggttagccataacgtactaaatttcaaaatgccagtaacatataccgaccacgtcgataccattgcaacggaacctatgttattgagcagtgtattgaaacacataatacgtaatgctgaatccaactccgtaatacgcacgatggcgatcttatgtaaaagattatttagatataccataaaaatgattctaaaactcaagaaatcggatgaggcatatttgatgtttgatttaacgatgtcgtaaacatattgcattcatcacggaccccaaacattagtggaatacagtgctccgaataagtacacccttcatgcttgcatagataagaaaattacgttacttgcatctcgcattgtgaaggttaagtcatcacaaactacatagtcacgcaaagccagcactcctgacgagctggaacaaacaccggagaacaaacccgataatggccgagatcggcctgcctgaccccgaatacagcgaacccaacaacttcatggtcaaacttgtcctgcgcaacaacattcggcagtgcgtaccctacctcaacgacactgagggcatgaccatcaggaaggtcattgcggagctcgggtacccgtccgagggggcgctggtgaaatgggttcgcgaggatccgcgcgacgcgggctgcacgccgacgagcgtgtaccagtggatgcaccgctaccacagcgaggggatactgggcctgatgaacgcaagaaacgcgccgatgcccgctgaaccgatgcccgggtccggcggagacggcgtggaggggctgcgccggcaggtggaggccctgcggttggagaatgcggtgatgagggagacgatcaatgttttattcctcgccaagtcatatccccacctatactgaaacgcatgactgtgaagagcactgctgaactgcgtccgtggtcgtatcgccagaacgcgctggtcaaatcgttgatcacgattgcggcgggcgtggcttccgcctttgtgggcacgttcgcccaccgtatgggtgcagaactgagtgttccgtatggtctggtgctggcatttctgctgatcggcctatcgacatggtgcgcccgttcgcgcatgggcgcggtcggactggccctgcacctcatcgcctcctcgctgaccgcatggggcatggcactgaccaccacatccggcaaagcgctcatcgtcgccggattccaaggcgacatgccgttcttctcccagcatgccggctacatctggctgtacggcctgatactggtccaagtcgtcctgctcattcttcccgcccgctggttcgttattcccactcattctgaatcgcgcgcgtaactatatatggcggcacatttccgggaatgcgtcgcgtatcggcgggcgtaggggattacggccgctaccatagaaccttatggcacgcatgaaactgttttacttgggcccggaaggcaccttcacccatcaggcggcaatgacggccgccgaccagttcgccacactcggcgacttcgacctcaccgccctacccgacgtgcccgcgatcatgcaggccgtacagtcgcgccaaggctggggcgtcatcgcatgggaaaacaacgtcgaaggctatgtggtcccgaatctcgacgcgctgatcgacgcccccgacgtggccggcttcgcccggatcagtgtggacgtggccttcaacgccttcaccgtgcgcggccacagcatctgcgattgcaccggcaaccccgtcagcgcccacccgcacggcctggcccaatgcacccggttcatcgccgaacaccatttgcagcccgaacccgcatcctccaacgccgccgcctgccgcgacctgaagcctggccgcgtggcgctcggccccagcatctgcggcgaactctacgatctcgacaccctcgccgaacatgtgcaggatttcgatggcgcgcacaccgaattccttgtcatcgccccgcgtgatgtggtccaggaattcaacgcccgcgcccaccgcaatgacgccggcgacttcgaaaccatcatcaccttcatcccgctggtcaccggccctggcgtgctcgccgacctgctggacgtcctgcgtgatgcggggctgaacatgaccagcttcatctcgcgcccgatcaaaggccacgacggaacctacagcttcatcgccacccttgacgctgccccctgggagccaagattccgcaccgcactggaagagatcgccggacacggcgactgggcaaaaaccttggccgtctacccgcgccgcgaacgcccgaacccgccggtcgacgcctggatgctgcccgagggcggcgtccacatcaccaatcgcgcgtcggaaggctggcagtacgccgagggagcaaggaaggaactgctgtggtagacacagtcggaatcgtcggactcggattgattggcggctcgctcgcacgccgcctgaccgagcgcggcgtacgcgtcatcgcgtggaaccatcgctcgcacccctacgcccaggccgaagccgatggcattttctgcaagagcacgctctccgaactcatggatgccgagccggatgtggtcgtgctgtgcaatccgctcaaggcgatgccctcaatcctcgccgccctagccccgcttatgggcgaccatccgaacaccacgctcaccgacgtgggctcagtcaagggcatggtccgcgatcaggtcaaggctgccgcgctggggaagtgctacgtcggtgcccatccgatggccggcaacgaactgtccggctggcaggccgccgacccgcatctgtacgacggggccctatgggccatcaccgtggacgagtccacggactaccgccgcttcctcgacgtcgccgcgatgattaccaaggacgtcggcaaccgcgtcatcgtcgtggacgacgagacgcatgacaaggccgcggcgatgatctcccacatgccgcatgtggtgtccaccgcgctgatcaacgaactggtcgccaacccggaccgcaacatcgccgccgcactggctgccggctgctggagggacatgacccgcgtgtccctgaccgacccggaccgcacgcgcgcgatggtcgaggaagactcgctgaacgtcgaagtgctgctgcgccgcatggcggcacgtctgaccgatatggccgaccaactgcacgctggtgccgacggcgagcaggatgtgatgggattcttcgccgaaggcgaccccttccgccggtacaaggccgccgtgacgcgagccggcatcaccgctgcacaagctggtacggccaccgcgcagcaagccggcacaactgccgccggattcccggaacgcgagctcgccgtccccgaagccggctggcagcagaccttgctgttctccgcacgccggggagaagccatcaccggtttcatccatccgcgtcaggccatcgtccaactgcgccccgccatgtaactgcgccccgccatgtaactgcgccccgccatgcagcccgtgtgcaggttcccctcgccgcccgtcacgaagaaggctgcgcgagggggatgaagttcccgcttgttttcgtgagaagaccgtgtggctccgctgttcgaaagacccaaaggagtaaggtagtctgtaccgtttttcgggaaacgcatagaagttgatgcggcggatggttaaggggatgatgacgtatgacgttaccaaggcagattccggccggtgcccgcgtggtggtgcgcatcaccgacggcattgacccggtcgaccaccgtatgaagttccgcgactatgtggggcatgtggtttcctgggatggatacacgttggagatggtgcgtgacgccgccgccaatggttcgcgcccggcccagaacgtgaccatccatcaggaacagatcgccacattgaaacccgtgccggagcggcgtaacacgccaccccggccgtaacccaaggccataaagaattcggaggagaacgagagtgtcatctacgcagttcgacggcgatatcgactccttcgtctcctatctgaagtccaaccgcggcctgtcagcgaatacgctcaaagcgtatcgcgcggatctcacggcatgcctgcacctgttcgagctgcgcggcgtgaccgatctgaacgagatcacgctggatgatctgcgcagctggatggcggtggaatcgcgcgatcacgcccgcagcagcatggcccgcaaaaccgtggccgtgcgcgggttcttcgcgtgggcctatgagcatgggctgaccgccaccgacccggccgccacactgatgactccctcgattcccagcacgctgcccgcggtgctcaccgaatcccaggccgagcaattattggatgtcgctgaacatgccgttgcaacaaaccagtacaaggacgatgggggagcggcagccgcgtccggcagcggcaaggcagctggcaagacagctgataagtcggccgataccgtaaaccgcagtgaggcacccgcccgtgcagacaagcgcgacaacgcccgagtcaccgccgaatcgcagcgcaacgccgcgattctcgaactgctgtatgccaccggcatccgtgtcgccgaactggtgtcgatggatatcgccgacatcgacttctccaatcgcaccatcaaagtcaccggcaaaggcaacaagcaacgcgtggtgccgttcggactacccgcccagcgtgcgctggagacttggctggaacaggggcggccggtactggcccgtacggcaacggatgcagtcaagtcccgtgctgccaacgccctgttcctcggcgcacgaggcggccgtatcgaccaacgcatagcccgtgacatcgtgcacagagcggcccgagaggccggcgtgccggacatcagcccccatgcgttgcgtcattccgccgccacgcacatactggacggcggtgccgatttgagggaggtgcaggagatgctcgggcattcctccttgaaaactacacaacgctatacgcacgtctccatcgagcagctcaagaaccgttacggacaggcctttccgcgggcatgaccactatgtggacattggttaacaaactcagcaaagactgaacctagccggcaagaacccctgaattttacatgggtgtaacaaaaaatacactgcttgtctcccaagtgcgcaaaaatgacaggtaatcagcaacggggttggattgttcgagacatcgtgagatgcaagtctcacggtgacggggaatccagccccgttcgcatgaggcggggctgagacgtcctgcaacctaatgaataggagaaatcatatgaagaagaaagctcttgctttcgctgccatggcttgctccgtggccatgctgctgagcgcctgcggcggctccaacagcaacgctgcctccggtaacaccgctggctccaacatcatcactgcgtacaactccgaagcgcagaacccgctgatcccgggcaacaccaacgaaaccggcggcagcaagccggtcggtctgctgttctcccaactggtctccttcgacaaggatggcaaggcttccaacgaagtggctgagtccatcaccccgaacgctgacgccacccagtacaccatcaagctgaagtccggctggaagttcaccgacggcactccggtaaccgctgagtccttcaccaaggcctggtcctacgtggccaacgccaagaacgcccagaagtgctcctccttcttctccgccatcgccggctatgacgatctgcagaaggatggcctcaagggtgacgagcagctctccggcctcaaggtcgtggacgacaccaccttcaccgttgacctgaaccagtccgactccgtgttcccgattaaggtcggctacccggcctttgccccgctgccggaatccttctacaaggacccgaaggccttcggcgaggctcctgtgggcaacggcccgtacaagttctccaagtgggaccacaacaaggaaatcgccctcgtcaagaaccctgactacaagggcaacgaggacgtcaagaacgacggcgtgaccttcaaggtctacaccgacgactccgccgcctaccgcgacattcaggccggcaacctcgacgtgatggaatccgtcccggccgccttcaccaagaccttcaagaccgacaagaaggtccaggcttactccgaggccggctccgtcatccagaccttcaccatcccgtcctcccttgaccacttcaagaacgacgaggaaggccagctgcgtcgtcaggccatctccatggccatcaaccgtgaccagctcatcgacaaggtgctcaacggcaacgccaccgccgccaccgagttcacctccccgaagaccccgggctactccgactccctcaagggtgccgacaacctgaagttcaacgcctccaaggccaaggaactgtgggccaaggctgacgccatctccaagtacgacggccagctcaccttctcctacaacgccgatggtggtgccaagccgatttacgacgccgtcgtgaaccagctcaagaacaacttgggcatcgacgcggccaccaacccgatcccgaccttccaggaattccgtgacgcgatcaccaaccgtcagatgaagggcgccttccgtaccggctggcagcctgactacccgtccgccgagaactacctgtggcagctgtactccaccgctgctgctgatggtaacggctccaacgatggtgactacaagaacccggccttcgatgacctgtgcaagcaggctgctgccgcttccagcactgatgacgccaacaagctgtaccagcaggctgaggaaatccttctcaacgaccttccggccatcccgctgtactactccaacgcctccggtgtggcttccctcaacgtgaagtccggctacgccttcgattggcagaacctcccgacctacaccgagatgtccaagaagtgagtctgactcactgaacggataccgttaggtagttcggaaataaagggcgaggatcgcaagatccccgccctttttgttgtgtgaggggtgcttgctcacgccatcgggaaccaagttaaagtatccactatccgaccgcaaccatgggcatatccaccaacattgcccaatctcaaaccttgcgttaacgcaaatttacatatcacagtccgggcatgcggtaaactgtcggagtatttatcgaccggcgggggcgtactataccctttctggccggtctaggaaataaggagcaaccgtatgggtaagtatcttctgcgacgcattctgcagatgatccccgtggttctcggtacgacacttctggtctatgcccttgtcttcgccctgccgggcgaccccgtcaaggccatgttcggagacaagcccgtcaatgaggccgtcgcagcccagatccgcgcagaataccatctcgaccagccgttcatcgttcagtacttcatctacctgaagaatgcactgaccctgaacttcggcgataccttcgccggacagcctgttctcgacgaaatcgcccgcgccttcccggtcaccatccggctcggcctgatggcgttcgtgttcgaggcgatcttcggcgtggtcttcggcatcatctcgggcctcaagaagggcaagtggtacgacaccgtcatcctgatcgtctccctgctgcttatttccgtgccgaccttcgtcaccggcttcgtcatgcagtatgtctttggtattcagtggacgatattgccggtgacggcaggcgcagacccgggcttcatcgacctgctcatgccggccatggtgctcggatcggtgtcgatggcctacatcattcgattgactcgctccgaaatctcctccaacatcgccgaggattacgtgcgcaccgcacgtgccaaaggtatgtcgaacggtcaggtcatgctgcgccacgtactgcgcaactccctgattccggtcgtcacctaccttggtcaggacatcggcgccctgatgggtggtgccatgatcaccgagcagatcttcaacatccacggcatcggcttcctcacctaccagtccattctgaagggcgaggctaacctggtggtgtccatcgtcacgttgctcatgctgatcttcgtggtgtgcaacctcgtcgtcgacctgctgtacgcggccctcgatccgcgtatccgttacgcgtgagccgggaggagtgagcgataatggcaaacgaaaccactgagaacgaactcaacgagaccggcgaaccgggaaccgaatacttcatggaaaccctgcctggtcaagaccgctacgtggctccaatcgaggagaccccgttgcaggacatcgattccgtcgacgaatctgctccggccaccagcatgtgggccgacgcatggcgcaccctgcgccgcaacccgctgttcatcatctccgggctgctgattctcttcatcatcgtggtggccatcgcccccgggctgttcaccaagcaggacccgaacgcttgcgatctgggcaactccctgagcccctccaccgccggccaccccttcggcttcgacctgcaaggctgcgacgtgtacacccgcgtgatctacggcacgcgcacctcgctgtccgtcggcgtgctctccacgctgctggtcgtgatcgtcggtaccctgatcggcgccgtcgccggcttcttcggcggctggattgatgcagtgctgagccgtatcaccgacatcttcttcgcgctgcctatgctgcttggcgccatcgtggtgcttcagatgttcaagacctccaagtccatctggaagatcgtgctggtgctgacgctcttcggctgggtcggcgtatgccgtatcgcccgaagcgccgtgctggaatcgaagaacctcgaattcaacaccgcttccacggccctcggctccacgcctgccagaaacctgttccgtcacatcttgccgaactccctggccccgatcatcgtcatcgccaccacctcgctggcctcctacatcgtggccgaagccacgctgagcttcctcggcgtcggcctgcccaccaccacggtgagctggggcggcgacatctccagcgcgcagaccaacctgcagaccgatccgatggtgctgttctacccgtccgccgcactggccatcaccgtgcttgcgttcatcatgatgggcgacgccgtcaaggacgccctcgacccgaagagccgaacggcctgagcaaggggagtggagaaagacaatgactgacaataccaacgccacgatgctggccatgcagaaagaacatggcccgctgctggaagtccggaacctggccatcgacttcaccaccgacaccggcaagccggtgcatgcggtgcgagacgccaacttcaccgtctatcccggccagtgggtggccatcgtgggtgaatccggatccggcaaatccacctccgccatggctgtgctgggtctgctgcccggcaccggtcacgtggtcaacggctccatcaagctcgacggcgaggaaatcgccggcgccaagcagagcgagttcgacaagctgcgcggcaccaagatgggtctcgtgcctcaggacccgatgagcaacctcaacccggtgtggcgtatcggcacccaggtcaaggaggcgctgaaggccaacaacatggacgtggaccatgagaagcgctccgccctcgccaaggctctggccggcgacgaggtcgaagtcaagggcaacgacgacgagaccttcctcggcgccaaggaactgcccgagctcatgaccgaggccaagaaggctttgaccgaagccggcgtgtccggcgaggacttcgacaaggtcgtcgcccgcttcaccaacgaatgggttccgggctccgaaacccgttggcgcgtggccgacgacctcatcaaggccggcgtggccgatgatcaggcttggtacctggccaagaaatacgtcatcggctccacgatggaagaccgcatcgcgggcctcctgtcggaggccggactgcccgatgcggccacccgcgcccgccagttcccgcacgaattctcgggcggcatgcgccagcgcgccctcatcgccataggcctggcctgcagacccgacctactgatcgctgacgagccgacctccgccctcgacgtgaccgtgcagaagcgcatcctcgaccacctgcacatgctcaccgactcgttgggcaccgccgtgctgttcatcacccatgatctgggtctcgccgccgagcgcgcccagcacattgtcgtgatgtacaagggacaggtcgtcgaatccggaccgtccctggaagtgctccagcacccgcagcacccgtacaccaagcgactcgtggccgccgccccgtcgctggcctcccagcgcatcttctccgccaaggagcgcggtgagaacgcggacgccctgctcgatcaccacatcgccggcgaaagcacgcttgagaagagcgagcacatcatcaccgtcgaccacttgaccaaggaattcaagctgccccgcaagaaggagatgttcaaggccgtcgacgacgtgtccttctccgtcaagcgcggcaccaccctggccatcgtgggcgaatccggttccggcaagtccaccgtggcgaacatggtgcttcacctcctgaagcccacttccggcaaggtgttctacgaaggccgcgacacctccacgttcaaggccaaggatctgctcggtttccgccgccacgtgcagccggtgttccagaacccctacggttcgctcgacccgatgtactccatcttccgttccatcgaggagccgctgcgcatccacaagatcggcgattccaagtggcgagccaaccgtgtcaaggaactgctggacatggtcgagatgccggcttccgtgatgggccgttacccgaacgagctttccggcggccagcgtcagcgcatcgccatcgcgcgagccatggccctggacccggacgtgatcgtgtgcgatgaggccgtgtccgccctcgatgtgctggtgcaggatcaggtgctgcgcctgctcaacgacctgcaggccgagaagggtctgagctacctgttcatcacccatgatctggccgtggtccgccagatcgccgacgaggttgtggtgatgcagcacggcaagctcgtggagcacgccaccaccgacgaggtcttcgaccacccgcagaagcagtacacccgagacctgctcgacgccatccccggcggcaagctccaactcggtctggactgataatctgcgtttgagcgcattgtattgggttctttccatccgtggaaagaacccaatattcgtatgtgcaggtttgcatgatggttcgcgtgggacgaaaacgcaaaaattggtgttttcccgatgttgtcccacaatttgtgggacaacatcaacatcaatcgatagacatgagtgttgtcccacagcagatttctcacgaagcccggaattacgccattcttagtgtggtcgataattactcatgatgcggggtgtgggacggcccgcgaaaatcgtcgattttcggatgttgtcccacggaatacgtcatacctcgtatgtgatcgtgagtggggcgtgatcggaccagcgtttgtcatacgtgggagccttgtcgatgacgaatccgcgtgcggtctccgccaactcgggcgtggcgaactggtagtcgattctccagccgacattgttgtcgaaagcgcgccctcgttggctccaccaggtgtatggcccctgaatgtcgccggccaacgaacgcatcacatccacgaactcgtattcgtccagccatttgtccacgtaggcacgttcttcgggcagaaatccggcgtgcttctcattggccttggcgttcttgatatcaagcggcgtgtgcgcgatgttgaaatcgccgcagagcacggcctgtttgccgccatgcgcagcctcgtcccgcaacgctcccatgcgcttcagcatcgtgtccagaaaacggtacttctgttccattttggtcggatcgtcagtgttgccggcatgcacatatacggatgccacggtgatcgcgtagccttcaggcgttttgacatcggtttcgatccaacgccctgaatccacatcctcgctcagacctggcagaccatatcgcttgtcaagcacttccaagtcggtgagcagtccgactcccgcgcggcctttcacccggcagacctcgttcatggcatggaggttggccggtgcctcgatcttgccggcggtggcgtattcgaaaccaaattcatcgaaaatagaatcgacatcgtcttgaggcgcgcgaacctcctgtatgcaccagacatccggcgcatgcttgccggcccaatcctcgatgcccttgcgtttggccgcacgaatgccgttgacgttagacgtggtaatggtgatggtcatgcggccatactattttggcctccctacgaatcgaaccggacatcggcggccgcgatgctcagctttctctaagcctgagtgctagtgttagcaaggttgcaaccgttatacgaaacgaggaatcatgggactgttcggattcggcaagaagaagagcaagaaggaagccgagccggccgttgagcctgtcgatgaagacaaggtggccgccgaggccgcaaacgccgcagcaaaggcggaaagcgctgaaaccgtattggcggagccatccagcgaataccagggccgcggagaagagcgaggcccgtgggacgtcaatgatgaggacgtgcccgattatgacgattatctggatctcggtgcctactacctgcccttcctccagggcattcagctgcgtatcaaggccaaccgcgccacccagcaagtgcttggctccaccatcaccttcggctcctccagcctggagatcgaagcctttgccgcacccaagaccctgggactgtgggacgacgttcgcggtgacctgcttgaagccaacaaggcctcttctgaagtggacggtgtgttcggcaccgagctgaagctgccggtcaatgtcaagggcggcaagaccgtgaacacgcgcatcgttggtgtggacggcccgcgctggatgctgcgtggcatcttctccggcaaggctgctatcgatccggacagcccggagaccgaggcgctgaacaagttcttcgccggcatcgtcgtcgagcgtggcgaggagcctttggcgccgcgcgatctgatcccgatgcatccgccggtcgcccccgtcgagcgcaaggccgcggccgaagccggcgagcagaacggcaaggaacacttcaaggacattccggacaacaagccgaagggtccgctgagccaggaccagcagaccgaagtgaagaccacgctgtctcgcggcccgatgttctccgaagttcgctgatctataggaagagacttggcaaacaacaaacgcaccggtttgtccgcgctggccgacgccggcaatgacggcggggacttctccgtcattgatgccatcggcggccctcgcggcgtcatcgaatccatgctgcctggcgtggtgttcgtcgtactgttcgtggccacgagcaatctgaatctcaccattgcggtttcggccgtgttggcggtattgcaggttattgtgcgactgattcagcgccagtcggtaatgggcgcggtctctggtctggtggcggtaggcatctgcctgatttgggcatggcagactcatgaggcccgcaattactacatcttcggattcattaccaatgccggctatgccgcgttgcttgccgtgtcgctgattgcgcgcgtgcccggactgggtttggtcgtcgaattcatccgtagcctgcccaccgagcatttcaaggcatggttccatgactggatggacgacaaggccctgaaacgcgcctatatgattgtcaccggcctgtgggtcggtctgttcctgctgcggctggtggtgcaggtgccgctgtatctgaccaaccatgtggctgcactcggcgtgacccgcctgctcatgggcattccgttctgggcattggcgatttgggtgagttacctcattattgccacgccgatgcaccggcataaggtcgcggctaagaagatacagactgaagtcgctgttgatgccgaatccgaggcaaacaatgccgaactcgaaccgagcgcaaccggaaaggacgatgatgcaagctgaagttcgtatcgaacgatacgccgaccaaggccgctgcgtggcccatatcgacggtcgtgtggtgttcgtccgcttcgccttgcccgacgaactcgtacgagtcgagcttgacgagccccacgaccgggacgaccggttctggaccggcgaagtcgtcgaggttctcgagccgtctgaagaccgagtcaccccggcatggccacttgccggtcccttggcgatgggcgggggagtgggcggcgcggatctcgtgcacgtctctttgcccggccagctcaagtggaaggccatcaccgtctccgaacagatgagccgactcggccatatcgacgtggccgttcccatcgagcgcatgcccggcgacaaggaagccggcggcctcaattggcgtacccgcatcgaaatgattgccgacgacaacggcatgccatccatgcgccggcgcggcacacacaaccgcgtggccatcgacaccatgccgcttgccacgcgcacgctgctggacgtcgccaagcgcgaacacgtgtgggagggcggctttgaacccggctcccagattcgtctttccgtgcccgaaccgcgcggcgagatcgtcgataccgcggcagcagacgacaattacgccgtacttgtggacggcgaactgcgcgccggctcccagctgctcaccgaacaggtgactatcaacggcacgaccttcgactatcaggttgacgtcaacggtttctggcaagtgcatcgccaagcgccgatcgccctcggtacgcacgtgatcaacctggtcaacgggcagctgcagtcagcggcggacgccgtaatctgggatctgtattccggttccggcctgttcaccctgccgctggccacaatgaccggtgaacgcacccgcatgctcagcgttgaaggcgcgcgtgtggccgtcaagaacgctcagcgcaacctgcgcgccatgaacctgaacgatgtggacgcccgcgcgggtgacgtttcgcgcacgctggaccatgtgccggcgcatctggccaaaccgaatgtcgtagtgcttgatccgccgcgtgccggtgctcgtgccaaggtctgccgccagattgccgcggccggcgcatccagcgtggtctacatcgcctgcgatcccaccagcctcgcacgcgacaccgcgatactcatcggcgaaggctacgaactcaaagacatccgtgcctttgacatctacccgatgacccaccacgtcgagacggtggcactgtttacccgctgacaggtgagcatatgacacgacgaattctcggattgctggcctgcatggcggctgtgttgtccctagctgcctgcacgccggccggtagggcggtcggcgatacccaagacagcatgccggaagtcgcccacgattccacacatcccacggatgtcacagtcggctttgtgggctcgactgataccgccgcagacaagtccgccatcaatgcgctgtctgatgacaaactcaatgtctactatgcctcgctcgaaacatccgcgagctcggcaaacgcaactgatggcgtatccggtgaaaccgaatcttctgacgccggcaataccaacgaagacggtgccgatagtacggatgctcatactggcgtcgacaagaatgcggccaccgcacagcagggtgttgccgatttcgtggctcgcgcggtcaaaatcgtgattatcagcggcatcgacgttaccgacgccaaccgggagagctggaaccagacgttgaccaatgcgcgtgaagccggtattccagtcgctttcattgatccaaagcatgcgcccgaagatggactgctgtacgccgtcatccttcacctcaacaccggcagtgccgattctggcgacactgccgataccaagccaatggctattactgacgccgtgctcaccatcacgcgcgacgaaccccacgaacgcgagatcaaagtcaccgtctcctgagccgaatcagccccttgaagctgagaaagcaccctgaatcatccctgagccttagtggattgcgaaacaagacgcggtaagctggggaatatgagtgcaacaacagccgtggaaatgcctgagatcggagcgaccggtcttacccccaaagaagtggcgcaacgaatcgaaagcggccagtcgaacgcggtgaaaacctccacgtcccgctcggtgcgggacatcgtacgggccaacgtgttcacgttgttcaacggcatcatctgcgccgccatggcgctggtgctcgtcaccggttcctggagggacgcggtgttcggtttcgtcatcatcatcaacacgggcatcggcatcgtcaccgaactcagggccaagcgcacgttggataagctttccatccttgtggcctccgaattcctcgtgcatcgtgatggcaaggatgtcgaggtatctcataacgaaatcgtgcttgacgacttgttatggattcgtgccggcgaacaggtgccggccgacgggcagatcatccagacctggggactggaactcgacgaatccatgctcaccggcgaatctcgtaccgtgcgccaccaggcgggggagcaggtgtattccggtgccaccgcggtctccggcatggcattggtcaaggtcaatgcggtcggcagccattcctacgccgccacgctcaccgcgcaggccaaggtgtacaagaagaccgtgtccgacctgaacaagggcatcaacacgattctgaaattcatgacgttcctggtggtaccgctgtgcattctgctgattctttcgcagattcatacggtcggcggttggggcacggcactctccaccggcgaatggcggcaagccgtggtttccgcggtcgccggcgtagtaggcatgattcccgaaggcttggtgctgctgacttcgctgaacttcgcggtggccgccatgcgtctcgcccgtcacaatacgctggtgcaggagcttgaatccgtggagacactggctcgcgtggacgcgctgaacctcgacaagacgggcacgatcaccgatggcggtatcgccttcaaccggctcgtgatgctcgattccgccaatgcggctgcggaacaggcagccacgcaggccctctacgactgctgcaacgaggaacaacccaacggcaccgggcaggccgtgctcgccgggctcaaggcccaaggccatggccccggacaggtcgcatcccgtgtgccgttctcctcatcgcgtaaatggagcgcggtgcgccgcccggacgccggatcgtcggcggccacgggccgtgaggggaacgagacatggtacatgggggcgcccgaagtcatcgtcgccgcgctcgacggcgattactccgatgtgctgcggcaggtcaacgactacgccgacgacgggaaccgcgtattgctgatcgcccgatacgacggtcccgacgatccgcttcacaccggccgttccccgcagacggcctcgtccgccaagcccggtgaatccgacgggcctcggctggaggcgcaggccaggccggtggcgcttgtgctgtgctcggaaaggatccgcccggatgccgcgcggacgctggcctggttccgcgaacagggagtgcgttgccgtgtgatctccggcgacaatccggtgacggtcggcgccatcgcccgcaaggtcaggctcaccggcgaccgcgagcctgtggcgatggacgcccgcacgttgcccgaggacgtggacgagttggctcgcgtgcttgagaacgtcgatgtgctgggacgtgtgctgcccgcccagaagcgggccatcgtgcaggcgttgcacacgcagaaccacgtggtggccatgaccggcgacggcgtcaacgacgcgctcgccatcaaggaggctgacctcggcatcgccatgggcaacgcggcacccgccaccaaggctgtggcccaggtggtgctggtggattcgaagttctcgcacctgccggacgtcgtggcgcggggccgtcaggtcatggccaatatggagcgcgtggccagcctgttcctcgtcaagaccgtatactccgccctgatttcgctcggcgtagtgctgacgcaaatcccatacccatacctgccgcgccatatcacgtatatcggcgccctcaccatcggcatgcctgcgttcattctggcgctcgcgccgaacacgcgccgctatattccgggattcctcaagcgcgtggtcacgttcgcgctgccgggcggcatcgccactgcgctgtcggtgctgctggccgcttgggtgctgccgccggtcatgggctggaacgtgaccggcgatgccgcggacctgtccgccctgcgcgccaccagcgccatcatcctgttcgcgatgggcgtgttcgtgctggcccgcgtggccagaccactcaacggttggcgtggcgtgctggtggcggtgttcgcggcggcgggcgtgatcggcgcgttcgtcccgttcgtggcgaacttcttcgctctgattctgccgaccggcgccacgatggtggccacgctgatcgcgttggccggttccgcgctgatcttcgcgctgtgcctgtggctggcgccgctcgtgcgcggactgacgggcaagctctcgcgtcggcattgagacggcggcgcgattgtctcatacttcaagccgacacgccagagcctcggtaacgtgcccgtaccatgtgtagcggataatcagcggcatcataagccgattcatgatttcggaggaagcatgtccttacgcgacgaccagctggctaccctcaaggcagccggcaaggacttcgattactacaacatcgccaatctcgacggcatcgatcatctgccatactcgctgaaggtactggtcgagaatctggtgcgcaacatcgacggtgccaacatcaccgacgagcacgtcaagaccctgctcgactgggatccgaacgccgaacccagccacgaaatccagttcacgccgtcccgcgtgatcatgcaggacttcaccggcgtgccctgcatcgtggacctcgccaccatgcgtgacgcggtcaaggacctcggcggcgacccggaggtcatcaacccgcaggtccagtccgatatggtcatcgaccactccgtgcagatcgacaagtacggcatcgccgacgcggtccagcaaaacatggacatcgagtaccagcgcaacggcgaacgctaccagttcctgcgctggggtcagcaggcattcaagaacttccgcgtggtgccgccgggaaccggcattatccaccaggtcaacatcgaatacttggccaaggtggtcatgagcaaggccgaggccaacggcaacacgctcgcctacctcgactcctgcgtgggcaccgactcgcacaccaccaccgaaaatggtctgggcgtgctcggctggggcgtcggcggcattgaagccgaggccgccatgctcggccagccgatctccatgctcgtgccgtgcgtggtcggcttcaagctcaccggctccatcccggagggcgttaccgccaccgatgtggtcctgaccatcaccgacatgctccgcaagcacggcgtggtcggtaagttcgtggaattctacggcgaaggcatcgcctccgtgccgctggccaaccgcgccaccatcggcaacatgggccccgagttcggctccacctgcggcatcttcccgattgacaatgtcacgctcgactacctgcgcctgaccggccgctccgaagagcaggtcgccctggtcgaagcctacgccaaggccaacaagctgtggggcgacgcttccgacccggattacgtggaaccgcagtactccgaatacgaggaactcgacctcggtaccgtggtgccgtccatcgctggcccgaagcgcccgcaggaccgcattctgctgtccgaagccaagagcatgttcgagaagaccgcccccgcctacgagaccgagaagaccgtcaaggatccggtggccgtgtccaccgacttccgtggcgatttcgacatcgaaaacggcgacgtggccatcgcctcgatcacctcatgcaccaacacctccaacccgtccgtgatgatcgccgccggcctgatcgcccgcaacgcacatgccaagggccttaagcccaagccctgggtcaagacctcgctggctcccggctcgcaggtcgtggccgactacctgaaggccgcggggctgcaggacgacctcgatgcactcggctaccagctcgtcggcttcggctgcgccacctgcatcggcaactccggcccgctgctgcccgagatttccgaggcgatcaacgccaacgacctgaccgtcaccgccgtgctttccggcaaccgcaacttcgaaggccgcatcagcccggacgtcaagatgaactacctggcctccccgccgctggtcatcgcctacgcgctcgccggcacgatggacttcgacttcgagacccagccgctcggcaccgacgcggacggcaacgacgtgtacttgaaggacatctggcccaccaactccgaggtggccgccgtggtcgacggcagcgtgagccgcgagatgttcctcaaggactacgcctccgtgttcgacggcgaccaccgctggaagggcctcgacgtgccggaaggcgagctgttcgcgtggaacgacaagtccacctatgtgcgcaagcagaccttcttcgacggcatgaaggccacgccggacccggtcgccgatatccacggcgcccgtgtgctggccctcctgggcgactcggtcaccaccgaccacatctccccggcaggcgcgttcaaggcctccagcccggccggcaagtacctgaccgagcgcggcgtggagccgaagaacttcaactcttacggttctcgccgaggcaaccacgagatcatggtgcgcggcacgttcggcaacatccgtctgcgcaaccagctgctcgcctccgtgggcgaggaggtgacgcctggcggcttcacctacgacttcctcgccaagaagccgaccacgatcttcgaagcctcccgcgactacatcgacaacaaggtgccgctcgtggtgctcgccggcaaggaatacggcaccggctcctcgcgcgactgggccgccaagggcacggtgatgctcggcgtcaaggccgtgatcaccgaaagcttcgagcgcatccaccgctccaacctgatcggcatgggcgtgctgccgctgcagttcccggcaggcgaatcctatgagtccctgggcctcaacggcaccgagacctacgatatcgccggcgtcgagaagctcaacgagggcgtgacccccaagacggtccacgtcaccgccacccacgaggacggctccaagaccgagttcgacgcggtggtccgcatcgacacgcccggtgaggccgactactaccgtaacggcggcatcctccagtacgtgctgcgcaacctcatgaagtaaccaccttcttggctcccctctcttgaggggagctgtcagcgaagctgactgaggggagcaaggccggtatccgccaacggataccggccttttccatgcatgccaaaatgctatactgtatagcatcttcgagatggaggttgccatgaccatggtccaaatgaacgttcgcattgatgcgaaactgaagaacgaggtcgaagaagtcctcaagggcaaaggcgtatcggtgagtgacgtaatccggtcgctgtggttatacatcgccgaccgcaaggaagtgccggcattggaaacgaccgccgaagagcaagcccgcgaggaggaaaagcagcgcaagctgaaactgattcgagaaggcaccggatacgtgcacaaggaactggtcaaggccggactgatctcagaagacaccgacctcatggaaggccttacctacaagcagttccgcgacaaaatgtacgacgagcaacttgatacgtattacaacatgaagagggccgattgatgaccgacgtttccatgcagcgtattttgcttgataccaatgtactgttggactatttgctccatcgcgatgatcacgccaagatggcggaagcggttatggaacttggcgcgaagaacaacgttacgttgttgtgcgcgtcattgtcgctgaaggatatcgcatacctattatcatcggcgattcgtagggaattcaaaccgaatgaatcggaagtggagaatttcactcgcaactttctgtcgtcacgggtgccatggcgttgtatcgagcaggtgaaggagatgtgtgacattgtcgctgtcgatgagtcgacatgtgataaggctttttccctgcaaaaacggcatcgggattttgaagatgatctgatcatcgttgccgcgcaacaatccggtgccaactgtgtggtcacatcggatgccgaattaatcagtcattttcccgaatattgcaaaacaccggctgaaatcgtggcggcgctggaataaatgagcgtgtggctcccctcatggaggggagccaccaatgatgtgccggctaccgtagcctactgcgcctgtagacggaactgcttccagatgtcgctgagcttctgaccgttgcgcgtgcgcttccacacgtccagacctccgccgcgacgtcctccggcggcggcacgggccgcggcggtcggagttggatattcggagccgtcatccagacggagacgaccgttttcggtgaccgtggcaaaccagcgctcgcccttgcgcggccgctcccacaccagacgctcgcccggcaccagcagaccagcgtcaatcacctgccggatcgtgacgcgccgcgaactatgagacggccgtggagaggtcttcgacaactcatcgacattctgcttggtcagatcacgggcgtccttgtcataccggatgccccagtattccacgatgagtcggaccgactcttcctgccgcgcctccagcagggcaggtgtgcagtcagcgaaatccttcaactgattggtcagcgggaaacgacgtgaatccgcgcgcaacagcatgcggtcgcgacgtgccggatattcactcaacctgtccaactgatcctcagggccctgcaccagcgccatattgccgagtcggtacatccagaaatcatgttgatcctgcgaccagtccgcaaacgatttcgaccgttcgatatctaacggcataatcggcagcgcactgaaccggcgtggtcgatccaactgcatgccggccttctgctcgttggcgcgaatcagcagcagacggaccaaatcgccgtcaccctgcatctcgccatgcaaacggaccaatgcgccttcacggtcgccgtccgagacatgcaacccgttcacgcgctggaccaaatagcccttgtcaagatcacggatggcggcgttcgcataaccgcgccgctccaacgctccagtgcgattcagcgtacggatgcccgtcacctgttccaatgcggtcagaatttccaacagccgacgctcgtcatgggcacccaacgattccagcgtggccgtggttctgtcggtacgcgaggcacgaaccacgaacggcgacaaatcggcgtcgcccagcccgcgatacgaattgaccaacgcccacatggccacgggcttccactcgtggctgcggtaatcgtccaatccctcaagccggctacgcacctcggcgggcagtatggtgtcgctggggcgcgcgatgatccgccatgccatcgcatagggtgccagtacttggttgatgaacgtgggcactgtgcctttgtcgatgtacggttgcagcacgtcggccaggaaatcctcgatgagcttgtcggtggccggcttgtgcgtgagcacgagatgcagataggcgaagaattcctcacagtcatgcggatcgtcgccgatcgggtcaatgatgtcatcccaacgggctgcgtacacgtcaagttcggcggtcgacaggctggccgtggcgcgcgccttgaacacgtcggacggggtgagcggcaggccgcgcatgttcatcacgtcgaagatgcgatgcgcgccgtcgagatcgtcggtggtcacgatgacgagcgtcacctcgttgaccagatactgcgcgaattgctggcgttcggatgccgaccaattggagatctcgtcgtacgtcttgcggatgttggcgacgatgttgcgttgcgcagcggtcgccagatcgtcgtcgttcatgtcgaacacggattcgaggttgtcctcctgcacgtgttcgcggaagaacgccgcgtcgcgctcgcgcaacgtgaggcgaggctcggtgacgatgccgcgcagcttgtcgccgggctccaccagcagcgcgtcgagttggcgcatgaggtccgggtctcgctccagatcgcgcagcacggcgatgatgatcgacagggataccagccgctgctgcccgtcgatcacgtcataacggttgtcgccctcgcgcaccagaatcagcgagccgaggaagtacggggtaccgggtgacttgcaggcgtcgtccaagtcgcttaccagttgcaggatgttctcggccttccatatgtaggcccgctggaatgaggggattgtgaaccggaaatccggggtgaacactttcccgagtggtagttccttcgcgctgattgccatgtcaatcccttcgtcgccggcctttggacggtatgccgacgtgccgactgtgctcaagcctaccagtgttcgcccggcggcgggcgcatcacgccggctcgggcaccgacccctcgtacaagtagaacgaagacgggttttctcccggcacggatgcgggcagtgactgctcgcacacctgcgtcaggccgcgatgtacatagaatccgacatcgcacgtggtatccgtgaataggaagtactgacgtatgccggctgcgcggaatgcgctcatcatcgtctcgaacatgcgccggcccagaccgtgaccgcgcgccgccggatcaagtacgaacagcaccacttcagccgaatactcatggccaatgttcgccgcctgcttacgcagttgcctatcgacatgaagagtcccgagaatctcgctcgcagctgccatgccgtcgtgggcaaacgccagttgcaatagcttgcgcaacgaatgacgccggtgcatgttcagcgggctgcgatggtcgagctcgtcgatacgccccacaatcaatgcgacgggtttatcttccagctccgcgacaaaggccgtggtcacacgtgccagacagttctcccaatcggcctcggctgccagcaagccggtccgctcatcatattcggcgtaccaagtgcggcgcaccaggtcgatcagcgccggataatcgtctttacgtaacgttcgaataatcgcttcactcatgttctccattatgactgatatggctcgataaccggacgtgttacagtcgcgccggcaaatcggcccgctccaccagcctcgccatctgtacgcggcccatattgagcttgtccgccgcggaggagagatgcgccttggccgtacgctccgagataaacatacgggaggcgattccggcgttgggctatgtgctgcaagacgattcgccgattacggtgcatgccacgcggatggtggaaacgcccgttacgctttgcgatgagcagaacgagccgatcgatcctattcatggaatgttcagctttgttcctctaagattggtactggaacaaacgctaaaggagcgattatgacattcggtcagcagccccagaacaacgggcaatacaacccgcaatacaacacgcctgattacaacgccgcccaacagtctggatatggccagcaatacgcacagtccggttacggccagaactactatgcccagccgcagggtgcccccacctaccagtacgcgccgcaggatgcggccggtgccggcgcgggtgccgccaccatcaacacgacgatgatctacaactacgaggaggcccgccgcgtctccgtagccaaggtgtacggcgagatgaccattggcatcctcgtcaccgccgtggtcgccgtgctcggccagatcaccggagcctactacagcttcctcatggccaccggcatggtgggcctcatcggcctgtgcgtggtgcagattgccctggccgtggtgctcggcatgcgcgtcaccaagatgaagtcggccactgcgcgcgtcatgttatatatgtacgccgcattgatgggcttcaccttgagctcgatcttcatggtctacgacctcggctcgatcggcgtggcgctcggtgtcaccgccgcgttcttcttcgctctgaccatgttcggcatgactaccaagttcgacatgctcaaggccggcccgatcctgatgatcggcctgatcgtgctcatcatctcgcagatcgtgctcgccttcgtgcaggtcgacggcatgaccaagatcgtctgcgccatcggcctgatcctgttcgccggcatggccatctacgacgcgcagtccacgcgcgcgctgctgaccgagtacgaggcccagggcccggaaatggtcaagaagatctccatcctgtgtgccctgaacctgtacctcgacttcgtgaacatgttcctgtacatcctgcagctgctcggcaacagggactagcctcgccagccgattggtgggcggcatgtagcctgctcgtcaaacgtcacagcccgaccacattgtggccgggctttttcatgtctgtcacattcgcacgttaggctgtctccccgtgaaaagacgagaactcgtaggcatgctgagcctgttgttgaccgcgctgatctggggttttgcgttcgtggcgcaggtccagggcatggatttgatgtcgccgatgttcttcaacgccacgcgcttcacgctgggagcactgtctttggtgccgattctgctgtggcagcgtggccggggagcgcggataagggcgatacagccggggtcgatgtcgttgggaccgaggcatccagggccgtctccacagatgccgcatcgaacggtgcatccgacgtcgttaccatcaccggtgccaagctgaatgcgaacaagcccgattcggccgtggcgcgattgctcgccaacccggtggtcatttccgtgatctgcggcatcgtgctgttcaccgccagcaccctgcagcagtatggcattctgtacggcaaatcggccggccgtgcgggattcctgaccgccatgtacatcgtgatggtgccgttgctggcctacgtgttcctgcgccggcgcatcggcatgctggtgttcgtggccgtggcgctgtccatcgccggcttctatctgctgtgcatcaccgatggtttcggttcgatcggcctggcggatatcctgctcgtgttcacggccgtgctgttcgccgtgcatattctggtgatcgatactttgggcggcaccatggacgccatcaagctttcattcggccagttctgcaccaccgccgtgctgagctgggcgggttcgctgatcgaaggctcggtcgactgggccggcgctgcccattcctggattccgattctgtacgccggcatcggctcggtgggcatcgcgtacaccttgcaggtggtcggccagcaatgggtgccaccgacgcgagccagcctgctgatgagcctcgaatcgttcttctcggcggtaggcggtgcgttgcttctcggtgaagtgatgaccccgcgcggcaacctcggctgcgccctcatcttcctcggcaccctgctggcccaagcgccggccaggctgccgaagtggctgcaacggtgaatgaatcggccgcaggccgattccatagcacctcagtccgaggtcttaggcgcttcacccacttgcggcgcgccgttgatgtcgcggtggatgttctgcatttgcacttcgacgttctgcagcgaacgggcgcagtcgagcagtgtctgtgaatgctcgctgagcttgttgtccggcaaatcggtcttgtagcgcagcgcatgctccagcgacgcccaataatccatggcgatggtacggaactgcacctccaccggcgtgtaatgcgcgcccgaggagagaaacacgggcaccgcgtagattacgtgcaatgaacgatacccgttctgtttcgggttcttgatgtagtccttgacgcgcagcacctgaatatcggactgcgacgacagatagttggacacggaatacacgtcgtcgcggtaattacagatcacgcggatgccggccacatcgaacagattgtccttaatcgaattgacactgattggcagatccttgcgctccagcttgccaatgatcgaactcaccgacttcaaacggcgttccatatgatgtatagggtcatggctgaaccgcacctggaactcgtcgtcgagaatctccagcttggtgctgatctcgtacatcgcgccttcatacacctgcatgaggtcaacgaatttaacgacctgttcgggagtaaaggtgcctcccggaaggtccaacgctttgagacgggcttgcagatcggaggttttgagtcggctatgtcggtcaagtatcacgtccaccaatatactcggtggattccagccaatctggatgttagcggggaatctttccaagaacccataatttgacatcgtgacaaccaatggcatacgtgaccggagcatgacgaaccccgccgatagaatcggtcgttatgaatgaagacatgatgaccgaggcggagcgtgcctcgattgcagccgatggaaccgatagcttgctgggggagcgtggaaagggcgtattccatatccacacgctcggctgccagatgaacgtgcacgattccgagcgcatcgccggcgtgctggaggccaatggctacgtgcctgcaaccgaggaccagatcaatgacaatgacctcgatctgctggtgctcaatacctgtgcggtacgcgagaacgcagccgaacgcatgtatggcaccattggccgattcaatcgcgtcaaactggttcggccgaacctgcagatcgccgttggcggctgcatggcccagcttgaccgcaagaagatcgcggatactgcgccatgggtttccgcggtgttcggtaccaagaacatcgaagatctgcccaagctattggatcagaatcgtgcgaccggcaaggcgcaggtccaggtcactgaacaattgcggcagttcccgagccagcttcccgccgcccgcgcctcccgcatcagctcgtgggtggcgatttccgtgggctgcaataacacctgcacgttctgcatcgtgcccaccacgcgaggcaaggaaaaggaccgccgccccggtgacattcttgatgagatccgccaatgcgtggccggcggcgccaaggaggtcacgcttctcggccagaacgtgaactcgtttggttatggcatcggcgatcgatacgctttcagcaagctgttgcgtgcctgcggaaccatcgacggtctcgaacgtgtgcgcttcacttcgccgcacccggccgccttcaccgatgatgtgattgcagccatggccgaaacgccgaatatcatgcatcaactgcacttcccgctgcagtccggttccgaccgcatcctgcgcgcgatgcgccgctcctacaggtccgccaagttcctcgatatcttgggccgcatccgcgaggccatgcccgacgcacagatttccaccgatatcatcgtcggattccccggcgaaaccgaggaggacttccagcagaccatggacgtggtgcgccaggcgcgcttctcctcggcgttcacgttcatctactcgccacgccccggcacgccggccgccgcaatggaacagattccgcgcgacgtggtgcaggaccggttcgaccgactggtggcgttgcaggagcagatcaccgaagagaacctcgccacattcgagggccgcgacgtcgaagtgatgatcaccggcaaactcggcaagaaggacaccgacacccaccgtgtcaccggccgcgagaaaactggcgtgctggtgcacatcggcgtgcctgaaggcgaaccggtacctgaaatcggcgatttcgtcacggtcaccgtcacacacgctggccgccataatctgcttgccgaccccgatgtggccgctggacagacctattccgtgcggcactgagggggcgtatatgacgcaacgagtcgtctccatcgtcggtcccaccgcgtcaggcaagacggggttgggcatcgccatcgcccggcgtctggccgaagcgggggagcgggccgaaatcgtgaacgcggacgcctaccagatgtaccgtggcatggatatcggcaccgccaaacccaccgccgaagaacaggcggtcgtgtcgcaccatctcatcgacatcatcgaccccgaagacacgatgagcgtggcccgattccagcagcttgcgcgcgagaccatcgccgacctgcaatcacgtggcatccggccgattctcgtcggcggctccggcttgtacgccagagcggccatcgatgacatcaccttccccggcaccgatcccgacgtgcgcacacgtcttgaggaacgcgagaaaaccgagggtgccggtgctttgttcgacgagctgcgggccaaagaccccgaggccgccgcgcgcatggacccgcgcaatccacgccgcaccatccgtgcgctggaagtcatcgagcttaccggcaaaccgtattcggccagtctgccgcgctaccggtacgtgattccgtccgtgcagatcggactcgacctggatcgcccggatttggaccatcgcatcgatttgcgcaccaagcagatgtatgacgatgggttcatcgaagaagtcgaacggctgcgcccgcatctgggtgccaccgccgtacgcgcgctcggctatcagcagatcatcgacctgctggacggcatctgggatgtgaacgacgccttcgcggacatcgcacagaaaaccaagcgactcgcccgcaaacagatgggatggttcggccgtgacccgcgcatccactggctgcaggccctgaacccgaaactggtcgacaacgcgatggccattatcgcgcacgccgacgccggcgactacgactcgatcgacgcccgagccgacgaatacacccagcatcatctgggggatatcacggcgtaggaatcagccaaaggccgatgcaatcacccgcaatcagtgtgcaggcccctgattccagccggcgatcaagaacacgcgcgtcggattcgccgggcgtagtatcgcgtcgaacatcgtctccagtgcagacgtgtcgccccgatatgccgagtgcttggcggagcgatactcttcgcgcgtcactgagccccagtcgagatcccagccggcgtcatgtgccaagcgtgaaccgaatatacgcagcaccatcgcattgccgccacggaacggatgcagataaccgagctcatcataaatagaagcaaacgcgtgaacgaacacgtcgcgatccaacgcatgcaggttgcgcttgtccgccaactccatcgcgatgttgtgcgcgccggtctcaatgagcccagccgggaagaacgcctcaggattcgcggcccgagcccggtcgttcgtcacctcgcgtgtggtgtttgaggtacgcaacttgcccgcatcctcaaacacgccttcgaacagccccttatgaatggcggtcaactcatccaagtcgccagacggattccatcgacgttccgccaacaatacggtacgtgcgaacaccgcatccgcgcgatccgtggcatgatcatccagactgccggcagccagacgatcctttccggcagggtcggcggcggcgcgcagacgcatggcggtctgctcgtccgccacgtcgatgagatgggtcacgggctccaagccacgttcgtaggcaaccgcggcgcgcatcgttgcctcgcccggcgtcatcgcttccagtgcgcagttcttgagtgcaaatgcgactgcgctcgcacgctctgcgggtgtcatgcaacccatgataaggcatattcgcgctccagcggggaatcgactcggacgaaccgcggcgaatcggctgtcgggattcgtcaatcgaccatatcgtcacggtgtcgtcaccaaccatgcacccccgtactagtagaatcagacccgatatggcacgaacagcatcctccaacagcaccaaaccccgtaaatccaaagacaatgggtctacccatgatggcgaaaccaaggtccagcccgagcttgacctcgaacctgagccgttgtggaagaagatcctgctcgcgattccgcgcgcgttcggctccggcgtacgcgccgtcaccggcgtcggcgaatacgacccagcctaccgtcgtgacggtttgtgcttcctgctgctcgtgctcgccgtactgttctgcgcgtccgaatggttccgtgtcagcggtccattcggccagctgcttcacgccatcgcggccggtgtgcttggtctgatgagcgtcgtgctgccggtgttgctcgccgccgtggccttccgactcatgcgcaattccggtaaagggtccaataacccgcgtgtggtcaccggttgggtgctgctcatgtggtcgatctgttcgatcatcgacgtggcgatcgccgccgaccacaccggattcgacatcacgattctgcaatccgccggcggcctgttcggcttcttcctcggctcaccgctcgcctgggcctttccaacgtgttcgccatcatcattttcgtggtcgtcggcctgttctccttgctgatgattaccggcacccacgtcaccgatttgccggaggatgcgcgcaaaatcgccgctaagatccagcgcaaaccgtatgtgccgatgggccaggagacggatgggagcgccagccagttccccaacgaggtccgtgtgggagataccacactcgcctttgccgacggtgttccctcgcatgacggcgacgacgacggcaacgacaacgatcaggccggcgatgcacggcccagcctgttcgcacgactgttcggccgcaaatccaagaccgaagacgacaaaacccttgacaagtatgctgccgacgatccgttcgaccgtgccgccagccagcatggtgccaccgacgaaaccccggtggtcgatccgatgaccggcgagattaccggtgcgcgaaccattgcatcgtcttcgtacgacggtcgtccgcacctatccagccctgcgcctgctgccgatgcggatgatggcgacgcttcccgaacccgcgtcatcaccagtggccagcccgtcgccatgcccggtggggagcggtagacgatccgtgggcacccagtgccgcccaggccggtactgtcgcgctcgcgggggcagccggggcgatgggagcagtcggagccgccggtgccgcggccgcggcagccgcgaccggagcctacgcaggcgccgatgcggatggcagcggagtcggccagggcgtgcccaatacggacggacagccgaatgccgatgccggcagcgacatcgacgacgatgccaataggccgtatcagttgcccgacctgaacctgctgaccaaaggtcagccccatgcgatgcgtaccccggccaacgatcgcgtgattcgggcattgacttccaccttcgaacagttcaacgtggacgccaaagtcgtcggcttcctgcgtggcccttcggtcacccaatatgaggtcgagcttggccccggcgtcaaggtggagaaagtcaccaacctgcagcgcaacatcgcctacgcggtggccagttcggatgtgcgcatcctttcaccgattccaggcaagtccgccatcggcatcgaaatcccgaacgaggatcgcgaaatcgtgcacttgggcgacgtattgcgctccgacaaggccgtgggcgacccgaacccgatgctctccggcatcggcaaggacgtcgaaggccacttcgtgaccgccgacctgaccaagatgccgcacctgctggtggcaggtgccaccggttccggtaagtcgagttttatcaactcgatgctcacttcgatcatcatgcgtgccacgcccgaacaggtgcgtctgatcatggtggaccccaagcgcgtggaactgtccgcctacgcaggcatcccgcacctgctgaccccgatcatcaccgatccgaagaaagccgcacaggccctcgaatgggtggtcaaggagatggatgcacgctactccgacctcgaattcttcggattccgccacgtcaaggacttcaacgaggccgtgcgcgccggcaaggtacatgcgcccgccggctcccagcgcaaggtggccccctatccgtacatcctcgtggtggtcgacgagatggccgaccttatgatggtggccaagaacgatgtggaaagctccatccagcgcatcacccagctggcacgagccgccggtgtgcatctggtgctcgccacccagcgtccgtcggtggacgtggtcaccggtctgatcaaggccaacattccatcccgactggcgttcgccacctcgtccgccaccgattcgcgagttattctcgacacggtcggtgccgagaccctgattggccagggcgatgcgttgttcctgccgatgggttccgccaagccgattcgtgtgcagggctcgtgggtgtccgaatccgagattcgcaaggccgtggagttcgtgcgcacccagcgcaagccgaagtatcgtgaggacatcgagcagatggccaaggaagccgaaaagaaagacagcatggagccggacgagcagatcggcgacgacatggacgtgctgctgcaggccgccgaactcgtggtcaccagccaattcggctccacctcgatgctgcagcgcaagctcagggtcggcttcgccaaggccggccgactcatggacctgctcgaatcgcgtggcgtggtcgggccgtccgaaggctcgaaggcccgcgaagtgctcgtccagccgcaggacctgccgcaggtgctcgccttcatccgaggcgaaaccagctcgcttgaagccaccgccccgcaacagcccgaactcggcgagtaattcacccatcgaccttcctctgatgagggaggtgtccccgaaggggcggagggagagaagcgccgccacgcggccatcagcacgcaacctgattcccgaataatagcagtcaatatccagccaccactcactcaaggtaggagtatggggtaacgtgaacactatggatgagaacacaatggacaagcagtcatcgcccaaatcatcgctgttcgacggatggaacgcgccgccgaacctggtcacctactcgcgcatcgtactcgtggtgattttcctgacactcgacattctcgccggcgcctggggtgagagcaacctgaccatgcgctgggtcgccgcggtactgttcatcatcgccgcgtccaccgataagatcgacggttggatggcccgcaaatacaatcaggtcaccgaaatgggcaagctcatggatccgatcgcggacaagctgctcacttgcggcgcaatgattgtatgctccgcgttcggcgagctcggctggtgggtgaccatcctgttcctgattcgcgaaatcggtatcaccgttatgcgcttcttcgtcatggagcgtccgggcggcaaggtcatcgccgccgcatggcccggcaagctcaagaccgtattccagtgcgtgggtctgtccatgctgctgctgccgttctggtcattgggtaacggacaggccacgccgttctggatgaccgcttactacttcctgacctacgccatcatctacgtggcattggtcctgtgcctctactcgggtgccgtgtacctgtacaacacgttcgtcgccccgaagcggaagtgacggatattccaatgcaggaattgtgcgacagtctcgcggccggcatcctcaagatctgcgaggcgaacaatacgaaaatctcctgcgctgaatccctgaccggtggcctgctcgccgatgcgttcgtgcgtattcccggtgcctccaacgtgttgctgggctccgctgtcacctacgacatcaatgccaaggcctcgatcctgcacgtggacaaggccctattggatcgagaaggtgccgtacgccccgaagtcgcccggcagatggccatcggtaccgctcgtctatacagccagccggaatacggcgaccgaatcatcggcctttccaccaccggcgtggccggccccggtccggacggtgacaagccggctggactggtgtatgtgggcctgcgtatccccgcaagcctcaccgcggaccatgtcgaagtgctcaaagccgtcgaactccatcttgacggcatgcgcgaagaggttcgtcgcctcaccgtattccacgttctgcaaaacttgagtctattcacagcaagttttaaggaataaaaccgcgggaccgtcgtgttgtacatagtggaaacactgaaccgaccttggaagggcgatggcgatggaaacgatgacccgagtgaacgaacagatggatgtggccgccaagaagccgatggctgtgcagccgggtgtcgcccgtatgcgtgaactgactccggcccagcgccgtgcggtgatgttcgcccagcagcaggtgctcaaggcgcaggccgccaagaaggccaaggatcagcgtcaagccgttcgtgaacgtatgtgggatgaggattcgccgtcgtacaagccgactgccgccgccgagcccgtggtggttgaggaggagcctcgcgaggtttcgctgcgtggtgctatcggtcatgtgctgcgcgaactgcgcacgcgcgatcgccgtacgttgcgtgaggtctccgagaaggcgggcgtttcgctgggctacctttccgaagtcgaacgtgggcagaaggaagccagctccgaactgctgagctccatcgccgatgcgctcggagtctccacttcgcgcatgctgcgcatggtggctgattatctcgactcggtcgagggctgatcggttggcggtgtgaagccgcgtacagtagtctatgtctagctgtgaacccgtatcgcttgtggcgatgcgggttttgctgtcctgcgggtggtggcacactggcgtgtatgcgtgaacgggaattctgggaattacttgaagaggtgttcggtcggacctacggtcgttcgctgtcgcgtgatcaacggatgcccaaactggcgaatatgactgtggtcgaggcgttggacgcgggggaggagccacgcgtggtctggaatgtgctctgcgaccagatggaggttccggactccaagcgttggggccacgatcataacgcgccgcccatgcccgccgtctgacactgcgggattacggagtcgctgaatcgtgaaattggcgatttcggcgtgttgcacgccaaattcgaacagatgttcgtgtgtgtggttatagttatccacagtgacaagaagccgcatacgtgtgcacagggtgcttgccatccgccataagccttatcgcagtagggcttaaggaggccaggcggccgagcttgggcaagctggaaccacaatggttggtctggattgcctcgcatggcatgtccgtcatacggtggaggcatccgattcgcacacgacttcgacaaggagaagatcatggcacttgagaccaagccggccaaggacccggcagccgaggacaagcacgagctcgatcccaagcgcaaggcggcgctggacaccgcgctggcgcaggtcgagaagagctttggcaaaggttccgcaatgcgactgggcgaccagcccgagcagaacgtcgaggtgattcccaccggttcgttggccctcgatatggcgctcggcatcggcggcctgcccaagggccgcatcgtggagatctacggccccgaatcatccggtaagaccacgctcgcattgcatgtggtggccaatgcccagaagaagggcggcgtggcggcctacatcgatgccgaacacgcactcgacccggcctacgcccgcaagctcggcgtggacaccgactcgctcatcgtctcccagccggataacggcgagcaggccctcgaaatcgccgacatgctgattcgctccggtgcacttgacgtcattgtcatcgactcggtcgccgccctagtgccgaaggccgaaatcgaaggcgaaatgggagacagccatgttggtttgcaggcccgactcatgagtcaggcgctgcgcaagatgaccggcgcgttggctcaggccggcaccaccgccatcttcatcaaccagctgcgtgagaagatcggcgtgttcttcggcaaccctgaaaccaccaccggtggtaaagctctgaagttctacgcctccgtgcgtctcgacatccgccgcatccagaccttgaagaacggcgacgaagcggtgggcaaccgcacgcgcgtcaaggtggtcaagaacaagatggccccgcctttcaagtccgccgaattcgacatgctctacggtgaaggcatttcccgtgagggctcggtgatcgacatggcccagcaggttggcgtggtcaagaagtccggttcgtggttcacctatgagggtgatcagctcggtcagggacgagagaaggtccgtcagttccttaaggacaacccggccatcaccgaggagattgagaacaaggtcaaggccgagttcggtctgatcggttccgccgatcagttcgcggaagatggcgaagccgcagcagcggccgccgtcagcgaggccgctgcggccgacgtggccaaggacagcaaggccgcagcggcgtctgctgccaaaacgatccgtgccaaggccggcacggcgaaggcctgaacatgattagtgccgaagcgttcttgcggcgcaatcctgttgcgtcgcaagacatgcccattgccgagcagcgtgttcagtcgaaaccgtcgggacgtttttctcgacggggagaggcgctgccgttgtcgaagatcccaatgatttggacgcttgccgcgaggctgccttgcgtttgctggacgcggccccgcgtgcatccggcgcgttacgcgaacgattgcttgccaaagggtacggcgaggcgatcgtggacgaggtcatcgaacggctgattcgcgtgcaactgattgacgaccgcgcttatgccgaatcggccgtacgctattgtgccggtcgcatgatgggccgtcgtggtgcggtcctggaacttgctcgcaaaggcgtggaccgcaaactggctgaacaggtgtgtggcgaagctgagcaaaatggcatctttgaagatgccgcatgggaattgggccgccagatagcccgcaaaacccatggcctcgatcatcaggtccgtcagcgtcggttttggtccgcaggcggccgcaaaggacacagccccgaaaccctccgccgagtcgccgccgaattgttggcgtagccaagaaaaaaaaatgagacctctcataccccgggttctgtcgtgccgtgcgcgaacgcgcagcacggatggccatccatctcgacctgacgttaccgccaggctctagcagcctacccgatgacacgggcgagcagcccttaccgccatctgcttggccttgctcccgatgaggcttgccatgcgacctactgttaccagaggcccggtggtctcttacaccgccgtttcacccttacccgtcgaggacgggcggtctgttctctgttgcgctatctctcaggtcaccctgggcggacgttatccgccatcgtgctctatggagcccggaagttcctcagccgatcccaatgaagatcacggccgcggccatcaagaggtctcaagcttgcaattatacataaggtgcggaaaaggcggcatcccgccctgcggtgaggccatgacgttgcccggttatcctgttttctccatagttgggcgattcgtgaacgacgcgccgaatatcggatggggcgtgtcgggcgtgtcgtatggagacgaatcaaatctgtaagagcttggtatgtgcgagaaagagcaagaaaacgctgcctatccattgcagtatttaccatgacgaacaaacaagccagcctgataaaccggtatcaaatcttcttataggagactgctgccaaaagcccagtatatacatcgtttcattgcagagaaaagcccggagacaaacatatattctctgggcgagtttccggccgttcacccattgttcgtctacaatgaaacatacccggtcggtgatgatgccgttcggaacacatatagcgggttacaccgcttgagttagaggaggtcaacatggaaatcgtcgttaccggacgccacacgcaggtcaagcaaaggttccgtgatgtggtcgagaccaagatgaatcgtgtgaccgctatcgccccggatgctcagcgcgcgcagattgtgctgacccatgagggcaacccgcgtcaggccgataccgccaagcgcgtggaaatcaccgttatcgccggacgtaccgtggtgcgtgcggaggcttccagcaccgatgaattcagcgcgctggacatggcgctggataagttgacgctgcgtctgcgtcgtactcgtgaccgtcgcaaggatcaccgtcgtggttacgcgaacccggtcccggtggatctgggtgttatcgccccggagaccgagccggaggagtcggaggaagagccgaacaacagcccgcaggctgcggtcgcctccgatcttggccctggcgaatccgtggaggtccaggttggggatacgccgattgtcatccgtcgcaagctgcacatcgccgagcctatgagcatcgacgaggcgctgtacgagatggaactgatcggacacgacttcttcctgttcgtgaacaaggagaccggacgcccgtccgtcgtctaccaccgtcacggttggagctacggcgtgttcgaaatcgatactccggagaatgtcaagaaggcctgaaggtaaggcctgctgacacgatcagctgataccgcatggaccgcttccaatatggaggcggtccattttttcgtaagaaggtcgaaaaaatcgactgctgacggtgcgaggcgctattctggtacgcggacaccaccacttatcagtcaagggagaacccagtggtcgatattgttgacaaagccctgcgaatgggtgaaggccaccagctcaagaagctggagaacgtggccaaggccgtgaacgctctggaggatgagatctccgccctctctgacgaggatctgaaggcccaaaccccgaagttcaagcaggagatcgaaaacggcaagagcctggacgagatcatgcccgaggcgttcgccaccgtgcgcgaggtttccaagcgcacccttggccagcgtcacttcgacgtgcagctcatgggcggtgccgccctacactggggcaacatcgccgaaatgaagaccggtgaaggcaagaccctggtcgccaccctgcccacctatctgaacgccctcgaaggcaagggcgtgcacgtggtcaccgtcaacgactaccttgccagctaccagagcgagctgatgggccgtatctaccgtttcctcggcatgaacgtcggctgcatcatcaccgagcagaagccgccggagcgccgcaagcagtacaacgccgacatcacctatggcaccaacaacgagttcggcttcgactacctgcgtgacaacatggcctgggagaaggccgacctcgtgcaacgcggccaccactacgccatcgtcgatgaggtcgattccatcctcatcgacgaggcccgtaccccgcttatcatctccggcccggccgaaggcgacgtgacccgctggtaccgtcagttcgccaagctggtgctgaagctcacccgcgacgaggactacgacgtcgacgagaagaagaaggtcgtcggcatcctggacccgggcatcaccaaggtcgaggacttcctcggcatcgacaacctgtatgagccggccaacaccgccctgatcggctacctcaacaacgccatcaaggccaaggaactgttcctgcgtgacaaggactacgtcgtcacccaaggcgaggtgctcatcgtcgacgagcacaccggccgtatcctgccgggccgccgctacaacgagggcctgcaccaggccatcgaagccaaggaaggcgtggaggtcaaggccgagaaccagaccttcgccaccatcaccctgcagaactacttccgtatgtacgacaagctcgcgggcatgaccggtacggccgaaaccgaggccgccgagttcatgaacacctacaagctgggcgtgctgccgatcaagaccaacaagccgatgatccgcaaggaccaggacgacctcatctaccgcaccaagaaggagaagctggccgccatcgtcaaggacgtggccaagcgtcacgccgagggccagccggtgctgctcggcaccgcctccgtggaaagctccgaagtggtctccgccctgctcgacgtggcgaagatcccgcaccaggtcctgaacgccaagcagcacgagaaggaagccgccgtggtcgccgtcgccggccgcaagggcgccgtcaccgtggccaccaacatggccggccgtggtaccgacatcatgctcggcggcaacgtcgagttccttgccgacgccaaactgaagtccgagggctactctccggaggacaccccggaggagtatgagaagcgttggccgggcaccctgaacgagatcaaggcccaggtcaaggacgagcatgaggaggtcaaggaactgggcggcctgtatgtgctcggcaccgaacgccacgagtcccgtcgaatcgacaaccagttgcgcggtcgttccggccgccagggcgacccgggtgaatcccgcttctacctgtcgctggaagatgacctgatgcgtctgttcaacacccagctggtggcccaggtcatggccaggggcatggaggaaggccaaccgatcgaggccaagtccgtcaccaagggcgtgcgcaccgcgcagaaggccgtcgaatcccgtaactatgagattcgcaagaacgtgttgaagtatgacgacgtgatgaacaagcagcgcacggtcatctactccgagcgccaggccgtgctcaagggcgaagacatccacaaggacatcctgcgtttcatttccgacaccgtcgagtcctacatcaagggtgccaacaagggatccgagaaaccgaaggactgggattgggagggcctgttcaaggcgctcaacaccgtgattcccaccaaggtcgacgaagacgaggtcaggaagatcgtcggcggcctcaagggtgcgaaggccgtcgaggccgtgcgcgacctgatcgtcgaggacgccaggcagcagtacggcgaaatggaggagaccatcggcgagaccggcttgcgcgatctcgaacgtcgcgtggtgctcgccgtgctcgaccgcaagtggcgcgagcacctttacgagatggattacctcaaggacggcatcggcctgcgtggcatgggccagcgcgacccgctggtcgaataccagcgcgaaggctaccagatgtacaactccatgatcgaggccatcaaggaggagaccgtccagctgctgttccacatcgacatcaagcaggtcgccaccaccgacgatgccgttgacgaggtcgaggagaccgccgaaagcgccgacaccatcgccgtggcctccggccccgacgagaacggcgaatccgtggtcgaggccgccgagggcgaagtcgaagaagaggacgaggatacggacgccaagcaggcgattgccgaatccgcagccgcctccgaggccggcgagtccacgctgcctgttgccggcccggctccggtcagccacgccgaaggcaaggttccggtttccaagcgtccgaagagcgaagagctcaagacgccatgggccgacggccgcaccttccctggcaccggcaagaacgccccgtgcccgtgcggttccggccgcaagtacaagatgtgccacggccagaacgaagcgtgacggtgacgatgaatcggcattgaccatccgatggttcgacgaccgaacggatatacgccggggccggcgcccaatgatatgggtgccggccccggcgttattcacgatcggtatgatggtcctgcattatctggcggcgtccgccaacagtatcccggcgattgcatcggcgagtctcgcgtggccttccggattcatgtgcagtttatcgagatcgctgggttcggcgaccgtcgcggcgtcgaggaacagccacccattacgttcggcggccttgcggtaccagcgagacagttcgtgcgagcgttcgacggcgctctgcgcgaaactggcatagggaactccgggtttgatgtggatgggggagacgagaaggattctcggcgccggcccgcaacccgcatagtcgtaatcgcgaatcgtgcgtgcgaccatttcggcgcctgccgcgacgatgcgcgatgatgcattgaacatctctttgaggtcattggtacccagcatcacaatcgcgtaatcgagcggacagtgcgattgcaatacgatcggaagtgcctccataccggaacgatgcggctccaaagggttgtcgaacacggaggtgcgaccgctcataccctcttcgatgacatgccatccatcccccaacagcgaggccagacgccccggccatcgcacgtcgagagggtgcctggttccgggatccgcgggatcggtgccgaaggtgttggagtcgccgaaacataatacgttcttcatagatgaatccttcttgaagacgggcagcaacgcacacatcatacatcgatcggcgccaagcgttcccgacgtttgccgtagcccgcccgggcgcacacggtgcgaggtgccggccgatggatgttcgtgatacggacgggaacacatgagggagcgccgagccgttacaattggcggcacaatgacaatgacacgggcgcccggaagcgtcgaggagggcatcatggccgatatcacatggaagtcgattctcaccaagctggtcgggggagaccatctcacagccggggaatcggagtggtttgtggacgatctgatgcagggcaacgcggaccccgccgccgtcggtgctgcgctcgccatgcaggagcagctgggtctgaccgccgaggaggttcgcggtgccgccaaagccatggttcgccatgccgtgccgctgcacgtgtccggtgagagcaccgacatcgtgggcaccggcggagacggattcgccaccgtgaacctgtccaccatgggttccgtggccgctgcagccgccggcgtgacaatcgtcaagcacggcaaccgcgcggcgtcttcgaagtgcggtgccgccgacgtgctcgaggacctcggactgccgttggatctgaagcccgaggcggtcgcggaagtcggcgacgaggtgggtatcaccttcgcattcgcccgcaccttccacccggccatgcgtttcgtgggcccgatccgctccgcgttgggcatcccgtgcgtgttcaacgttttggggccgctgaccaatccggccaatcccgcacatgtggccgtcggatgcgccgaccggtcgatgagtccgatcatggccgccgtgtatgccagccgcggccagtcaggtctggtctacacctcgcatgagggtatggatgagctcgctcccaccggcccggtgagcgtatgggagattcgtgacggcagggtcgacgaatccgagttcgaccccaccgtggatctgggtttggaagccatcaccgtcgggcaactcaaaggtgggacgccggatacgaacgccaacgcattcagggaattcctggccgccaaggacgttccttcccgcaccaccgcgctgctgaacgctgcctccgccatcgtggctgacggcaatctggtcggcaacggcacactggccgagcgcttcgccgaggcctacaaactggccgaggatgctgtcgactccggcaaggctgaagccctgttcaacaagtggatcgaaaccgcccagtccaagcgttagacccgtgcgccgtcgtcgtagtatccgccccggttccctgggtggtctttgcggttgaggattcccgccaccagaccacccaagccgagaaggacgcccaatccgaagaggatgttgagcaacgggcccaatagcggaatcgaattcaaaccgggaacgagcaccatcaccatctcgcccacgagaccgacgacgagcagcgtcaccagcagcatcgtggacgtcctgaccggcccgaggtcggggttcgggggagtgaagccgccatcgtcatgcgcgtccatgccgttgtcgacgtccagccagctggaaccggtgaaatcgcgcgggccagaacgtctgccaccgcggccgggacggacgtcatcggtgaacgatccgatgtccagatcgttcacggaaagcagggcctccttctcgcgttttttggcctgcttctcgaactttctggcctggcgcgaggaagccacgtcgtgcaggtcggcctgatgttcggcttcgaatgcggcccacgccgaatccagatcgttcgtgccatgcgacccgtcgtcgccgtctccgggcgtccggggcgaaatgccgtaatcctgtccgttgcccggcgtgggggttggccgctttccgtcggcattgctattctggttctcagtcataactgtcactctaatcaggcgaccggccaatggctagttcgtctgcgggaggaatgccaagtgctctactggttcttcgtcaaaggtctcggccctattgctcgtcatcgtttgagccctgctgtcagcggactgaataacgtgcctcgagagggtggcgcgattatcgcagccaaccatctggcggtgattgatgatgctttgattccgattacctgcccgcgcatggtgcacttcatgggcaaagccgaatacttcgagggcaagggattgaagggcaagttcaagaagtggtggttcacgtccgtgggcgtgttcccggttgatcgttccggtggcagcaagtcgcttggcgcactcgagcacgcacgcgagattatcgaggatgggcacctgttcggtatccacattgaaggcacgcgcagcccggacggtcgactgtacaagggacacaccggtgccgcacgacttgcgctcgagaccggttgcccgattgtgccgaccgccatcatcggctcggacaagctgcagccgattggcacgtcgattcccaagaagggcaagaccaaggtgctgtatggtaagccgattgaggttgcgaagaagccggtcgatgagattacacatgatgatttgcgctcgctgaccgatcgtgtttccgccgcaatccagaaaatgagcggtcaggaattcgtgaacgaatacgcccagaaggtcaaggccgagctcaaggcccagcaggccgccgaagaagccgaataatgtgtgttggctcccctcagcgaggggagccagtcgattactctcacacgatggtgagggtgatgacggtggggttgccgttggcgtcgcgcaagcgagtcttgccgccgttggagaggtccgtatcgccgcttttcacggtacgtaccgtgccgaacaggccaccgagcaccttgtcggctttcaccttgaacccgagactctcaagcgtcttggtcacggcgctttcctgtttgccgacaaggccggacggtatcgtcgccatctccggacccttggaaatcaccacgtccacgctatctccccacttcagctgggctccggcttcctgagacgcggaaatgacttgaccagcctcgaccttgtcatcgtactgttcggtgacattggccgtgagcttcaactcgccgagcgcggcttgcatctcatactgggtcttaccgacgatgtcaggcatggtcaccggcatcggtcccttgctcaaagtaatcgtcacctcatcgttgtgcttggccgtggtaccgggatcaggggaaatcgtcaacgccacaccctgcggcgtgtccatcgaatactcatccttcgactcgtcatgcttgacattatcgaagccagctttcttgagcgcgttcaacggattcttgccattggccgaattcgcgtcgagaatatccttcgggatggtggccatccgtacgcccttggacaccaccaccgtaagctcctgattggctcgcttgcttatgtggctgttcacaacggccttggtcttgttcacggaagaagagatgatcttgccttccgccacgtcgtcgctgtattcctcgtgcgtcttgtaggggatgccgaaagccttcaacgtgctttcatacgtggcccaatccgcgccggtcagcgaacattcggtgcctgcattcgcatcgcaggtcacgtcatccggcttgggcacactccaatagctgcccggtccggcaaaccaccaccagccggcggttccgccgattgcagccagtaccagcacgatcaccagtacgatgaagcggtttttgctgcgctgcttctttggcccggtgccattggaagcgacgtccggctcatcggaaagggcaggcgctcgggtgaaggcatcgccggcctgaggcagcacttgtgtctcgctgccggactgtgccatgatttgcgtcttatggggagccgaagcatcggctggcgtcgacgaatcaagtgccgtggtgggggcgaccggaggagccggaggattgacgtctgcggcgccaccggtatcggcggtattgcttgcgacatcatcggccaaaaacgccggtacggacggctcgaacgttgctgcaccggcaggtacgccggtcagcggggcctgctcggcgatattgcctaccagcgctgcagcggtggcatcggtatgatcacctccaatgggttcggcatgcaaacggtattgccacgcctccagcggcaatttggcggccaactggctcaattcctcagctgctgccgcgccatcggtggggcggacatccacctgacgcgcggtcagatgggcgatgaacgccgccacggacggatcaatgccctgacagaccgtggccacggacggcacgtcctcatgaacatgcttgaagacaagcgtcaccggattatccgaatcgaacggcactttgccggtcagcatctcccatgccatgatgcccacggaatacaggtcgccttgcgcggtggcctgattgttctcgatcatttcgggagccagataagcggcggtgcccaatagcatgccggtggagctcaatgtggcttggctggcggccttggccagaccgaaatcagtgatctgcacatggccgcgatcattgatcaaaatgttctcgggcttgatgtcacggtggaccacgccggcgcgatgcgcggaagccagaccatccagcgtttccgcgaccacgcgcagtgtctcacgcacggagaatgtgccttgggcgttcatctcatgccgcagattgacgccatgcacatattccatgaccagaaaatcaagtccattgaactcgccggtgtcatacacctgaacgatgtgcgggttggcgatggacgcggccgaattggcttcgcggcggaaccgttcgacgaactgctcccgatgcgggcctttggcgagttgtgtgtgcatgaccttaatcgccacggtgcgccccagacgctcatcgatggcctcatacacggtggccataccaccctcggcgatattgcgcacgatgcggtagcgtccctcaatcatctgtgcgggctcgttctcactcatgttgtatcgtacggttcctttaatcacgactgaacatgttcagtgtacatggccccggttacgcggccggagcatcagcgcatagctttcacgggttttcaccggtgtttatggtctcatggtccggcggctcgcattgtggactatcgcaaggattcggggacgaatcgcgcacaagcctcggtcagacggcgttgcgcttcggaattcagctcaagaccggcaatcgccttacgggactcaccccatagggcagcgatgcgctcgcgggatcgatcaagagcaccggtcgacgtgaacagttcaatggtgcgggccacctggttgtcattgcgacaatcttcttcgaagatggcaatcagatcggccttatccgccgtatctgccgcagacagagcatcagccaacagcactgtgcgtttgccttctcggatgtctccgccaactggttttccggtattgcggcttgatccgacgacatccaacaggtcatccgccagttggaacgccagtccgagcggccggccgacggccaacgcgcaatgcctggcctgatccgggctctctcctgcggccagcagtgcaagcagcagtggagcgatggtggtgtaactggctgtcttccagcggaatacgttcaatgaggcgttcgccagagcttcgggattagacagtggggtcatctcgacggccaagtccagtacctggccgatttccacctcacgctgcatggtaagaaacgcctcgttcagggcatcggtgttgggaagacggctggcggaccggcgtgtgatttcaatgcaggcagtggccagaatgtcgccgagcatcaggcccaagccacggcctatggcaccgctgtgtacggcctgttccaaggcacgatgtgcggaaggcctgccccggcgcagatcggattcgtcaatgatgtcgtcatgcaccagtgcggccgtctgaaacacttcaatggcgcaggccaggtcgatcatggcgtcacgccgatcaggcgtcacgtcgccggcaagaatatcgaaggcgtccaatgcgagcagcgcacgcagtcgtttgccgccttcgctggaggaggcggcttggtccacaacctgttccatcaccggtttcagggcgtcggtaacctcgtcggtggcgggggcggcagtcagttcccgcaccaactgaatgatgcgtggctcgatgatttcgcggttgttagcagttgtgcacatgcctaataacttatccacagggtttgaagaacacaagaacgttgggaatcaagggttttgaagctagaaccacaatggtcgttttttcctgcgtcatacggcgttttcagccatagtgggcacacaccccctcggcgcatgagctatctggctcggcgcgcaccacaacaccaatagattgcacaccgttagtcaaggaggacatgatgaacaacaacacgccgcacaagccgcgtaagagccgacacgccaaacggcacgccgccgagcagacggagccctttggctttgacgagttggagacgagatcacaggaatttcgcaatgatcgccgacttcgaggcgcgcaacaggctaatgccgactgggtggccgaaccattggacgaatggctgtcttgtctcgatgccgggaacaccgacctaggccgagagacgatggccgcgtttgcggtgggcatgcgcgagaccttatcgattcgtgatgcgctgattctctcgttggttattgatgaaagccgttgccccaagtcatggctcatggaattcgcggcgcgaccgcatctggcacgtacgagaacacgaatgggcgagctgctgacctgcgcattcgaggatgaaggcatgatgccggataaggagcgttgccatgccggcatcggtatgttgctcgatatcgcggaagcctcaccggtgccgtactgcatacagccattggccgtgatcgcttacaccttatggtggctgggcgatccacgagcaatggtgttcgccttgcgatgcctgctgctcgatgaggattgttcgctggcggcgatgatattctcagccgccgatcgaggcgtggcgccggcatggtgctcgggctgagtgaacagaaacggcggatctccgaggttttacgcgcgatgcgcggaaggaaagcgtgtggtgatcggcaacacgtcgggcaacgatgtgggaataatcgtccgtggagggtggtttactcacatagttgacgatttgcccttgctagaagtgggcccatgtggtatatgcgcttcacggcgagagatcagaaggagcagttttggccacgaaggaaacgacggcaaccaagcagacagccgagtccagcgaggagaccgagaagaaggccagctctacgaccaccgcacgcaagacttccgtcaagaagtccaagtccgcagagccctcggaaaagaccacgcgcaagtccgccgcgaagaaaaccgcgaagaaggccaaggacgatgaactcgtcaaagacgaggacactcaggtcgatgacgggcttgatgacgatgccgaggtcaacgacgacgatttggacgtcgacgatctcgacgaggatctggacgacgttgacgaagacgatgccgacgacgacgatgtggaagaggatgaggacgaggacgaggaagaagccaagtccacggcacccgagcagcccaaggaaaagggtgcctacgtggtctccgacacggatgatgaggaagaaaacatcatcccttcgggcaatccgaagcgtcgtgtgattgcggccggcgcaaccgccgacccggtcaaggactacctgaagcagatcggccgcgtgagcctgctgaacgccgagcaggaagtcgacctgtccgagcgcatcgaggccggcctgtacgcccagcacctgctcgacaccgaaagcgaaggcatggagttcaagcgcaagcgtgaactcaagtgggccgccgccgacggcaagaaggctaaggaccatctgctggaagccaacctacgacttgtggtctcgctcgccaagcgctacacgggtcgcggcatgctcttccttgatttgatccaggaaggcaaccttggtctgattcgtgccgtcgagaagttcgactggaagaagggcttcaagttctccacctacgccacgtggtggattcgtcaggccatcacccgtgccatggccgatcaagcccgcaccattcgcgtgcctgtgcacatggttgaagtgatcaacaagctgtcccgtgtacagcgccagatgctgcaggatctggggcgtgaacctacgccggacgagctggcccgcgagctggatatgccggttgagaaggtgcaggaagtgcagaagtacgggcgcgagccgatttccctgcacaccccgcttggcgaggatggcgattccgagttcggtgacctcattgaggataccgacgccatcgctccgtccgacgccgtggccttctccctgctgcaggaacagttcaagcaggtgctggaaaccctgtctccgcgtgaggccggcgtcatcaagatgcgctatggcctggaagacggccagccgaagacgctggacgacatcggccgtgtgtatggcgtgacccgtgaacgaatccgtcagatcgagtccaagaccatgtccaagctgcgccacccgtcccgttcacagaccctgcgcgacttcctggatcaatgatcatctggctcccctctgtgaggggagccaagcatttgaagagaaaaataggactgtatgcccaaagaagaatacggcgccaaggacctagctgttcttgagggcttggatgcggtacgcaagcgtccgggcatgtacatcggcaccaccgactcgcaggggcttatgcactgcttgtgggagatcatcgacaactccgtggatgaggccttggccggcttctgcaacgatatcgtagtcaccttgcacaccgacggttccgtggaagttgcggacaatggccgaggcattccggtggataaggaaccgaaaaccggcctgtccggcgtggaggtcgtactgaccaaactgcacgccggtgccaagttcggcaattcgtcttataacgccgtcggtggcctgcacggcgtgggctcctccgtggtcaatgccctgagctcccgactggacgtcgaagtggatcgtgacggcaagacgcaccacatgaccttccaccaaggtcaccctggcgtatacacggatgccgacccggccaatccgtctcccgattccccgttcaagcgcactcgcaagaaccgacccaccgagctggaaatcatcggcaaggtatctcccaaaaccactggtacccgtattcgctactggtatgatccggagatcttcaacaaaaccgccgagttctcatacgaacagctcatcgaccgcgtgcgtcagaccagcttcctggtgcccggcctcaaaatcaccatcatcgacgaaaacgtacccgaaacggcggcgactgacaccgtcgaggccgctgataccgccacagtcgaacccgtgcaagagcaggtgccggctttggacgtctcgtccaacgatgccgaactcttcggcgactccaccgaaacccaagtcgacagtaccgggagcctgaccgaggagaatttctcactgacggccagcgaccaggtcgtcgacggcgcgttcggcgaacagcccgcgcacccgcgcgtcgtggaattcctgcacaccggcggcgtcaaggacttcgtcgacttcctgtccaaaggcgagccgatctccgacatctggcgcatccaaggcgagggcacctataaggaggagacccaggccgtgggtgagggcggcgaactgcacgcccaggaaatcgaacgcacctgcggcttggacatcgccctgcgatgggtcaacggctatgacaccacaatcatgagcttcgtgaacatcgtggagacgcccggcggcggtactcacgtggacggtttcatgaacgccatcaccaagcagattcgcaaggcggtggaagacaacgcccgcaagctcaaggtgaacatgaaggactccgccatgaaggtggagcgcgacgatatccaagccggactcgtggccgtggtcaccgcacgcgtggccgaacctcagttccaaggccagaccaaggatgtactcggcaccgcgcaggtcaagccgatcgtcacccggctcaccgacaagcaattcggtgagatgatcaccggctccaagcgcgggtacaaggaacaatccggccgcgtgctggagaaaatcgtcggcgaaatgcacgcacgcatccagtcgcgcaaggccaaggaggtcacgcgccgcaagaacgcgctcgaatccgcctcgatgccggccaaactctccgactgccagccgggcaatgacgacgtggccgaactgttcatcgtcgagggtgattccgcactcggtaccgccaaagccgcacgcaacgccggtttccaggcactgctgccgattcgaggcaagatcctgaacgtgcagaaggcgtcgatcacgcagatgctctccaacaaggagtgcgcagccatcatccaggtggtgggcgccggctccggccagagctttgacatcgaacagtcgcgctaccacaagatcatcatgatgaccgatgccgatgtggatggtgctcatatccgtatcctgttgctgacgctgttctaccgatacatgcgtccgctcatcgaacacggctacgtgtatgccgcagtgccgccgctgcaccgcatcgcgttgaccggctcgcacaagggcgaatacatctacacgtattccgatgacgagctggccggcaaactggccgacctcgacaagaagcacatcggatacaacgacgacatccagcgatacaagggtctgggcgagatggacgccgaccagctggcggacaccaccatggacccgcgcacgcgcatgctgcgccgcatccgtatggaggacgccgcccaggcatccgagattttcagcctgctgatgggcgacgacgtgccgccgcgcaagcagttcatcgtcgacaacgccgacgatttcgatcgctccaagatcgatacctgatcgaagacgtcgctgataatgacatcgtgcttaccgagaatttccgtaattggcgtttgaggtgagcacgttgtcatatgttttattcgtgttgcccatgagttattcgatagactgatgacatcgttatcacaaccgatgccgtactgtgaatgggagatggaacatggccattctgttgcttgccgtcatctatgtggcgtttatcagtctggggttgccggattcgctactcgggtccgcgtggcccaccatgagccagaatctgaacgtgccggtggcgtgggctggcggcatctccgcagtgatttccatgttcacgattgtttcggcgctgctttcggaccgaatgacattgaaattcggggccggtaaggtcaccgccgtttcggtggcgttgactgcggcggccttggccggtttctccattgccccgaattactgggtgctgttggccatcgccataccgtacggccttggcgcgggcggcgtggatgcggcgctcaataactacgtagccattcactacgaaagccggcatatgagctggctgcactgcatgtggggcgtcggcgcatcggtcggcccctatatcatgggctatgcgctctctcaaggccaaggctggccgtggggctatcggtacatcgcgattctgcaggtgatgctgaccgtcattctggtgctgagcctgccgctgtggaagaaacgtggcacgactgggggtggcgaatcgaccgatggcgccgcatcatctgacggcaatgccgagggatgtggtaatgctgaaggggcgtctgttgctgaacgcaaaccgctcggcgtggccggcgtgctcgccattcgcggtgccaaggaaatcctcgtgatgttcttctgctactgcgccatcgaatccacggcgggcctgtgggcctccagctacatggtgatgcacagcggcatcgacaagatcaccgccgccagctgggccggtctattctacgtaggcatcaccgtggggcgtgcgctttccggctttctgagcatgcgattcaaggacccggtcatgattcgcctcggccaagtgctggtgctcgccggcatcctcaccatgttcgtgccattgcctcaccaccttggcgtggtcgttgggctggtggtcatcggcttcgggtgcgcgccgatttatccgtgcgtcatccactcgacgccggcctacttcggcgaagacaaatcgcaggccgtcgtcggcgtgcagatggcctgtgcctatgtgggctcactgctcatgccgccactgttcggcatcatcgcgcaatatgtgacaatcagtctctacccgtggtatttgctggtgctcttggtgctgatggtggccatgcacgagcgtcttcgtaagttgcgcggctgatcatgcgcgcatttgggcccgccgcctactatgcttggagcccatggtgataagtgaagaagaacataaacagatgcccgagcccgtacgggaacgattggaagcgctgaaggatgcgccgggctcggtaatcgtggtcggctcgatgaacgccgattacaccgtgaccaccaaacgactgcccaagccaggcgaaaccgtcaatggtggtgccatgaaagtgctgccgggcggcaaaggcgcgaatcaggcgtctgccgctgctcgcctcggtgtcaatgtccagttgctgggcgcggtgggcgaggactccaacgcggacttcctattaggcaagctggatgaggccggcgtcgacaccgccgatatcctgcacgttgaaggccccagcggcaccacggtaatcaccgtgagcgctgagggcgagaacaccatcgtctattcgccgggttccaatgccaaggcaagtgccagctatgtgcaatcacatcgcacgaccatcgccgaatgcgcggtattgggactgtgtttggagagcccgatttccaccgttatcgccgccgcgcagaccgcgcatgacgctggcgtgaccgtgctgctcaacgactcgccatttatggacgagcttcctcacgaactggtggaagccacggatattcttctggtcaaccagcatgaagcggctcaactgctgggtctaccggacggcgatgtggaatcactcgactggtatgaggtcgccgaacgattcaccgattacggattcgaccgggcgatagtgacgcttggtgcgtcgggggcggtggtgatcgagaacggacgttggcatcgcgtatccgccgcgcaagtcaatgcggtggacaccaccggttgcggcgactcgttcatgggaactgtgctggctggcttggccgctggccatacgctgctgcaatccgcgcaaatcggctcctatgtctccgcctatgcggccaccaagcttggtgcccaaagcgcctacggcaccgccgaagaagtcatcgcctacttcagctgacctataatcgtacatatgtacgaaaccctgagcctgttttccgaacccaccaaggtgtggttcgagcatgccttcggtcagccgaccgaggcacaggctcaggcatggccggcaatccattccggtcgtaatgtcttggtcatcgcacctaccggctccggcaaaacattggccgcgtttctctcggccattgaccggctgatgaccgtgccacgtacgcggcgtgccggtgtgcgtgtgctgtatatctcgccgttaaaggcgctcgcggtcgatgtggccaagaacctagaacagcctttggagggcattgccgcacaatgcgaggcgcaagggctgcccgtgccgaagatcgcggtcgccactcgttcaggcgacaccaccgcacaggagcggcggcgcatagcctcccatccaccggatatcctcgttaccacgccagaatcgttgtacttgttgctcacttcgaaagcagggcggattctcggcactgtcgatacggtgatcgtcgatgagattcatgcagtagcgggcaccaagcgcggcgcacatttggcggtaagccttgaacggctggagaaccttgtcgcagaatcgcgcaagcgagatgcgatcgttgcagatgctgatgagggcggtgatgccgccgttgatgctggccgcggcgatcgtcatatgcagcgcattggtctatccgctacggtgaatccgcctgaagaggcggcgcgattcctgggcggcgggcaaccggttaccatcgtgaatcccggtgggcggcctgcaatggatctgcgcatgattgagccgttggaaaacatgcgtgatttgcagtccgtgaatgccaagcagcgtgtcggtggcgtggaggctgaacggtccgctccgcatatcagcggtgtcacgccggccatgcagcgacttgccgaacgcaggggcattgtgccggtggatgatagagatgtttcttccacttctggggacgattctgatgcgagtgatgcgttcgattcctccgcgttggttggagcggcgggcgaccgtacctccggttccatttggcccgtggtggaacgcagcattttggatgagattctcgcgcaccgcactacattggtcttcgtcaattcgcgtggtgtggccgaaaagctcaccgcgcgcctcaatgatctctatgcgcagacccggcatggcaccaatcccgacactgtgcgtgatccgggctctccggaaggccgcgaagggttctccacacattacgatgctgtggtcggctccaccaccatgcttgtcggctcacatgagggcgacgatgtcatcgccatggctcatcatgggtcggtctccaaagatcgccgcaaaatgattgaggaacggcttaagcgtggtgaattgcgctgcgtggtggccacctccagtttggagcttggcattgatatgggttcggtcgacttggtgattcaagtcgatacgccattgtcggtctcctccggattgcagcgtgtaggccgtgccgatcatcaggtcggtggcgtctctcacgcattgttctacccgctcacccgtcagcagattgtcactggggccgcaagtctggaagccatgattgccggcgatatagaaccattggccgtgccgcgcaatccgctcgatattcttgcccagcagaccgtggccgctgccgcgatgcacgatttgaacgctgatgactggtatgccacggtgcgccgtgctgcgccgtttgccgaactgccacgtgacatgttcgatgcggcaatcggcatgatgtccggcgaatacaacagcgaggaattctcggccttccggccgcgactggtatggaatcaggataatggcctgatttccgcccgtcccggttcgcagaaagtggccattacctctggcggtacgattcccgatcgagggctgtacaccgtggtcctgcctgaggcggacgccggcaaaggccagcgtcgcgtcggcgagttggatgaggagatggtctacgaatcgcgcgtgggcgatgtcattacgctcggcacctccacatggcagattcaggagatcacccgtgatcgtgtggtcgtgactccggctccgggccgcaccgcccgtctgccgttctggcacggtgaaggcgctggccgtgactacggtttcagccgtaccatagcccgcttcacccgagaaatcgccgccggattagacgtgaagcggactgaggggaggtctgccgcagaaggtccagctgtcccaaccttcatcccaacaattctcactcgcctccaccgagatggcctagaccccaatgccatcaccaacctggcccgcctgctctccgagcaacaagccatcaccggcacagttcccagcgaccaaaccctcatcgtggaacggacccgcgatgaagacggcggatggcgcatcgtgctgttatgcccctttggccgccgcgttcacgaaccgtggtccatggccatcagccgcagactgcgccaacgctacggtttcgatgggcaggtatatgccgccgatgacggtatcgtcattcagctaccggacggtgacggacatattcctgttcaagacctggtccttttcgacccagaagacctcaaagcagatgtagaacgtcaagtgggcgagtccgtgctattcgccgcacgattccgcgaatgcgccacccgatcactgttcatgccgcgatccgacccgggccgtcgcgtgcccctatggcagcagcgactgcgcgccgcacagctcctgcaatccgcacgcatggccaagaacttcccgctgctgctggaaaccgcgcgcgaatgtctgcaagacgtatacgacatgcctgccctgaacgaggtgatgaccggattgcaatccggcatcattaccgtgaaggacgtggagaccgaatcgccatcgcctttcgccgagaacattctctttggcttcgtcggcgtggtgatgtaccagtatgaccaacctcaggccgagcgcagcgcgcgactgttgtctctcgatccgcacgtgctcgaacgcttgctcggcaccaccgacatggcacaagtgctgaatccggacgtgattcgcgaagtcgaacaggaactgggggagcgcactttctggaatgaacttgccgacgatgatgtgactggtcgcgtgacccgttacgccaaaacccatggtcctttcaccgccgatcagctcataaccgacctacacctcgatgctacggatgccgtgcacactctggatgtgctggctgccaaaggcgagttgctgcaaggccactttgtagatgatgacgagcaaggccaacagtggctccataaggacgtattccgtcgcattcggtctcgctcattggccaaggcgcgtaaagcagtccagccagtagaaccagaggcgttccagatgtttcttatcgaccgacaaggtatcgggccggtcggcggcgaacgatatgaaggtgctgacgggctcatgcgcgttatcgagcagctggagggcatatcactgcccactgcactctgggagtcggcggtattccccgcacgagtacgagactaccaacctgcattgctggatgagttgctgaccagcggcgatgtggtctgggtcggctcaaaaaccgggggaaccagtgcgatggaccccggtgaggttgctttctatccggcggattcaatattgctcagcgatgtggaacatggtacgacatcgaacgcctcagacgccaccatgccggaagcgattctggccgcactggactcagggggagcgttccatgcccgtcaactgatggatgccgccaaacgtgtgtggaatgaggccgcggagccggacatcaatccaaacaccggcgaaatcattccgcaagagtggagcgaacagcagttcaaggatgccttgtggagcttggtctggcaaggtaaggtcaccaattccagcttcgcgccggtgcgtgcattaaccgcaggcgcagcaagcccgcgtaaatccactacatcacgtcgtcgtgggcgtgtcgctccgattcgccgagccacgacggatatgacgttaggaggtttgtggtctgccgtgatcgggcaagctgaaggcgaagacactgaccagaccgaacgggcactcgcactggtcgagacgttgctggacaggtatggcgtcatcgcgcagccggtgattgacaaggataatattccgggtggctactcagcgttgtatccggtattgaagcgcatggaggagcatggtcgactggtacgaggcatgttcgtccgtggtttcggtgcggcccaatttgccgagcacgacaccgtggatgcgttgcgtcatccgtcagagcatcgcggccagtccgtggtggcattgagtgtgctcgaccccgcaaatctcagtggctccgccatcgcgtggccggacgcgcctgccggtgcgggtaaaccggcacgccgtatcggagccatggtcgtgctcaatgcgcaaggcacgctactatacgcggctgccaaagccaagcacctgacggcgttcgatcaatcggtcgaccatgaacccgctgccaacgattccgacgaacagatgcgcaaggccgccacagaactggcctacgccctcaaacgcaatggcaccggttccgtgacgttcagcgacatcaatggcgaacccctcaacgcgcgtcaccccttcgcccgcatcctccaccagtccggcttcacccccgttccccgaggcatgcggctgtactgattgagcccaactatcgaatgcggtagttggagccgcgttgggtcatgatgaggccggcgcgggtgagcttcttatccagtgtgtagagggcgttcttgaggagcccttgttgctcgaagaatgggccaccgacgagcttgaccaattcgctggtgttgacgaactgaccatcagccttgaccagtgcttcaagcaaactgtattccagacgggacagtgagattgcgctgcgcgtggatgcgtagtaggccttgtgattcgtggtgtccaacgtgagattgccacgaatgatcatggcggggagtcggtggcaagcgagccgacgtatgagagcagttcgccatcggagaatggtttgctcagcgcggcatccgggcgtcgtacgttagcttgtgcgctagcggcggcattgtccgagcgttgttcggcttcggcatctgagttgtttgcgcgtgaatccgcgctgaaggagctgtagggcgtctcttcgataggggcgtactcgtcaggcagcgctcgccagcggctgccttcgccaatggttttgctgagtggcgtcgaagtcagcagcagaatcttgacggaggcacgggcattgcgtagggattcgatgagctgcttggtggaactgccgagcagggattcatcaagaatcactgcgtcaaatgactccttggcgacagcggcgagcgcgatactaccggtgcttgccaaagacacttcatgacgaccggcaagtagggcaccacgaatggcgcgggccaacggttcattggatacggcaaccagtagtctcatcgccacctccttgatgcttagtgtaggtcgggtttagggtctcttctctattgtttggctcactgtcgttcgttcctcgcctacaaacaccccactgggggtgtttgctttacggctcggcccatcagagggagcttaattgaggttacgcaatgaaggcgatgggggaggcgaggtccactccggaaccgtctcggcgcatatcgggcttgggaagctcgaccggggagcctgcggatgtggaagcgtgcaacgggtagaggcccacccaggcaagaatcagcgtgttctggcccttgaggaagcgctgggaacgcacgccgccggtagcacgacccttggtggggtacatttccagcggagtgaccttcgccgcgccgttttcggtgccgggcagtgcatcggaatcgccggccacggtgagcaccactgcaccggatccggaagtcaagccgttctcgccctcttcataggtccatgccaccttgccggcgggaaccacgttgaaggccgccacacgggcaccctcggccagcttgatgccggccataccgcccgcggtacgaccctgcgggcgcacgttcttcgcctcaaaggtcagtagcgaggaatcggaggagatgaacaccagacggtcgtcatcctcggccacggcggcgaataccacttcatcgccatctttcagatcaatgacgggccaggaatccatggtggtgggtgcctcacgattccaacgcttgatgacaccgttacgggtaccgatagccagcgacggcaacggcttggcctcggcggccccgccatcctcgctctcatccttggcactggccttgccggacgtcggctgctccatggcaatcgccgtaatcacacgctcaccgcgaatcggatcggtggattcggtcatgccgatcagttcgtcggcctgaactccgcccttcagcgacaatgtggcggcagcgggcaaggcaggcaaatcaaccacatgcgcgagcaccaggcggccggccgacgtgaccagcccgtacgtggcgcgcgtggaagtctcgaagattgtggtgatctgatcgtctcgcagacgttcatcggatgcggaccgtgcattgaacacgtccatcgcgcttggcgtggtacgggcaatcaaaccggtggcgctcatcatcaccacgcacggctcgtcctcgatcttcaaggctccggtcagcgcggactgttcgccggtcttcttggctgctgctgcggctgcggccacatcggcttcggcggaggaaatcgtggtggcggccttcactgcttcgagtgcggacttggacacacccgaagccccggcgccctgcgccacgaccggcgtcagcgtgccatccgggtcggcgtccagcagcacggtgcgacgcggcgagccccacttggcgaccgcctcgtccatctcgtcggtgaccacctggtcgagcgcttcggcggaggccagaatgcgggtgagctcctcgatgcgcttcttcaggtcatcgcgttcggcctcaagttcgatgcggttcatcttggtcagtcggcgcagacgcaggtcgaggatgtactgagcctggacctcgtccaaatcgaaaacgaccatcaaacggctcttcgcggcatccgcatcatccgaggtgcggattacctgaatcacctcgtcgatgtccagcatggccagcagcaggccctcgaccaggtgcaggcgttccagcgccttcttcttgcgatattcactgcggcggcgaatcaccacacggcggtggtccacccacacctgaagcatctccttcagacccatcgtgtgcgggcggccctccaccaacgccacgttgttcatggcgaagttgtcttgcaacggtgtgtgcttgaacaactgcaccagaaccgcatgcgggtcgaaaccagtcttgatttcgatgacgatacgcgtgccgttatgacgatcggtcagatcgaacgcgccggaaatcccctccagcttgcggttcttcacaccgtcggaaatacgttcgattaccttctctgggcccaccatgtacggcagctcggtgaccacgatggcctgcttgcgggccgtgacatgctcgatatgcgtggcggcgcgcgtggtgaacgtaccacggccggtggcgtaggcctcacggatgccgtcgcggccgatgatcgtgccgccggtgggccagtcggggccgggcacgtaacgcatcagttgttccagggtggcgtccgaatgcgccatgaggaacttggcggcgttcaccacctcgcccagattgtgggtggccaggttcgtggccatgcccacggcgatgcccgagccgccgttgaccagcagatttgggatggcggccggcagcacggtcggttccttgagcttgttgtcatagttcggcgtgaagtcgacggtgtcctcatcgatatccgcgttcatgccgagagccgccgggccaagcctggcctcggtgtaacgggaggccgcggggccgtcatccagcgagccgaaattgccgtggccgtctaccagcggcagacgcatcgcgaacggctgtgccaaacgcaccatggcctcgtagatcgcggaatcaccgtgcgggtggagcttgcccatcacctcgcccaccacgcgggcggacttcatatacgggtggtcgggagtcaggttcatctcgcccatctggtagacgatgcggcgctgcaccggcttcaagccatcgcgcgcatcgggcagtgcgcgtgcgtaaatcaccgaatacgcatactcgaggaaggacttgctcatctcctcgttcagcggcgtctcgacgatatgctccttgaccgtgcgcggatcgtaggtttgcgcggacggtttgcggtgtgatgccatgaaactccctttcgaacgcccccatattagcgggagggcgcgaaacagtgcgcagagaacggttctcgataacaactgtgcgctggtttcgatgcgccaatcgcacatgtctgccgatagaacggcgtgattccagtgtttcagtcgatgtgcgtttgtttgattatgtgcgttggagcgcacggttgttatcgagaaccgttctctgcgcactgagccaaggggaggggtgctacttgaatgggcaactatgagtgttgagacgccggatatggacgagttgctgcggctggtgcccactgtgggctatggggatgacgtcccggccgatcggcgtgggggagcgctgcacctgtccgccgtgctgcccgccttgtccgccgccatcggacatccgactcccaccaaggtccacgccgatcccaaggcctgccagcgcgcgttgggactgcccgacgccgaatcggccatcgtggtgctcgtggacggcctcggcttctggaacctcgccatgcgcctcggccacgcgccctatctgcgttcgctgatgaacgaaagcgccaatcagcgtcccgtcgccacctgcgctccaagcaccactgtggcggccatggccgcattcggtaccggaacctgcccgggactgaccgcaatggcgggctatacgcagctcgaacccgccagccataagctcatccaactcatccagttcaaagacgcgctggcaaccagaccagccaatccgcacattcctgtgccgcccatggtcgatccgttcgacctgcagcgcgaggagacggtgttcgagaaacttgcggctcaagaggtgcgtgtcacgagctcggggttgcccaagttctccagatcaccattgaccgaagccgcattgcgaggcaccgactatcaaggcaacgtcaccccacgtgatcgtgtgctggccgcctcacgcgcctcacgcacccccggcctgacctacctgtacatccgtgacgccgacaaagtcggccacaattacgggtgggattccgaacactgggtggccgcattcgaacatatcgacgcccagctcgcgctcctgaaacgcagcgcacccaaaggcacgctgatcgtcatcgtggccgaccacggcatggtgcaaaccgacatggaccagcggattgacatcgccgttgaaccgcagctcacccgaggcgtgtcactggtcgggggagagccgcgctcgctgatgctgtatgccgagccggatgaacgacctgaggatatagcttgccggtggcgcgattacctgcaagaccgagccttggtgcgaaccagggatgaggccatcgcggacggattgtttggaccggtctgcgagcgagtccggccgatgcttggcgatgtggtcgtgcaggcagcgggagccgtgaccctcgtcgattcgcgtacgcaaggagacaaagccactcacctgccgagcgtgcatggctcccaaacggcattggaaatggatattccctgcctgatcgatatggcctgattcggaaattcagtctccgaacagaatctcgtcccagcttggtacggccgaacgccctgatttacgcttggccggtttggctggtgcctcgtgtttggtggcggcggattcggccgcccgctcctgctcggtggctaccagctgtgcatcggggccacgccgtatggtcttgtccgaaatattgtcagaaccctgctctggtgccgtggcaggcgattgctgcaatcctgcggcagatgacgaaacagagctggcggtctgcgaagagaccgggcttggggccgtagcgtcatgagcctggttcgtggccggtgagatggacgtggataggtccaccgggggcatggaacctgtggaagtgacggagggccggattgcggcaggccgtgcggccggaatcgaaggcgtaggtgcagcccaagcagacacggcgcgctcgatacgcgcggaacgtacggagtcgccgggcagttcaggaatcgtcggcttgagtttggaatccgtggctgattccggattctgttcgccgagcagttttcgagcggcattgttcaggctcattacggaattgtcgtgcatattccacgtccattcggcatggatctcacggcccgcggaagtgaatatcgccacgatgcgccaaggctcaagtccgcgtcgggtggatttccaggtcactgattccatgccgattcccgcagaggccagcgtgcgttccaccagttcgctgatggtgcgcaccctgctgtctttgggtgccgccacggcaaggaactgttcgatggcatactgtttctcggtctccacggccatggagaaacgacgtaccagcgtttcgctcagatgatatttctccgcgacgcgggccggatcggcaccggcgcgaatcagcgactgtatctgggaaatcggcaaagtggactgctgatgcggctggggagcctgtcgcatctcgcttctgacctgcttggcctcaagaatcgcccgttcgagcgtgtcgtccacgctcacagccatttccccgccgccaatggagaatacgaggtcccccgtcttgctcacgcgtacgaaacgggctttttcaagccgatcatctggcatattcgcaccactttccgtcgcaaagacattacttcttttaagtatgccccacgtgtcgaactttacgagtatttcaaatcgtgtatcctatgggcgagtacggcgctgaccgtgctatatatatcgacttacgaaccaaagacgacgaaaggaccatgatggctcaggattatgattccccccgcaataaggatgaggacgaggaatcgctgcaggcgctggggaagtcctcgcagaacgcctcgggcgacatcgacgacgatgagaacgccatcgccgaagactacgaactgccgggcgccgatttgagcaacgaggattcctcggtgaccgtcatccccatgcagggtgacgagttcgtctgctcgcagtgcttcctggtcaagcatcgtagccagctcgcctacacggacgaggatggccagccggtgtgtgaggagtgcgccgcctgatggcgttcgacgagacctacaacgagcccgaatccaccgaggtcctggtcaaaagcctcgaccccgaacacccggccctgctccggtacgcgcatgcgggcgatgccggcgccgatctcatcaccaccgtcgacgtgaccctcaagcccttcgagcgggcattggtgcccaccggcgtggccatcgccctgcctgcgggttacgtggcgttggtgcacccgcgttccgggctggcggccaagcagggcgtcaccgtgctcaacgcgcctggcaccgttgatgcaggctaccgtggcgaaatcaaggtgccgctgatcaacctcgatccgaagcacaccgccgtcttccatccgggcgatcgcatcgctcaattggtgattcagcggtatgttgaggctcggttcatcccggccgagacactgcccggatccgatcgcgccgaacgcgggttcggttcgacgggagtggcgtcctgaccggattaggccggttgaatgaccaaggtgatgacggcaacaacggttgcggaaccaatgatggcggacgggtgcgtgcgcatggcactggttcgcggttacaatgaacttcatgacgagggaggtgactggcatggcagagattgatggcgagcagtacgccgcccgtaaactgggttgcgagatcagcgctgatccgctcaatccgctggaaccaatcaagaaagtgtgcaagtcccaccatcccggtgaggatttgtccatcctcgaccgcgcgtaccggcgcgccgtcatccagcattgcacgcaacggcgcaagtcgggcgaaccatacatcgtccatccgttggccgtttcccagattctcgcggatctgggcatggggccgattgtggtggcggccggtctgctgcatgacacggtggaggacaccgactacacgttggatcaatgccgtgccgagttcggcgacaccgtggccggtctggtcgatggcgtcaccaagctcagccagcttgaagtgggcgactccgcccaggccgaaacgattcgcaagctggtggtggccatgagccgtgatgtgcgcaccctggtggtcaagctggccgaccgtgtgcacaacgcccgcacctggcgctatgtgaagaccacgtcggcgcagaggaaggcgcgcgaaaccctcgacgtatacgcccctttggccaatcgtctcggtatgaacgccatcaagacggagcttgaggaactgagcttcaaagtgctctatccgaagatctataacgagatcgttgtgctggtggcccgccgggccggtcagcgcgacgtgtatctggcgcagattctggcggagatcaacgaggatctcgatgagcagagcatcaaggcatacgtcaccggccgcccgaaggactacttctcgatttatcagaagatgatcgtgcgcgggcatgatttcgcgaacatctacgatctggtcggcgtgcgcatcatcgtcgacacgattcaggattgctatgcggcgctcggtgccgtgcatgcgcggtggaacccggttcccggccggttcaaggactacatcgccatgccgaagctcaacatgtaccagtcgctgcataccacggtggtgggtccgggcggcaaaccggtggaaatccagattcgcacctgggacatgcaccgccgcgccgagttcggcatcgccgcgcattggaaatacaaggaaaacggtcaggccgggcgtgccttgagctcgccggacaagtccgaccgcaggcgtgacgagaagaaccaggagctttccgaagccgacaatctcaaatggattcagcagcttgccgattggaccagcgaaacccccgactccaatgagtttctggggtcgctcaaggaggatctcggctcgtccgaagtctacgtgttcacgccgaaaggcaagatcgtatccctgcccgctcatgccacgcccgtcgacttcgcgtatgccgtgcacaccgaagtgggtcatcgcacgatgggcgcacgtgtcaacggacgtctggtgccgcttgacaccacgctcgacaatggggacaccgtcgagattctgacgtccaagtccgatacggccgggccttcgcgcgactggctgagtttcgtcaagagtccgaaggcgcgcaataagattcgtcaatggttctccaaggaacgccgcactgaggccatcgaggagggtcgcgacgagctgactcgggcgatgcgcaaacgcaacctgccggtcaacacgctgttgaccccggaagcgttggtgggtgtggccgacgatctcaacttcccgaacgcggacgccgtgttcgcggccatcggggacggtcaggtctccacgcagaacgtcatttcgcatttggtcaaggacgcgggtgccgacgaggtcgatgaagaggtcgagcaggaggttctgccgctcaagcccgtggagcgcaagacttccagcagctccaccggggtatccgtcaagggcgtgggcgatgtgtggatcaaactcgcccgttgttgcatgccggtgcccggtgatgacatcatcggattcatcacccgcaaccagggtgtgtccgtgcatcgcaccgattgtcagaatatgatcgacttgaagagcaagcagcccgagcgtgtggtcgaggtcgaatggaccagcaccaagggtctgttcatggtcaagattcaagtcgaggcattggatcgccgcaacctgctgtcggatgtgacgcgcgtgctttccgatcatggcgtgaatatcatctcgggtacgatcgccacgggttccgatcgagtggccaccagccagttcagcttcgagatggcggatccgcagcatctcaactcgctgttggctgccgtgcgcaagattgacggtgtgttcgacgtataccgcatcaccggtgccaaggaatccgccgaaccccgtctgcgcaagatgaagtagggatgtgggtggcatacggcggggccccggtccgaatcgtcggatcggggccccgccttgtggcacttatggcatgaaggtatgggcggtttttaccgcttcacttcgatggagaggattcctgcgggctcggtcggacggtcggacgaatcggtgcccagtgcttcgagcttgtcgacgaccttcttggaggcgtcgtcggcgacttcgccgaagatggtgtgatggccgttgagccaaggggtcggtacggtggtgatgaagaactgcgagccgttggtcccgtggattttgccgtccatgccacggcggagcccggcattggccatggccaacaggtacggcttgtcgaattgcaggccggggtcgatctcatcgtcgaattcgtagccgggtccgccggtgccggtgcccagcgggcagccgccctggatcatgaaatccttgatgatgcggtggaaggtcagaccgttgtagaagggttcatgggaaggctggccggtgtacgggtcggcccattccttctcgccggtggcgaggcccaggaagttggccacggtgttcggtgccttgtcgtcgaacaggttgatggtgatgtcgccctcggaggtgcgcatgataatggtagtcatggctccaagtgtctcatgggcttgagaccggacagtgggtgcatgagctatgctccttgtgggacctgccctgttgtgaggactactctcgggagagacatgatgttcggagcggttatttccagttgaatgtgtagctttggtccggctgttcctcgccatgggtggtgacggtcgggatgttgccgtgccaggtgacggtgaagttgcccgagtctaatgatttgccgtcgttgtgcagatccgttttgatttccgtgacgttctcggaaccgataacaccgggatcggtgtcccaagagactttgaccgtgatgctgcttgggccgaagaatatgggcgagccgagttcgctgatggtcacttcgcaggtgccgtcagcggatttcgcgtttacgatgcgatgcgacatatccgtttgcatccatatgagagtgcagcctccagcccagatcagcgcgattgcgagaatgatatgctcaacgatgtgtgccgctttatgcgagtatccttcggtcataaatgtccccacgctcgtgtcatcatgccatagccttcaaccggagccttttcatcggtcgttgaaaagatggttggcgatatcgccccgaccgccgaagccggacggcacgtcacccaaagagttcttagcgaagtcgaacaatcccatggtcatgcctctttacctttgggaaaccaatatgactaccgtatcagttgtcggcgtcatcgccgaggcttgcgatttgcggaagtggcccatatccatgcatcgcgtcatgaaacgggacgccgtctcgcgcgtaattcgtgcctgtagaatctttaaagaccaagtttggagggagcgggatcatgccacgcaagctgatcatgtgcggggaccatccggtccttgcgttcgaatacgatcccgagtccggtcgcgcgtgctcctctggcgaggtccttgaccatgatcgtctgcccctggaattcaccacgcacggcaagagcgcgctgtatgccaagaggatcgacgaatggtggaggtcccgcgccatcccctccacccgcgacggcatccgccgcgtgctcgaatcgcttggcgcggcatcgaccgacgaactgctcgacaggacctacgggctgagcctgtcggaccagtactgggtcagacacgaggacgacccggccgaatggaaggacgtcaacttcttcgacaattccttcgacgaggcgctgggcgagatcctgctcacctcgtactcgtcgtcccatgacatcagcctcaacgtccccgacgtgtccactggcggcgatcttcccaaacgctggacgatcgacagggccaccggcaggagactgctcgtcaagtcggggcgtactggccaggagccgatgaacgaggtcatcgcctcgaggctctgcatgcgattgggcgttccggccgtccggtattccctggcacgcaacggcaaccgtctggtctgcccgtgcgaggacatgctcaccagccatgaggagatggtctccgcctggcaggtgctccaatccgccagaaccgtcaatggactcaactcgcatgaccagtggatccatgccgccgtcggcttcggagctgacgagcgcgccgtgcgcgacgccgcggacgactggctcgtggtcgattatctcatgcgcaacaccgaccggcactataacaacttcggtctgatccgcgacatcgagacccttgagatccgtccggcgccgatctacgacaccggcgcgagtctgtggagcggcgagctcgatgtggacggccgcgactggttcgccaagccgttctacaccgcgaccggcaagccctcggctttgcggcagctcagactggtggaggattggagccggttcgacctggatgctctgtcggactggcccgacgaggcggcgcacgagttgtcgcgcatgcgcatgttcgcgcccgaacgcctcgacgccatccgggtacagttggtaaagcgtatcgggatgctccgcagaatcagcgaaggtgaggtccttcgtgtttctgacccgattcgcaataaaacggatttgatggacagattcggcgagacgttgcggaagaaccttggacaacgggacggggatgccagaagcgtcggaaccggaccggatgcgttgagccgtcatctgaaccgctagcgcaacgaatcactactggaataatggactttgcaaccggaacacgaaaagaggagcatgatggccaatcccgagctgtcacggcacatccaggcccttcccgacgagctgaacgcccttgaagggggacgggagatttccgaacacctgcggagggtcgacgcgctgaaggaccgggcccgctcgctggagccgttggacggtgtcgaggacatggcgttggcggattacgaccgcgactggctggtgcgctacacctacaactcgaacgccattgagggatccacgctgaccctggaggacacgtcgctggtgttggagggcgagttcgtcccatcggactcgccggccagatacgtgttcgcagcgcgaggggtcgctgacggcatggcctacgtgcgcgaatatgccaaggaggggcggaagctgaacgaggagctgatccgtcgtctacacgaggtgaccgcattggatctccagccgttcgcccgcggcacgttccgtccttatggctatttggcgcggatcaccgccacccgagtcaagaccgcggacccgctggagatccgcgacgacctgcgatccttgatcgacgggttggatggctgcgcagcgcatccgctgctcagggccgccggtttccacgcgatgttcgagaacatccatccattcatggacggcaacgggcggaccggccgccagctgctcaacttcgtgctgctgcggaacggataccgtcccgtggccatcaaatacgatgcgggtcggtcatatgcgcgaggcctggaggcatggcaggtggacggcaagccggattcgttctgctccattttcctagactgcgtggaacaggaggaacagacgctcgtcgatctgatcgagcggcttcgccatctgagataggtcgcaggaacactcgcatgcttctttcgtgtgcgtcggtaagccgctgatatgcacagaagaatgagattattcttgggtgcctgtaggtgcctcgtggaaaacgagcgtaaccggcaggtttcccaaaaatcgaaaaccttggaataaagcaaaaaacagttggctactattatcatgcgaggtgcgcatgatgatggtagtcatggttccaagtgtctcatgggcttgagaccggggaagagacgtgattgcgggaatggcgcggagagccgtggactggctgcggccgatagccgggaagccgagccgcagcgtgaagcgtcatgcgagttggctcgcgatgatcaacgcgccggcaacgaccatgagcgccgagaagacacgcagaagagtccttttgcgttctcttcccggtttttggatccaatcacgacgtatatcaggactaatccgacggccagcggcaccaaggccagtagaagcagtggcttttccatggcgcctcctttctgaacgctgtgattcagagatatctttagctaatcatgggatatgggcggcttggcgccgattggtgatggggctcgatcctgatgttcgtcggtgccggaatatggtgcattccgtcaaatagaggtgggcacttggatacggtgtcgctttattggatttctttgtttctatggtttgattatgccacgagtccaacaaaacgttaccggcccccagcgaggtggtgacgttttcttggacttcctggccgggaaggagaacccccttatggcgaagtacagcaaggagcagcgtgacagggccgtggatctgtacgtcagatacgagcgctgcgccgcggacgtgatccgcgagctcggctatcccagcagtgggatgctgccggtgtggtaccgggaacgcctcgaggaggaacgcgccggaagacagtccactcgcgggaaacggtaccggcggtacacggacgagcagaaacaggccgcggtggaccattacctcggacacggcaggcgtctgagacgcgctatgcgcgcgctcggctatccgaaaagccatgagctgctcaccgcgtggatcgacgagctggtgcccggccgacgcaggctgaggcacggcccggttcccgaggaattgaagcggaaggcggtggtcgcggtcgcgtccggacggctgaaatcacgtgaggcggccgccgagctgggcgtggaggcgtccgtcgtcgggaaactggaaacggcagatgctcgccggatccaaggagacgcacgtgacgaagacacctggagagaagcccccgacggccggggaggggaaaaccggcgtggagccctctacgccggcggtccgcgggacgcggccggcctggcggacgcggtggcggcgctggagaagaggctggcggagacgcgggcccgtctggacgagctggacgccgatgtcgaacggcaacgacgggagaagagggaactggacatcgagatcgcgatccggaagggcgcgttggagctgttgggaaaagagccgggcgcagacccggaaaacctgaccaaccgagagaagacactcctcgtcaagaccgttagcgagacgctgggcgtgacggccaggagcctcttgcccgtggtcggcatcgcgcgcagcacgtaccattaccagctcaagtccatgaaacgtcccgacaaggactccggtctactggagctcgtgcgcgaggcgctccgggaacagcaagcgcaggtacgggtacaagcggatccacctggagctgaaaggcatgggcgtcagggtatcggccaaacggatcatgcggctgatgacctcacatggcctggtgcccctgttcaagagcgcgaagcggtacagctcgtacaagggcgagctcaccaaggcgccgaagaacctggtgaaccgcgatttccacgccgagcggccgaacatgctgtgggtcacggacctcacggaattctcgatccccgcgggcaaggcctacctgtcgccggtcatcgactgctacgacgggcttcccgtcgcgtggacgatcggcacgagcccgaacgcggcgttggccaacggcatgctgctggacgcgtgctccacgctcaaggacggagagaagccgatcatccacagtgaccgcggctgccactaccggtggccggaatggatccgcatctgcaaggacaacaacctgacgcgttcgacgggcgcgaaaggctgttctccggacaacgcggccgcggaggggttcttcggccgtcccaggcaggagttcttccacaagcgcagcttcgcgggcgtctcgatggacgggttcatcaacatgctcaacgactacatggtctggtaccgggacaggcggatcaagacggagttcggcatgagcatcatggatcgtcgacgcgggctcggtcttgtggcatgattggtggtgatggaatcaacgacgagtccaacaaaacggcaccagcccctgctcattatggagaaaagggttacttcgatatatatgattatgcttggcatactgagcaagtttgtaaagaaccagtgccgcctaatcttctgtaggattccagtactggtagggtaaggataaattattagatgagtaattcgttaaagctcgtttctgctcctgtgcgcgaaagcaggttgtgggatatcccaggttacgtgccatggttcacggcggacagcgcgacggccatcggcgtggccctgcggtatctggcggtctctctgatcggatacaagctcaccggatcgaccacagcagcgggttggttgggctcgctggccgcgatcgcacagcaggcggccgccgtgttcggcgggacattcgccgaccgtcacgatcgcaagacactgatcatcgtgaacgcgacagcgggcgtcatctgttgggggtcagtcgctgcgctgctcatggccggcaagctggtcttccccgtgctgcttgccatcgcggtgttcgagtctgcggtcaacgggtttctcggccccgcctcggatgcgatgctcaaatccatcgtcgatattcgctcatatccgaaagcgcgcagtctcaacgaaggccgtgacgcgaccatcaacatggccggcagcccagtcggcggcctgctgtacggcatcgccccgtggttgccgttcctgtcggctgcggtcatgtacctgctggcaggcgtggctgcgacacgtatccgagtcggcggaaatccgcggaacggcagcgatagcggcaacggcgatagcgacgatgacggtgggaaagcgggcggcgcgtcatttttccgtgatttcgccgaaggatggtcgtggtcgctgcaccgcaggatgctggtgttgacgatggtgtcgtccgcgctggcgaatttcggggtcaatggcttccagtatgcgattcagctgcatctgatgcgcaccggcgtgaacgcgacgctcatcggattcgtgaatacgggcgtattcctcgcgatgctggcgggtgcgttcatcgccggacggatcagcgataccgcaccggtcgggccggtgacatgctgcggattcgtgttcatctgcatcgcttcgctgccgatgctgctgaccgacaactactgggtgctgcttatcgccaacgccgtgatgtgcctgccgttcccgatcatcaacgcgttgcagctcgggttcattttcggtaagacgcccgacacgatgcaggggcgtatcaccgtgacgcttaccgtaccggcccaggcactgtccgcgttctgctcagcgacggccggaagtctgctgcccgctttcggattcagcgggactatgctggtgttctgggcggtgatgctcgtcagtatgctgctaatcgtcagttcgcgcagcctgcgcaccattccacgcgccgaccagtgggatcgcacaccgctggagtagccgcggacggccaccaaccatggggactatgcaccgctgcgcgctgctctccgcacacgtcttccattccgcaaaccggctgcgctgacaggacgatgagtgcggtcagtttgcggcagtcagtttgggaagaactcaaaatctcgattcagcaggctcaaatcacgagttttcagattgtggtctggaaaactcggtggaagaggctgatcccgggagaaattgagaaatccggatgtccgtttgcgcgaccgattctatgaaaacttccggatgcgcgcgggagtttagcgcgaaacatgaatccggcgaagttctcccgggaacggcttcaaggtcgatttttgagaatcgcggaattccaacgtttttgttgagagattatgcatgagagtaccggattctcgtaaactcccgcgtccggcacgggagttcagcggcgaattcccgaagtcagcgtaaactcccgcagaatctgggagattatggcccgacgaggtctaccagaacgaactcccagattgaccgccgttcagccagacgaaaacgacccagcaccggcggaatcgaacaaacaagcgccacaaccaccatcaagcagtcggcaacgtcattatgagctgataggaaccaaccttcttgtccgtcatcccagtaaacgttgcgttagttgacatgtcagggtattattctcgaacagtgtgtaaacacactattcacgtatacctctggcgtgtccggcgatgggatgcccgcggcggatatcggacacgatcttcccgatccagcactgttcccggaccacgcagtccgcgaccatgcacgccaggggaaccggatcgccgtacgcctgccactgctcgagccgtccggcgtaggtgctgccggcatcatgcctgatggcgatgggctcgtaccccgcctgcatgagcatcatgttgaggatctggcgtccggtacgcccgttgtcgtcggcgaacgggtggatgttttcgagtgcctccgcggaggcgcgctccgacgggggtaccatcatcggaaagtccgccggaaacggcggacttttccatatccgcctccgcatcgtccgaaacgcccattctcctcatcagagaatcatcaagaagttgttccgtgcttactttcaagaatcttgatgcattaaccaggtcgtatacagaccagcctgttttccccgacatctttagggacatggccgaacggccaattcccatcgcttcggccaagctggactgcgaataaccataagccgtcaatagcattttgacattgaaggtgattgtcgactccagctgcttttgataacgcccggtttgttgcgcactttggttgaggtctgaatgaagggacatggtccgtcgccggggtacgatttcagtcgccaaacataaaaccgctatggaaagaggcgacgaaccatgtcgaaccagattctacaggtcgacgagaacatgctcgagacgaagctggaccgtctcgtgtcccggaagggcgaggagctgttgaacgcgatgctggacgcggaggccgacgagatcaccggggccgcgagatacgagcgtgcgtccggtcggagggcctaccgtgcgggccactacgagcggaacctgaccgtgaaggccgggacgatgacgctcagggtgccgaagctgaagggcgcggtcttcgagtcggcggtcatcgaacgctaccggcgtcgcgagcagagcgtcgaggaggcgctgatcgacatgtacctggccggcgtcagcacgcgtcaggtcgacgacatcagccgcctgctgtggggcgagcggatgccctcccagacgctctccgacaagctcaagcgcgtgtacgaggacatcgatcaatggcggaaccgtcccctggcggcccattcgtacccgtacctgttcgtggacggcgtgtggcacaagcgcacgtggggcgggtcggtcgagaacgtgagcgtgctggtcgccatcggcgtggacgacaccggccaccgtgaggtcgtcggcgtcgcggagggcatgaaggaggacaaggccagctgggagcagttcgtcaggagcatgatcgaacgcggtctcaggggcgtgcggctcgtggtcggcgaccggtgcgccgggctcgtctccaccgtgaactcgatgctgccggacgcgcgctaccagcggtgcatggtccacttcatgcgcaacgtcctgtccaaggtcagccacaagcacgcggcatgggccgcgtccgccctgaaggccgtgttcgccatggaaagccggcaggccgcgttggagaaggccgaacaggtcgccaccgaaatggagtccaaggggctgaaggccgccgcctcctgcctcagggaaggcatcagcgagaccacgacctacctgctcgacgactatcccgtcgagcatcggcggcggatccgcacgaacaacatgatcgaacggctcaaccgcgagatccgccggcgcaccagagtggtcggcagcttcccggacggcaggagcgcgctcatgctcgtctgcgccaggatccgctacgtcaccgccaaccaatggagcgcacgccgctacctggacatgtcccggctcgacggcatcatgcaatcaaccgactgaagttgtcctcccggcaacgggccgaaccgcttttgcgcaagaattcgggcgttatccattgccgttctgggacaggctgtaacggatcgccacctaggtcacgctctcatcgtccgcgtcggtcatgccattcgctgtaggaaatccctaacgattgaatcccactgcgcgtcggtcagaatactttcgcccgcgcgtcatatgagccattaggccgatatactctgagtataccaattccatgaagtagcgaggagaacaggtcatgccgactttggaatggatgggaaagaacaaggtggtcgcctaccaccgtcaggtgccgtaccgtgttcttgaccgcgttcctgaaaaaagcgtcctggattcacgtggatccgattgcggtatattgttttttggtatttactgatttcagtatttccgtattccggtattgcttatttgtctacatttttttggtaaacgtagacttcgtcattaactggaatgtatcccttcaggattttatccttacgaatttccttcccgattatcttggacgaataggccagtagataatcaagagtcgcctgatacggttcgagtatgaagatgcatcggctcagcgactccaggtaatgaagctgctttctgcattccctcttattgaaccaatggcgccatcttatcgagaacttcttttgctcactctgcgaagagtcatagataagcggaaatggtaatggtttcaaacctggttcagccattccgttgcgaaaatacttatgccacttgcgcgacaatgaggggaatctgattttaatccatgctctttgtgcccaggttggggatacgcgtgctgccggaagcgttataaaacattcatcgtagaatatggaattcttatatatggcttcccatatcggcatacgtccttcagcgtctttcatggtctgattaactcggtcggcccatttgcggaatttctcatatacagaagaggccaacccgaggaagaaaccaaacagtgcgctgaagaaattctggaaaaccggattcgaaccatctggaatcaagaaaatggcaatcaggcaaatggcactcagcccgacggcaatcgcggccgtcctaatgcggcggatccgtcgtctatagaaatccggattcatattcagcaacttgcccaagtcgttaatcaaacatcccgaagcggactcaggatacacctttatatcgctggctgaatccgcggtttggtttcctccatcggtgtcatgtctatcgaaaccgtccatgccgaatactgtcttgtatgagatgggattctccttaccgagataaataagcgaaaccatcatacataactttctgattgacgctcattccgtccaaaacgatataagcagtctcaaagcgcgatcaccatcggttcgcgggtcttctcgttcatcggtttctccttgtctcggttttccagtgtttccatatcccggtttttcggtatgtagttctttcggtatttcggtttttaggtaaaacggtttcccggttttcaccggttccggtatcccgctccagcaggatcttcctgagcctttccacctcgtcccggagcttgccgatctgatgctccttctgggcgatgacggtgcggtggcgtgcctgacgtgtcatgcgtggcatctggcgaaaggattgcgactggaatgaaggactttaggagcggaatcaggcgcggctccgtctaagggccgtcggttttgctagaatctaaagagaaaaggaggtgcaatgttcggaacgatatctgaatccgagatgcgccgccgcacggagaacgtcggactgtcggtgcagtccgtgcggctggaaggcggcgacgtgacgagggccttcatacgcgatgccggagaatatgcgcgggggagcatcggcagcgccgagcttctttcccgcacccgtcgccgttacggattggagtgacgatggcgcgtgtcttcgatccctacctgattccgggaacgaacgtgctgcggaaccttgtgggcgccacggacaaggatgcgctggcggctgcggagaacgatctctgctccgcccgcgccgccattctgagagagaatctcccacctgcggaggggacgctggaacagcttcgccgcatacaccggttcctcttccaggacgtgtacgactgggcgggggagatacgaaccatcgacatgggcaagggcgaggggcttcccttccaaccgttggagctgtttagcataggggtgcactactccgagggggtgcttcgcggtgacgatcttctcaaaggcctcggtcatgaagaattcgtgaagcgtctgagcgtcagctacaacaacttcaacatccttcacccgttccgtgagggcaacggacggacgcaacgcattttctgggagatcatcgcgcgcgaggccggctggcatttcgactggggactcatcgacaaaaggacgaacgatcaagcctcgatcgcggggatgcagcgaaacgatctgcgtcctctcgaggatatgttcgggagaatcgtcaagccggtgtccgaaccgttgaccatgtcgaatgacctggcccatcttggtgagtatgcgcaaccggcgaacaaggcatacgacatgtctcccgcacagagacaacatgtgtgcgagcattactcctatcagcgtgccatcgttcctccagggcaggaaaagccgaaactcaggcacaggtcgagatgattttcggataacgcctcacgtatctaagtgttgcgacggcagatgccgcaacgcttagatgcgtgggcctgttccgtttgatgccggtctccaccggttttggtttttcattatttcggtttttcggtttttcggttttgggtatgcttatccggactggctccgcccgtctccgtcgtcttcgagctcttccagtcttcttcggagtccggcgacggtctgtcgcagctggtcgatttcctcttccttctgggctatctgcgccttgatgccggccggatccccggcggggagatattcgagcgccagtcgttcggcgacgtcgcgcctgtgtctcggcaccacgcgttggtagcatcggacggccacgtcgacgtccacatggccgagctcgtccatggtctcgcgcagtgtgccgccctggatcatgaacatcgtcgcgtgtgtcgcgcgcagggagtggaacgtcacgtcctcgcggttgattcttttcctcgcggtgcggaactgccgttggatcgtcgtcgggttcaggacccgttccgggtgcctgatcgcgtggaagagcatcgtgtcgggatccctgtcgggacagaacctgtcgatatgttccctgatgagacggcagaccggtgcggggatgggtacgactcggtggctttccggggtcttcgtctcgtcgagccggtattcgcccagatcgtccggaccttgcgtcacggaatgccgcacgtacagcagtctgtggtcgaggtcgatgtccctgagttgcagtccgcagacctctccgatgcgcagcccgcccaccagcagcgcgagatggatcgacaggcggtagtattccgggaagccctcgaccagcgtgtcgatctcctgcctggtcatcggcgcctgctcgcgtcttttggacggtctcttcctcgtgacgagattgcatggattcgagaacaatagcggcggacctccgtccggctgccgctcggtcgcggccctcatcaggcgcttgagcagccagaccgcgtgctcgagcgcggagggacgcacctcgtcgcatgccttcgcgtaccattcgttgacgaattcctcggtgatgtcgcacatgggcgtctcgccgaaccaggggagcagtttgtccaacgccgccttctggatccgcttgcttctgccgctcagctccgacccgtccttcttccgcaggttggcgacgaaacgcgtcgcgtatgaggagaacaggaccctgccgtgcatcgtccttgcagacgggtgcgtccacctgcggattccctttttatggtcgatgacgagcgcgtgctcctcgtcgagccagcggtacgcctcggtctggaattccaatccgaatcggcggtagattctttgcctgggattgacgggactctggtatcgggcctgccaggagacgatccttccgtccgcgtccttgcaggcgacgacgcatccccatttccgtcttttcctgtctccattggacatcggttgttttgtctttctctacttcttgaaaaaccattagaagaaagagtaattgcctacgccggtgattttgaataaggtgctatccttcgaccgtggggattctatctttcgggaaaatcgggattgttcagggctcttggagtggttttgactggaatttcaacaatcttcagtgatctgtttcctgatgtcacatcccaaagaagaagcatcatgcgcatgtcaccttcggaggtgcgcatgataactgtagtcatggtccccagtgtctcatgggcttgagaccgggtgggaatgctgtggctcttgcttatcgtgcgtatgagccgcaagcgctatgccaacacttgcggctcacattatagataaaactggtctggctttaccggacagatttggttgtctaattattgttattactctttatgggaggatagccgtaatatacggaatcgtaatgcggtgaagaagtattgtactttaacaatgtatatgattctgcctcaccaacttttgtaatactttttgctagactggctggtgtattcatggctccagcgtcaactttactgctgtcactagcaattgaatttcaaatttttgaagcgaaagtagaacagttgttaagatagccccatttatcgttatttttaatattagaattcactgtatctaaatcaatttgccttaagggtaattgaatggaaacattctgaagattaataccattggaattaagcttcgaatcaagattgagccacagacccttatattctctactgacatctacggattcatcccaagtgcttgctgttatagatttaccatcagcaacgttaatcccagcaatgtctgccgtagaaccagacaggtttgtgatcataagccaagaatgaccgagattcgtgaaactagatgacgagccggatcctgtagtagaataaatctgcagtaaagctacagcctctgcagcgcacgttttgtaattagcgccccgagaaggagatgagataattctcagatcttcgttatctgaggttttctcaaaatcttccagagaagcattagacggaaagctagatagggtaggactcctatagggagtttccatagattctgctgccgacgcatttactgttacagttccagccaatattacagatactagagcagtgacaatttgtttgagtttctttatttatttctcctttttatcaggaataaaatagtttcgacagcaccagcagcgacaaggaagggggctgctcgtaaaaaataaagatatgaaggaaagctagacacgtattctggatgcaggtagtcaaaaataaagccgcttactgtgcgtaggagtccggcacacactaggagacctgcaagaatgtggcaaattcggcgcatattgactcgattctcgaactgcggaggaatgagtcctattgtagtagggcttgtcggagaggccaggcccagttcaaggagcggaaggcttgcgtcgctcctgcggcatcgacgagaaagtgttccagcctcctggtgaagagccacgagcaccctgcttggggacccgacatcatcgatgtacgacatacggcatctacgacttcgcccggttcgtgcagacgcttgaaagagcgagggtcatacaggcctcgtggaggcacgcgtcttctcctttgtaggcgtttgggtttttctggtggtggtcttgatggaccggcgtgtgcctctggaatgatgatatggaggtttcattatatcgtccgccgtctggctgggttgcattcgcgggggattggcgctattctgtaacagcgaaataagctggacttcgttcggttcgctgaggccattccgtggacgcggggtggcctcagtgctttcatcgctggattgggggaggtcggacccatgtcgttgcgcaaaccctacaggagtgtgaacgaacagctgcgcattctgcgctcccgtggcatggccgtcgatgccggtgcgggtcatgtgctcaggcgcgagggctattatccgatcgtcaatggctataaggatttgttcctcgaccgaaaggcatgcctgaccgctggtgatgaccggtacggaacgggcgcgcgtttcgatgatctgtacgccctgttcctgttcgaccgtgagttgcgtgaactgttgttttcctccatcacacgggcggaggccgcgctcaaggcagtgtgcgcgcatgagttcaccgggctgcaccccgacgaggtcaacccgtatctcaatcccgactattatgattccaggtgccgtccgagcgccatggcattgatcgacaaggtcttcaagcggatacttgagttggacggcaacccgcgcaacaggggcgactatggcggcaaggcgtatatccgccattgcatggaagaccacaacggccaggtcccgttgtgggtgctggccaacgatctttccttcggccagacggtatggttcttccaagtccagtccccggccgtccgattggcggtcgccgaaagtttcaccggtttgtatgcggacacgcacgacaggccacggcgcatcaccatcaagcggctggacagcatcttcaacagactggtgttctaccgcaacctgtgcgcgcatgacgagcgctgctattgtgcccggtacgatgggcgcgctaacgagaacgtgtatcaggccatcggggatcttggttatttgcttgacaaggacgattacttggaattgttcggtcgcttctccgcattggtcgcacgggtgacctccaccatgccatcgcggagccaagcgatcctgtctgccatgggtgtgcgcgaacgggaactggccgacagggcggaaatcatactgcgcagctgaccgttcctgctattgggacggtggcgtcgcaggcggctttggaccatgagccagctgatctgggctgtctgcaatgggcctgtgggattcgggatggatttggatgccattggcggctgggacggttgcacgggctgcgtatcgttctgtctattgtccgccatggagacatgctgccgggtgaatgcttctgggcaccacccatgcggaacatcatgaaaccacagggggtattgcacttttccgtgccggtcggcgaagacgctgagcgccggcagggtggtggaacgttcccggattattcttgggtgcctgtaggtgcctcgtggaaaacgagcgtaaccggcaggtttcccaaaaatcgaaaaccttggaataaagcaaaaaacagttggctactattatcatgcgaggtgcgcatgatgatggtagtcatggttccaagtgtctcatgggcttgagaccggggaagagacgtgattgcgggaatggcgcggagagccgtggactggctgcggccgatagccgggaagccgagccgcagcgtgaagcgtcatgcgagttggctcgcgatgatcaacgcgccggcaacgaccatgagcgccgagaagacacgcagaagagtccttttgcgttctcttcccggtttttggatccaatcacgacgtatatcaggactaatccgacggccagcggcaccaaggccagtagaagcagtggcttttccatggcatctcatctcgaacgctgtggttcagatgtttcgatgttcggtttttctgcgcttgctgacaagagccatggagcagcatgccgatacgcacagattcactatgcaggtcgccgccggcagtagccgtatgaacggctgactgtagaaatcgaggacatccggatccatgaatcctgagtacatttcaaaaaccggatatgatgcgagagccggcgccgaactcacgaggaacagtatccaaatgacgggtaatctcaggatggatactgttcggcctttccgatggacttctttcgagaacatgaaaagagcccaagaggccactgcgattaatgcacccgcgcaatacaacagacagggaactcgctacgcatgattccgtcctcacttcagtcgcaggtaatttggcttatcgatcttctggcaggttcgagattatacggtgttttgagattaccatacctgacatggcagtcgaattgcccgttgtctattggcagagcatccgactgttaatcggacggtcgctggttcaagcccagccgcaggagccagacaaaaacccggaacttcggttccgggtttttgttacccgccccccgaaactcctttatcaaggaatcatccataagggatgccgcagcagacggtctccaaggcgtactgcaccgtgctcatccccatggacgacggcaactggcacgtcaccgtgtactgtcccgcttcgctggacggcccactgctcgacaaggattccaacgaattcgacacggacgacgtgaaacccggcgacaagtcgtacaccgttgccaatccattccacctggatcacgcacccggaacagacggtttcatcttcggccctgacaccctccgacgatagcgatggactaaccattcaaccgcacgcgtaggaggagcgcattccaaccatgaatgaatgacatatagacgtcaagggcttgcggacatcgtgtccgcaagcccttgacgtctcaatccaacgaaatatcgacttttacccgtttgtcggattcaggctttcgcgcaagtccggcgatgaggagggccaccagcagggggatcgtcgtcagtgtaccccaggaaatcgagaacgtgtcggcgatgtagccgcacagcggggtgacgaccgcggtgaaggccatcaatacgagcgatcccacggagaacgcggtcgcgcggatcgaatcgtcaatgctctcgtgcaagctgctggagatcgtgttcgccacgtacatctgcgcgcaggagaacacgaagaacgccaggatcctcaccgccggcatcggcgtggccgcaagcaccaccgccgacacgatgagcacgaggatcgcaatgtcgccggaacgtggatgcagccgcagcatacccagacgactgccgacgatctgcgcgatattagtgaacactaggccggcgaactgccaccagaccccggtctggtggcccatcagcagcaactgccagaacgtcagcaccgacaacgtacccagattgaacaccaccatattccatatctccggcttccgcagcagcacggccgcggccgccacggtctgcctgacatgatccaacaccgtcagcgaggtcccggactcgcccggctcggcggatccatcggattcgacggacgcctcggcctgccgttccgtcgtcccgctcccatccgtcgctgcggccttggtgcgcgacccggccctcatcagaccgagaagcgggatgatcgccaatacgtagaacaccgtcgcgcccagccagatcagctgggagtcaagcaggaacagcacggcaccgaccgcaccgccgcatatcgtgcacacaccgatcatcgccgacagtcttgacaccaaggtcttcatacccagcgagggatcgtacttgcgggcgtattcgatgtacagcgaggacgccgcgccgctttcgaccgcggccccgatgccggccagcacgttggccaggcacagcacggcgaagttcgcggaccagaacagcatcaatatgaatcccgcgacgcggcacaacacgccgatgatcagcgtccgttcccgggaccaccggtcgaacagcacggacgtgggcagctcgctggccgattcgctgacgtcgaacaccacattgacgatggagatcagcagcaccgacaggcccacatcatgataggccaccatatagtagaccgaaaaacatccggcaccaagataaataagcgcattatacaaacaggcaaaccgaaccatcaatcattcccttacataaacaaagaaccggtatacgtcgatctatgtatattaaatcccatagccttagcaaaatcctccagacgattggagtttgtaaaatacgtcgaatcacaaggtgcgatattcgtcgctatacatttgagagccttctgctgttttcgtgggttagaggatgggtgttggtaggtggatgggtaggccgctgcatcggagtttgatcatggcgatgagattgtcgacgtggcggaagccgtaggccatgtggatggtgaccttgatcttgtcgttgaatgcctcgggcctggcgttggagtggccgagtccgatggccccgaggatgtcgtcctcgcgtccgtgggtcttcccgcatggttcgacgatctcggggatgcggctgtgtgaggcccggaagatccatcgttccagcccggccccggcttggtcgatgggccgtcgccgttcgccgcccccgtcgtcgtactcagggcacttgcgcccgcagtgcgaacacccgggtgccgccttctggcaccgcacccggaccaccggcgcgggagcgggacacaacggcgaatcgtccgccggcacgtcctcgacgaccatttgggattcaacggctcaccgacgaaccaccacccacgaaaacaacacaagagcctgatttaaactgtagtctgcatggtggaattattcccgtgtctgtaccgccagaagtaccgttaagggaatttccgtataatgcagttgtggagcttgtcaatcccggagccgatacggtatcaagaaagacctatacgggtgcagatgcggattggtatgtaaaagtagaggacattgtattgaagaacgcaggcaatccatggaaccatacaccgcagggacaaccgaaaaaataaatttggtgggtaaattttttattgtagcagatatatggaactgttataatatggatatgaaggaagcaacgcatttgaagttgcagaaggagtgaatctgaaatgtgtatggaatgttatgttgacgagaatagaataacaccacttttaaatccattagattgtttagaaaatcatacacaatacatttgtgggacttgcgggaggtgtatctgcattgagcatgatcccaaacgtggattacaacggtggaatttcccttttagatcgttagagatagcgaaattatatttgcgtactgctgattatagtactaaaaagtcatgtggtatttacgaactgaaaagtgagaatggcagactttcatacaaaatctttgcggacggtgaggacttgctgttatatctaaagaagaacaaaggaaaaacttgcaaagatatgaaaccggttttcatgattgaagaatacagagaatatgcaaatacgcaaataagaaaattgacctctgatgaaatacagagatatatgtcagagcgataacttccagttttgcaatttcatatctatgcatacatagcagttagtcttaggattgactgctttttttgtactcagaaaggagtgattgatttatgcaaaagatttggaacaaaagacaccgtatcagtgccggcgacgaacaccttgtctatcctttttccatagggacgtttctgtttttgttcgtggcggttcttctgctactgaatataaaacagctcgtgcgtactgattgggaacgtctcagcttgttagagaacggcttgacgctttccacatacaactttataaccatacttggtgtgccgacactcccgattatatgatgcatttcaacggattcaggttcatgggcccatacgggtgctgaccaggatgggagcaaagacatgtcaatgaccatgtctcctgattgctgaatcagtatctccgacgaagccttcgcaatagacgatgaggaaatggaagatgaacccgttcaagatgaagactgacgcagaacctcaggaagcttcgtcttccgagtaagctctgtgctcctcatgcagacacgtgataccggagcccctgccttcgccaagaaatacggtcccacggtcgtcagcaaggtgggccacttggtcgtcaatgtggtgaagaaaagattctagctgcatatctgtccgagtcggacacgatttacggcgtgtgtcctgcgaggggctggtgatgttttgtcgtgctcatcgttgattccatggcctccatcaccggtgaaagcgcgatattggaaaaacaccgtgaggccatcgagcgtgatggtcccaggatggtgacgcaggccgtcgggaagaatacgttctacggcggatccgtgaaaccggatcgtgatgataagcagtcctccagtccgaacagctacttccagaccggatacaagagcctgatggatttggcgataaggcggattctagtggtggttgcaacacctgaggtttgagcggccttccatggtcacgttgtcggttgttgaggttatcacgcggcgtcgagcagttcgatgatcttctcgcttggtttcatgaacccgagggttttgcgtggccggtcgttgagttcctcggcgaccgcgtcgaggtggtcctccgggtagacggatgggtcggtgcctttggggaagtactggcgcaggagcccgttggtgttctcgttggtgccgcgctgccacggggagtgcgggtcgcagaagtggacggcctccagcgaggcgccgatccgtttgtgcagggcgagttccgctccctggtcccaggtcaggctgttgcgcaggagtttgggcaggtgctgcatcttgtcgatgatggcctgccgggcgtgttcggcgtcgtgcccgtcgggcaggtgcggcaggatcgtgaacctggtggtgcgctcgacgagcgtgccgatggcgcttttgttgcggctgccggtgatgagatcgccctcccagtggcccgggaccgcccggtcctcgatctccgggggccgctccgagatcatgaccatgggttcgcggaaacggggtttgcggccttggccgcctcggggtctgcgggcggttcgcccctgcctcatggcgcgtttcggctcctgcctgagttcgcccctggcctgcaggtagatgggctggcagatcgtctcgacgctcgcgtgcatatccccattatccgggaggtccggcctcggccggttggctatctgctccgggctccaatgcctgcgcaacccggcggcgatctcgtcccacagtcgcgtgtcctcggccgccttgcgcggtttggggcgtttgagccggtccgcggccttctgccgggcgcggcagggctcgtaaccgccggactcgggattcccgtcgcgctcgacctcgcggccgaccgtgccggggtcgcggcccagcaggcgggcgatggcgcggatcgaatcgcccagacacagacggtccgcgatctggatgcgctcctcctggctcaggtagcgcggatggagggtcctgggtttgtccatggtggaacgataccggtccaccaggggtttctcgttccttcccgtggcgcgcgtcctgccgttgcgccacgccttgccggtgcgtttcgagacgccgaccgcgtgcgcggcctgggtgaagttcatgccttcctcgtccagcaggcgcacgtactcggcgcgtctcgcctcgcacatcagcttcctcgtcggatattcgacgccgttgaacgcccaacggtgttccccgccacggtcttcgtttcggtggcttgtggtcacctgaccctccttgcggtaggtcaggtgttgcaacgatcactagaacccgccgggccggtagtattcgggggcaatggcacgagtcgatctatcttgtccttggtgagcggcgtctggttgcgccgggcgctcggcttgcgcagggtgatgggcgccacgggcaaggccgtgggacgcatctattgaatcggagtcgcggagcagtccaggccggcaaggcaacgtgtgaccgcaaggcggcgggggcctcttatgctgggaacgcacctcgatgatcctccgatcggcgtttggaatgggcccatgccgttcttcaggaggagtcgaagatggatggaagcgcaggcgactagcggtgaatgtttgtagttttcaaaggacaggagtgttgggaaaatctactgtaagcaaaatccgatacagggaatctgattatctacataaatacagtatctaaagactgtttattgcttggatgataagtggttcaccatgaatgtatcgtgattgaatatgggtcttgatatgacgagatgcaaagggagattgcacgcatgtaagaccgtgtatctccctttgacaaactatctgaagttctctacatttataactctggaaaaacaatcgagcaaattcatgttgtgagtgaccatgattatagtaatgccatcttcatttaattctttcagaagcttcatcactatcgattcattctctttatcaagtccggaagttggctcatcggctaatatgatccgacttccttgcaaaatcaacttgataattgcaattcgctgttgctctccgccgcttaactggtatactttcttgtcaagcatatcagttagctcaaattgctttagatacttatcgattagtttgagtttttctttcttttttattttcttatattcaagagccaattttaaattccataacacgctttcatcttctataagtccataattctgaaacagataacctattgtgtatcttctcaagatcatagcatttttactgtttatggacacattttgatgaccgtcaatagtgattgttcccgcagatatatcagtaatcaatcctattatatttagaagtgtcgttttacccgcaccgcttttccccacaagccccacaaattcgcctttttctatttccaaagacagattttcaaatagaacctgattttttccatattgtttcttgatgttcttcaatgtaatcaatgacataattatgctcccttttcaatctcatataaagtgtttgagatataagttctataaagcaattcgcaaaatatgtagtcaataaatatgatcacgaaaatgaaagcaaaataatgatttatagcagtcaatatgactgatataatgagtccaattccccaaagaatataacgattctttagagttctagaatgagagaatcccaaaatctcttttgccgcatatttctttcgatttacaaagatgtccacataatttgaaatatacaaaataaatagtaaagacactataaatacaatcatgaacatggtgagtgttttaagaacgaaagtcacattttcgagctgcattaaataaggtgtgagcaatgttccagctgtaactaattgctctaaaccatattctgacaacaaggaagaaaagtcttctcttgattccatctggaaaaatagacaccttgtatttaaggaatccagatagtaaagtccagcaaaatcgcctgtatcaacaatgataataggatcggctatatcagaaaaaccattttctgtattagcttttattgtggaagcatcgtcgatataaacaatattaaacttgtcaatggttctttcttctcctggtattccatagaattgattgtaattcatcaatcggaaatattcttgcttgatatattctttaatagattgttcatcattcttgtatttatgcggaaccaatacggttggttcattgaatttatcttcttccaatggttttccgttgagcttaatatttgaaaaatcattcagatagttcctgtttgcgatagcaagctgttgttcataataggggcgtgatgtctgcaaaccatcgtctgtcttaaaatcacacagtagtgaatggttatgattgtacatctccgatgcttgcttggaatagttttctaatatgtttgtgtttgctaacgcatagtcatacttcgaggaattaaaaccattggcggtataatatccatccagatacttatagtctaaaacagcttgttggctttgtctaaatgagtttccttgatttagtaatgaaataatggtaataacgattattgctgaaaaagctatctttataacctgaactacagcgtttgtgccgttatttagagtcttattttttatcattgcttctaaagaaacaaacttaattagaatacttgtcattaaaacacaaagtatatttatagctaaaactccaataaagaatagcacgcttgttattaaataagaagaagcatacctgtttgttaatgcgtaataggtatttaacaacaacagtaatactaggcatactacagaataatattttattatatttgtaatttgttcctttaaaatatgtatagtagaaaagcccatgctttttttaatacctatttttttcaaactataggaggtataaatacagtatatgatttgaattacaataaataaaattatgaaattcacaagatttagttccaataccatactgtacggaatggagtcgctttcaaagttgtttatcgcgacggacagtcgagatgctatctctttgattgcatcggctggtaaatctgtatagaatacaccaacactatctagaaaatcttccttctgcaattcatgatattgaaataagatagaagaagatataggctgtttttgtgtaaaagaatttaacggaaagcaatacagatcataaacagatttatctgtggaagtgagcgtattgttgataagctctaatttattatgagaatactcttttgtaaataacgtataaaacctatcgagaacttctggcgatgtttcctctaagacgtacccttttagattcttggcagcaatgttattcttttcataaatgttgtaaatggaagtattaaaaatataggcaaagagtatgacttcaaggaaaataaaaatctttaaaaactttttcatagcatacgcctcttctttgaagggatctataaactagagcgggacaaatagccccgccctaaatactcgaactactttgctcaatatggataataatcataataagatgtttcatccgcccaccaaactctccttgcgtctttgtaagcgtagtttgatttgaggccgctggtatgcgtatctccgccaattttcacggcctactttaccatgtagttacgaccaatacctgctttgcgtccaatttcggaacatacaacgatagtcgtggccttaatgtctcatgggcttgaggccgggtgtcggacgcacgattcccatgcgtatgccttggtgtggcctgtccggttgtggggatctgagagaggtggtgttcggggtggctctttccagtcgaacgtgtagctttggcccgactgttcctcgccgtcgagatgctgccataccaagtgatggtgaagttgtccgagttcaatgatttgccttcgtcgtgcagttatgtcttgatttctgtgacgttctcagagtcgataacattggtatcggtgccccaggagactttgaccgtgatgttgcttgggccgatgatcatggtcggcaaactgccgcccggatggtggttgtgcacatccatcgacaatgcgttcgggcttggtgccgtgaccagagtggattacggggcatggacgtcgtcgattggtctggtggcgttgttcgacgttgcattcatctgccttggtctggctttggggcgcattcgccgtacgcgcccgtccccatcttctcacgccgccacgcagtcggccggatgatcacgaacgtttcgttccattgaccggttctcgatggaacgaaacgttcgtgatgacccggtggacgggcccttccctgatccgtggccacggtttgcgtatatcgcaagttgaacgctgcggatggatgggtgcacggtatcttgaaatcttcaaaaagtcttcaattttgctgtttattctctaccctgaaaacaaggaaagggtattggcaaacatggaagcaattctacagacgaataacctatgtaaggatttcaagaagcaaagggctgtgaataagggttataggccaaaatgtgtgtccgttttggcttgtgttcctttgtggcggtgggcgttcctcctgttcgagttgtatgggcggggaactcgaggtcggccagaatgtgtgtccggaatggccggtcaggccttgcggcacaacggttgagtgactttcgagttggcgtggcagattgggtggatgaacacaccttgttgcgccgtgtgcggcgagccgatgaagcggaacggaaggacgagctcgggacggatcaggtggcggtgccggaacgccggctgtgggagctcacgcacccagtcgcgcgacaacagcgcccgtgatctgcggtgcggtctggattggctgttctcgaagcagtcgcaggccgagcaccggctgccggcacgcacgctgcgccgcaggtgcgagctcatgtggggcctgtggccgcccgtgccgctggtggacgaggtgcatcatgtggtgcatgtggacggcatccacctgcaccgcgacgcggtggtcctgatcgcggtggccggcgggcacgtgatcggctggcacgtcgccaaaagcgagaaagcggcggcatggcagtgcctgatggcgcgcatcgcgccgcccgacgtgctcgtgtgcgacggcgggggcggcgtcctcaaggccgcgaaggccatgtggccggatacgaggatccagcggtgcctgttccacgtgcaggccaacatcctcgagctgaccggcaggcggccccgtctggaggcgggcggacggctgcgccgggtggccctgtccctgccccgcgtcggggacgcgggcggcgcggccgaatggctggtctcctacaaccagtgggagcaggacttccattcgttcctcgacgagaagagcgaatacgccgacggcggcgtgaacgacatgcaccaaaggctcgtcaaggcacggcgcatgatccgcagacgcatccgcgagggccacctgttcacgttcctcgacgaggggctcgcgtccgtcggcccggtgccgtccaccaacaacctcgtcgaatcatggaacgcgcgcctgcgcgacatgctgcgccgccaccgcggactgcggctggtcagacggctgaaggcgatctgctggtggtgccaccagcacacggcgcatcccgagaccgacgcgtggctcgcggccaacgcgatgaccgacgaacgactcgagcgcctctaccggcaggcatgggagagaagcccgcaaggccagtacgagacgttcggcatccccgcaagatacggcaccggcatcgactggaacgagttccacaccagggtcgaatggcagtcgaacgactagaccaccagacacacattttggcctataacccgtgaataacgtatctataaccgttcggagaggttcgatatacgggctgcttggcccaaatggcgccggtaaatccaccactctgaaaatgatcacgggcatgctccgtcctaccagtggcaagattctgtttgatggacatgagtggagcagaagagatctggaacagatcggagctttgattgaaactcctccactgtatgagaatctttccgcaacggagaatttggaagtccgtgtgaagttgctggatattcctaaaacccggataggtgaagttctaagaatagtggatctgcaagatacgggacggaaaagagccggacaattctcaatgggtatgaaacaacgtttgggaatagccatcgctctgttgaatagtcccgaattgttgatcctggatgagccgacaaacggattagaccctatcggcatacaagaactacgttctcttatccgttccttctcatctaaagggatcactgttattctatccagtcatattctatcggaagttcagcttattgctgacgatattggtatcatctcaaatggtgttttgggatatgaaggaccaatgaataaggatcagaacttggaagaactatttgtcgaggttgtaaggaaatcacaggaagaacgatagtatgatcaattatatagcctctgaatacctgaaacataaaggtactttcgttaggaaaatagcatggatagcccctatgctaacggtatgtcttaatgtgcttgctcctatgtggtatcagcagaattcatataactggtggtatgtgttcttgtatcccggttgcgtgacgctattatcaatcctgataattcaaagagatggcggcaaattacagtttagggccatattgtcgttacctgtcgacctagagcgggtatggtatgcaaagataatcacctgcatactttatgcggcactcgccaatgcaattctgatgttgtgcaatattgcaggtggtttcattattcaacgcatcttcggcatacccatgacgatcagaccgatgcaggcattgttcggaacgctctgcatcattttggcaagtgcatggaatataccgctatgcttatggctgaccaagaaggtgggtgtattcgccactctcatattgaatgtcggaatgagcctgacgctggggatattggggcggacacaggcctttggttcctgttcccctatagttgggttgatcgccttatggttcccgcattgggaatattgccgaatggggcatcagtacaaggaagtaccctgtcgactcccttactgttggtcatcgcggtactgtgcctgtcggtgtttctactatatggccttgcgaagtcaacggcaagatcctttatcaatcaggaggttctttgatgtcgggtattatcagatgtcttcaagcggaatggcttaaaagcaggcatacgccattacttctgatccatgttctcttccctgtgatcggggcctgtgtttttgctggatatttccgtatatcaggttggggatggatgacggctgtgacgacttttttagaagttgtggcaattgtttttccacttgttatctctctcgtcgtaggtatgacggtcgaacttgaaaatgaagcaggtcattttcaatcaatccttggcgtggttccttcgcgcatgtcagtatatatcggaaaattggcatatcttatcattctggcagcttccgcaacggcgctttgtgtcttcttatttgctctgctttattcaagcgttccattctcgttctatatacgaccacttaccatgttgatattgtctgcaataccactgtatcttatttccatacttgctggtttcactctaggtaaaagtgtagttatgggtataggtattgcaggaagcctattatcggcattgctggctacgggacttggagactgtatctggaagttcattccgtggggctggggagtgcggtttatggattattgtgtcttgagatatgttaatgaggaacagttttattctggattatatgaactccaactaggattcatgatcatgcttgtctcttcaatggtgctattcatcgtaagcctgatgtggttccacagatgggaaggagcaaagggatatgaataagatgctgccgatgctttgtgctggtatcgcatgtctatctcttacgggctgttcgttgcaagaggggaacagcgaatatcccggagagcaatgttatttgaacaaggataacgtgacgaagttctcctgtatgggaaatgactacaccattctagaggatacggtctccaacaacggtctcggggcatgggtcgggtatgtccgacaacttgttgctgtggacgagacgggaaaggtaatacttcaagaggatcttaagaatggtaccttgcagactctggcgaagatatcggatctggtggataaagcccctggtaagtcccatgttcttccattcgtaaatgtgtatgcagcttctgatgccggcgactatctgattgtggatataaatggcgagtatcacaaagctgtcatagacgaagatgtcagagacgtggatagggtgtttgattttaaggacatgcgacaatccacgagttgcggattctcggtcaatccccgagatgcgacccagattctttgtgatggcgtagtctatcaagtaacttctgatactgtgtcagatggtgaactaggaagtcgcattgatcttcttgctaaaaatgtcgtatttgatgcagagacgaagattcctttgtcagaggaggaattgagggagattgactggtatggggaaaccttcggacggcatcgggaacaatgggtgtacaaggacgtttatgagatcaaccgtacagagaggactgaagccgttgcggtgcggataaatggcgtcttctatgttgcaaagcgccaatgaccgttttattgcatgcgtgaattatggaatagaagaggcaggcaggtgtatcatggcgacaatcctgatgattgatgatgatcgacccatcttggaacttgtgaagaacggactggaaaaagatggacattcagtgacgatccatacgtccgccgcccatgtgccccttgaagggctgaacgggtatgatctgattatattggacatcatgatgcctgatatggacggattcacctactgcggcaagatacgttcgttggtggactgtcccattctctttctgaccgctaagacaatggagagagacattacatccggtcttggactaggagcggatgactatctgacaaaaccatttcgtattgcggaattacgtgcgagagtacatgcgcatctacgccgtgaacagagagaacgacatgtgtcgcttacgtttgatcggataaagattgatctatccgcaaaagaactgctggtggataatatacctgtacctttgacgaaaagcgaatatctgatctgcgaatatcttgccggcaacagagggcaagttttttcaaagaaacaaatatacgaagccgtttttcccttctatgggtatggcgatggttctacaatttcgacgcatataaaaaacataaggtcgaagttcgaggaggccggtgttcaaccaatcgtaacggtctgggggataggctataaatgggaacaaagatgaagacgacgcttacaagaactttttatagatttcttgtatgtctgctttgcggactgtgtatgtccgtagtcatcccctttgcctgcatgatgttcgcctccagcatggggcttgtaacgtttgcggataatgccgaacggcaagcgaaaaatctggtgccgatactcaccgcaacgccagatgtatcagacgtgtatctgcccattgggattaaataccttcggttggatagaaactatggatccatagatacgaatatgaacgaagaagagaaagagaaggctctggcgtttgccgagacgggtctcatagatgcaggcggtagaacacagttcatcttcatcactcgagatgatgggtacattgttctgcagtacgtcataggttctcagtatctcaatgcacagtgcaacaagtacctaccgtctccggagatactgctgattgctttgatcatcgctaacagcttaggcttatgcgtctacttgacggttcatttcgccagagagctgagaaaagaattgacgcctatattagaagccactaaagagattgaaaatcacaacttagattttgctatcaggcattctcgaatacttgaatttgaaaacgtggtttcatcttttgatagtatgcgaaacagtttgaaagagtcattggaacagcagtggcgaagtgaacaagcgcagagagagcagatcgcatccttggcccatgatctgaagactccattgactgttatgcaggggaacatcgacctgttggatgagacgacgcttgacgaagaacaaaagctctatctgtcgtatgcgatgagaagctctgagcagatgagacggtacataaagatgatgattgatatatcccgaacatcctgcggatatcaattgcagatggaagacatatgcttcccggagttctggagacatgtcatatctcaagctgaaatcatctgtagagataaaggtattgtgattcagcagacgcagcacgctcttccgaaacatataactggggatggagtattgttggagcgggcattgatgaatgtggtttcaaatgccgtagagcactcgcccgtagactctccgctatatatggatgcggatggccagggtgatcacttgaatgtctgcattacggactgtggctgtggtttttcgcaagaggcattgaagcacgcgaaagagcgtttctatatggcagaccagagcagaggctccgaactgcattatgggatgggcctatatatcgttgacgtcatcataaaacagcatagaggagaactgctcctcagtaattccgcagaaaccaaaggcgccagggtcacgatacggctaccacgataagggaacgactcatgcgtcgttcccttatcatatctccaagcgatattcggcatggtggtcccggattcaacttagccgtcgactgacgtcgcggccgttgggctttccgcatgcgctatttgcccgtgctgccggctccggtgctttggccggtggccggcgatccgctggtgccgttggtgtcggtactggttgaagtcgatcccgatggatctttttgcgtcgagccggtgccggtgccgttcgaaccggtctggctgccgccggtgccttggctggtcaggtcctcggtggtcggattctttgaggtgccggtgccgttcgaaccgttggcggtgccgtcggttttcgaatccgaggcgccggcgccggtcgaacccgaggtgccgttggcgtcgaggtcggtggagggggcgtcggttttcgaatccttgctggttcccttcgaatcatcgccggtgcccgtctggggcagagtgttgttctgatcgggtgtgcccgttcgcgtgccggtgtcgttgcgcgcgggcgtggtcgtggtgggggatacgagattgtccgtgccgcgtccctgcgtggccagcatcacgacgccggccgtcaccgccacggcgagcaggccggacaccaaggtgacgatcatggcggtgtgcttcgaagcgcggaagcgggacttgcgcagctcatcgaccgagtacgtcctgccgttcgcccggctgaacacgatttcacgcggtctgcgtgtggaggaagcatcatcggcggtcacgcccgtcgccgtatcgggctcgtcccgaacgtcggtccggctgccggccgttcgggggtaccgccatcggcatcgccgttctcggcgtccttcgtgatcccgttgccggaggacgaggccgattggagtttttcgccggaggcggtgagcacgttctggtagatcttggtggccacggcggagacgacgtaactggccgccgctccgatcaccgaaccgccgatgccgatcttcgatgcgagcaggaacgaggtgacggcggcaagggtgcccgccacgatggatgagagggagattccttcaaaaaacttcttcacaatgcacgaccgtagggtgtcgggctgacaggttgcctgagactcgatggaagcggggcgaggcctacacgagaccttcaaaatcggccttcgtacaggtcggacacgccctgcggcgcacacacgtgcgtttcgcgtcgccgcagggcgcgggacatcgtcaattacgatgcagcgactgcccggtcggtctgatcaccgacatcagtacggcggcgaaaatcaaagcgaaacccaccagtgaactccacatgatcctctcgccccagaacaaagcggaaaacgtgatggcgaacagactctccgtgcacatgatgatcgaggcctgcgaggcgggcacgtgggccagaccgatgttctgcatgatctgggcgctcatcgtggcgccgaggaacaggtagagcacgctggccaccaccgagggcgccagccaaccggcgttcggcgcgggttcggtgaacgccgctcctgcgatgaacaatacgccggcgacgccgaactgcacgaaggtgacggcgatcgggtcgaaccgtttggtatagatgcccaggaaagtcaggttgaacgagaagatgaccgcggtggcgatggtcagccagtcgccggcgcccagcgacaacgaaccgcccggcttcaacgagacgaagccgacgccgaccagacagatcacgccggcgaccaggttgatggccttcggccgggtcttcgagacgatccatgtggcgaacggggtgaggacgcaataggccgccgtcagaaacgcgctgcgcccggggtcgatggtccgcaacccgacggtctgggtgaccatcgtaccccaataggtcaggcccgccaccagtgccggcacgatgatcttcggcgtcagatacggcacgatatgcctatggaacaacgccagcatgcacagacaggcaccggtcatgcgcagccccatcagccattggggtgaaatcgcctccatggcgattttggcgagcagatagctgcctccccacaacgcggcgcagcacagcagcatgagtctggcgagattcgggggaaagctgcgtgaccagcggctgcgcaacttgttgcaacgatcgaccaaacccatggtgcacctctggacggttggaaaaaacttgtggctctcttggctcacagattacggggactaccggccaaaaccgaccggtcggcgggtatcgggcgcgtatcgtcccgtattgccgccggcgggcggaagcgagatgaaaaccatgtgaaggtgaggatactcacagtgagcgcccgggccggtcgcgtgcgaaaccggtattctggaaaggaacagacatggttccgcaacaatcttgaaaggattcgacatggcagtcatcacaccgcagatcaaggaattcatcgagaacaacctcggctggatcaccaccgtctccaaggacggcgaactggacctcggcccgaagatgtctctgttcgttctggacgacacgcacatcgcctaccatgagcgcaccgccggccagcactacgagaacctcaagaacggctctccgttggtcatcgccttcgccaacctcgagaagaagcagggctaccgcttccgcggcaacgtggtgctgcacgttgacgacgacatctacaacgagcaggtcaaggtcgccgaggaaaagggcaccaagaagccggccgtgattccggttctcgaagtcaccgagatccagaaccttgcctccggcccgaccgccggcaagaccatcgccaaggactgattagctgacgtattggtggcttcctcgtcagagggagccactttttcgctttttagtgcgcagtactaggtgacggccttgggcgtcggtggtggcgaagaggtaggtgctgccgccgtccttgagtttgagttttttgcgtagctgggccacggttagggggaaattgcgtacggagatgttggcgtgcgtgagaccggccaatagctgcttcagttctctcttgttcatggtggcgatggattcgatgacgaatgctctgcctggaaaatcggaaataggttcggccgccacgaacaggtggctattcgggctgatgtgatgcacggcgaagcgctgttcgagaacatcaaagcacccggccttcatgattgaggcgttgggttcgtaaaggcacttccaatgcgaggaatcgaagccgttcgcgctttcctcagccgggagatcctcggtattacaggtattgcatgcaactaaggcagaatcgctgataggggtttgattgtcgctgttatcgccggccttgtacgacagcacctgcccgtcattgacgcataccacgagcggcgaggcgcaacggccgcgccccaacaccagcaacaattccttgcattcattaccggtggagacgatatgcacctcgtgcaccgcgccggcgaaatccgtaatggtcttatgccagtcgagcatgggggagagcttgaccatgaccgtcggtgccttggccagcagcgtatccttcagggtcagcacatccggcgtgcaatcggcaatcgcgtaggtacgcgagccatgatcgtcacggcgggccggatcgaggaagatcatggaggctcggccaagcgtatcaagcactgctgttgaatcatcattgatgatttcggcgtggccaaggccgagtattgggaaattatggcgagcgatatcacataaagtggattgttgttccacatatatggcacgattgaacactcgggacatgtaagaaaagtcgacgccgaaaccgccggtcagatcgactagggatgtcggggaatcgtcggcgtcgtcgactgcttccccgtccaacaatcgctgtgctaaccgggctttgtattgagccgtgaactggctggaacattgttccattgggacttgcggcgggaaaatcagcccatcatgggacgcccagtcaggtagcttgagtgaagcacgctgccagccggcaatctgctccagcgcgaacggcacatccacgtcgccatcatgtttggcgtgcaaggccacatcacgcacatcttcacggcggtgtttggcgatgaacgcccaggtcgactcagaaatctccatgccgccattctaggggttgtgctgagatgagtatggcaaatcgcaagagaacgaggtggcgaaaaccgatgatcgatgaagtgatgatgctgcgtcatggccgtacgcgatacaatctcgaacaccgtctgcagggccagatcgatgtgccgctcgacatcgtgggccaatggcaggtcgatcagaccggattcgcgctcgcttcacggtattactgggccaaggtgaaccgacttgccgagcatcccgaagccatcgcccagcccggtcctgacgccgctgaacgcactgatacgcgacagttcgaggaggctcccgccgccggccggcgcatggtggtgatgacctccgacctgttccgtgcccaacagaccgcacacgccttcgccgatattttgggattgccggtcacctgtgaccaacgactgcgtgaacgcagcttcggcgagtgggaaggcatgacccgcgccgaaatcaaagccgttgcagccgacgactacgcctcttggaaacagcacactgggggcgaaaccaagcatggtgtggaaagccgtgccgccgtgggccagcgaggtgccgatgccgtgcgcgcactggtcatcgactccgcctattcagacagcatgcccaccacgctgatgctcgtcacccatggctcatggattaccgccaccatctccaacctgctcgaactcgacccggacggcatgaacgcactcggcggcatgcgcaacgcctgttggtgccggctcaaagtgcgccacagcgtcaacggcatccccgccgaacagcccctgtgggagttggaggaatacaacaaggctcccgccatcgccgacagcgccgactgggagaacgggccgaccgatctgcgcggaccgcacatgccaagttggcagccaatcgtctggtgacggtcgctatgcgaaaccccgctcgcaaattcgaacggtgggtctagactgattgcggtttggaaccgtacagcgatagaacagtaggaaagcgcggaaggcgggtgaggcgacatgctgagaatcttcagctcaatcaatggccaggtggagcagatcgagaaaccggaaaacggctcctggttatgtttgagcgaacccactgatgtggagctcgccaccgtcgcctcgcagaccggcatcgacctggccgacctgcgcgcgcccctggatgacgaggaacgttcacgtgtggacgtcgaagatgattacacgatgatcatcgtcgacatccccaccgtggaagagcgtggcggacgcgactggtacgagaccatcccgctgtcgatcatcgtcaccgaaaacctcatcatcaccgtctgcatgcaggacacgcccgtgctccacccattcatggaaggcacgatccgaggcttcaacaccttcatgcgttcgcgcttcatcctgcagatcctgtaccgcaacgccacgatgtacctgcgttacctgcgcatcatcgaccgcgaaagcgacaagctcgaactgaagctgcgccactccatgcagaaccgcgaaatcgtgatgctcatggagctgagcaagaccttggtgtacttcaccacatcgctgaaatcgaacgaaatcgtgatggagaaactcaccaccctgcaacgcatcaagcaatacccggacgacgaggacctgctcgacgacgtcatcaccgaaaacaagcaggccatcgagatggccaacatctacagcggcgttcttgcgaacatgaccgacgccttcgcctcgatcgtgtccaacaacctgaacaacgtgatgcgcatcttcaccatcatctccatcaccctgtccatcccgacgctgattttctcgatgtacggcatgaacttcgacggcggcatgatgggcatgccgttcaccgacaagccttggggcttcctgctcatcatcgtgatctccatggtgctttccggtgtggttgcctggttcctcacacgttcgcgcatgttcaagtaaggcgtttgacggttatgcaccattggtcatcgttcgccaaccgtagcatgctccgcgctcgccgcccgatgcggcgcggatttcgctctcggctgatggcaggattcgccgcggcctttggcatgatattgccattatctggtctggccggttgcggccaaattcaagtcaccaccgtctccggagcgccggagggacccaccatcgccattggggtcgcagccgacgaaccatcggtgggagcatggcatgacggcacataccagggcttcgacatcaccatcgccaaatacgtggccgccaaactcggctatgcgaacaagcagatcgtcttcaagcaggttcgccccgaaaaccggcgctccatgctggacaatggacaggtcgacatggtcgtcgcctcttggcctatcaccgatgggtccagcgcgatcgttgattttgccggaccatacctcacgaccagcgtcggtttgctggtcaggtcggatgagcgtggccgattcaccaatgacgcaggttcggtgggcgatgtaggcgacggcacggtgtgcgcagtgaaaggtgacgagacagtcggcatcttccgcggcaaccacccgcaggctcggattcaggagcgtagcagttatgcgcagtgcgtcacggccgtgcaagtagggtcggcggatgccatagcctccgatatggcggtgctttccggtcttcaagcggccaacgggccccagtatatggacgtgattgcggacaagggcgaggtcagttatggcatcgccgtgagtcaaggcatcagccaattggcgcagaaaatcgcggaagcattggaagacatggttgaggatggcagctggacggccgccaaggatacgttcacaagccaaacaaagctcacggtttcgctgaacggtgaccccaaagccatcgtctcggatgctgaataacgattgacgacgtgtccagttgcgaggctaccttgctgatttatgagtgacaacgagaagagcacgcaaaccgaagagcccaacttccgctacaacgccgcactggcgcaggacatcgaaaacaagtggcagaagatctgggatgagcaaggcaccttctgggcggccaacgtcaacggcgatttgaaggacggcaagggccgcaacgccgaggggcgcaccgcctacttcgccatggacatgttcccgtacccctccggcaagggtctgcatgtgggccacccgctgggttatctggcctccgatgtgacgagccgctaccaccgcatgaagggcgagaacgtcctgcacgccatgggctatgacgccttcggcctgcccgcggaacagtacgcggtccagaccggtcagcatcctcgcgtgaccaccgaggcgaacatcgccaacatgagccgccagctgcaccgcatgggccttggcttcgacaaccgccgcacgttcgccaccatcgaccccggctacatgcgttggacccagtggatcttctcgcgcatctacgattcctggtacgacgaggaggccaccaacccgtccggctccaagggatccgcgcgccccatcgccgagctcgtcgccaaattcgagtccggcgagaaggccattcccgggcatgagtccgacggcgtggcgtggaccgatctgacgaacgcccaacagcaggatatcttgaacgacttccgcctggcgtacatctccaagtccccggtcaattggtgcccgggcctgggcaccgtgctggccaacgaagaggtcaccgccgaaggcaagtccgaacgcggcaacttcccggtcttccagcgcgagctccgtcagtggtccatgcgcatcaccaagtacggccaccgtctgatcgccgacctcgacggcatcgattggcctgagaaggtcaagctcatgcagcgcaactggatcggtgaatcccatggtgcctccgtgcacttcaccgtggccactgccgacggtgacaaggacatggaaatctacaccacccgtcccgacacgctgttcggcaccacgttcgccgttgtttccccggaacatcacctgctggagaacgtgcccgccgaatggccggccgatgtacccgaagactggaagggcggctatgtcaacccggtcgaggcggtgaaggcctacaggctcgccgccgaagccaagaccgccaaggaccgcgtggacgagggcggtgagaagacaggtctgttcaccggcctgtacgccaccaacccgatcaccggcgcgaagctcccgctgttcaccgccgactacgtgctgatggactacggcaccggtgccattatggccgtgcctggtggcgaccagcgcgattacgactttgccgtgaagttcggtctgccggtcatctacaccgtcaagcctctgccggattccggcgacgacttggccaactacgagggcaaggcgccgttcgtttcccatgacggcatcgtgatcaactcccacgtcgaatccacgtacgccaagggcgatgcgctgtcgctcgacggcctgcgcgtagatgatgccatcgccaaggtcaacgcctggctggaggacgccggcgtcggcaagggcaccgtgagctaccgtctgcgcgactggctgttctcccgccagcgctactggggcgaacccttcccgatcgtgtacggcgaagacggcaccccgcacctgctgccggattccgccctgccgatcagcctgcccgacgtgcccgactacgagccgcgcaccttcgacccgatggacgccgaatccaatcccgaggcgccgctgagccgcaacgaggactgggtcaaggtcgagctcgacttgggcgacggcaagaagacctactaccgcgacaccaacaccatgccgaactgggccggatcctgctggtactacatgcggtacatcgacccgaccgacaccaagcacatggtggagaaggacgagttcgactactggatgggcccgaaccacaacaagtactcgggtgatgaaggcggtgtggacctgtacatcggcggcgtcgaacacgctgtgctccacctgctctactcccgtttctggcacaaggtgctcttcgacctcggctacgtggattcggccgaaccgttccacaagctgttcaaccagggcatgattcaggcctacgcctacaccgacgaccgcggccagtacgtgccggcggacgaggtcgtggaagggccggccgacgcctccggcgagccgacgttcacctggaacggcgaacacgccaaccgtgagttcggcaagatgggcaagtccctcaagaacatcgtgaccccggactacatgtacgagaactacggtgccgacaccttccgcctgtacgaaatgagcatgggcccgctggacgagtctcgcccgtggaacacccgcaacgtggtcggtggcatgcgcttcctgcagcgtctgtggcgcaacgtggtggacgagaccaccggccaggcccatgtgaccgaggacgcgcccgatgagaagaccctgaaactgctcaacaacacgattgccgaagtgaccgcggagatggagggcatgcgtccgaacaccgccatcgccaagctcatcgtgctcaacaaccacctgaccggtctgaaggccgtgccgcgtgccgcagtggagccgttggtcctgatgctcgccccgatcgccccgcacatctgcgaggagatgtggagcaagctgggccaccccgagtccctgtccgccgagccgtggccggtggccgacgagcgttacgtgggccacgataccgtgaccgccgtggtgcagatcaagggcaaggtgcgtgccaagctcgaagtgccggtcgacatcgatccggccgatctcaagaagcaggcgctggccgccgtcgccgaccgtctcggcggcaaagagccgcgcaaggtgatcgtcaaggccccgaagatcgtctccatcgttcccacggagtgacttgttgcgggttaggctcccctctttgaggggagccgctcgcgtggcgagactgaggggagcgtcaaccgccccacctcaattgtggataacttcataagctagaaccacataccccgtttcagctggacaaacgcccatgaatccatcagcgtggatgcatgggcgtttctcataaccatcgcgcagaccatgccgccaaccgtttgcgcgcattcagcaggcagagcgaagccatgccccaaccgcgagtggaacggcccacgacgcctccgccgcctcccggccatgcacggattcgtccggccggccacccaccccaaagggcgcagagcggcctgcggcaggcgacccgtgacaaacgtgcgttatcggatctgattggcgtacgttccgccgatgccgtcggagaatcagccagactcacccgggatcagccgcgattgtcgttcaccattgggcatgccttggccgtgatattgctgctgatcgtcgcccttggcatcagcttggcattgctggtccagcagtcgatgaatatggccatgctgtctcaaccgaccgccatgcagaccacgggcggctccgctggagatcagacgatgccatcgcagaacaccacggacgagaaacgcacggatccgcagcagtcggagcattccgatgccacagcgaaccccgaatcggataccacgcaatctccgcacatgcagacggacggcagcgatgccggcgcttccacgcatggtctcatcaacctcaacacggccaccgctgaggaattgcaatccatcaaaggtattgggccggttaccgctcaacggatcattgatcatcgcacggcgattggcgggtatgcatcagtcgatcagctgctggatgtcaaaggcatcggctccaagacgttggagaccatgcgagggcaggtgacggtcggatgagcagggatcggatactgcgcgagcaggggagccgcgattggaggatgctgccgatcgccatagtgatgtgggcggcgagtctgggagcgcacgcattattcgcatggaggatgtctgatggactcggcaccggtcaggcaaaggccgatgccggagctggcattgacgccaccataatcggcatggaatggcctgtcacacgaatattacctataacagtggcgtcatgtgctgccgtggcggcgacgatcgtggtgtctttccgcctgcggatcaggtggacgggaacattgaccgtatgcgtcgcggtggcgtgcatcggcagtatgacggcaatcgcgtcggacaccattgcctggcatgatcctgcctccgcacaagctcgccaatccagttcataccacgaagtcatggccacggtgacgacgcccgtgatcgcttcggaccaacgcacatacgattgtcagacggacatacggctgagcggcatcactgtggatggcgcggacgtacgttccacggtcgccgtgcgcgtatacgccgatgaatcgtattgtgggcagttgcgtcgaggcgcggtctatctgttgacgggcgtattgcagcaagcgcgatatggacgcataccgctatggctgctcttggaaggaaaacagccggtagcgcaggtgcgggctccgccgtggcatctcgccgcgattgcgcaggtgcaggaggcgtttttcaccgtgaccggacaattgtccgatcaggggcgtgtgttggtgccgggactgacgatgggtgtgcttggccaggattatatcggcggcgatgccggtccgatgccggtcaacagcacgtatgcgcaaacgttggaaaatcagttccgccggtccggcatcatgcacctcatggccgtatccggcggccacttcgtactggtggcaggactggtgcgtcggttatgcatgtggatgctgcttgatcggcggctgacggcgttgctggtctctggagtatatgcgctgctggcattggcgatgttccccagtgattcggtcacccgcgcgttcatcatgggattgataggtgcgttggcgtatgcgatgggacggcgtacgcaagcgttgagcgccctgtgctggacgataatcggtgtattggcggtgaacccggatatgtcggccagctacggattcgccttgtcttcggccgccgtactgggtatcgtgctgtttgcggggcggctggccggtgtctttgagcgagcgatgccgcacagcatcgccgaaatgatggcgatgaccgtggccgcgcaattgttcaccctgccgattcaggtgttgatggaaccggaattgccgttgctgtccgtgccggcgaacctgctggtgtcaccgttcgtgggattggccacgatggtgggattgatggcactggcctgcgcatggtgcacgccatggctggccggcgtattcgcgtggatatcgtcatggggcacgctggtgatggaacgggtggcgttgtggctgggcggcagcacgatggccgtcatcccatggaaagacggcgttacgggtgccgtgctgattgtgacggcggaaatcggtatcggcatgctactggtgttcgtcagccgttgcctccagcatgtccgtcgttatgaggccggaatgtctggcgtgcgcttcggttccgcttggcgcgtccgcctcagtctctggtgtgaggagacgagacgcctctttacgtggcggcaagccgaatagccaatgcggtattcggtgcagcaaccatcgcaatcccagccgaataccactatcttgacggcagcggcaaaatcgtgatgccggcaggtcattgtccaacctgtgtggcgagatgggggcatggcgaaaacagcagcgaatgcaccggtaaccgtggtgcccggaggcgactcgtatttgaacgacgcgcgcaccaaggcactgtgcgcgcaggcgttgaaggcgcggcccgacgccgacctcatcgaactcgacgccacatcggccgaccagtatgccttcgatgaagccgtcagcccatcgttgctttccgacgttgccgtggtcaaactcgtcaacctgcagaatgccgacgacaagctcgccgaagctctggtggcgtacaccaagcaggccgccaaggatccgaacggctccagcgtggtgatctgccagcacgagggcggcgtcaaagggcgcaaaatcatcgaccaactggtgaaagccggcgctcgcaaagaggacgtgccggatttgaagaaaccggatgcacagctcaatttcgtgctcggagaattcgagaaacgtggtcgtagagccgaaccgatggccgcacagcagctggtatccgtactcggcggcaaaaccggcgaactcgccgccatgtgcgagcaactgtgtttcgactttgacgataatccgatgggcctcgaccgtgtcaaccagtatttgaccgccaatccgcaggtcaccggttttgccgtggcagacaaggccgtggaaggcaaaaccgcagaagccatcgtcatgatgcgtgcagctgtggaacaagggaccgatcccatcgcgctgatcggcgcgttggccatgaagctccgtaccattgccaaagcctcggcggtacgggccggcacgatttcccaggccgaagcgaaaaccaatccgtgggtgctgaagaatgcgatgcgccaacttggcggctggacttcggcaggactcgcgcattgcatccgtatgctcgcctgggcggatgagcaaagcaaaacaaacggtggcgacccggtatatgcgctggaacgctgcattgaagacatcagtcataaaggtcggtaaaagtcgataaaggagtatttatgagcgaacacactattgcggctcccaccagcgaggccatgcaggagctcggccgtcgtgtggccggaatggtacacggcggcgatgtattgctgctctcaggccctcttggtgccggcaaaaccacattcgcccagggcttcggggcggggctgggcattaccgaacccatcgtgtctcctacattcaccattgcccgcgaactcgacgggcatttcgccgacggcactccgtctcatctggtgcatgtggatgcctaccgtctgggcggctcagcctatgcgccggggcaggacgccatcgggcgtttgttggacgagctggaatcgctgggattggacgaagaacttgaagaccccggcgagaacacggtggtgcttatggagtggggcgaacaaatggccaccgccttggcgccagaacgacttgaaatccatatcgatcgacctctcgattcctccgatgccgcatccgctggatcagacggcgaactcaccagcaacggcactcgtaccgtcgcattcgtcccagtcggcaagcgatgggccgcgttcgatctgcagtaagccatgcgcctatagactcctcgatgtacactctctagaggctttacgactaggaggattcatgggttgcacgttggtgattgacacctcattcggctcgacggtcggcattgtggggcgcgagcccattgtagagaccgattcgcgcacccatgtggagaagctgcaggtcaatatcgcgcgtgcggtcgaagaagccgggttcccagcatctgacattgcaacagtcattgtgggtaccggtccagccccctttactggtctgcgtgccggtatcgttacggccaaggcactggctttcgcaacgggagcgacgcttatcggccataatgttcttgagtctcaggtgcaatggaatctcattcgccgtggcaaagccggcactctcgacgatactcataaatgccatgtgctcactcttgccgtaaacgacgcacgccgcaagcaactctattttgcgttgtactcggacccgctcgttggcgatcccaatggcgaaaccgtggcgacggctctgattgacatggacatcgattaccctgcatccatcgcgcagcgcgtgaatgatgccgttcatacgtaccgcgacggacttatgccagaagacagcaatgtggatgtggtcgtggatgttgtgggtcatggggcccgcaaatatgcggatgcgctgggtgcaatcgagcagcttggcgacatcaccgatgaatccgtattggaccaaggggagcaaggtctcgctatctttgccactgatgcggaactggttgccaaccgtaatcccgatacgccggtcgaaccgttgtacctgcgccgtccggacgccgaagtgccgaatccgctgaagcacgtgctcggccatgccggtgccgataaggcgtgaagtgggttgtggtccgatgattgttgacatcactgccgtaagtcgtgatcttgcggtttgctccatcgcacagttggaaggcgaactgttcggcctcggcgcatggaatgcgaacatggtgcgagaggaactggacgcaccggcccgcacgtatctgctggatgtgctgggagaggtggaacaggcggttgtccgcggctacgccggcttctggtatgacggcgaggacgccgagctcatgaccatcggcgtgggcaaggcataccagcggcaaggcatcgccgctgcgttgcttcaggcactggtcgacgaggcgaagcgtcagggcgcctcgcgcatgctgctcgaagtgcgtgtggataacgaccctgcgttggccctgtatcagcggttcggattcgaacgcatgggattgcgcaaacgctactaccagcccgaaggcatcgacgcatacaccatgagcttggacctgaaacctagggtcgtgggctttgccgccccgcagacggcatcggcggacactgaagacatcaccagcaagcaaacggagaagaacggagaagcacgatgagcgaaccggttgtactgggcattgaatccacctgcgacgaaaccgcagccgccatcgtacgcggccgcgaactgctctccaacgtcgtggcctcatccatggaggaacacgcgcgatacggcggcgtgatccccgaaatcgcctcccgtgcgcacgctgaggccttcgtgccatgcgtgtccaaggcgctcgccgacgcgaacatgacgttggcggatgtggacgccatcgccgtgtccgccggtcccggactggccggttgcctggccgtgggcgtgtccggcgccaaggcgctggcctgggctgcgaacaagccgatttacggcatcaaccatgtgatcgggcacatcgccgtcactcagctgcagttcggcccgttccccaaggacacgctggctctgattgtctccggcggccacacctcgctgctgcatgtggaggacatgccgcgcaagatcgatgtggtgggcaccacgctggatgacgcggcgggggagtgcttcgacaaagtcgcccgtctgctcggcttcccgtatccgggcggcccgcgcatcgaccgccacggacaaaacggcgacccgcacgccatcaaggtgccgatgggtctgacccaaggcaaggccggtgccgcgcacccgtatgatttcagtttctccggtgtcaagaccgccgtggcccgttgggtgggaagcgagcaggccgccggccatgagattccggtggacgacgtgtgcgcatccctggccgactccgtggccaccgtgctagcccgtaagtccatgcgcggctgccggcagtacgattccaacacgctgatcgtgggcggcggcttctccgccaactcgcagctgcgcgccaaactgctcgaattcggcgagagctacggcgtcgacgtccgtatcccgcaaatcaagctctgcaccgacaacggtgccatggtcgccatgctcggcgtgaacctggtcgaagccggcgtggccccagcgcccccgacttcccgatcgactccgccatgcccctgaccaaggtctcgatgtaagatttgcacggtattcccaaactgatactgggaataccgtgcctctcatcggtgaattgacagtgacctgtctgcctgatgtgagtagtggtgaggtcttcgccatggatttcccggttgatgatggggtgtcgtgtctggtcaccaatgcgatgaaaataaaaaagcctcggagaaccgaggctttcgatggctcctgcgactgggcttgaaccagtgaccgtccgattaacagtcggatgctctgccaactgagctacgcaggaatattcaattttcatcccgtccggagttacccgttcaggtgagctcctgcgactgggcttgaaccagtgaccgtccgatatacggttctggcttgcagccgtagggcttcttgcaacaggtgtagagaatacacctgctttgcttgtccttcaaatcggcgtgtctcgacaattcttctcgatgcacccggttttccgaagagcttcagccgtacggaagagaccttgagaacccgatggtatcaaatcgtccgtttctccaaaatcgtgaacaagagcatcacggacgtgaccgaagacgacctcatattttatcttgccggcatgggaaccgaaggcagacgcggagtgcgcagctgcgtcaaggtcttctaccaatggggcatgaaacgaggactcgctcgctgcaacccgacggacgaagtgcccaccgtccccgtcacccttccttccggccgcatctgcccggaggagaacatcgaacaagggctcgcatcacccagggacgctgcggcgtcgattacgtggcgaggaggatcaagacggcaaccggatacccgtcgcacagcctgcgcatgccattgcagaccctgaaaccgctgggacgccaccggaaccgttggtagacaggaaacccaaacatcggctgctgcccatcacacccatcatcgacgatgagccgcctcgtgatgcgcggaacaatgacactcccgtctccgagtctgacaagcagacgggatcaacgatagacacaccgatggggatcggagaacatgccgaggatgatgcgtccttggcggaattatctgccgacgaagcggatgaggtagccgttcattggcatatcccttttatccgcatcgccggcatcatgctcattctggccatcgtaacgggatcagccgcaggccttgtcatggcgaagaagaactatgaccatcaggaggcgctcacgtcatgcaatcaagcaatcaaacaaaccggcatagtgcggattgcatggaacaaagcgttgaaacaggcggaaccatatgcgaagctccaggataaagacgtgcaggatcccaagtctttgggactgctcagcaaaatcatgcaatatcagccatcggcctcaacggagaatcgcgatccgagtctgacggccgaccgtctcgatcgcaatcgtgcagaaatagggagagagaataaccagctcagaacccagatcaggaacctgcatgacacagttggcacgatcaaggcgtcacaggaacaacaacggatcgacaacgcacagaacgtactgagacaaaccattgaagacgccgataggctctacaaagaatctgagaacaaggtcagagacggcaacacccgcgtacggctcaacgagcagatcgcccatgcacgactcatgatgcacgaccgtcagaatcttgatgcctataacggaaccattcaagatctcaacgaggtcatgcaaatcgttcgggattccatgacgactgtagaggatgaagatgaagatgtatccgatacagactgttcggatgattccacacagccgggctcggatcctcaatcatcgaaccgacgacccgcaccatcatcggaaggtttatcccagccagttacgcaaggcaatcccacctgggatgtgcccgggcaatcggcaatcccttcattccccgaccggctaggataatgtcacctgcaggaatgatcaggagatggtgcggcggtattcgtcgagctttcgggccggtcaatctcgacgacgccgaacgtatcagggagtatgcggttgaactcgaccaatctgccgttggcagtcacggccgggctgacagacctgaccagattaaagcgattctaaagaacaagaagataggtgctatcccacggaatatatgggatagcacctatctcatatattgcggtgattgtatttattaagaacgctgttcgcgtattcaagatgagattcagcctgttgcttcatgagcttatcgctcgctatgatatcgttcttctcctttagtaattcccacggaaaaaaactgtatttatgagacggttcggtatattccggaagttcaggtctttcaaattcagtcaatccgaattctcgtgaatttgccttttcggtctccgctgagaccaaagtcgctaaattccagacaacttgatctgcttcccactgagaatatgcagcagatacctggaacatcagtatgcctgtcatgcagacatatatcaaggcaatgactgatatagcctgaacccatctgttactcttcatgccattcaggctcattttctcagtcataacgatattgaagcccataccaggtcatattattttttccttgttcatgggcatgctgcagcgactccgtcaacgtgatttgatgacgattctctgtcttctgatctatgaccggattggctttgccgtcctttacgacaacacccacgacgaacatagcgtgatcgatttcattatttgaggtccaatctacatacaatatgctgccttgccatgctttccaaacattatccaaactgtcataactatgcgaataatgcttcatgtacgaataattgctatccgcattcatccaagcacgtgtcgtcagcttgtccggcaatacagtagagtaattccacagtctggtcagagtcattccaccttcatgaagagcctgcgagacaaagtttgcacagttagagccaaaagacggatacgcggaattcattttatgctcatatccaggactcgtccatttattggcataattcatagccttaatataatttactccgacggagttgtccccgaaggcatatgtctgagccttgttgagtgcttcactttccaatgcgccattttcatccaaagaagcaggtgttttgtcttcggtcggcaatttatccgatgcgtcggcatattccggtggatcttgttcatcaatcactttgtcgctaataattgaataccctcgctgccttcccacatgggcaaactccatgatatgcgtagaagtccaactctggtcaagatggtccgtgcgcttaccattaacataaataacagtatccgagtctgcgtccagactcacgttcacggtcatatctgtatcaatcagatactctccgtcatctgatgattgaatgcttctaattgtcggtacgacttcaacattcttgctgataagaccctctttggcttgttcctcagcggtaagtgggatattcagtttggacctcgtacgcggcgaatgatattcggctaatagttcttgtgaatactgatgaagcgtctgctggatctcttgcatctccacattgtcgcttccatacgcatatgcattcgcaggaagcaacaaagtcggcactaaaagagcagtcagcagaggaataatcttttttcttgcatttaacacataatagcatcgaattcaggagacctgagttctaaatagaagcgcaacacctgtctatggttggaagtgttcaagtccacaaccgaagagaaagtgctgcgctcgatatgaaagcttattcccacctgtcggcagaggaacggatccgaatcgacgaattgcgcaacagggacgggctcggcgtgcgtcagatcgcgcaggcccctgcgcatgtcctactccccgttgctcgcatgggtgatggacgcgctcaggaaggggtggacgccggaaaggatcgaggggcgactgaaggtcgaatggcccgacgacccgcgcatgcggataagccacgagtgcctctaccggtggatctacgcgaaaccgcagagggcgctggacctcaggcagtacctgcctcgcggcaagcggcaccgcacgcgttcgaagggcaggaggtcgaaggggccgcgcattccgatgcgcgtgccgatcacggaccggccgaagaaggtggactcgcgccatgagttcggccacttcgaatccgacaccgtggtcggcgcgtccccgtccaagcggtgcatcgacacgcaggtcgaacgcaagagccgccgcctgttcgcccgcctcatccccgacaagggcgcgctggcgaccgcgcgcgccgaatacgacatctacaaggacatccccgcgcccgcgcgcatcgaccggacatgggacaacggcacggaatcctcctgccacgtgctcgtggacgaggccctcggcatgctcacctactatgcggacccctactcctcataccagcgcggcacgaacgagaaccgcaacgggcgcatccgccgctacctgcccaagagaaccagcttcgacgacctcacggacgaggatctgcaggccatcgtcgatgagatcaacgacacccccatgaaggtcctggactgggaaacgcccaacgaggtttggtaccgcgagctcggcaaggtaatgtcgaagacaagccacccaaagacgggtgttgcacttataaattgaatccggggggccggaacgccccgggaagtcaacggcgacgacagggagacgacgatggagcagccgaccacgatcatcgccggggtggacacgcacaccggcatccacaccctcgccctgctcgacatgaacggcagggtcctttccacgaacaccttcggagccgacccggacgggtacgggcatctgatcgccatgctcggcgacccggcccgctgcgccgggatcggcgtggagggcacgaactcgttcggcgcggcgctggcccggcggctccaggccgccggtttccccgtgtacgaggtgctcaggccgaaacgcggcgtgcgccgcaaggacggcaaatccgatcccatcgacgcgatcgccgccgcgcgcagcgtgctggccggcgacggaacgagcctgccgaaaagctcggacgggtgggtcgaggcgctgcgccacctgaacgcggaacgatcccagccggtcacggcgatgaccacgccggccaactccaccggcggtctgccggccgccgcgcccgaaccgatcagggagaaatacaggggactgcgcaccgagacgcgcatgaaccgtctggcctcatgccgcccgtccggcggcctcgtcgcccacagcgtgctcaccgcgctcaaaggcgccgccaaggcatggagggcgctcaaggagcaggcggacccgctcgaggaacgcatgcggagcatcctcgacaccaacgcgcgtcccctgctcgacatctaccgcgccggcaccatcaccgcggccacgatcgccatcgtcgccggggacaaccccgaactcatccgcgacgaggccgcgttcgccaaactctgcggcgcgtgtcccatccccgcatccagcggcaagaccaaccgtcaccggctcaaccggggcggcaaccggcagggcaacatggcactgcaccgcatcgccatcgtcaggctcggataccaccagccgacccgcgactacgtggcgaagaaaacacgagaggggaaaagcaagctcgagttcatccgctgtctcaaacgccatatcgcccgcgaggcgtacaaggccctcatcgccatccgcaacggcggcgcgggacggcagacgccgcaggaacgcggcgcgctcctacgacgcctgcgcacgagccacgggatcacgcaacagcagatcggcgaggcgctggccgtgccctccagcaggatcagtgaaatcgaacgcgggacccgcgacctgcccgaactcgagcaacgcgccacccaatggatccactccatcaccaccccgacgacacgacactcccaaccgcttgacgatgaataggagcatcaaaaaacacagaaacgtattaaaaactcattattttgatttaaaatcaaattacttttccttgcaaatagcaattaaaaaaaaataaatgaaaagagtgagaatgttaattatattagcattgatacttttaatatcaagttattacttatatacgctatataatgaatcaagaaaaggaaatttagaattaaattatcaagtagggataaaaactcgatggacaatgtcgtctgaagaggtatggaattatgtacacaaaaaatattcatttgtttttctaattagcggcataatcgttgcattgatggctgcgatagtcataatcggcgcatttttgtcaaaaagcataaacaatctcaataatatctattggctagcaatgttatttattacagtattgttattgctatttgttatagcaataggattctgcgcaaacaacgatgcaaaaagttattttcttatgaaggaagagaagcaatgagtaaggtaaatgaagagaagcaatgagtaaggtaaatgaagagatgaccgaaaatattaacaatttatggtctgagttgattgaaaaccatgataaaaaacaggctttcatgaatcatcctaacgaatttttaaaatcggaaaaaataagcatatatctaaagactgtcaatggtagacatttcgaacttggagagttcatcggagaatcaccggcaaacgcccgaatggcaatattagagtcgattatctcaatgataaccaacacggttccgacttccgaaggtgaagaacctgagaggacgccttactggggcgttaacttcaatgcaattacaaattttaatgtgtggtttaacgcaaatgctgtagcgaatgcaaacgcaatgagcaatgcgaatgtgggcacaaacgcaaacgcgggaatgaacgcaaatgcaaatactgccaagaacgtaaatgtcagtggcgaaggaaatccgcaaatacaaagtgaacacaaaagggacatcaatctgacatattccgataagtatctaaaatccgaattacacaagtattttcaaaatcataatttaactacacatcgcgaaaaagtattactagtataccttattgaaaattccgggaacagaaagaacatcgaatactcgtttcatggacagaggataaaaatagatattgaaatggagggcaatatagctttaatagaaaatggcgagttaatcaaggaaaggaagtaagttcaatgagctggaattcgataattgaagatcattatatggaaatgctttcgaatatcagagagacagctatcgctacaaccgaccagtgtaatattaaatatgaacattgtctgatgatgtctggcccttcgcgaaaagaaaaactgtcatatcttttaatgaagcgcttcattgattcattaagggcaaaatcaaagttaaatactgttgtatttacagggaggcgagtcaacccttttaggcgaggatttgcttagcatcatatcctactgttcaagcattggtctaggaacacgtttggtgacaaacggctcgtgggcgattaacaactgtgctacagaggatatgatcctctatttattggagtccggtctcaatgaactcaacatatctaccgatgattttcatgctaaagaggtttccttagattgcgttaggaggatctggaaatgcgcaaaaggacgaggatttagtgcggttattttgggtgtatgtagtggtcccgagagcagagtaacacctcagtttttagagacatttttaggggaaaaaattccttatatatacgacgcaatgggaaacaaacaaatccctgagccaaatcaggacggaacagtatacgcaatttcaaatactggcatagcacctttggggagagggcaccatttaaaagatggctggtttcgaaaaactagaagagtggagcatccatttatcggaagatgtccaaacatatataaacccttgacactaatggcagatggaacaatcggcgcatgttgtggcatcaattgtgaacggacgtcgattctttccattaaaaatatatacaacaacgaaagctatttttccgacggaaaaccttcatatgaacagcaaataattatctgtgcacttgatgtcttaggcccagcatatttatacactattgcaacgggagatgcatgtgaacatatcagaggaataaatatatcgtcgtgccagatatgtgagtttctgttccgagataattctctgaccaataaattattccggtcaatagatcaaattgaatttgacgtaataagtcaactagtatctattgatatatctaccccaattcttaactaggggttttggatgaatactagactattttttaatagcgaatctattgatattgacgatggatatttcttacgcttggcattatctaatagtggatatctagatttgttgtcggctgtccctcccgcggctgatgtaattggtacaatcagctctatttacgaggagttacaagagcctttaaagtacatttgcgatctgcttctttttggaaaaaccgtttgtatggaaaaattgcctgaagctcttgttgagtctatattaaaaattagagaatctgggctcatcgcattgaggggaaatgccgtttcgttaaataatctttatttacagttggtcgatggattattatatttttcggaattgcctcatggaagacaaactctatattatggcacggattcttacgcattggcctgtcgtttggggaccgccccttctaggaataatgttctcgactactgtgccggtccaggaattcaaggattgctatctgcatcgcatggcgcacacgtaaccgctgtggaggttaatcctcttgcatcggagctctccttatgcaatgctagattgaataagctagataacctctttaatgtaataaacaaatcggttattgaatccgaaacggatttgaaaaatttaagatttgattttatctgcgcgaatccgccacttcttccaattccatttaatcttaattatccgtttgttggagatggcggcacagatggattaagcatttttcgacaaataatgaattatggtattcctcatttgtcgagaaatggcaagattgtaactcttggactttcaggtggtagcgaggttgggccagatatttactgtctagccgagcaacttcagatgaagtatcagatgaagtttattcttatcatcctatctcgggttgagattacccccagatccctatggattcaatatatggcggatacgatcaatatgtattctctgggtgagaatacggtctcatgcaatgaagtctttgaatcttatcagaatgaggatattagctttgtctactcatacacactctccgctatcaataataaatgttatggcagagattttacagtgattgaatgtgacgacaaaagtcagccgttaactcaatggtggatatcataacatagttttatttcttgaatgagataacacgaacgtcatatatctcagatattttcgtggaataccgagtttactctttgcaaggttgatatatatgattgcatcacctatagtatgtgacaagaaacagggatcgctgcttgagtccttacaaatatcggtatgtaaactttttaatatcggtaaactaaggatgttgattattatcagtctatcactggtgcgtggtctaattccaggtattcaggtatttctgattggtcttttgattgatgccgcggctaattcctattcatttcaatatgtacttaactcctctttctatcttggtggaacaattatatctgcttatctttttgataatttaattatatatttaagtgattcgataacaattgatctttcgaaggatgtagattttgatatagttgataaactatgcaatttagaggtacaacagttcgaaacagaagaaacatatgatctaattcaacgagctgataattcaacgggattacatatttttggcctatttgattctatacgatccactattcaatccggaataactatattcagtatcactctagtaatctggtcatggaatccgtttgttgcaatcatgttaatagttgcaccggtaccgtccgcaattgctactctcaaaatacagacaatggcgtacactatagattataatagggcatccgatcgacgagttgtatcatactatagatcactattaatgtccgatagcgcacgcaaggaaataatactattcaaatatgcggatattcttcgtgaaaggtactctgttttacaaaaggaatttcagtttcaagatttaaaaattgcgaaatataatttcacaatagccggatcgcttggatttatttccattattgcaattattgttgcaattgttttgggcgctcgttctactcttgaatccggaaacgttggagcgcttgctggatacataagtgcttctacttctataggccctcttatgctcgccgcgcttgttggcttcatggggctacatcaacatcttttatatatatcaaattgggttgcatttttgaagttaaatcctaagaccccgaaatcaggagatattccctataaaggttcggaccccgcttcaattgaattccgcaatgtttcttttacttatccaggtacatcatataaggtgttgaataacatttctttcaaacttgaggcaggtaaaacaactgctttggttggtcttaatggcgcagggaaaaccaccatcatcaaacttctacttaggttttatgaacctacttctggagccatttttctcgacggaagagacatttccgagtattctcgtgatacactttatcagcatttttctgcgctcttccaagactttgtcaaatatgataggtcattagcggataatgtcctttttacctcttcaagtgacgaccgtgatgtggatagaattctaaaaaccttatccatggtaggtttaaaatatttagctaatctacttccctatggactagatactatgcttggaaggcggtttgaaaatgggcaacagttgtccatcggacaatggcaacggcttgccatggcgcgcgcattatataagtcaccctcacttctaattcttgatgaaccaactgcgtcggttgatgcaatatccgagaattcaatttttgatgcaatgtctcaattgagtcggaacatgactacagtaattgtcgctcacaggttcacaaccattgcacattcggataaaatcattgttattaaggatggcactgttcatgcgattggaagccacacagagttacttgaacaatcggaattttaccgaaaaatattttatgcacaggttcactaccacgattactgaacggtttgttttcattccttttagaaatgattccgaagagtccttcatatagttaatatcggatatattatatgaatacgttgtttttatgtattattgacatattttcctgattcgaatggcggtatgcttctgagtagatagatgcactggtcagtggggatgcgtccgagttcgtcgggggggaggagtttgcgggcgttcttgcctgtgctgcgtgtccagctgccgttgaggcctttggtctcgctggtttcgatgacgtcgatggtttggtcgccgagtcggtcgctgatgtattcggtggcgctgggttcgttgccgccgaggaagagctggctgtcgcagttgcccgcgatggtctcccaatcgtccttgtagaggcttttgccttggctgacggtctggaggatgatgccgcagctgatgcgccggcttcgtatggttgcgatgagccttacgaagttggggattttgccgatgttggcgaattcgtcgagcatgcagtgcccgtcgtggtcgagcacgccgtcgggtttggtgtcggctttgcgtacgagtgtttcgaagaggcattggcagaagacgctggcgatgaaggagaatgtggcgctggtgtcgggcagttcgaggtagacgatccgtttgccttggtcgagggtttcgagccggatgtcgtcgccgtcgaggatgacttggttgagggtggggctgcaacatcgtgctcgtcagccgtatgctcggacacgtcaacatcgccaccaccatgcgttacatcggactcgtgcaggacgagatgcgcaacgccgtggaatccaccacccgcacggacatgagattgaccatgcccacgaaccaaatcgtcggcacaaacggcgtcgccacgtactcactcagcaccgcaagaataggatagacaaaaaaggtatgcgccgacatgcgcaaagaagcatgtcggcgcataccggcaccgatatcagaggcgtctgccctcgccggcggaaggcatcaggccggacaacatgcccatcggatcatcagtcatggatgcggaatcataggttggatcgattttcgtgttcgcactatccaccagcatgaggatccggtcacggatacgaggctccacatccgaatacgcctcctcgatgttggagaggaccagaccggccattctcctggcctggccgacgacccgctcgggatcgaggttgttttccgatgccagcttctcccaatgacggggcgtcacatccctggcaccggtgacgccgccgatgcgcataggcagctttcccgtcaagaggaagggaaaggcttatgggcatatccacacccttggcgtattcgaggggaacattcccctcggaatcctccagaaacacaccaacaggagaatcacccatccaggcgtgcagctccctcaccgggcactcccgagactggaaagcggcaacgcggctatgtctattcccaacacatcagctgcggggaacaccgcttcaatcggggcttcgccccgctggagcaaatcatcggcgaaccgaggatcgatgccggcccgggaggcgagatctccggcgctccaggaacggttcgccgcctcttcccggaaagcggccgcgatatccgattcggtgcgggcgaaaagagtccggcgtccacgcggcgtttggaaacggctgaggtaacgcgcgtactccagttgcgcctttgtcggctcaggcggtttatagtccagattcgacattgcaggcctccttaacacttgattactctagcctttacagataaatccagtgattatctcgcccttctcgtacaggctcgtatattcgtcgcccatgcggtcggcgaagtcccttaccctcatatcgatatcccattcgatgggaggacatccgaacgcgagttccacgtatcggggtcccaccgacatgccctgatcggttttcagatccttccagagcggtccacggattccttgccgccatcgtagcgtcggcctgcggcgtcgaacggttcgcccacccatgcctgcaagtcggagagcacgtcggcggcgttctcccgttcgcacacgtcacctcagtaaaccggaacctccatcgaggccatcgaggggaccaccgggcacgatgcccatcccgttctcggcatcattcgtcgccgccgaccttcacgccgtattcacgcaagcggccggcgtcgcgcacgaggccttcgccgatgatgcggttgtattcgcggatgtactgccaatcgactggatagtcgatgttctcgagcaggaatccccacgcgcgcttgatgttgttcaccgtgactatatcgtccacgctcataccctcgggcgcgcgcccgtcgaagatctcctgcgtgtcggggaaggtgacgccatcaacctcgatcttggcggtgcgccagatcgaatcgaccagcagccgcttcgccagttccacggccgtgcgcctatccgtcgtcgtatcgttcctcaccggttccatcaaagctccttatccgcttccgataattctatcgaagtggccgtgccggcaaaggacgcctgagagcgggggcatggagctcgtgttcgtgaggttggacgaccatacgccgctgatcattcatgcgaacaatctgaccaagggattccgcgacgagataaggaggaaccgatgactggtcgcaggtacatagccgagaacggcaccgaaatcaccgacgagctggtcgacaggtgggccgaggaggccgagaacggtttccccggcgccgaggtcaccccgttcgaggggcgcgcgtgggaggccgacaccgagcctctgcgcccgcgcaccatccgtctgagcgataccatggggcatctcatcgaggcggatgccaagcgcaaccacatgagcgtaagcgcatggaccagagccgcgatgaccgaacggctctcgcacctcgtagacgcctgacgcatcagacacagctaatacaggcgctgacaacgcaccgacgcataagagaactggcgtgtgaggtctcatcaagactgcacacgccagttctccaacgatgtatgaggtttgaggttatttgtggtccttgtcatgtggatgccaccatttacaccacaccaacaagtaggcgacgagtccccctaggaaaggcaggaaattaactaacttcatgatttaccttcgcatgaataaaaacctgttcagcagtgacttgaaacccacgcccagaagaacgcaaaaccaagacccaccaacacagcgatggcaggattcaccccgacaaggctcaatgcggcttgccatgctgcgtcatgaccaaatcctatggcggtgacaagatacgggcatacatcatgcggcgtaatcctcaactgtgccctgttcataagttcctgacgttgttccgcaggaattttctcaagctcatttgctgcattggcgactaccgcagctagggattcagtgcgaacagcaccattgaaatccttgaccgtaacgactcctgtgtcgtagttgattgttgcggtcaacgtacctttaccatccacttcgacggtcgaggtattttcgccgtgaagctctcctccgaatgccgcaggtatggactcttttggcattccgctgattgcgatctctgccgcatttgctgatgtcatcggcacgagtcccaaaactagtgctaaggagaacgagactactagggcaagtattccacgtgccgatttcataagacgagccattgatgcctccgatgcttcattgccttggtaggcggtatacccactatttggtaggcaagtagaaaatcgcttgtctagtaaaagagtatatcatcaacagagctcgtctttgggtggcttgtcctcgacattaccttgccgggctcgcggtaccaaacctcgttgggcgtttcccagcccaggaccttcatgggggtgtcgttgatctcatcgacgatggcctgcagatcctcgtccgtcaggccgtcgaagccggtcctctcggacaggtagcggcggatgcgcccgttgcggttctcgttgccgcccctccggtatgaggagtacgggtccgcgaaataggcgagcatgcccaacgcctcgtccacgagcaggtggcaggaggattcggtgccgttgtcccaggtgcggtcgatcctcgccggcgcggggatgcggctgtagatgtcgtattcggcacgcgcggtcgccggcgcgctcttgtcctcgatgaagcgggcgaacaggcggcggctcttgcgttcgacctgcgtgtcgccgcaccgcttcgacggtgccgagccgacggccgtgtcggactcataatggccgaactcgcggcgcgggcccacgcgttcgggacgttcggcgatcggcacgcgcatcgggatgcgcggccccttcgacctcctgcccttggcgcgcgtgcgatgccgcttgccccgaggcaggtactgcctgaggtccaatgccctgcgcggcttggcgtagatccaccggtggaggcattcgcggccgatcctcatatgcgggtcggccggccattcgaccttcagccgtccctcgatgagttcgggcgtccatcccttgcgcagcgcgtccatgacccacgcgagcagcggtgaatgcgccatgcgcaggggcttgcgcggctggcgggcgcgccgctcggccttgcgctgcgcggtcatcgccgagtagaacggcctcgacgtccacgcgcccgccttcagccgtttcggccggtaggggcgatgggactcgttctcgctggacgtgaaccacaggccgcgtcccggctcgcggatgacggtggacttgtcgcggccgatcctcaggacgatctggcggacaccgagcccgtcacggttcctcaactcgtcgatccggacgcgttcctcggccgacaggtgggaatacactttcctcatgagcaacaccttcttgagttaggacttgaacacttccaaccatagacaggcgttgcacttctatctagaacccgggacgcatatctctcatagacgccatgcgccgccgtgccgggcgtgcgggcggagaatcatcgtatgataccgaatatcgtcaggggttcggacccggccggcctggtgcgctacctgttcggcaagggacggcgcaatgaacacaccgaccagcatctcgtgtgcgcgagcggcgacatgtttccctcgtttgacatggatggcaagccggcggcgtcgtatgcggagataggccgcaggttcgaccgacgctaccgcgtcaggggacgcaagggcgatccgttcccgcccgacatgcgaggcaaggacaatcccgaacgagagcatggcaggaagcgcgtgtggcactgctcgcttgccatcaaggccggccagggcatactgaccgatcaggaatgggagtcggtcatccgcgattatctgatgcgcatgaacatcatcgacggcgacggcgatcagggcgtcacgtggctcgcggttcgtcacggactgtccgccaacggcaatgaccacgtgcgccaaggcgtcgcgcagcgaggacgagttcatacgccgcgtgcgcagggaaggcttctccatcgaccccaggctgcgcaggggaaccgccaaagactcgttcaccgaccccggccaggtggtcggctaccggatcacgtggcgcagcgcggacgggtggacggaacggttcaacgccttcgagctcggcgacgacatgcgattgaaacgactgcgcgacggctgggcggacgatgtcagaagccgcagcctcgccgtccaggaatggcgcgccgcgatggagaaccgcccgcccttcctcgatgacgggcgagaaagacacccggagaatctgtccacgcacgacatggaacgcctcgtatccgaagcgttcgccatcgccgccaacctcaacagcgcggcggacgacgacgaataccgggcagcgatgcgcgagggcctgcacacgttcgacatgctgcgcgaacgatacgggcttacgcaggacggcctgtggataacggccacggacatggacgaaagccctataccagcgcacgtaggaaaaatttgacagcagcctcgaatccctacctccgtcgcatgtcggtgcaaactcagaaggaatgtcctcccgagagtacacatccgctctcattcattgaggtatcgcgcgtaacgagttttcattgtaaatgccacggtatggtgacggattttggaggacgataatgacaatacaatatacagcgcagccggctgatccggcgtcgagtgcggtgctgacgcgcgggctggtgaagcggtatggggattttctcgcggtgaacgggttgaatctgaacgtgccggcgcatggcgtgtatggtttgctggggccgaatggcgcgggcaagtccacgacgatgaagctgttgcttgggttggcctcggccacgagcggcgatatgtggatgttgggggagaaggtgggtggccggcacaggttgcaggcgggccgggtcggttcgatgatcgaggggccgagcttctacccggggttgagcggtctggataattgccgtatggtggccgattacctgaatctgccgggttcggccgcgcccgcgattttgcggcaggtcggtctggccggccatgagggcaagaaggcgagggactactcgctggggatgaagcagcggctgggcatcgcgatggcgttgatctcgcagccggagctcctgttgctggacgagccgacgaacgggctggacgcggaggccgtggtcgaggtgcgcgagatgatcatgggtctgagccgcgaacggggcatcacggtgatcatcagctcgcatatcctttccgagatcgagaagatggcgccggtcgtgggcgtcatcgcggccggccgcctgttgtatcagggttcgctcgacagtctgcgcgaggaggggcacatcgatttgcgtgtctccgacccgaagctcgcggcggcgatgctgggctcggaccggatcgactaccggtggctgccgggcagggatggcggcgtgctgcgcctgccggaactgccggaccagcgaatcggcaccctgatcacgcagctcgtcggccagggcgtcgcggtctatcgcgtcgcctccgagcgcaagacgctggagcaggcgttcctcgaactgatcgaaagcccgcagagccgcgagcccacgcctcatcaggcgcaaaatgccatggattccgacgccgcacgcgcatccgcgcacgcatccccgcgtcgtccgttgccgatccggcaggctgcgggtcgggcggcgttcgcggcggcggacggaggcgcacgatgagcggcgcggcagtgttcgcggcgacgggccgccgtccgccgcgcccccgcgcgaagaccggcagcccgttcacgctggcgcgtctggagttgttgaaggtgcggggctcgtcgttctggtggatgctgctgggcatgatgctgctggtttcggcgtgggcgggcatggcgttcatgaaacgcgccggcagtcccgtcccggcgttgaggtcggccgcgttggccgatggcgaggtctatcaggtcgtgagcctgctggccccgattctggcggccctgttgaccagccgcatcgccgtgctggagacctcggagcgcatgaacctcacatggctgtcgttcggccagtcggacgcggcccggttcgtgggcaagctcatcgtcgccggcaccggcgtggggctttgcttcctgatcccgttgctgtgggtgccgatcgcggcgaaggcccttggcttcacggtggccggctcgttcgccgcgctggtgtgggtgccggccctgaccggcttcctgtccgcgacggccacgagcgcggtccagctgatgttctcgatgatgatcgacaagcaggccatcggcctgggtctgggcgtcatcgccggcgtgctgggctccggcctgggtgcgatgaacagacccgcgcttggctggctgttcccggccggcctgagttcggccgcgagcccgttcgtcagatccgtggatgcgggcggcaacgccacgatgctgctcgccgcgcgcccgtggatggccgtggcctccgcggccatggcgttcctcggctggacgctggtcagcatggtcgtggtcaaggtgaaggagtcaagacgatgacacacgcaaacgcagtgaacccggcaaccaatccggccgccaatccagctgccggcccgagccatgccgcgatgccccgcgcgcatgcggcgggacgccgcaggccgtccgtgtgggcggcgttccgctgggagacgcgcaaggccggcaacctgtggtactggatcgtgaccgtcttgttcgacgcgatcggcatgttcaacgggtggagccagtacaccggctaccaggcggagttcgccaggcagggcgtgacctgggccgcgatctggggtcaggcgatcctcctgccgagcatggtgttcatgccggtgcttgtggccgcgttcgccgcgcaggtcgaagccaacgagcatcgaggccgcaactggcagcggctgaacgccgccggcaccgtgaacgcggcgatcgccggcaagatgctgcacgggctcgcggcttcggcgctgaccgtcttcgtgttcgaggcagagttcatcctcgtcggacgcttcgccgccggattcgacctcgcgcagctcggcccgttcctgctgcgcggtatcccgctgaccctgtcggtatgggcgatcatgacgctcacgcaggccgtgagcgcgaaggccgaatcgttcgcgggcacgatgagcgtgatgatggtcctgaccatcggcggctgcgcgctgagcctggccgccccggccatcgccgggccgtatccgctcgccctgatcaccagcgcctccgccgcccgcgacctcgcgaacatcgccagcccggcatccatgctcgcctccacgaccgccgccgccatctggaccgccatcagcgccctgatcttccaccggctcgccaaacaagccgtctgagcaaccgtccacgggctcccctcacctgcgggagcccgccacccaacaccatggaaaggcttcatcatgcacaccaccagccaacacaacgaacgacacgacgaacaacacaacgcgccacacaacagcgaacagtccatacgcctgccgcgccgcgtcatcgccgtgctgatcgccgccctcgccgcgatcatcctcaccggctgctcgaccggcatcggcgtggccggagacaggaacctccaaggcatacgcacccaagacggcgactcctacacgggcggctacaaggccgactacagcaagttcaccggcgaggaggccgtattcggcggcaccggcaagaaggccagcatccacctgaacggcaccatcacaggcacacccggcaccggcagaatcctcgtgaccaacggcagcgacacgaaacgacccgtgcccgccacgaacggcaaaatcgaccagacctacaacgtcacaggcaccagcttctacatctacgtcaccggcgaccaattcaccggcaccgtgaacctcacatccaaggagcaatgaccatggcaaacacatcccaatacccaaaccagcaaccggcatatacgccggcaccgccggacggcgggcggacatggggcggctgcgccagcctcgcattggccgtccttccccttctgtgcacgctcgtgccccagctgctcggcatccacctctacacgacgggctgggtcaggaacatcctcgtcatcatcgacttcgtatgcctcatcgcttcgctcgtcatcgcgatcgtcacctatcccgaacaggcgggaggacacagaatcgtcagtacaatcgcgatactcctatccgcaggcctgactgccgccggcggcatgctcatcttcctcatgttcatcaaccagtaggaatccgactgacaacggaaaacttctttggaagttcatctaaccgcatacacgccatacggcacaggccacatgcgatacgcttcaacacggatggggcagcacccagggaaggagaatcgcatgaccgcaaaaaccggaaacgacaagcgccacgcggttaccggcctgatcggccacgtggccgcgttctggcggtccagcccggtcgcgcgcatggtcgcgccgatactgtgcctatgctacgacgtgatgatgctcaccagaatcgtattcacccatggcgggggcgattcggcagccatgaaactgttggagcatcaatggggaatccccgtactcgccatcctatgtgccttatctgttgtggcgctgttgttccgtatcagaatgccgttcgctattttgtgtgccatatgcggattgtatctatgcgcttgcttgcttcaagcggagccatatctgatgttgcctctcttgtttgccgtctacacgtctacagccttggccgcgaccgctgaacgtgccattgcgggaatggttttgtcgggattgtcaatcgtttgcggcctctggattgcgaccttccccgccttgcagactgatatacttctgcccgagtccctccttgcgtcgatgaccgctattttagctctttggtcgcgcaacatcagtcagcggcggaagggagcggccttggtggaagctcaacagcaacgaagcctggaattggaacaggaacgcgatgaagaacgtcggcgggcggacgtcgcagccgaactgcatgacagcgtgggccataatctcaccgctatcattgcacttactgaaggcttggagggattgacacaggagccggtggaaggcgctataaagagtatcaataacttagctcggcaaagtctaggtgatacacgcgaggcggtacggaaactttcatctccggtgacgttacggaaaacaaaaacaggaacggtggaactgtgcagctggaatgatataaacccgattcttcaacatgctcgtgatattggaatcgccgccattctgaccgagacaggaaggcgtccagacgatctagcccaagctgatttatgcttccgagtgagtcgtgaggctgtcacaaacacaatgcgccatgggaaaaatataacgcgaattgtggtttcatgggatcatctggataatggggaactccatataacagtgcgtgatgatggtaagccaacgctgaacaaagataaccgcgctaaggggaccggtttcgggcttgctggcctagtgactgaagttacgcgggtcggcgggcaccttcactatggctcatcatcagggcaggggtggactgtttcagccattattccacagcaaaaatgtccatatattcctgtgcaggagggaaacgatgattaacgtaatgatcgtggacgatcagcagccgaccagaatgggtttttcgctcatggtcatgaaagatcctgcgcttcgcatgacgttgcaggcggggaatggacaggatgcccttgatattcttgcggcactgcaattacatgggcagagcctccctgacgtcattcttatggatgttcgcatgcctgttatggatgggctcgatgccacggcaagaatcaaacagttatatccttcaatacgtatcctgattttaaccacatacgatcaggatagctatgcgtttgggggattgagcgccggagcttcgggattcttgcttaaggacgttaagactaaggacctgtgtcgggccattcactcggtgtacgatggagacgccatactcacaccacggattacaaaggaagtgattcgccgaggagttcccaacgtcagcatcaatgctgacactctggccatcagaagtaaattcgattcattgggacctcgcgaattcgaagtctcagcactggtcagcgaaggaatgactaacgctgaaattgctcagcgtctcggaatgcaactggaggcagtcaaaaaggcggttagtaggtctcttgccaagctcgatgtcaaagaacgtgttggtatcgcggtgctctggtataaggccggaatgccgaatctgcagaagtgacagattccgtagaataatgtagggtttctgaatcgtgaagggctcgtagcgggcgaacccgtgacggtccatgactgtcctcgtttgaatggcgatcggcgcgcatcgtggtaccgccgaccggtatcttctcacgtgaatgaagcagcttcagggaatgagtaacagaaaagccaccggcgacacgccaatggcttcaggtgagctcctgcgactgggcttgaaccagtgaccgtccgattaacagtcggatgctctgccaactgagctacgcaggaatattcaattttcatcccgtccggagttacccgttcaggtgagctcctgcgactgggcttgaaccagtgaccgtccgattaacagtcggatgctctgccaactgagctacgcaggaatgtctgctgtgtttgagatttctctcgcgcacaagtcacacatcttacatgcttgccacgaaaaagcaaattacatgcgtgtagggcatgtcgcgccgaattccgcagaatcggactcatcgaatacccactcatacaacatgatgacgatgcggcgatactgtcacgcgaaatttcattgtggataacttcggaagctggaaccacataggtcgttctggctggacatcctgtttcggacccctcaaggtgggtatcaccggcaaagaagccggaatcacatcacactcacactatggggaggaatctcatgaatgcaccactgttgtttgattggcgtcgcgacgaagcccgacgtgccagcaggcggcgtcagcaggcgcgtcagcgggctcaagaacggcaacggcgtatggatgccataatcgcgttggccgccgttatcggcctgctgcttgccttgggagtaggactggcatccacgcctcagcatgttgcgcatgcggatactgcggtgaccggagatgcagcatacacggtggaggatttcaccgatatgtctgatttggcgtggcgcaatggcaatcagtgcgaatcccggttcgactggccggtcgacgatccacaggtcgaacaacagttcgagcggccgatcaacccgtgggcaccaggtcatcgtggcgtggatcttgttgcggagcaaggtaccgtaattctgtcaccacaggcagggaccgtgagttttgctggcaaagtagctggcaaagatgtggtgagtgtacggcatcgtggaggtgtcacgtcaacattcgaaccggctgttaccgagctctcggtgggggatacgatctcccgcagacagcccgtaggcatcgttgagggcaactcggaccattgcgaagaccgttgcctgcattggggcctcaagcgaggaacagccgactatcttgacccacagcaatatgcggggagtcgaaaaatcgtactgaagccgtcatgattcagcaatgtttgtcggccggaacagggccgtacggaagaggcatcgcaggcggctagcggcgtgacgagtatgaatcacagaccggcatcggccaaggagatatatccgggggcgatcagcgcggacttgagattgctggcgctgacagccagcaacggttcgttgatggtcgggatcttcttcacgccgcctacctcggagttcctgattgaaggcatggaattcagcgcttcgttcttgttgagcctggcgcaggcctgagcgatatccgtggcgatggtctgtctgtcttccatgccggtcatccattgcttgccattgacgatggatgggatgttcgagacgtacgcgccgtatccggtcaccagaggccattgcgagtcacggtccttgtcggaagcggaggtgtccttatccgcatcgtcatcggaactggatgagtcgtttgcgttgtcgttttcaggggatttgatcgggtccggcacggcgtcgcggctgagatccttcttgccggtgatattgccgacaatgcccgagatggtgatctgcggattgatatcggcggcagagccggtgtatcccagatcgttcaattccttgacgacctcggaggcgatatagtcgttcatcgtgatgatgccgtcaatacgggtgagtgtggactgcccgtcggtttttgccagacgcttgtcaagcactttcgcagtggagccttccttggcggcatcgtaggccacggcttgccaatcgttttccgtggatttgccgtccaaggtgcctgaagggctttccacgacgcccttctgatagtaggagcccagtacctgccagataccacggaacgcctcttgggcgaacgtggaatcgttggcgttgcctttttcgtccacggcggtgtatggcagcagcacctcaatgtatttggggttgtctttactggccttatccaacttgagtttggacaccatcttttccgcctgtagcttgccgatggtctgggcgtcggagaacttgacgaaggcgtccggcttatatccctcgatgctgttgccgagcaataccacatgcatgccggattccttggccagcttgagcgatgagaccagccggtccacggcctgcgcctgctcgtccgatgcagtgccgtcgctctcagtgttggacgagtcatctttggaagagctgtcttcggaagaatcaccgtcagaagtagctccctcatccgtggcatcgttggtgctcaggttctggctgacgtaatcgccgtattggcgagtggaagcgtcggcctcgactactggagccacgagcaatgtcatgttgtcgggcgcgatggcaatgccggaatcgcccgtggtgttattcgaaagatgatcgaccacaaagtcttggatggcgcggctttgcttgtccaacgagtcggacgtcgtatgatcgatatcgcctttcttgaaaccggcgtcgaccagagccttggtcaggtcaggcaccagcttcgcccacttgttcagtggcgtctgctggttcagcgtaatgccgtccgaaggcgtgaacacggccacgccgccggaagaattggacgtcaccgtggtttgaccatctacaacggtcttattgtctgaggtgcacgcggtcagtgacagcaccatcgcgcaggatgtgataatggcggcgagcagggtggttgagcggcgtgcgaacaccataagcggcgaaacctcctcaagcgtgcgtgaaaacaaactgaatcacgattctagtaggccgtatacgaaaaagtcccggaccagtggacaaatcgccacatatccgggaacaattaggggtattgcgtgcgtgcatcgaacaactgtcatgattatcgtgctgaggaacattccggatgaagcacgacaatcatgacagttggcgacatgacatgacccatgtaggtccgtacggtgtgttcgatgatttactcggccagagccttggccaggttctcgtccagcgcgttcatgaagccgtcggtgtcgagccacggctcgtccgggccgatgagcatggccagatccttggtcatctgaccgccttcaacggtgtcgacgatgaccttctccagcgtcttggcgaagtgacggacttcgggcgtgccgtccagatcggcgcggtgcttaaggccgccggtccacgcgaagatggaggcgatcgggttggtggaggtcttctcgcccttctgccagcggcggtagtgacgggtcacggtgccgtgcgccgcttcggactcgacggtctggccgtccggggtcatgagcacggaggtcatgaggcccagcgaaccaaagccctgggccacggagtcggactgcacatcgccatcgtagttcttgcaggcccagatgtaaccgccgtgccacttcagggagctggccaccatgtcgtcgatcaggcggtgctcgtaagtcaggccggcctcggcgtacttgtccttgtattcggtctcgaacacctcggcaaagatgtccttgaactggccgtcgtaggccttcaaaatcgtgttcttggtggacaagtacaccgggtaatgacgcatcaggccgtagttgaagcaggcgcgagcgaaaccgcggatcgaatcgttgacgttgtactgcacttgggccacgccgccgtcttcgccgtagttgtagaccacgtgctgaatcggctcggagccatcgtccggagtgaaggtgacggtcagctggccggctcccggaaccttgaaatcggtggccttgtactggtcgccgaatgcgtgacgggccacgacgatcggcttggtccagccgggcaccagacgaggcacgttgctcatcacaatcggctcgcggaagatcgtgccgcccaggatgttgcggatggtgccgttgggggacttccacatcttcttgagaccgaattccttgactcgggcctcatcgggggtgatggtggcgcacttgacgccgacatggtgcttctggatggcgtgggcggcgtcgatggtcacctggtcatcggtctcgtcgcggtgctcgatgcccagatcgtagtagtcgaggttcacgtcgaggtacggcaggatcagacgatccttgatgtctttccagatcacgcgggtcatttcgtcgccgtcgagttcgacgacagtgccttcgaccttgattttggccatgcttcctcctgatagatggtgtgaagatgatttagtcatagcgcatgtttgtaacgacttgaagcaatcgtccggtccgtgggaaacggccttgttggcgtcccacccgggcaataggcttacaaccatgtctcaggaaattgaaatcggtttgggcaaaaagggccgtctcggctacgcactcgacgatgtggcgatcgtcccctcccgtcgcacccgcgaccccgaggacgtctccacctcttggcagatcgacgcctatgagttcgatgtgccggtgatcggcgcccccatggattcggtgaccagcccggccaccgccatcgccatgggcaagatgggcgcgctcggcgtgctcgatttggaaggtctgtggacccgttacgaggacccgaccccgctgttggacgaaatcgccgggctgccggccgatcaggccaccgaacgtatccagcagatctatgccgagccggtcaagccggagctcatcacgcaacgtctgcacgagattcgcgccgccggcgtcaccgtggccggcgcgctctccccgcagcgcacccagcagttctactccaccgtggtggacgcgggcgtggacctgttcgtgatccgcggcactgtggtctccgccgagcacgtctcttccggccaggaaccgctgaacctcaagaagttcatctacgaccttgacgtgcccgtcatcgtcggcggcgcatccaactacaccgccgccctgcacctgatgcgcaccggcgcggccggcgtgctcgtcggcttcggcggcggcgcggtctccgccactcgccagaccatcggcgtgcaggccccgatggccaccgccatcgccgacgtggccgaggcccgccgcgactacatggacgaatccggcggccgctacgtgcaggtcatcgccgacggcggcatgggcgactccggcagcttcgtcaaggccctggccctcggcgccgacgcggtcatgctcggcgcgccgctggcccgcgccaccgaggcccccggcaagggcacccactggggttccgaagcccgccaccagacgctgccgcgcggctcccgcaccacggtcggcacggtcggcccgctcgaacaggtgctgttcggaccgagccaccaggcggacggcaagaccaacttcatcggcgccctcaagcgcgcgatggcctccaccggctacgtcgacgtgaagaacttccagcgttgcggcatggtggtcaacccgtattccgcacgataatcccgattaccccctgaagatgggggtttgccctccatgcaggaggcttaacttgcccgaaggcgcgctcaagtcgtttgacttggcgcgcctttcgtgatgttgtagtacagacgctcgccgatgatggtgagttgcaagggggcttgaaggggtcatcatggagtattcgggatttttccacggcacatatcagtacgggccgttgccgagttatgacggattcatcgttgtggagctgtcggatcgcccggtgcggtatcacatccaacccacattcataggcgggctgaatgcgaaggaatgtcattccatggccatggctgcatgccgcatcgcctgcacatcggcggacgcgatacgtggcaaactcagcgtcgcacatctcaacagagccatgacaaaaccatgcctggaccggctgcaaaccatgcaatacctgctcggcacccacatggtcactcatccggagctcaaagcgaaattctgctatctgcccactgtccccacattgatcgacggcatgatcaccggcaaggacacgctggaaatggcggtattcatgaccatcggccaggaaaatctgcgagtcaacctcaaactgaagtacatcggttcccgatggatgtgcatctatgccgatctgggctgaccagacggccccgcccgcacaccgattcctacgctggtagcggaagacggttctgccgtgtcataggctggttcgcctatagtagtgatcatgcgtgaacatgtagaagaacccagatatgtcaccaccgatgacgacaccgtctactcgctgctggccaaacgagcagctcgcacgccggatgacgtcatcgcggaatggcaggatgacaacacccaccaatggcgcagcgccacagctactgaaatgctgtcccgcgtacgcgaggtggccaagggcctgttgggacttggcgtcaaagccggcaccatggtgctgatttactcgcctacctgctatgagtggggtgtggctgatttcgcttgcgcggcaatcggcgctgtggttgtgcccgtctatgagaccgattccgcccgtcagaccgcgggcatcgtcgaggaagtcgatcccgccatcgcctttgccggcgacttccagcgcgcacagacgcttgagcagattcgtgtcaatcatccgggcatgaaatacgtgttcaatttcaaggccgatggccttgacgctgtcgctgacttcgggcatggcgtatccgatgagacgttggatgcggctatcgctcgtatcaaagccgatgatctgcttaccgtggtctacacctccggttccaccggcaagcccaagggcgcgatgctctccaaccgcaattacacgcacatcgtgcttaacggctacgagattctgcgtggcatgctgtacgacgacaaccgtctgctgctgttcctgccactggcgcactgcttcgcccgctacatccagtacgtgtgcatcggtggctgcggcgtggtcggatacattcccgacgccaagcgactgctcgccgatatccgcagcttcaggcccacatacctgctcggcgtgccgcgtgtgttcgagaaggtgtataacgcggcctcgcagaaggctggtgccggcatccaggggcatatcttcgcccagtcggtcaagcacttcgtcaagtggagcaaggatgagcaggccggccgcggccattcgttcatcgagcgcatgcgccattcgttctacatggccacggtgggcaaatccattcgttccgctctcggaccgaacctcaaatggctggcctgcggtggtgcgccgctcaacgtggatttggcccacttcttcaacggcatggatgacatcaccttcatccagggttatggcatgaccgaaaccgccgctccgatgctcgtcaattgggaggatgacaacgaggtcggttcggtcggcaagcctgggcctggcatgggcgtgcgtcttggcgaagacgatgaaattgagctgaccggcccgaacgtgttccttggctactacaagcagcccgaactcaccgcacagacgatgactgccgacggctggatcaaaaccggcgatctgggtcgtatcgacgaccgcggcttcaccttcatcaccggacgcaagaaggatatcatcatcaccgccggcggcaagaacatcagccccgccccgatggaggatgtcatcgacacctgcccgatcgtggctcatgcagtagtagtcggcgacggcaagccgttcgtatccgcacttatcgagctcgaccccgaaatgctgcattcctggctggaaggtcagggcctcaatgccgacatgacactcgccgaggccagcggcaacgacgcggtgcgcgcctttatccagcagtacatcgaccaggccaacgccaatgtctcccgcgctgagtccgtgcgcaaattcgcggtgctggatgaggaattcagtcaggatcacggcacgctcaccccgagcatgaaagtggtgcgtcccaaggtgttgcagcgctacgccaccgtcatcgaagaggatctgtacgcgcccaagccatccaacaagccgttgcccgccactgccaagatcatcgacagcacgctggagaccgtcaagaaatcctccgaatcggtcaagcaggcgtccgaacaggtcaaacaggcctcggaacagatgaaaaccagcgtgtctgattcgattgctagcgtgtcggagaagatcaagaagtcgaaggccgaacccgaagagggcgagaccggcgattccgccgacaatgccgacaatgccgctgacaccggcagcaagctggaccagccggctgacgagaagaacgaggagtaacgatagtggccatccgtgagattagggtcgtgcccgacccagtcctgcgcaccccctgcgatgagatcaaggagatcaccccggccgtgcgccgcctggttgacgacctgttggaaaccgtggacgatccgggccgagcgggcctgtccgccaaccagatcggcgtgagcctgagggccttctcctacaacatcgacggcaaggtcggctacgttctgaaccccgtactcgaggagaagtccggcgagcagtacggcgatgaaggttgtctgtctgtgcccggcttatggtacaagacccgtcgtgccgactacgcgcgcgtgcgtggcatcgacctggacggcaacgaggtcgtgctcgagggctccgggctgatgggccgtatgcttcagcacgaatgcgaccacctcgacggccacgtgtatttggatcgcctggaaaaggaagaacgccgcgaagccctgcgctacatgcgcaatcgtcaggcgaagtagtccataatcggctcccgctggcgggagccgtcgaacatagtgagactgagggtgggtctgcaggtaccgcccgcaactcccctcagtcgcctacggcgacagctcccctcagagaggggagcctttttagtaccggctccgtgctattctcgaaacttgtgtgccacccggcaacggacgcagtcgctggcgtacagagccacccaatattgtcaaccggcacacaacaaattcgcgtcatgctcgcgacggcttgtgtcggtcggctgcacaactcgtgaaaccgggggagcagctgcacgcaggtgcgcatgaccaggcaagaaccgacaatgaaaggtagtaataccatggctcagatcactatgagcgatatgctgaaggctggcctgcacttcggccaccagacccgtcgttggaacccgaagatgaagcagttcatcctcacccagcgcaacggcatccacatcatcaacctgttcaagtcgctcgacatgatcgacaaggcgtacgacttcatcaagaccaccgtggcccacaacggcaccgtgctcttcgtcggcaccaagaagcaggctcaggaagctatcgccaaccaggccacccgcgtgaacatgccttacgtctccgagcgttggctcggcggcatgctgaccaacttccagaccgtctccaagcgcgtcaaccgcctcaaggaacttgaggaaatggacttcaccgacgtgcacggctccggcctgaccaagaaggagctcctcctgcttgagcgcgagaaggacaagctcaacaagcagctgggcggtatccgcaacatgaaccgcaccccgtccgcgatgttcgtcgttgacatcaccaaggaaaccctggctgttgaggaagctcacaagctgggtatcccggttgtcgccatcgtcgacaccaacgccgatccggacaccgttgagtacccgatcccggccaacgatgacgccatccgcggcatcgaactgctgaccagcctgatggctgacgccgtcgccgaaggtctgctggagcgctccggcgccaacaagaccgagggcgaggccgccgagcagccgatggccgcttgggagaaggaactcctgaccaacgaggctcctgccgaggcttccgctgaagccgccgctccggctgccgccgagggcgaaaccgccgaggcccccaaggccgagtgatgctctacgatgggaagtgcctgaataagcgcttcccatcgttcatgggtaagcaaaatttctcaaggagaataatcaatggcagcaattaccgccgcactgatcaagcaggttcgtgaagacaccggcgccggcatgctcgacgtcaagaaggctctgaccgaagccgaaggcgacgtcgcccgcgccaaggaaatcatccgcgccaagggcatcgccgcagccggcaagcgtgaaggccgcaaggcccaggaaggcaccattgcctccaaggtcgtcgagaccgccaatggcgagaccggctacgccgtcgaactgaattccgaaaccgacttcgtggccaagaccccgaagttcgtcgagttcagcgaggaagttctcggctacgccgtggacgccgaagccaactccgccgacgaactgctcgaagccaaggccggggactccaccgtcaaactcgccgtcgaagaggccgcggccctgttcggcgagcacgtcaaggtcggtcagttcgccaagatctccggcgagcacgtcgaggtctacgcccacaagaagtccgccgagatgccgccgagcatcgtggccatgatcgccaccgacaaggccggtgccgccgtggcccacgaagccgccctgcagatctccgccatgggagccaagtggctgacccgcgaggacgttccggccgatgtggtcgagtccgagcgtcgcgtggccaccgagaaatccctggccgagggcaagcccgagaagatcgttccgaagatcgtcgaaggccgtctcaacgcgttcttcaaggaagtcgtgctgctcgaacagccgttcgtcaaggatccgtccaagaccgtcggcgacctgttcaaggaagtcggtggcgccgccaccgcgttcgcccgcgtcgaggtcggcaagggcgaagaggagtgagcccgaggcccacttcgcgcgattagcgtaggattccgcgaaacgccatccgtctgcacgtcaaacggatggcgtttcgtcgtaagggcccgcggatcgtcgatggcgtgttccgagggtgtcgttgcccaagggtgtcgttgtaaaccgatacgctggtctacggataatttcacatgttcggttctgaggaaggcatgatatgactgatagcgacaagccgcgcagggttctgctcaaactgtccggtgaggcgttcggtggcggtaaggtcggcatcgacacccatgtgatccgccgcatcgccgaggagatcgtcccggccgtgcggcagggcgtgcaggtggccatcgtcgtcggcggcggtaacttcttccgcggcgccgaactccagcaggccggcatcgaccgctcccgcggcgattacatgggcatgctcggcacggtgatgaactgcctcgctctgcaggacttcctggagcaggaggggcaggccacccgcgtgcagaccgccatcacaatgggacaggtcgccgagccgtatattccgctcaaggccatccgccacctcgaaaagggccgtgtggtgatcttcggcgcgggtgccggcatgccgtatttctccaccgatacggtctccatccagcgctccctcgaaatccattgcgacgaggtgctgatgggcaagaacggcgtcgacggcgtctacaccgccgatccgaacaaggacgcgaacgccaagcgtttcgaaaccctgagctacaatcgcgccctcgtggacaatctggcggtcatggacgcctcggcgttgtccatggcccgcgacaacaagaagcgcatccgcgtcttcggcctcgaaggggcgggcaacgtgacccgcgcgctggtcggggacgagatcggcacgctggtctccaccgccgaatcgcgcgtggccgaatagcatatggacgtcccggatcgggcgttcgctgacgaacaacatcgacaatcatcacatataaggagtgaacatgtccctcattgatcaggccagggaacagatggccaagaccgtggaaaacaccaaggagaacttctccggcatccgaaccggccgcgccaacccggccctgctcaacggcatcaccgtggactactacggcgccccgaccccgatcaaggccgtggcctccatcggcgtgcccgagccccgcaccctgtccgtcactccgttcgacgcctcccaggccggcgccgtcgaaaaggccctgcgcaattccgacctcggcgtcagcccgaaccgtgacggcaacgtcatccgtctgaccatgccggaactcaccgaggaacgccgcaaggaatacgtcaagctcgccaagggcaaggccgaggacggcaaggtggccgtgcgcaatattcgccgcaagaccaaggaagccctcgacaaggccgtcaaggacggcgagatgggcgaggacgaaggcgatcgtctgctgaaggatctcgacaaggtcaccaagtccgtcaccgatgagatcgacgccttgctggaaagcaagcagaaggagatcatggaggtctgattcggacctggtacggagcattatggaacgcaacgaacaactccacgaggaggccgaggaggcgctcgaccagatcaacaagaagaccggccgcaacatgccgcaggccatcgccaccggtgcggcgctggtcatcctgatcgtcgggtgtctgctgctgagcgtcgatctgttcgtgttgctggtggtcgtgttcatgatcctggcgttgtgggagctcagggtggacttcgccaccgtgggcctgcatatcccggtgatcatgctgtggctgtgctcgtccttcaccctcatcgccacgtattattccccgtaccatctcatcacgatgtccctgagcatcatcgtgtcgatcatcctggtcgccatcgcgtccagcgcgaagatcaacgtcggcaaccgcctcccactggcggtcgccggcaaactctccagcacggacgccagcgcccgcctcgagtcatcgttcaaccacgagggcggtgagcagcaccattcccggctcagccatgtggctgtgtccgtgcttaccgtgttgtacattccgttgttggccagctgcatcatcatctcactgacttttaatgggcatccgattgcacacgccatcatgctggtgttccttcctgccctatccgatacgggcggtttgtttgccggtgcctggcttggcaaacacaagctcagcccgcgtatctcgccgaagaagtccgttgagggccttatcggctcgatgctcttcgctatggctggcgcgttcgccgtattcgcatgcacgtatgatgcctcgaaatgggccactcgttggtggatgccgatcgtggcgggtattctcatcggtgccgtgggcacgttcggtgatttgtgtgcttccatgctcaagcgcgatatcggtatcaaagacatgggccatctgctcaaggggcacggcggtgtgatggatcgtgtggattccattttgatgagtgcaccattcacctgcgccttgctgtgggtcaccggactgtgattcgcatgcctcgtgcatgaaacaatgtggcatcgtgtgtatatcgcacggtgccacatgtcatatatgggggaaatcatcgttcaatatgcgttcgccatgggctaagacatggaccatctgattcgtatgcggcacgccgtatggtggattctgatatttctattgcatgtttgaccattttctgatattgagagcgaagcgaacccatcatgaccacacagcatcctgacactccggaaaccggcattactcccggcggcacatcaggtgccttccgtgacgtgctatccaaggaccatgcccgccgtggtaagccgccgctgcactttgtggatatgacgcccgagcagcgcatcgagaaagcggccgaactcggattgccgaagttccgagtcaagcagctcgccaaccattactttggccatttcgatgtaaatgccgctgaattcactgattttccggcagccaagcgcagcgaggccgccgccgcgttcttcccgcagctcatcaccgaggtgacccgccaagtggcggacgaaggcaccaccatcaagaccttgtggaagctgttcgacggctccctcatcgaatcggtgcttatgcgatacccgacccgcaccacgctgtgcatctcctcgcaggtcggctgcggcatgggctgcccgttctgcgccaccggcaagcttggcctgacccgtaacatgtccaccggtgaaataatcgaacaggtgcgtgtggccgccaaaatgatgcgcgacggcgaagtggccgggggagcgggccgactgagcaacatcgtgttcatgggcatgggcgagccgatgggcaactacaactccgtgctgtccgccgtacgacagatttccgccatgcctcccgaaggcttcggcatttccgcgcgcaacatcaccgtatccacggtgggcgtggtccccggcatcaagaagctcactgccgaaggcattcccgtgcgtctggccgtttccctgcatgcccccagcgacgaactgcgtgacgagctggtgccgatgaacaagcgtttcaacaccacgcaggtgttggatgccgcgcacgattattggctggcctccaagcgccgcgtcagtatcgaatacgcgctgatgcgcggcatcaacgaccaggccgagcatgcgcagttgctggccaagaggcttaaccattacggcgacaactgggcccacgtcaacccgattccgctcaaccccatcgagggctcgaagtggaccgcctccaagccggaagacgaacagcggttcctggagatcctgcaccgcgcgggcatcaccgccacactgcgtgacacccgcggccaggatattgacggtgcctgcgggcagttggccgccaaggagcggtagtttcggtgacggaatcgcctgcggccgattccgtcacttcagcgcatccttgattgcgcccacgaagtagtccagatcgtcgggcttgcgggacgtgatgagcttgaagccgttggcgtcgtccacgtgcagctgctcgtcgacgtaatgaccgcccgcgttctcgatatcagcggcgatatagcggcagggcgcggcggtcttgccagccaccagacccgcgttgaccagcagccacgcgccatggcagggcgcggcgatcggtttgccttcgtgcgtgaactcctgcgccagcgtgatcgcatcctcattgacgcggatacgatccacattgcaggtgccgccgggcaccaccagcaggtcgtagtcggcagcctgcacatcggacaggcgcgcgtccggggtcagcgttgcaccttcgtagcggtcgtgctgcaccgtctcacacgggtccaaggtagtggcggcaagcgtcaccttggcgccggcggccttgagatcgcgcagcgggcgcgtcagctcggattctcatattccagaaactggtgcggcgcatgtaacgggcggtaggtagtctgaaggacagtaatgcaaagccgaacaggggagtgaagcatgtcgttggcggtacgagtcatcccgtgcctggacgttgacgccggtcgagtggtgaagggtgtgcatttcgagaacctcaaggacgcgggtgacccggtggagctggcggccgaatactaccgtcagggagccgacgagatcaccttcctggatgtgaccgcatccagctcccaccgcaacacgatgattgacgtggtctcccgcaccgccgaacaggtgttcattccgatgaccgtgggcggcggcgtacgcacgcccgaggacgtcgactcactgctgcgctgcggtgcagacaaggtcggtgtcaacacggcggccatcaacgacccgtcgcttatcagccgtgtggccgatcgtttcggcaaccaggtgctggtgctctccgtggatgcccgccgcgaaaagggtgagcagcacacgcagtcgggttttgaggtcaccacgatgggcggccgcaaatccaccggtattgatgccatctggtgggtcaagcgcgccgagcagcttggcgccggcgagattctgcttaactcgatggacgccgacggcaccaaggaaggctttgacctcgagatgattcgcgccgtgcgcaaggaagtcaagattccgatcatcgcctccggcggtgccggcaaggtcgaggacttcccgcccgccatcgaagcaggtgccgacgcggtgctggctgcatccgtattccattacggcatcctgactatcgccgatgtcaaggcggaactcaagaagcacggctacaccgttcgctaaacgaatacaccttgctcccgctgggcgaacaatccagtggattgttcgtggcagtgcgctatgcgcacgtcgcacataatccgggagctgtcagcgaagctgactgggggtggcccacaaaaagaagataggtatgacagacactacatacgacaattccactgaactcgatccccgtattgccgcgcgcctgaagcgtgacgtcaagggtctggtcgccgccgtcatccagcagtacgacacacacgaggtgctgatggtcggctacatgaacgacgaggcattacgccgcacgctgaccaccggccgcgtgaccttctggtcccggtcccgtcaggaatactggcgcaagggtgatacctccggccatgtgcaatacgtcaagggcgtgtccctggattgcgacggcgacgcactgctcgtcgaagtcgaccaagtcggcgccgcatgccacaccggcaagcgcagctgcttcctcgaaggcggccccctgcccgtggtcgaaggccatcgcccggccgagcagcagaacgggctttcctgactgagggaagccgagcgaccgcgtaccatgaagcaagacatcgagtttgtaggtaaaggagcgaatatgagcgaatgcagcgtcaaacacctgaagtggggcgccacctggcccagtcgcgaacagttccacgaactggccgacgccggctaccgtgtgattccgatcgtgcgccgtctgctcgccgactcgctcaccccggtcggcttctacgagcgtctcgccggcggccgatccggcaccttcatcctcgaatcggcggaatacggcggcacgtggagccgttacagcttcatcggcgtcaactcgatggcccaactgcgctccaacaacggtcaggccgactggctgggcaaggtcccggtcggcgtgcccgtcaccggtgacgtggtcgaagtcgctcacgccacgttgaagactctgaaggccccgcatgtggaaggcctgccgaacctgaccagcggtctgatcggcacggtcggctgggatgccatccgccactgggaaccgaccctgcgcgccgaagctccggacgagaccggacagcctgagaccgtgcttgccctggccaccgatatcgccgtggtcgaccacgtatccggttcggtatggctcatcgccaatgcggtgaatgtggatgataaatccactcgcgccgacgccgcctacaacgaggccgtcgctcgactcgaccagatgcagcgcgatgccgccaccccggctccggacgagtcccgcgtcaacattctggacgaaacggtcacccaacccgagctgcgcttccgcaccgagaagagccactacgagcaggccgtcaaacgcgccaagcagcacatcgtcgacggcgacgtgttccaggtggtcatctcccagcgcctcgacatcgattcgcctgctgacccgttcgacgtgtaccgtgtgttgcgcacgctgaacccgagcccgtacatgtatttcatggcgttgaccgacgctcagggccgcgacttcaacgtgatcggctccagcccggaaaccctcatcaaggtggacaacggccacgcgatgaccttcccgattgctggatcccgccctcgcggcgccacccctgaggaagacgagaaattcgccaaggagctgcttgccgatccgaaggaacgcagcgagcacatcatgctcgtcgacctgtctcgcaacgacctgagtaaggtgtgcgtgccgcagtccgtggaagtcgtgcagctcatggacatcaagcgtttcagccacatcatgcacatctgctcgacggtcaccggcaaggtcgacccctcgctgactgcattcgatgtgttcaagtccgcgttcccggccggcacgctgtctggcgctcctaagccgcgcgcagtcgaaatcatcgacgagttggaaccggccgaccgcggcatctacggcggcaccgtcggctacttcgatttctccggcaacatggacatggccatcgccatccgcaccgcgttcctgcgtgaccatgaggcgagcgtgcaggccggtgccggcattgtgctcgactccgtgcccgccaccgaatggcaggagacgcgcaacaaggccgaggccagcgtcgaatccatccagatcgccgcccagctgcgcgaactgtaacgttcaacgcatagcgatgcccccgccgacagaagttgtcagtgggggcatcgctgtctgtatgtcagtgggttgcgcccaggatgtcggtggcgtcggtttcggtgctcacagcggcttcgatggcggcttcgataccgcgcgccatggtcgcgatctccatggtcggcgtgccgttcggcttgcccacgccctgcgcggtcgcatacggcacatgaatgaaaccgcccttgacgccggggaatttgcggtcaatcagatacaacacgttatacatgatgctgttgcacacatacgtgcctgccgtatacgacatgaatgcgggaatcccgtggtcattgatgttcctgaccatggccttgaccggcaacgtggcgaaatacgcggtgccaccatcctcccgtagcggcatatcgaacggctgctcgccatcattatcgggaatacgcgcctcggccaaattaatggccactttctccacggtcagagccgaccggccaccagcctgaccaatgcacagcacatagtcaggctgctcgcgcaccatggcttcctcaaccacggtcgcactgcgcgtgaacaccgtcggaatctccagtttcaccactgtcgcaccggcgatttcatccggcaacagcttgactgcctcgaatgcggggttaaccggctcgccgccgaacggatcgaatccggtcaccagaatcttgctcatcattagctccttatttcacggattgttgtggtatctggacaacgaggttattgcgcgatcagcatatagacgatctgcaccacaatcatcaccaatgcaggcagcacctgcttcttaaccacgcccatgcggtccttcatatcgagcatcgcgacgggcacgatgttgaagttggcggccatcggcgtgcacagcgtgccgcagtagccacaggtcagcgccagaatgccaatcaccgccgggtccgcaccgtaggcgagcacgaatggcgcgccaatgcccacggtcattacggtaattgcggcgaaggcattgcccatgatcatcgtgaacagcatcatgcccacaccgaatacgatgatgcccagcgtgacgttgcccttcggaataatgccgccgaccagcgtggcgatcacgtcgccgacacctgcggctgtgaaaatcgcgccgagactggccagcagcatcggcagcatgcagagcgcacccatggcagacaacaggcgttccgaatcgttgaggaatacgaccggcttgttgtcatgcgagaacgcgaacagaatcacggcggcaatcatcacaccgatgcagcagccggtcagggcgctgacgctgggaatcagggcgccgataatggcgaacacgcccaggcacagggcgggaatgaagatgcgcatgccgatgcgctggaagttcgcggccacttcggcggtgctgggagcgctcgaatcggacgccgatcccttacgcacttggcggaagatggcgggaatgaccatgatgataatgagcacaccgtccgcaatggccggaatccaacggccgaacgcgatgacgataccgagcgccgtccagaacacgaaagtgccgtagcgggccttgttggttttatcgagtaggttgcgtacgcccgcatacacggacatgaaacccatgaaaatatagaagagctcgaggatcttggtgccaacggtcacgctggggtccatgaagaacgacatatcaggcctccttgccggtggtggtagcggtagtggcctgagcggcggcttcggcaccgtagtacttcttacgcagtcgtgtgtccttgatgatgtaatagacggcggtgaccgccacggcaatcaccgcgaccgggatctcgataatggccatgcgcaatagttcgacgtcataacccagcggcttcaatgtggactgcacgagcagcgcaccggccgtacctacgaacagcacctggccaaagaaccatgcgacgttctccataccggaagccatgcccttgagctcttccacatactcgtcgttcggctcgtgaccggacgcttcaatcgcgcccaccgccatcggcataatgaccggacgcacgaacccggccacgccaccaaaactcacgttgaacgcggcgaacacgagacgcatcacaccatacagggcgatcaccataccgggcgtcgcattcttcaccctgccgatcagctgcgcggctgcggttttcagaccgttgcgctccaatgtgccggtgaccagcaacacgatgatgaaaattgccatgctgcggttcgagacgaacgacgtacccaacgtggtcaggaagccgtcgacgccaatgccgccgaccagcgcagtcaccaaagccgccacgataatgatcagaatcgcatcaagtctgagggcgaaacccacaatcacaatcacgattcccaataacacgagataatttggttccatgcggcaaatcccttccacagtacgtgcgcattgcgccgcaagcgtattcgaataccagatagtgtacgacgcgaatcatgcttcggcggcctcttcgcgcacatcgtgggtattgcatgggcgtcgcgcgcctcgcgcacggctgcggccgggacggtcggcatggtgttcgctatgatgtacagtcggactttggtaagagacagtattcgtaacaggcaagtaggttattcatggctattgaggtgcagggacttgaaattcagatcggcgcgcgcacgctgcttcaccccaccaacttccatgtggccaagggagacaagatcggtctggtgggccgcaacggcgccggcaagacaacgctgacccgcgtgatcaccggcgacatgctgcccaccgccggcaaggtgcgcgtctccggcaagttcggctacctgccgcaagacacgcacgcctccgatcccacgcagaccgcgctcgaccgcatgatgagcgcgcgtgacatcgccaccatcatcagccgcattcgcaaggccgaaaaggatatgaccgacccggatccggacgtgatgagcaaggccatgacccggtacgacaaggccatgcaggacttcgacaaggccggcggatacgcggcccagtccgaggcgatttccatggccgcctcgctcggcctgccgcaggaggtcatggagcagcagctcggcacgctctccggtggccagcgccgccgcatcgagctggcgcgcatcctgttctccaatgccgacaccctgatcctcgacgagccgaccaaccacttggatgccgattccatcgaatggctgcgcggctacttgaagaagtacgagggcggcttcctggtcatctcccactccaccgaactgctggacgaagtggtgaacaaggtctggcatctggacgcgcagctcggccagatcgacatgtattcgctcggctggaaggcctacctgcaccagcgcgtggtggacgaggagcgccgccgccgcgaacgcgaagtggccgagaagaaggccgaccgtctcatgaagcagggcatccgactgcacgccaaggccgccaaggccgtggccgcgcagaacatgatgcgccgcgccgaaaagctgctggaaaacacctccgaggcgcagaaggccgagaaggtggcggacatccgtttccccgagcccgcgccctgcggccgcacgccgatcatggccaaggacatctccaaggcctacggttccaacatcgtgttcgccggcgtgaacctggccatcgacaagggctcgcgtgtggtgatcctcggctacaacggtgccggcaagaccaccacgctgcgcctgctggcccacatcgaggagccggacaccggttccgtggaatacggtcacggctgcaagatcggctacttcgcgcaggagcacgacaccttggatctgaacgccaccgtgttggagaacctgcagcatgtggcgcccgagctcgacaacacgcaggcccgttccattcttggctcgttcctgttctccggcgatgacgcgatgaaaccggcccatgtgctttccggcggtgagaagacccgtctggccttggccacgctggtcacctcgcgagccaatgtgctgctgctcgacgagcccaccaacaacctcgatcccgcctcccgtgaggagattctgaaggccattgccaagtatgagggcgccattgtgctcgtcacccacgatgagggcgccgtcgaggcgctcgaccccgagcgcgtgctcctcatgcccgacggcgacgaagacctctggaatgattcgtacctcgaactcgtagctgaagaatagtcctaccttttggttcctctcgctgaggggagctgtcagcaaagagcgggttaaccctaggttcccctcgctgaggggagctggccgccgtaggcggcctgaggggagtctcgcaagcatgcaaaggaaacaaccatgccaaccacaacaggtaagaaaatcgccatcgtcaccggcagcgcgctgggtttgggctacgagctcgccagccaactcatcgccaagggctggctggtggccggcatcgacttcaacgccgaacgtcaggccgagctgagcacgcagtggcccgccgaatcctaccgcgccttcgtaggcgacatcactgacgaagcgttcgtcaaggaatccgtggcgagcatcgctgcgcttggtcacatcgacctgctcatcaacaacgccggccagccctcgttcaaggtgcccaccgcctatgaggccgccgatgtcgacacatgcctcaaaggtctcaaaggcatgatcctgtggacggtggaaaccctcaagacctgtggcgagcgtgacgtgaaaatcgcccagatcatgagcaccgccgccacgcggggcaacgcgaacgaaagcgtgtactgcgccaccaagtggggcgagaagggctacaccaagagcctgcaggccgcatacaagggcaccagcgtcaaggtggtcgccgtctatccgggcggcatcgacaccgccttctaccgtgatagccatgactacgtctccgaagccaagcagcacaccttcatgcagcccggtccgctggccgaggtcatcctcttcaacctgatcaacgaggccaacctcaccgtcaccgacatcgagatcaaccgcaacagctgagctggcaggttatacacatatccaccgattcggccgagctggttgcgcgcagaagttggttatgccatcgtgagttgtatccgtgaataacgcggttcacggatacaaccatcagggggatggcatggagtcctatgcatacaacacgttcttcacacttgatgaggcgcgagacctcgcccagaaaacactggaacaatgccgtgccagatcgatgcgcacttcacaggagctttgcttcagccatggcaccaggctacagcttgctggcatgacggccacgctgaattacaagcccaactatgaccccaacaaactgcacgttacggtgtccggggctgaaagattgtcgaatcttaccgaaacgcaatgccattattggggtcatggcattgaccagacgatgattgatgatcttatcgccgtggtttcagtggaacaggcgctgtgtcagatcgcacagttcgtcgatgtggaaagtatggtcattgccttggattgggccacctgccgtaatgagcatctgaaacagacaacgaaagacaagatatcgttgttcctcgccgatataggtagattcccaggtatcagattatttcgcaaagcgctctcgttgtgcagagagaacaccgattcgccgcaggaaagcatccttcgccttgaatcggtaaaacgtggattacccgaattggaggtgaatgctccgatatacctcccgttgcagaacaaagaggtggttgtggacatggtgtatccgaatgatcatgtgattctggaatacgacggacggtaccactatgaccgaaaccgatgggaaggagatatcgagaaaaggaacaacctctccttcgcgggctataagacttttcccgccacaagaagaacgttcgctaccacgcagaatctggatgaatacttcagaatcgttggaagtgcaattgcggaataccgcaataccgggtcattttcacaatgagatatgaccggacgcattcattaggtcgattcttcattcattaggtcggtgagctctgacagtcaccactggaatggtgccattccaacaccgacaatcgcagcctcatgacctaatgaatgaagaatcgacctaatgaatgattggaagcgttccgcgcaacgttatggcacccgcaagaagccggaacccggaatatgtctgttatcgtgggagccaagcaacaggtgaaggattgagtatgcacatcagtgacgatgagtttggacgggccattgaacaggtgttggatgatttgcctgaacggtttgcgcgggtgctggagaatgtcggcatcgtcgttgcggacgaacccaatgagcgcgaactggtcacaatgagcaatccgtgcggtgagctgctcggactgtatgagggcatacccatcacaaagcgaactacgggctgcagcggcgtgatgccgggacgccatcaccctgttcaagggaccgcatgaacgcgtatgctcgacacaggccgagctgcgccaacagatccgcaaaaccgtgttgcacgagatcggccattattccggcttcgatgatgagtatctgcactcgcacggctactgaagcgatgctgtttcactagcggggagccgtcatactgccgtatgttgccagatttactgcaagtggtgcaacgcacggatgatggcgcaacggtcctcgacggttccctcgttggagcacatggcggcgtaccaacacggattgcgcaaggtctcggcgccggtggcctcatccgtggcgacgagcgtgtgcagatcgttggcgtactggaaatgcaggtggctgagcagcccgccctcggcgaacgccttgcgcgaaggcagagggttgatggccagcagccagcggaacgggctgtcttcggcggccggatcagcggtgcggaacacgaaggtgggggagtcttcgagaccgtgctcgatgacatggtcgatggtgtattcgtaggcgtcgaggctggtgtcgtcctcggcgaaccattcgatggcgagcgagaggcattgtccgtggagccggattcggcggccgggcttgaagccagggccgcaatccggtgccgatacggttccaagtcaaacgcccgcaatcccatggcggccacgcagccgggggagagggacaggaattcatcggcctcgtaatcctgcacgatatgtccgccgtcgaataccacgtaccggtcggccacgccgttgagccatgcgagtcggtgatgaaacagggcagcatcatcgtgacgcccacggccagcgcggagaccacatgcagccacggcagtcccagggcatcggggtcgagcattcccagcgcggtgagtacggcataggtcacgccgaagttcaacgcggttcgccatcgggcggccgccagcaggggcaacaggaacagcacgaccatgacgatttgcgtggcgagccctacatggaagaacagcatgaggttcgccaccagcagaaggaagagtctcgcgcgcggatcgagcgtccggcgggcaggattcatcaggcgataccggccttgatgaaatgcttcttcatcatgcgctggccgaaccagccgccgagaaccgcgcacaccagaatcgcgatcatcgagatgaagaacgtgccggtgttgatgtaggcgatgaacgaaagcacgaaatgcccggagatgaacaggaaccgtccgatgatcacgcccatgacggtgatgccgccgaatttgccgaggcgtgcggccagcagcatgtacacgcagccggagatgagggccgcgatggcgatccggcaatggcagcgctcgcgcggcctgaccggcgacgcggtcaccggcacattcgacccgaatacggtggccctggccgcagccgcaccaatccgcatcacggcggtgaacgcgaaactcggccaatcgcaggtcagcccggcaagctatacgggcgtcaccctgcatgcgcaggccacgttgaccgccacaaaggcggcgacgttcaaagccggagacaaggcgcaggtcgtgctgccggacaacaccaccgtcgaaacgacgctcgcctcggtcggtcagggcgggcagaagaccggcgacaccgggcaagccacacagccatcggcgcgcatcgacttcccggaccagtcgtaggtggcggctttcgggccgacggccgtgcaagtcatcatcccgaacgccgatgcctcgaccggggagacactgatcgtgccggtgaccgcactgatcgccagcgccggcagcgcgtatgcggtcgaagcggtacgcggcggcaagttggtgcgtgtgccggtgtcaatcgggctggtgtccgacgcgcaagtgcaaatcaccaagtccgacggcctcaaggcgggagacaaggtggtggtctcatgaatgacatcgagtttgcccccgctggcgggggctcccgcgcagcaactcaaaacatggcgaaaccgacgacgtcttccgctcccgctggcggggctcccgcgcagcgggtgggggcggtcgccgaggaaccgccgttgaccaccctcagtcagtttgcgctgacagctcccgccagcgggagccagagcatggggcattgctgacgttggagcatgtgatgaaggcgtttccaggcaaggacgggagcgtgctggagatattgcatgatacatcgctggccatcgatcgcggcgagctcgtggccatcgtcgggccgtccggctcgggcaaaagcacgctgttgtcgttactgggcacgctggacatgccgacctcgggaataatgcgatacgacggcggggatgtgaatgcgatgggtgagcggcagcgcagcgtcctgcgggccgcgcgcatcggcttcgtgttccagcagttccatctgatcgccaccgtagccgccttggagaacgcgatgaccggcctgcaatacacgaccatgccgcgcggcgaacgccggcaacgggcctccgaggcattggaacaggtcggattggggaatcgcctgcatcaccggccggcccagttgtcgggcggcgaacagcagcgtgtggccatcgcccgcgccctggccaaacggccggacatcatcttcgccgatgagccgaccggccgatcgccctcgactggacctccctgccgctcgcctgggccgccgccatcctggtcggcatcctcgccggcctctacccggcctcccgcgccgcccgtctcaccgcgaccgaggccctgcgcggcgaataggggcgacggctggagtgaacgatcaccatgagtgcgcagcctcaatgtcacttttattgcacatgatgacatgtgcaataaaagtgacatattggtgctgggcggagagagcacgcgtggcgcgggcgaggtgtggttcgcggccatcggctagtatggtgcggtcacgacagagggaggcatgctgtggccgatgtgatgcgggagctggaacggctgcgaccggtgtatgagacgggcgtcctgcggttgctgttgcgccagaacgcgatgctgtacgtgtcgctgctgcgttccacgttcgacccgctcaccggcgagctgccgcgcgagaccgtggaggagcggttcgcgcaaagtctgaacgctctggccgacgccggcgaatatgcgccgcgcgaggaccagaccttcgccgcggccgcccatcagatcctcgccgacctgacccgtgaaggcgaaggcgactacgcctggctcgccaactcgcatgatgcggccacacaccgattcctctaccgtttgacggcccgtgcccaccgcgccatcgaggcgctgagcaggctcgaagacgaatcacgcgccctgtccggcgcgcaggccaacagcatcatcatggaaatcgagcacgcgcgcatgcagctgaccgccgaccccggcgagcgcatcaaactcctcaaccgtgaaatcaaggaacgcaagcacgagatcaaacgcatccaacagggcaagcagcatgccacgctgagcgaagcccaggtggaggacgtgatcgccgtgatccacaacacgctgcgcggcgtgcccatcgacctgcgcgaactcgtgctcgacgagcgggacaacggcgacgccttgcgccggcgcatgcaggccggcgacatcagcgtggacgagaacctgacccgctaccacgatgaataccgccgctcgttcagcgaatcggacagcggccgccgcttcgaggacgccttccaggtgatcatcaccgacgagggccgccagcaaatcgacgaagccctgcgcgccatcgccaaaaccccgtatctggccggcgaatccggcctgctgcttggccagatacgcgacgaactggcccgcatctacgacggcatcgaggccgtgcgtcgtcagatgcgcgtctccgacgaggcgatcagccggctcgtgcgccagcaaaccgacactcgctaccgtacgatgctcacccgcttgaaccgactgtacgcgcgcctcaacgcagatgcgaaaacccatatgggagacgcctcgcgcccgtgcgacacggccaccgcggacgcgctgttcgcgccattgccgatgcgcccggccaaatccatgacccgcgccaccgcacccggcctgagcgacctcgccgccgaagccccgcaggcgactccggtggccgatctgcgggatatggtcaacagcggcggcccccgactcctgcgcatggtcagtctcatccggcgcaacccggtgaccgttgacaggtccgatgacaggtccggcgcaaccctcgtggacatcgccgccagcttcaaccggctgcccgaaagcgaacgccgcgaaagcgagatcgtcggcttcctgggcgggctgggagccgcaagcggcagcgccatcgctgacgagccgtccactgacggcgtcggcatcgacagcgacatcgtcactgagccggccccggcgcagcgcggcgataccgcgacctggcattgcgtatcgatcgacggcgagccccggaactggatcactagaccggtgctggccgacatggacgagctgaacatcattgtggaggaaggatgaccgtggccgaggaacacgaggaacatatggacaacgccaacccgtacgccctgttcgaaggcgacaccggcgacatgccggccgaggcacgcatggccgccatcgccctcaaacgcgaccgctatatcagcgggcccacctacgacaccgtgctcgacaaccgcgacgccgtcgtacgctccctgaacaacgacctgctcgacttggtgatcaacgaacgctaccgcatcatgtacgccacgcccgtggccggcgacgacgtgaccctgcgctcgctcaaaacccgcgtcagcctcaaacgcgaggaggccgcgctgctcgccttcctgcgcatccgcgtcctcgaatacgagaacgtgcacgccgaccccgccgactggctcgtcagctttgaggagatccgcgccgcgctcgccaccggcgccggctatctggccgcccgcaacgacgaggaaggcgtggcaaagcagatcggcgccatcgtctccgcgatgatcacctacgggtatttggtgcgcctggacgacgaagccatgtaccagatcacgccgctcgtgcccgtggtgctcgaccgcgaactggccgacacctggctcgacgtcgtggaacacggcgacggcgacacggaagatgacgatgacgagaaggaagccgaatgatgcaggcgacagacgtgcagatgatcgcggaccggtggatgctggaatcccgccgactcatcaactggggctcctatgagggctaccacgaattccgcccctccacggaccacaagctgccggtgaccctgctcgccggcgccagcgaatccggcaaatccacgctggtcgacgcgcagatctccctgctgtacccaaccggcacgccgttcaacaaggcctcgaactccggccgctccgaacgcagcgactacacctacctgcgcggcatggtcggcgtgggcagcaccgaaaccggcgacgagccgctctacctgcgcggccgcgacgagaacggcgcaccgcaacccgtgtggggcgccatcgtggacacctatcgcaaccagaccaccggccaggtgctctcctgcgccaaattcctctacctgatgcccggcgacggccgcggtgacgtgcgccgccagtacgtggtctggggcaagcccgtggaccccaggcgcatggaccaataccgtgacgccccgttcacgccggcccagctcaaagccacctaccccgactgcctcacattccccagcgccgaagcgttccacacacacatctggagcgcaatgggcctgagcgaggccgcctgccgactgctgcacaagatccagtccgccgacgcgccctcccggctcgacgacatcttcaaacaaggcgtgctcggcgtgcccgaagccctgggcctggcccgcaccacggtcgaggactacgaacgttacgacgggaacttccacgccatggacgagaaaacccgccgcatggacacgctgcgcggcatccaacaggcctacggcgaatacgccgccgcacgcggcaaggcccgcgccttcgaaccggtcaagccggccgtcgacggcacggtgccggccgtgctgcgcgactgggcattggcccgcatgcgtggcgaagtcgccgtccaactgcccgccgaccgcgccgaacaacagaacagcgaggcggaagccaagctgctgcgccgccgaaccgaagacctgcgcacccgcctcgacatgatccgaggccagatgcagggtctggacggcggcaacctgacccgactcgaactcgaactcgaccaggcccgccgcaccctcgaagacgtgcaagccaaccgaacacgaatcgaacaaacgttcgcatccatcggcgagacgctgcccggcaacgaacaggcctggaacgagcgccgcatcaacgccgtgaacttcaaacgcgaatacaacaaacgagacggcgaatgcgaggaagccctcaccgccgccatcaacgcgcgggccggcgcacgcggcgacctcgaacgactgcaacgcgacttcgaccggcaacgctcccagcgcacccgcatctcccagcagatggacgaaacccgcgccatgctctgccgcgccaccggactcacccccgccgaactgccgtacgtggccgaacttatggacgtgaacgaacacgaggaagactggcgtctcgccatgaacgtcgcctacgcgcccatcgcccagaccatcctcgtcgacaagcgccacgaacagggcttcgccgccaaagtcagcaccatcgacccgcgcaccatgccccgacacacctggcagttcgtggacaccgcacgccactacgacgacaccggcgcgcacgcgaacatactcaccggagaacaggacggcgactggctgtccggcaaactgcgctaccgcgacgactcgcccttcgccgactggctgcgctcgcagacccaggccgaacgattcgacgccctatgcgtcaccgccatcgacgacaccgaccgcaccaaccgtcaggtgcaggccgacggtcagatcaaatccggcgcacgcggccagcacggcaccaaagaccgcgcccaggtcatcggattcgtcaacgaaacctacctcaacgcgctcgcagcgcaggtcgacgccgcccgcaacgcgctcagccaagccgacaccgactacacggccgccaaaacacagtccgataacctccaccgcgaactcgaactggccaaccagctcgcctacacgtcatgggaacgcatcgacatcaccggcgcgcaacggaccatcacggacacgcaggacgccatcgcatccatcaaaaacgatcccaaactcgccgaactcgccaaacagcgcgacgaactgaacgccgaactcgaccgtgtggaacgccagcgcatcgaatccgaccaggccgcggcccgcgccggcagcgccgtcgaagcggcgctcatctggctgcgcgaccatgccgacaccggcacgacggacgccgccggtgtcatcgccgacagcggcgatgacgataacgccaccaccggcccactgccggacgaagtcacggcggtgctcaccgaatcctacgacaaccgattcgccggattggcggacgccgccatgcgcgcacacatgatcatcggcgcgggcgtggccggaacgagggcgccgggggagagtttccccgaacgcaccatcgccggcatcggcaaggacatgacctcccgcatcgatctgctgaacggccaggccgacgccgcgcgtaccggcgtcgaatcgaaaatgagcacctacatcgcgctctacgcggccgacgacgactcgctgaccgccagcgtggaggactaccggtactatctcgacgaactcgccagcctcacccagctggccgcggtcgccgccaccgacgccgaataccggcgctgcctcgaacagctgctcaggagcttcctgaccatcaaacgcgccatcgacacggatgccagcgacatccacgaccagcttgaccgcatcaacgccatgctcaaaggccaacagttcggtcccaagcacggcagcctgtccctgcacgcggacgtgcgccgtcccgagcgcgccttctggacgcagctcatccgcgtcatcggcaccctgaacgattggaaatccgccgacgtcaacgattccgacgcctcgcgcaaggccttcgcggcctgtgcgccgatggtcgggctgctgcgcgccgaactcgcgcaggtcaaggacgcgaacggcgtgaaaagctacggcgcccgcaatctcgacccgcgctgccgctcgtccttctacgccatcgtgcatcatgccgacggtccggacgaacgcatcacctccaccggtggtcgctcgggcggcgccttgcaggagctcacctcattcgtatacggcgcggcgctcatctacctgctcggcggcggcctgaccagcgaaccctcgtacaccacgctgttcctcgacgaggcgctcatcaaggccgacggccgttacacgcagcgcgccctcgcggtgctgccgcgcctcggattccaggtcatcgtctccgccccggaaagcaagaccggcgaaatcctcgaggtctccaccaaggcctacgtgacctacaaggaccccgacaccggcctcacctccctgcgcgaggccgtgctgcaccagaatgacatggatgatgaatcatcgtcggatatattgaaggatgacggggttgccgaatgagcaatcccggcgtcgccggtattaagacgattcggtccactgatggtccggaattttgcatactatggttcggttttccggcctgacacgccatcgaacaagcgttcgaatttggtcgtgtgttcgggtatccttgggacagatttggcgcgcgcataaacgtgcgcgcgggaacggtgagatggaaggtagggtgtggctgtggcggcaacgcggactggcgcaaggcgcgcaacaagcgcaacgggcgcgaaaagcagcaagggcaagaatggtgaggtcatcgtcgaaaaggtgatgaccagcgactccttcctgagccgggagatcaaaaaggcgccgctgatcgaacacgatggttcgctggtagctgatatctcgcacatcccgaacgatctcaagatcacgattcagggtgcgcgcgaacacaacctcaagaatgtcgatctggcgattccacgcaaccgtatggtcgtgttcaccggcctgtccggttccggcaaatcctcgctcgcgtttgacaccctgttcgccgaaggccagcgacgctacgtcgaatccctgtccgcctacgcccgccagttcctgggtcagatggacaagcccgacgttgacttcatcgagggcctgagcccggccgtctccatcgaccagaagaccaccaaccgcaacccgcgttctaccgtcggcaccatcaccgaaatctacgattacctgcgactgctcttcgcccgcaccggcatcccgcactgccccgaatgcggcgagcccgtcgcctcccagaccccgcagcagatcgtcgacacactgctcggctatccggagcgcacgcgattccagattctcgcgcccgtggtcaagggccgcaagggcgagttcgtggacatgatcgagctgctgcgctccgacggctacgcccgcgcgctcatcgacggcgagatgacgcagctgtccgacgacatcaaactcaccaagcagaagaagcacaccatcgaggtcgtggtcgaccgactcgtggtcaaggacggtatccgccaacgtttgactgattcggtggaaaccgccctcaagctcgccaacggcagcatcgtcatcgacttcgtggacgaggaggaaggcagcccggcccgccgccagccgttctccgaacaccgcagctgcccgaacgggcacacgctcgaactcgacgaggtcgagccgcgcaccttctccttcaacgccccctacggcgcctgccccgcctgcaccggtctcggcttcaaactggaaatcgacccggacctcatcatctccgacccggacaagtcactggccgacggcgtcatcgaaccgtggagcggcaccaagatgaccgcccagtactacggccacatcctcgaaggtctggccaaggaaatgggcttctccatgaagactccctggaaggacctgccggacgacgtcaagcacgacatcctctacggccacgacttcaaggtcaacgtctcctaccgcaatcgctggggacgcctgcgcgaatactccaccggcttcgaaggcgtgatccgcacgctcatgcgccgccacgacgaaaccgattcgcagtccatgcgcgaatactacgagtcgtacatgcgcgaagtgccctgccaggtctgccacggacgccgtctgaagcccgaagtgctcgctgtcactgtggacggcaaatccatcttcgacgtgtgtgacatgcccgtcgtacgcgaactcgcctggatcaacggcctgaaactcgaaggctcggcacagctgatcgccggcgaagtgctcaaggagatcaaggcccgactcggcttcctgaacgacgtcggcctcgactacctgaccctctcgcgcgcggccgccaccctgtccggcggcgaggcgcagcgcatccgactcgccacgcagatcggctccggtctggtcggcgtcatgtacgtgctcgacgagccgtccatcggcctgcaccagcgtgacaacgaacgcctcatcgaaaccctgcaccacctgcgcgatctcggcaacacgctgattgtcgtcgaacacgacgaggacacgatacgccgtgccgactgggtggtcgacatcggccccggagccggcgaacacggcggcgaagtcatctactccggccccgccaagcacctcatagaagccaagcgctccatcaccggcgactacatcgcccaccggcgagagattgccgtgcccgccaagcgccgcaagatccacaagacccaggtgctcaaagtcgtgggtgtccgcgagaacaacctcaagaacatcgacgtgagcttcccgctcggcgtgctcaccgtggtcaccggcgtctccggctccggcaaatcctcgctggtcaacacgatcctctacccggtgctcgccgacaagctcaacggtgcacgcatcgtacccggccgccacaggcgcgtggaaggcgtggaccaggtgcgcaaggtgatccacgtcgaccagaacccgatcggccgcacgccgcgatccaaccccgccacctacaccggtgtgtgggacaagatccgcaccctgttcgccaagactcccgaagcccaggtgcgcggctacggccccggccgcttcagtttcaacgtcaaaggcggccgatgtgaggcctgccacggtgatggcacgctgaagatcgaaatgaacttcctgcccgacgtctacgtggactgcgaggtctgccacggcaaacgatacaaccgcgagactctcgaagtcacgtacaacggcaagaccgtggccgacatcctcaacatgcccatcgaggaggccgccgacttcttcaaggcgtacaccggcatctcccgatacctgaagaccctcgtggacgtcggcctcggctacatccgactcggccagcccgcacccaccctgtccggcggcgaatcgcagcgcgtcaagcttgccaccgagctgcagcgccgatccgacggcaaaaccgtgtacatcctcgacgagccgaccaccggcctgcacttcgaagacgtgaacaagctgctcaaggtgctgcagtccctggtggacaagggcaatacggtcatcgtcatcgaacataatctggatgtgatcaaggaggccgactggctgatcgatctcggtccggagggcggcgacggaggcggcaccatcgtcacgcagggcacgcccgaacaggttgccgaatgcgaatcctcatggaccggcaagttcctgaagcccatgctttagccttccattgcagctgacctcgggtgggtgggggtggtatgttgctggacatgctccgggccgctcaggccaagtctttacggtccagcaacacacaccccaacccacccaatccctgatgattggttttgcttaatagcgaggaggattatgacgaacgatattgagcggcatagtccggatgagtggcggaagactgcggcggcgttaatgccggaaagcgtagctgtgggtgccggggaaacgacggcgaaggtgaatgcgaatggggcacctttgctgggggattctcgcgacctgttccgacccaagacctcggatattcccaccaaacccggtgtgtacaaatggcgcgacggggaagggcgcgtcatttatgtgggcaaggcgaagaacctgcgcaacaggctcaccaattatttccagccgctgtatctgctgcatccgcgcacgcagaccatggtgctgaccgcacgcagtctggagtggacggtcgtcgccaccgaactggaatcactgacgttggaatacacgtggatcaaggaattcgacccacggttcaacgtgcagttccgcgacgacaagacctatccgtatctcgcggtcagcacgggggagcgaattccgcgcgtgtgggtcactcggtcgcgcaaacgtcgggatacccggtatttcggcccctatgccaaagtatgggaattacggcacagccttgaccggctgttgcgcacgttcccggtccgcacctgcaccaccagcgtattccacaaggcgcaactgaccggacggccatgcctgttcgcctccatcggcaaatgctccgcaccctgcgtgaaccgtatcgaagcggacgaacaccggcggctgtgcgaacagctggtcggcgtgatgaccggacgactcggacggccctacatcgcccagttgacccgcgacatgaaagaggccagcgccgaactcgaattcgagaaagccgcccgactgcgcgaccagatccaaatgctggaaaccgtggtgcaacagaacgccgtcgtcttcgaccaggatgtggacgcggacgtgttcggcttcgccagcgacgagctcgaagcctcagtgcacgccttttatgtgcgcgccggctcgattcgcggcgaacgcaattggagcgtcgaacgagttgaggacatcgatgacgccgacttgatggccgaccttctggcgcaggtgtattcggacgccgccggggacaatcacccccagtcggccgcgaccatctccaccaatcgcgaggccatcggctccacgcaaaccatcacggccgcggacgctgtggcacgcgcccaggccacccgagaacgcaacacccgtcaggagaccaccggacgcgcggacctgctggcacccatcgcaccggtaccgcgcgaaatcatcgtgcccgtcgaaccggcccgccgtgaggaactcgaaggctggctgaccaatctgcgcgggggagcggtgaccatccgtgtggcctcgcgaggcgacaagaagcagctcatgggccgcgccaatgagaacgccagccaagcactgcagcgcagcaagatgagccgcatctccgacatgggcgcacgcacccaggccatgaacgatgtggccaaggcattgggactcgcggaagccccgctgcgcatcgaatgctacgacatttcgaacactgtgggcggtgccttccaggtgtcctccatggtggtgttcgaagacgcgatcgccaagaaatccgaataccgacgcttcgccatccgaggcaaggacggcaaaggcgcggtgggtgatctgtccgcactttacgagacgctcacccgccgcttcaagcacggcaacatcgccggcgactccggcgaaagcatcgacgcggaacagcgcgcggcctcggccgccggcaagatgaccactgccgtggcggcggagacaatcgctgcgaacggtaacgacaatggtgagaacggttccgacatcagtggcaaggggcacgcggtgccggacggagtgcagaacgatacacgggaaacttcgcccgacatcgtccagcagaacacaaaccggcatcactttgcctacaagccgaacctggtggtggtcgacggcggcaagccgcaggtcatggccgccgccaaggcgctcgaggactgtggcgtgaacgacgtggccgtctgcggactggccaaacgcttggaagaggtgtgggtgccggacgacgactatccgatcatcctcaaacgccagtccgaaggcatgtatctgctgcagcgtgtacgcgacgaatcccaccgcttcgccatcacctaccaccgccaacagcggcgcaaaggcgccctgcgcagcgcgctcgacgagattccaggcatcggcaaaagctaccagaagcggctgctcaaccacttcggctcggtcaaagccatgcgcgaagccagtgtcgaggacttcgagaaggtcaaaggcatcggccacgccaaagccgaagcgctgtacaacgcgctgcacgagcagtgagccggcccggtccagcagcccagagtgaattttcggttgcggggcctgtggttgacatattcgaagcaaagtgtcggctagcatgggaacagacatcaaggaggggatatggccaatcatcgttgcgctgtactcggcaaacccgtcgcgcactcattgtcacccgtgctccacaacgcggcctaccgttcgctgaaactcgacgattggctgtacgacaagcacgaagtgggagaggatgacctcgacgctttcctcaaaggcctcgactcgacgtgggctggcctgagcctgaccatgccgttgaaaaaggccatccaaccgtacggtgttccggaaaatctgtgggccaaggaactgaaggtggcgaataccgcggtattcgactggagcgtggctaccgatgatcccgcttggccgaacggcaagccagacatcaagctatacaacaccgatgtcatcggcatccaactcgccttcgaccatgccaatcgcgaactcggcgaacaccacaccgcatcgagaagcggcgccgcgctgatcatcggcaatggcaacaccgccacttcggcgttagccgcatgctgcatgatgcccgaaatcggccatatcatcgtcgccgcccgccaccccggaaaaaacaccgggcttaaaccagtggccgagaagttcgtcaacgtgcataacccgtatagcgaaatcgaattaggcgacgatcaggccctgctcgaggcagcccgcaacgccacctatgtcatcaacacgattcccggacatgcggccgacaacgtcgcggatgccctcaccaatgccggaaccgagccattctccggactgctgctggacgtggtctacgatccacgccccaccaagctcatggaagcctggcgcgctcatggcggtcacgccatcggcggtgaagaaatgctgctgtaccaagctctcgtacaggtattgctgatgaccggtatctgggatgacgacccgcccagcgatgccgaccagcgtctgcaggacaccaccaccgaagacgaccagctggagatcgcgatgcgcaaagctcttgaggaggcgttgtaatgagtcaacagacaacaatccgcgataccggcgaggcggccgccacgaatgcgccggcgaattccgcgacatccacatcgactccggacaaccagccgaccccgcttgatgccttcgaagtgctgctcatcaccggtatgtccggcgcaggccgctctcatgccgctgactgcgtggaagacatgggatggtatgtggtcgacaacctgcctcccaaactgcttatcccgcttgtcgacatgatgaccacctccggttccggatcggggtcgggcgtccacaagcttgccgccgtcatcgacgtgcgctccagctatttcgacgagctggccgccgtgctcggccatctggatgatctcggcgtcaaaacccatattctgttcctcgacgccagcaacgaagtgctcatcaagcgctatgaatccgtgcgccgcccgcacccgctgcagcacggcaaccgactgatcgacggcatccttgaggaacgtcacctgctggaagacctcaaggagcgagccgactgggtcatcgacaccagctccctgagcatccaccagctgtccaccaaactctacgagacgatgctcggttcaggccccaccaccgtggcggtacacatcttcagcttcggcttcaaatacggcatgcccatcgacgccgatttcgtggccgacgtgcgttttctgcccaacccgttctgggtgcccaacctgcgcgagcttaccgggcacgacaagccggtcgccgactacgtgctttccagcaagggtgccaaggaatttctcgacgcttatgagaaagctatcgagattgcgttggaaggatacgcccaggaagacaagcactacgtaaccatcgccgtcggctgcaccggtggccagcaccggtcggtggcgatgagcgaggagctggctcgccgcttacgcgcacatgggctcaacgtaaccgtttccgcgagagaacagcacaagcgtcactcatcgtaagcaggcgtcgagcggtcatcgggcaagcgttcggtgaccacactgcgagaaagcaaagcccataatacgtatcaaacgggttcgcttgtccaccagattaggtatcacagaaagccgatggcttccgaccgtgtgacagcaaataacggcacgaagcgcctgaagcattgagaagaacgggactgtaggaggtagatcttggctcttctggacgatgtcaaaagcgagttggcggcctttgaaggcgattcgccagccgcgatcaaggcccaagctgcggccatgatccgttttggcggcggtcttcgaccggtacagaatacatacgttatccaagccgtattcacctcgcttgacgttgcagaatggctgaagaacacgttgaggaacacgttcgggcacgaagccgagatcaaccacctcacccgtcagaccccgaacggccctgtcgagacctacgtggtgctcgtcacccgcaacgtagtggccttggctttgcagaccggactggtcgaccgccgcaagcagcaggtccgtggactgccgtctgaagtggtcaacggatccatcgcccaaatcaaagcggcatggcgcggcgccttcatggcccgtggcttcctatccgatcccggtaaagccagcttcctggaaatcgcttgccctacggaagaggccgccatggccctgtgtggcgtggcccgtcgtctcggcatccaggccaagcatcgcacgctgcgcagctccgagcgcgtgaccctcaaggatcccgacgccatcgaacgcatgctcaagctcatgggcgccacccgttcggcccgcgaatggaccggcaagcgctccgatggagaggcccgcggcaaggccaatcgtctggccaacttcgatgacgccaatatgcgccgttccgccaaggccgccgccgaagccagcgaaaaagtgcaacatgctttcgaagtgctcggcgataacattccggacaacctccgtcaggccggccagctgcgcatcgatcacgtggacaagagcctcgaggagctcggcaagatcgccgaaccgcagatcaccaaggatgcgattgccggacgaattcgccgactgcttcagcttgccgagaagacggagaaggctcgagcagccgaaggcaagtaacccgacaatccgatttgtcgtgcctattcggcagaacgcgacaacgacagaacaaaacaccgcattcagtcagtagacgaatgcggtgttttgttccggaatgcctgtaatatgcaaagtggcaaaattggccactttgacgtgcgattcgtcaaggaaaggatattcatgaagacactcaaggaccttggagatctcaagggcaagcgcgttctggttcgcgctgattttaatgttccgctggacggcaccaccatcaccgatgacggtcgaatcaaggctgctctgccgaccatcaagaccctgcgcgaagaaggcgccaaggtcatcctcatggcccaccttggccgcccgaagggcaaggtcgttcctgagctgagcctggccccggttgccgcccgcctcggcgagctgctcggcaccaacgtgccgctggccaaggacacctacggcgaggacgctcaggccaaggtcgccgccatgaacgatggcgacgttgtgctgcttgagaacgttcgtttcaacccggaggagacctccaaggacgccgacgaacgcgccgcttacgccaagaagatcgccgccctcggcgaggccttcgtttccgatggcttcggcgtggtccaccgcgcccagggctccaactacgacgttgccgccgatctgccggccgccgcaggcctgctggtcgagaaggaagtcaaggccctgtccaaggccaccgagaacccggagcgtccgttcaccgtggtgctcggcggttccaaggtctccgacaagctcggcgtcatcgagaacctgctcgacaaggccaaccgtctggtcatcggcggcggcatggtgttcaccttcctcaaggccaagggctacgaggtcggcacctccctgcttgaagaggaccagcttgagaaggtcaagggctacatcgagaccgccgagaagaacggcgttgagctcgtgctgccgaccgacgtcgtcgtgaacgccggcttcccggccggtgacaccccggttgctcctgaagtcgttgccgccgacgccatcccggccgacaagatgggtctggacatcggcccggagtcccagaagctcttccacgacaagatcgtcgactccaagaccgtcgtgtggaacggcccgatgggcgtgttcgaggttcctgagttcgccgccggcaccaaggccgtggcccagggtctggtcgacgccaccgcagccggtgcgttcaccatcgtcggtggcggcgactccgcctccgccgtgcgcaacctcggcttcccggaggacggcttctcccacatctccaccggtggtggcgcttccctcgagttcctcgaaggcaaggagctccctggcctgaaggtgcttgagtaatccattttctagctcccctccttgaggggagctacgtattttctagaagggaaacatatggcgtccaaacgcattccgttggtggccggcaactggaagatgaatttcgaccatcttgaagccacttacttcgtgcagaagctggtatggctgttgcgtgacgctcacttcgacttcaaacgctgcgaagtcgcgcttttcccctcgttcacgtcattgcgcagcgtacaggtgctggtcgaagccgacaagctccatgtcgcctacggcgcacaatccgtttccgtgaccacccaaggtgccttcaccggcgatgtgtccgcggacatgatcgcccatctcggctgctcatacgtcatcgtcggccactccgaacgccgcaaataccatcctgaagatgacgccaatatcgtcgatcaggtacgtgccgtgttcgccgccggcatgcagccgattttgtgcgtcggcgaaagcttcgaggaacgacgtcaaggcattgaactcgatttcgccgtgggccaggtacgagacgtcacccgcgatctcaacgaagaacaagccgccgaactcatcgtggcctacgaacctgtctgggccattggcaccggcatggtggccactccgcaatccgcccaggatgccgcaaacgccatccgcaacgatttgaagaccacctttggcacgaaggtatccgatagcgtacatatcctgtacggcggatcggtcacctcgaaaaatgcggcggaactcatttcccagcccgacgttgacggcttcctgatcggaggggcggccttggacgttgaggaactcgccaaaatcgctcgattggcacttaaatccatgaaatcacggaactaataccacggttttcccgtgtgtgcgctatgctggtcaacagtccaatcaatccggaggtaccctgtgaccgctcttaagatcacgctgcaagtcatcgtcgtgctgctcagcttcgtgctgaccctgctcatccttatgcacaagggcaagggcggcggtttgtccgacatgttcggcggcggtctgacccagaacgccggtacttccggtgtcgccgaaaagaacctgaaccgttggaccgttatcatcgctctggtgtgggtggccttgatcatcggcctcgacatgatgaccaagttcaacctcggctgatcggcttgcacgccatatagacttgtcgctcgcgacccatgaccgttaccgtcggtcatgggtcgtatgcgttctatcgagtattacgaaaggacatcaccatggtcactatgaaccgcaacaaagtcgttatcgtcggcaccggccaggtcggtgccaccgccgccttcggcatcgtcacgcacggcctgtgcaatgagcttgtgctcatcgaccgttccgccgccaaggccctgggggaggcccgcgacctcgatgatggcagcgaattccaggaccgccacgtcaaggtgcgcgccggcgactacgccgactgcaaggacgcggacatcgtcgtcatcaccgtgggccgcaagccgccggccaactccaaccgcatggccgaactcggcttcaccgtgggtcttgtgggcgaagtggtcgacaacgtcatggcctccggctttgacggcgtgatcgtcatggtctccaacccggtcgacgtgatggcttggtatgcctggaaacgttccggtctgcctcgcacccaggtgctcggtaccggcactgcgctcgacacctcgcgtctcaagaccatcatcggcgaagagaccggccttgacccgcgcaacgtgggtggcttcgtgatgggcgagcacggcgactcccagttcaccgcatggtccaccgtctcgctcggcggcaagccattcgcccgcttcctggccgacaaccaagaccgtttcgcctccgtgtccaccaccgaaatcgaagagaagacccgcacccgtggcgatgagatcgtcgcggccaagggcggcaccaacttcggcatcgcctccaccgtggccggcatcgtgcagaccatcctgtgggacgaacgccgtatcgtgcccgtctccaccctgctggacggcgaatacggcgaacatgacgtgtttctcggcgtccccactgaactgcgggccaatggtgccaacgagatcgtcgaactcgatctgagcgaggacgagcgggccaaactgcaccattccgccgaactcgtgcgtgaccactgcaaggggctgctgtgattctcgacgccatcacaccgaaacaaccccgactgctggtcgccgacctcgacggcacgttgctgcacgacgccgaggtattcgaggaccggttcatcacccagcgcagcatcgacaccatcaaccgcgcgcacgatgccggactgaaattcgccatcgccaccgcgcggccggtgagtaccggcctccagttcgccgaaaaactgccggtggacgccgtaatctatctgaacggcgccctcatcgatttcgacccggcccactccgacttcgacctgctcacctcaggtgccacgccggccgatgagaaccatttgatcaagattggcttctcctcacggcgtgcctgcgaagtctgtctgttcctgctcgatcgcatgcccggcctgaagctcggcatcgtgatgaacgacgtgcgctacaccaacttcgatgtgcgcgtgtattggaaaactcaggccttccaatacacgaacttccacgacgtgcccgaaggcgtggcggacaagatcaccatcttccccgagcctgaacagtggaacgagctgcgtgcgctgattccgccggacttcgacatctccatcagcgaaggcgtgatgtggatgctcatgaacccgcaggccaacaaggagcacgcgctgcgtctgctatgcgaacggatggatgtgccgctcgaacagaccgccgccttcggcgacgacctcatcgatatcaacatgatgagcgaatccggccggggtgtggccgtggccaacgcgaaccccaaggtgttgtccatcgccgacgagatctgcccgtccaacaacgaggacggcgtcgcccaatggattgaagcgcagttgggctgaaccggtcgagacttgagaacacgccaaaattgaacttgtgttgaaccgggagtatgctttgaaccgttgttcaaaagataaattgaactcccggttggaggcataaggatatgagcgtatcggtgtttgcggaacgtctgcgcaatgcgatgaacagcaggggactgaagcaggtcgatttggtgcacgccgccgaacatcgtggcgtaaagatgggcaagagccacatcagccaatacgtggccggcaagaccatgccccgcgaggacgtgctcgaattcctggccagcgaactggacgtcgacgcgaactggctgcgcggcgaggaatcatccgctccctccaatggcgacgcggcaccggagggagccgggccgcggacggacgatgggaccgcgccggcgcgccggcgtaccttcggcaaatcgcacaagcttgacaacgtgctctacgacgtgcgcggcccggtcgccgacgaggcgatgcgcatggaggccaacggcacccacatcctgaaattgaacatcggcaatccggcacccttcggcttccgcacgccggacgaagtcgtctacgacatggcccaccagctcaccgacaccgaaggctactcgccgtccaagggcctgttctccgcgcgcaaggccatcatgcagtacgcgcagctgaagaacatcccgaacgtcaccatcgacgacatctacaccggcaacggcgtcagcgagctcatcaacctgtccatgtccgcgctgctcgacaccggcgacgaagtgctcgtgccctccccggactacccgctgtggaccgcctgcgtgaacctggccggcggcaccgccgtgcactacctgtgcgacgaacagtccgaatggtatccggacatcgacgacatccgctccaagatcaccagcaacaccaaggcgattgtcatcatcaacccgaacaaccccaccggcgcactttacccaaaggaagtgctccagcagatcgtcgacatcgcgcgcgaacgccggctcatcatcttctccgacgagatctacgaccgtctcgtcatggacggcctgcagcacgtctccatcgcctcgatggccccggacctgttctgcgtgaccttctccggcctgtcgaaatcgcacatgatcgccggctaccgcatcggctggatgattttgtccggcaacaagcgcatcgccaaggattacatcgaaggcctcaacatgctcgccaacatgcgcatgtgctcgaacgtgcccgcccagtccgtggtgcagaccgcgctcggcggacaccagagcgtcaaggactatctcgttcccggcggccgcgtgtatgaccagcgcgatctcgtctacgacatgctcaacgccatccctggcatcagcgccgttaagcccaaggccgcgttctacatcttcccgaagatcgacgtcaagcggttcaacattcactcggatgagcagttcgcgctcgatctgctgcatgaaaagcacatcctcatcagccatggcggtgcgttcaactggcggcatcccgaccacttccgtgtggtgtacctgccgcgcataggcatgctgcacgaaaccatggaggagctcgccgacttcttcagctactaccggcagaactgacccatggcgcatacagacgcacttgattcagggctgggcgtcacgccggtgccccgtctggccctcaccatgtcgttccccgccatcgtggcgcaggcggcgaacgcctcgtacacgatcatcgaccggatgttcatagggcatatccccgaagtcggcaatgcggcgatgacgggagtcggcatctgtttcccgattctgttggccgtcaccgccttcgcctcgctgatcggcgccggcggcgcgccgcgcgcctccattgaactcggtcgcggcaacttcaagaaggccgagcgtatcctcggtaccagcacggcgttcctcgtcgtcatagccctgaccctcaccgcggtgctgcagtcggtgaaacggccgattctctatgccttcggcgctagcgacgcgaccatcgcctatgcgaccgatttcatcaccatctacctgatcggcaccgttttcgtgcagttgacgctcgggctgaacagcttcatctcggcgcagggcaagaccacggtggccatggtctcggtgctcatcggcaccggtgcgtccatggttctcgatcccgtgttcattttcgttttcggatggggcgtcaggggagcggccgccgcgaatgtgatcgcacaactgatttcgacggtatggatcgtgctgttcctttcctcggggcgcagcgccattcgtctgcgcccggcgaacatccgaatcgaccgaatcatcattcccgtgttgacgcttggtctggcgcccttcatcatgcagattacggaatgtctgatcaatgtggtgttcaatgtcggtctgcagcggtacggcggtgatgattacgtcacctcgatcaccatcatcacgtcgctgatacaggtcgtgggcgtactgaccggcggttttcagcagggcatccagccgatcatagggttcaatttcggcgcccgcaatatgcggcgcgtccggcaggcgattcgcatggccttcgtcacgcagatcgcctccgccacggcgttggtgtcggtgcttgccgcattcccgggattcttcgcatcatggttcaccacggaacagacggtcatcgacatcgtgacccgcatgatgccgatcttcgtatgcggctggggcgtcttcggcatccagctgggcgcgcaatgcgcattcgtcggcatggggcaggccggacagtcggtgttcctggccgtcttccgcaaggtcatcctgcttgtaccgctcgcattgctactgccgcattggctcggcgtcgatggcatcttcatcgccgaacccatctccgacgccacctcgggcatggtggccggtctgctgttcctcatcacctaccgcaggatccgacggaatctggtctagatgtcgcggccggcaggcgtgacgcgccgcttgtcgacgatgccggcaatgacgccgatgacggcgggtaggatccagccgagctggtactgctgcaagggcagtgcggccagcgcggcatccagccaggcgatgtcgccgccgaacacgacggccaagctggagacacaggtggcgaaggaggtgacggccaccagcagcacggtccagaaatagacgcgcgggaaccgcgcgccgagcatggtatgggtgagcgcgagcagcaccagtacgatggcgatcggatacaatgcggacagtaccggcacggagaccttgatgatcgcgctcagtccggcgttggagacgatgaagctgaacacggtgaagatgacctgccacgtgcggtagctcggcgttcgtcccgcgatggagcggaatctggcgtggaaataggtggcgcaggtgcagatcagtccggtgcacacgttgaggcaggctatgacgaacacgataccgaggaacgcggtgccgaaggtgccgaacagggacgaggtgaggttggtgagcacggtcgcgcccgtgtcctttgccgggtcgatggcgctgatggcgccggataccgctcccacatagctcagcgctccatagatcacgatgagcagaacgccggtgccaagaccggcgtatgcggtctccttctgcacttggatctcgtcatcgatgtgctgggcgcggatgttcgcggagatcacgatgccgaagtacagcgcggcgagcagatccatggtctggtagccgtcgaggaagcctcgcgtcacctgattggcgaagtagtcgcccatcggtttggccggcgtgccgatgccgtgtaccaggcatgcgacgaacaggatggcgatcagcaccagcagcagcggtcccatgaaacgtccaagcaccttggagagtttctcgggatgctgggcgagcaggaaggccaatgcgaagaacacgcacgagtagatgagttgcgcgagccagccgtaggaagccggcacgaaaggcgacaccatcatctcgaatgacgtggtggccgtgcgcggaatcgcaaagcaggggccgatggtaagcatgatcgccacaccaagaaacagggcgaatccgggggagacccgtcgggcgagcccatcgaatccccctgcgaaggtgaccgcgaggacgccgagaatcggcaatccgaccgcggagacgatgaagccgacggctgccggcatggtcgccgatccggcctgcgcgccaacgaatggagggaagatcaggttgcccgccccgaagaacatcgaaaagaaggtaaatgtcatcaccaaccgttggtgcgcgacaagcttgttcattgcggaaaacacctttctcccgtgtggccgtagcactatggcatcggattgtccccgggtctgcgcatgacgggtctcccttccggggcaccctcgcagaggatacgcataagccccgaccggttggggtcggggcttatcgaaccgtcaatccggcacgtcaatcacgcgccggcgtcgcggctcaggcgttcacgcggtcgatgccggactggacgtcggccagcacggaatcccaagacttgatgaaggcggcgacaccgtcggcctccagcttgtcggtgacgtccttgaggttgatgcccagctcagccagcttgttgatgacggcgtgggactcctcgaaggtgccctcgatggacggagcgccgttgccgtggtcggcaagagcgttcagggtcttctccggcatggtgttgacgatgtgcttggcgaccagctcgtcaacgtacttgcagtcggagtaggcggcgttcttggtgccggtggaggcccacagcggacgctggaccttggcgcccttggcggccaaggcggcccaacgcggatcctcggcgaacttcttctcgaagagctcgtaggccagacgggcgttggccacggcggccttgccctcgagggccttggcttcgtcggagccgttggcttccagcagcttgtcgacggcgctgtccacgcgggagacgaagaaggaggcgacggagccgatgtgcttcaggtcgtggccgttggcgtcagcctgggcgatgccctcgatgaaggcgtcgatgacctgctcgtaacgctcgagcgagaagatcagggtgacgttcacggagatgcccttggccagggtggcggtgatcgccggcaggccctcgagggtcgccgggatcttgatcatggcgttcggacggttgaccttctcccagagttccacagcctgcttggcggtgttctcggtgtcgtgggccagacggggatcgacctcgatggagacacggccgtcgacgaagtcggtagcctcagcgatctcgcggaagatgtcggtggcgttgcgcacatcggtggtggtgagctcgcggacagcggtctcaacgtcaaccttgccgagctccttgagctgagcgtcgtacgggccgacctggctcagggccttctggaagatggacgggttggtggtgacgccgaccacgttcttgttggcgatgaggtcctgcagggagccggactcgatgcgggagcgggacaggtcgtccagccagatggaaacgccgttgtcggacgtacgctgagttgcttcagtcatgtttattctccttatattccctattggaacaaatctgtagggcatacccctgcgatctgcagggtctgcggcacggcggacggacccggaccttcgatgaccggccacgccggcggtcttggcccatccgtcatacgatcgtctcccgctgtggagactgacgactcaactcgccagcgggagacgcatgatcacttggcggcttcggcttcggcgatggaggccttggcggcttccacgacgtgctcggcggtgatgccaaggtcgatcatgttctgagcgccatcgccctgcaggccgaactgctcgatggagacgggcttgccgtaggagccgaggtacttgtaccacggcatggcgacgccggcctcgacggagacgcgggccttgacggcggccggcagcacggcctccttgtactcggcgtcctgctcctcgaaccattcgagggacggcacggacacgacgcgagccttgacgccctcgccggccagggtcttggcggcggccacggcccactggacctcggagccggaagccatgaggatgacgtccggggtgccctcggtgtccacgagcacgtaggcgcccttgcgaacgccttccttggccttggcggcggtctcggcgagcaccgggacgccctgacgggtcaggatcatggcgccgggcagcgtgttcttcttctcgaagaagtagcggtaggcctcggcggtctcgaaggcgtcggccgggcggatgacctcaagctgaggaatcgcgcggaaggaggccaggtgctcgaccggctgatgggtcgggccgtcctcgccgacggcgacggagtcgtgggaccagatgtacaggttcgggatctgcatgagggcggccagacggacggcggaacgctcgtagtcggagaacatgaagaaggtaccgccgaacggacgggtgtgcgaaccgagcaggatgccgttggtgatgcagcccatggcgaactcacgcacgccgaagtgaagctggcggccgaactcgttgcaattcggccactgaacggtggcgcactcggccggggcgaaggtggcggcgcccttgaggtcggtcttgttggagccgccgaggtcggcggagccgccccagagttccggcatgacggcggcgatggcgttgagcacggagccggaggcgccgcgggtggcgacgttcttgccgacttcgaaggtggcctcaaggtcgtccagggccttatcgaagccttccggcagctcgccggccttcaggcggtcgtacagggcggccttgtccgggttggccttgcgccaggcgtcgaacttctcgtcccaggccttgtgggcttccaggccgcgatcggcgaccttgcgggcgtgggccagggcttcttcgtcgacgtggaaggactcctccggatcgtagccgaggagcttcttgaggccggcgacggcctcggcgcccagcttggagccgtgggaggacgggtcgttggtcttgcccggggtcggccaggcgatcagggagtggaccttgatgagcttcggctggtccggagcggccttctcggccttggcgatgacgtcggccaggccttcgatgtcctccttgtaggagccgtcgggctggatgaagctgaactcgtcggtgtaccagccgtatgcctggaagcgcttgagcacgtcctcggccagcaccaggttggtgtcgccttcgatttggatgcggttggcgtcgaagatcacggtcaggttgccgagcttctggttggcggccagggaagcggcctcgccggagatgccctcctcgatgtcgccttcgccgcagatggcccagatcttgtggtagaacggggaatcttccttcggggtctccgggtcaagcagaccgcgctggaaacgctcgccgtaggcgaagccgatggcggaggcgagaccctgacccagaggaccggtggtcatttcgatgcccggggtcaggccgtactccgggtggcccggggtgcgggtggccgcgctgccacggaagctcttgaggtcgtccagggtcacgccgtaaccggagaagtacagctggacgtactgggtgagggaggcgtggccaccggaaaggatgaagcgatcgcggccttcccagttgggatcattcggatcgtgcttgatgaagtgctggtacagcgtgtaggcgacgggcgccagggagacgggggagccggggtggccggagcccgccttctcaaccgcgtcagccgaaaggaccttcgccatcttgatggcgcgctcgtcgagctcggtctccttgaattcggtcatggattactttccttccaattggtcgggccgcgtatccggcttgtgccgggcgcttgacgccctcacattgcgattaccatgctaccgtcggtttgcgacgttgtggtgcaattttggcgtgttctggtagtttgtgttctgttaacgttcacagtgaacattgctacgctgcaaacgaacgcattagcactcaagcctaaggagtgctaatacaatgttctaggatgaagtgcgccacctgcacgtggcggagccaagaaagaggcaatatttctgggttcccgcgtgtcgcggcgtggcgaaccgaccgtcggggtacgccctgagtgaaccgtgactgatatgaatatgtgtatatatatgaggaggcgcgcatgacgcaatcaagacgcatgctggtgctgcgcgccgtggtggaggattacatccgttctcaggagcccgtgggctccacttcgctgacgcgcgaccatgatctcggcgtcagttcggccaccatccgtaacgacatggccgctctggaggacgaaggctatctgattcagccgcacacttcggccggtcgtgtgcccaccgaaaagggctatcgatactttgtggaccgacttgctaccgtggtgccgctcagcgaggcgcaacgccgcggcatcaacagcttcctgtccggatcggtgagcctcaaggacgcgctgcagcgttcggcacgactcttgtccgaaatcaccggtcaagtggccgtagtcacctcgccatcgctggccaaggccacattgcggcatgtggagatggtacccgttgccatgaccacgttgctcgcggtggtgattaccgacaccggccgcgtggcccagcacggcctgaccatcgcatccatgcccgccgtggacgagatcaaccggctctccaacaccgtcaacgaacaatgtgtcggactgtccctatcgaaatccgcggagaccgtgcgatccatcgccgccagcgccggctacgagtcggtgcgcggcgtggccgacgcgctggccgacgccttcgaatcgatggcattggacgaacgtgcgaacgaactgtacatgtccggcacctcgcacctggcccactcccggtccctgaccgatctggccccgctcttcgacgcgctggaagaacaggtcgtgctgatgaagctcatgagcaacctgagcgaggagacgaatgcatccggcgtgggcgtggccatcggctccgaaatgcacacccccggcctgctgcatgcttccgtggtcagcagtggctatgggcgcagcggtgaggcgggcgaaccggcggggaacgatcccgtaggcgaacccgaaaccgaatccgagacggagagccagacgaacgacatggaacccatcgccttcgttggctccatagggccgacccacatggactatgcggccactatggccgccgtcagggccgtagccagatatttgaccgccttcctctccgaaggccggacccaagactgaccgccgtctgtggcacaatgacccgcagaccaaacgaacacaaaggatcaatcaagtggcagattattacgagacgctgggtgtggaacgcggcgccagtgacgacgagatcaagaaggcataccgcaagctcagccgtaagtaccaccccgacatcgcgggccctgaattcgaggacaagttcaaggaagtgaacaacgcctacgatgtgctgtccaatccggacaagcgccgcatgtatgattcgggcgtcgacccgaacgatccgaacgccggtgccggcggcttctccggggcgggcttcggcgatatgagcgacgtgttctccacgttcttcggttccgcgttcggtggtggctcacagggcccggtgccgcgtacccagcccggccgcgacgccctggcctccgcgtccatcgacctgaagaccgccgtgttcggcggcaccgcgcatgtcaagatcaatacgttctccctgtgtcaggagtgcggtggctccggtgcccagggcggcgcgcagccggtcacctgccccgactgccacggccagggattcatgcagaaggtcgtgcgcaccatgctcggccagatgatgacctccgccccctgcgaacgttgcgagggccacggtaccatcatccagaacccgtgccccagctgcatgggccacggccgtgtgcgcaccacacgtaccgtgggcgtcaccgtgcccgccggcatcaacgacaacgcgcgtctacgcttggccaatcagggcgaagtgggtgagggcggcggcgctgccggcgacctgtacatcgacattcgcatcaaagcggataagcagttcactcgcgatggcgacgacctgcactgctggattcaggtgccgatgagctgggccgtgctcggccacgatctgtccattaacacgtttgacggtgagaagaccgtgtccatcccggccggctgtcagcctgaggatacggtgacgctgaagggactgggcgtcacgaacatccgcaacaaggacgagcgtggcaacctcatcgcccacgtcaatgtgctgattcccaccaagctcaacgaaaccgagcgcggcctcatcgaacagttcgccgcctcgcacgattcaggcgccacgcacgtctcccaggcatcccgtccacaggctggccaaaagaaaggcttcttcagcaagttaaaagacgcactgagctgagaacgggttggaaaatggccgctttgccttgcggaagtagggctgagcggcttttttcgttttaaccagttttaacggtttttaacctgtttttacggaaaatgtgggcaaaatgtgggcagaaatcgagcccgcgaagccctctgccacaacgcgaaatcggccccgtccggcagcagtcaagctctgtgcgagctgtctgcgatgccggacggggccgaactatgtgtggttatgcggcgcggtcgaggcgctgtttgatggcgctgacgccgatgagcgcgccggcgaggatgccgagcgcgttgagcgtggtcactatcgcgtccacgtggggccagccccatgcggggccgaccgtgcccacgaacagggcgagtgcgggcaggacgatgaggcccagccatttgaggatgtcgtagacgcggctggggatgagccagtcgggcacgatgtcggtggatgccggtgtatcggttggattgtcggtcatgtttgctccgatcgtaaaaatgatggtgatgccgtcacccgcataatcgggtggcggcatcggtttgggttagcggcaggtcaccgtgtcgcccacgtagtagacgttgatgttgccgctggggaccgaacactgggagacgctgtagccgtgggaggtggcgaactcccacacggtgtcgccccactggaggaccttggagaccccggtggacgatgcgggggcggcagtagagccgccgccgtaggtgacgacatcgcccacgtagtagcggttgatgtcaccgcttggcgtgtgccatgcggacaggggccatgcgttgtaggctacggcgagtccccagatggtctcgctccactgcatgacgtggctgatgccacccgtgttggtgtcggccgggggagtgttcggctgtgcgggcgcggccggtgtggccgggggcgtggagccgccggcggggttggcgtacaggtcccactgccatgcgtcgccacggaagatgttgaggtcgatgggactccacgtgttgacgacaccggtgccgctgtattggcgcatggcctcgccgtatgcgccgatcatccacgggttggcctgatagccggtcgggctcatgttggcgtactgggcgatccacaaaccgtaccggtcgcggatgtcctgcgggatggtgccggcgaccgggccggtgtacagcaatgggcgcacaccacccgacaaccgttcgcactcattcatgaatcggcgtacccaatcccagttgccccatgcggggttgtcgtccatctcccagtcgagcgccacgatgccgtgacgccaatagttcgacgtgttccggtagaagaattgggcttcggcctctgggttgcctcccatcgcgtaatggtagaggccgaatttcttgccggattcctgcgcttgggcgatcatgcggttggcgtccgtgttgacgccggacacgagacagttgttgtacacctgtcccgtgccccatgtggtgccgacgacaacgaagtcggcctgcgtgttggcgatgtcgatgccgcactgccagttggacacgtcgatgccctgcatgtcggccatcgccgccggggcgaacgccatggagaccgcggcgacgagcgcggtcagcgtcatgcccacgcgccggtgcaggagtccgtgtttagacttgtttttgtcgaggattcccacatcctctccttcccgcccggtttcccgggcaaacgaaaaggccgcccggaatgggtggcctatggttgaaaatcgcatgcggcgatgtgatgcgaggtgggcggcaagccgccgcatcagccggcatcccgcgccgcgacggtctcgggcgcgatgtcggcgcgcagctcgtccggcaggcccggtttcggatggcgcgccatgaacgcggggtcggtgatctcacagaactcctgcagccagtggaaaagcgaacgggtgtacgccgtgagcgcgaagtacttgcgctgctgtctctccagatgctcgatctgctcctcctggtcgtccacctgctcacgcaatggcttgatgaccgaatcggtcaggatgtcgcacgcctgcgcggcgatctgcgccgtgtccttgcgacgcgaggagacggcgccgatgatggcgcccactccaccgctgccgacgagagcggtgatcgccgccgtccagaactccggaggcatcactcgcccgcctcgtcggaacgccatgtcttgatcttggtgatggcggcgagcttcgtggcagtgaccgtggcggagcacttggtgtccatgtcagagatggtcgcctctcccgcctgacggtccttgagcacggccgtcacgccgcgcgtgtagtcgcaccatacctccccgtccgcgccgccgtggtcgaacgtgagcccgagacggagcagctggtatacgatgctgcctttgggtgggcgcagatcgagcacgccggtctccgcagttgtttcgttgtcattggccatgatggcctcctttctgtttgttcttttggattcattgggcgatgctcagctggtcgagtgacacccagtcccagacgccgtagatcttcacctgttttgtgttggccggtacgtacgtgttcgtccattcgagcttgccgttccggtaggcgggcaggaggaagttccggtttacgggtgtcgtagccaggtcgagcaggtcggggtcggcgaagaggctgttgtcgccattgaccgtggtcttgactctgcctcggaagcgcaggcagcctccccggtacccgtacgacgcgtaaccctcgcatccattgcctgtcgtgatggtctgccagccggtctgccatatctggaccgattcgtggttgttgaagacggcccccgccgtgttcatgcggagcgcgaaatggttgtctccgtatggtcccgccgtcagccggtcgaggtggcttccatcgctcagcttgagcttcgatttgatggccaggaggtcgtggccgagcttgaccacatcctcgacggcgccgtccgcggcgtgggtcttcacgtggaaggcgccgtcggtgccgaccagtgcggacggtcctgtgaacacgccgttcgaccgcttgcccacctgtacgccgtcggatgtgaggctgatgcagtcctccaaggcccccacgcgcgaccgtgcatcggacgcgtccgatttggccgtgttggccaaatcccgcgccgtctggttttcggccttcgtcgcgaacctgacatccagactcgcgttgttctgcgtgatcttcgaactgatctcctgcgtgacgccggatttcgtcgcgtacgtcgacgacaccgtgcttgtgatgctgttcgcggtggcggtgatgtccgatttggtggccagtcccgacccgtccgcgccacggtaattctgcatcacgcccaaggccaccgacttgctggtctggtcgacgtagctgcgcgtgctgagcgtgtcgtacgcgaggttctgcgcgacgccgttcgtgggttccgagtccagtatcctctcgccgctgcagtttgggccgtcgttccatgaccggtagtcgccctggagcgcgtagtgcccgctccaccaggcccacggcaggtacgcccagatgtcgcaactccgatcgtcgaacgcgagcaccttgaccttcacgtcatccgcgttgcggatgcggttcacgctcacgccgaacgcgtgcgatgcggacggatgttcttgccagccatccttgacgaagatctcgaactccgcgttctggcgggcagcgccgttgaagccgtcgccggagtagacgtgcagaaggacgctcgacgagtcgccgttgctggtgagatagccgagcttgacccatttcgccttgcccgacgcgccaccaagcgtgaatgtgcgggtcgcgctcttcctcaacgcctcggtcgcatcgagggtcgtgtaggtctggccgaccgtcgatttgatcgaggaggccgactggtcgatcctggactgcacctcggctttgctcggatagtcccccttggtctggtaggtcgccgcgacagtggatttgaaaccatcgaggttctgttccagactgctgaccctgctcgtgtcggccttgccgccgatctgctgcgacagggtcgtgttgatcctgtcaaccttctgggacacctggctgatggtggtcgtgtttccctgggcggtcttggcgacctccgtcaccttgcctgtgatttcgtcggccttctgcgtcagggcgctggtggtggcataggaggacatgccgttcttggactggtatctctccgacacttcgccgcggatctggttcgccgtctgcatcagtgaggaattcgtggcgtaatctcctgctggctgcaatccggtcacgtccgtgcaggtgacgttcgccacataccactgcgtcgaaccgctatcccacggccagttgtcgatctggaagtacacgcagccgcgggatttcccggccggacaggcgaaacgccatgtggcggccatccacccatcgcccaatggtgtcgtcgattccgctttgacaaacccctcatatgcgggtccgctggtcagatgcgtgtaccagataccagcatgtagcggcaaaccgcctttgatctgcttgcagtaagcggtgatgacatacgtgcgccccggtatgacggggaaactggtgtcaggattaaaattgtcgcgtgctgcgagcaggttgacccggctgccgttcggcgcggtgacattatccaccagcgacgtgatctgcggcttgtcagggtcgaaaagctgattgcaccagagattcgaccccgagggtcgattatccagatcagacttcgtcgcgtacgtgctgctaacttcggttttgaatccgctgaggttctgttccaagctcggtgtgcgggacagcgcatcattggcggtggtactgacctgcgagatcgtggccttattgctgtcggcggtgctcttgacctgattcaccgtctgcacggtggcatccaaggtcctcgccgtctcgccgaccttcgcgctcaagccattcgccgtctgctccagcgtcgtgaccttgctcatcgcgccagtggcggtctgagagacttcggttacttcggctttaatggagttcgccgtctgggtcaattcggatttagtggaatatgttttatgctcagatgtaacgtccttgacactcacatgacggaactggagaaccttagctccttcagaaccaacatatgaagacatgtatacacgagtaactacagcattaccgagatcctgatatgcctcataggaatgccattcaccatcaacaagatcttttaacttaacgttgatcgcgaaccaaccaacatctgttccgatggcgttgatactatcaccttcggcaaccgtgtcttttccggataccaatcggacatcaatggcataccttatagtcctatgaggtccgatctggtgaaggatttcggatgggccataatcgacatggttctctttacccgggaaagtacgctgaaatactccatcgactatttcgagacagaatttatttggtcgatcaggattcggaattccattttcgacaatctcgtcaccaatacctttggactgatatgtatcagctacagtggtcttaaacccgttcaggttcgcttcgagattcgtcgccttatcgacggcaccctgggcggttttcgcgttggaattgatgctcgcggccagcgaatccgacgtggccttcaggctcgtctgcgtcgcatacgtggcatcgttatcagacttcgtggcatagttcttgctcaggttcgcggaaataccgtcggcggtctgctgcgccttcgacgcggccgtgacagcgccatccgccatctgcctcaccgaggatagggacgaggataattcattgctcgtggccttaagctccgccttcgtgctgtacttggcgtccgaatccttggcggtctgataatccttgctcagagtcgcgttgatgccgtccgcagtggcctgcgccttggaagccgcagtcacggcaccatccgcggtctgcagcgacttcgtgatgttcgcctgcaagccttcggccgtggtcttaagctccgtcttggcggcatactttttattggactcggcggtggacgtgtaattcttgctcaaattcgcgctgataccgttcgcggtctgctcgacctgcgtcgccttgctcatcgcatccgacgcggtcttcgtgctctgcgataccgtcgagctgaggccggtcacggtctgccgcaaagaggtcagactcttagtcgtggcctgaccatccgaagcgacgccctcgatacgagtggacaatgcatccagcttcgtcgtgtgcccgttgacggtcgtggtcacgtcaccgatctgcccggccagcttatcgcccttgtcgctcgctgcctgagccttcgcatccacatcggcgatgctcttgtccaatgcggccttgtccgcatccaccctctgcgagattttgtccgcggcggccttgacttgattcgccttcgcgtcaacggcggaaatactggatttgagcgccgtcgtctgcgactccagatcggagcgcacaccatcagctttggcggcggaatcctgcgcctgcttgcgcacatcatcgatacccgcctgcgcgtcccggcggatctgctcgcccttggcgatcgcctcgtccgccttcgcagccgcggcgatcgccttctgctgcgcgtccttggcggccttgtcgatgccgctcgtgtccaccaacggcagttggacgccgttcttgtccacgcggttgacgccgtccgaggcgttcccgccggcgaggatgccactgccgtcgccggtgtcgatccacacgccgccgcttctgcgggtgagcagaccggtcgcgacctccaacgcgttgaggcccgtgccgagcagcagatcgaggtcggacgggttgatctcgccatgtaatgccatgagataacctccaaaaaagaacatgggatccctgcgtcaggtgcaggggtcttcgcagatgtcgaacaggagcgtgaccttgccggtctggtcgccgctcatcttcatgagccgctgacggtagatcccgtcgggcaggtcgggaaacccggttatggagacctcgaagatctcgccgggccagaatgtgccgggtgcgtgcaggggcatgccggaagcgtccacgtcgttcgcgtcgatcgtgccggatagttgcatgagaggtttggaattcgcggcgagcttggcctgcgcgtgcgatttcaggacgtcccagctcttcgcgtcgggatcgctgtacacgccttcgcgcaacggccacgggtcggaccgccggcacagggtcaggtcctcggccagacagcagatcgtggccttatcgctcccggcgccggtcgcgtagaaccgctgtgccggtgccatgcggtccaccttcagatcttctagggtgccgcccaatggatggtagtccaatgagtgcacggtcttctggccgagatacacgtcgccgtcactcccggcctcgaaccggtatcgcacgtgctgcgaatccgaaagatacggcctgaactgcatgtctggcccgctggtcacgttcgtgagcttcgtgagtatctgcttgcaggactggttctgtacgtcccagtcctggtagtccgtacgctggtggccgccttgctcgccgagccatggcaggtcgatggggagcgtgccgccgggcttggcgctggtgcattgacgaatcacctcgcaggcgatcgcgcgcagggacagtccctgccatgcatacccgccgggggccgtgtgcgccgcgttggtgccgaacccgtcctcgtgcgcgagaatcctgtcgcccagcacggtcgggatgctgtccagcgggatgctcacatcctgctgactgctcgacctgacgccgaacaccccaccgatgatcggcgtgcccaacgaggcgtcgccgtccaggacgccgtgccagaagagcacgaggccgcgtttgccgcacatcagcgcatccgcccgcgcggtcggcgtggatcccggtatctgcgaccagggcaactggagcccggacacctcgtccgcgcccacgcccttgtccctcgtcgtggaaaaactggagttgctgacggtcatcgaccatgtgaagccggggatgtcgatctgctggccgagcagcccggtcatcgtgtcgcacaggcaggcgcgccagctcatctcgccaccccctcgtccttgacgacgagcacgcggcccacatacgtgtcgccattgtccttcacgccgtaatgcgtcacatagcccgggccctgttcgttgaacatggcgacgccgatggtgtgcgggcccttcgcaagctggagggagcacgtgcattcatgcgtcacccacgaatccgtgtattcgattttcctcgtggtgtacagattcccgtcgacgacgaaccgcaccgcggccacgcccttcgcgccgtttttgctcggcgcggagacgcacgcgtacatggtcaggagcagattgcggtcggtcggcatcttgaacgtgtcgatcaggaacggcgccgtgtacgcgggattggatgacgcctgcagatccttgttctccgcgatcctggcgaggatgccgaggttcgcgccgtaggggatcgcgtagtcctgcgtgtcgaccatcgttgccgattgggtggacgaggcggctgccggcatgcgcatgctcatcagcctcgtgcagccggacgggacggacggggctaccggattcgcgcttggcgtgccctgtgtgacgcccacggccacctggttgtcctcgtcgccctgagagatgtcgttcgccttgagccatatggtgtctatgcgagggttcgacggatcgccggccgagacggcgacggtctgcccgccgttccaatacgcttccgtgtacccgtccgcattgccgcgtgagcagacggccacgcccgcggccacgttgtagcgcaggtcggagcgacccgtcacgtccaatccgcacacgatgccgacgttctcccagtgcgccttgatgatccggcggtgggtcggcgggtccattcccctgccggtcgaatcgggggccactcccaaagctgtagtcataatccctccttgatcacatgtaggtgtcacggcattcgacggtcacgtacccgtcgccgacggattgcaggttcacggccaccgagccgcccggcggcacggtggggaagccgcgctggcgcaggttgcggctcacgtccaggccgcctatgctcgccgcgcgactccgtgagtccagcacgagcggcacgctgccgaccgcctgcgaatagtccaggctcatgtcacggcccgggaaggtcaattgcacgccgtccggccacggaccttgtaccgtgaacaccgggtaggctcggctggaaccgttgttgacgagcgtgcacacgttccgcgcatccacggccgaacgcccatacgacagcggatacgcgagccccgcgtccccactcccatacgacaggcccaaccccgcatcccacgccggaaccaactgaaaacgccgcgcatcccacgacaaacgctcaggacgaggacacacgaaatgcaatgtcagatcgttctccaacaggggattccaccgcgagttgcggcccatctgcgccacgtagccctcacagtatgtgtcctcgtcgccgtcgaccatgcgcagcctgcaggagcggtgcgccgcggtgttgatgcggcgcatcagggagagtaggtccgcacggctgtagccgaccgcctcgtagtgcacggtcacggtgcgggccgaatacaggatatccgtttcgggcacgtcatgcgcgccgtcgccctggccgcgttcgtgcaactccaccttcgcgtccggcagcgtatcccagccctccacgccgttggcggtgatgtacaggccccggtcggacgaatccgcgggattgaaccggcagacgagctcgtcgccggcccacagctccccgtaacgcgggctcaaagtccacaggtcgttcatcttgagagccttcccacgagatgagcggcgttgcggtacatgatcgacgccgccgtatacatgtcatccgccggacgcacgatcttctgctggaacacgggcgctatcgtctggttgacggtctggttgttcgtcaccggctggctcagcatcatcggcgagggcttgtagaacctctcgcgtggaatctgacgacggttcatggccgcgtacaaatcggcaccgtaatagccgaccgatttcacgttgctgacgaattcgccgcttttgacgcgcgcgttcgacagggtgatattgtcgtcccccgtgtaggtggccttgccgggcagcagcccctcgatgacacggccgccaccggcgtagccgcgcatcgaaaccccgtagccggtgaacaggccaccggtcttgcctgccgggcgaacgccaacgcttgtatccggcacgttctttgtcatgtgggtctcgatgaagttgcggacgatgttcgtggttatcgtgacctccctcggggtttccaagggttcgttgttcacatcgcgaatggcctgcaatgcctgatcgttcttgccatagatgtagccggtcttgggatctacctgccagccgttcgcttcgaccattttgtcgaacaggggcgtgttgttgcccttgaggacgccggtcttgtcgtcgatttttgcgccgccggcgattgccatggcgacgtcgaactggctcttatccaagtccaggtagccggtcttggggtcgatcttcgcgttggtggcgtcggcgatcttctgcatcaggtcggtgtcgtcaccggtcaatcgcacggtcttgtcgtcgattttctcggccttgaccttcaccttgtccagcacgtcgctggcctcgtccgtgatcgtaatcctcacgtcaacagggttagcggcctcgctgttcatggactcgatgctctgacgcagcctgtcggcctcgctgcgggccaaaccgtaacggtctgcctgagctgcggccgcgtcggcgctcatgccggctgccgtggcgttggcgatgtatgcctggcgtgcgcgctcgaggatgtcgcccgcctgctgggtggctgctgcagcgtcgccgtgggcctggccttcctcgaggatcttctgcgccgtgctctgcgcggtcgaggcgagaccctgcagcgcgctctggctgccatacgcctgagactcgtatcccgccaaagcattaccgttgtcatcgagcactcgaccgttcttcgcgatgttctcgttgaggtcgagtatgccctggttgaacttggttacggcctgatccgcggacagctgcacgccgggcacgctgaggaagcctttaacgagatcgtcgatggcgtccatcaaatcctgagtgctggtcgtagcgccttgtgttgcgtttgagtattctccagtggcgtcagcagcgccgttggtagcattctctacttcagcgagtgcgttggcttttgacttggctgcatcggatgccttgttatagttatccttttcctcgttgagctggctgagaatgattcccgcgagttctttttgcttgccgcctttcgcgatcatttcatcggtgacaccgttgattcggcgcattgctgccgagttgccctgtgcggccaacgccatgtcggacatcttgattccgacatcatcgagtaagctgccaagggtcttgtatccgtaatacgcctgttcgatattgtccggaatgatccaggagttatcgatttttgcatttgatagattatcgatgatttgtttgctggcgtcgccggtgctttccagcgcggtttttagcgagtcggctcgctgcttggcctctgcggccttgtcggcgaaggagaggagggccgcgccggcgacgccgatggctataccccacggtccacccaataacgacactatgccgcttcccaggtttttgaaacctgccataacgccttgagaacgactgacggcggcgccaaacgtgcttagctgagattctgcactgccgaaagtcgaaccccatgcctggaacgctgacgcgattccggagccgaggcctataagcctttgccctgggtcggcgatcaatccgatggtttgcgcaagctggctgctgctcgcgttcaacggtgccatagccctgtgcaatgcgaccgagccgccggcaagagccgtgaaaagcacgatgccctgctgcaccggtgcgggcagcaggctgaaaccgtccaccagcgtgtcaagcatctgcacgagggagcgcaatggcccttggccgccttcgccgagggaaatcatgagggatttaaacgaaccactgaggttctcgatgtcgcctttgaggttgttgttcctggcggcggcctgttgggcggcgaaaccggattcgcttaccgcgtcggtccagtcgtcgataccttccgcgccctgctcgtagagcacgttcgcggctcgaatggcgtcggtgccgaaaatcgtggccaacgcctgattgcgctgctcctgggacagtccgcccaacttgtccttgagcacgcccgccaagccgcttaggccgatgaatttgccttgtgcgtcgtaggcgttgatgccgagttcccgcatgaggttcgaggccttcgtgctcgggttggcgagactgatgagcatggtcttcagcgaggtgccggcgtccgagccgatcatgccgctttcggcgaacgcggcgagcgtgccggcggtctcctgcatgctgatgccgaacgagtgggacaccatgccggcctgattcaacgccagaccgaggtcgtgcgcggaaccgacggccttgcccgcaccggctgccagcgcgtcggccacctgagtagattcggcacccgtcaggttgaactgcttgagggtggtggccatgagttcggctgcgtcgcccacggccatgccgtcagacgctgcgaggttcaacgcgccgctcagaccgccggagagaatatccgacgtgctgagaccggccttgccgagttcgttgatggcgtcggcggattcggtggccgagtatacggtgtcggcaccggcatcaatggcggcctgacgcagttgggccatctcatcggcgctggctccggtgttggcttgcacggtgctcatgctggcgtcgaagtccgccgccatcttgatggccgctacgcccaacgcggtggctgccacccctgctgcggcgactccggtggtgatgagcttggtcttgcctccggcggcttccatggtggtcgcggccttctggctctcgccactgactttggccatgccggccgtgaaattagacgtgtccgcgagcaggcggactgtgatgttgcggttcaacccgcctgccatagcggcctcctgagattcatcttggtttgattcccaccgtcaatgcggaccgcttcagctcgttctcgttcgcatggtctttcttccattcgtcgagcttgagggactgcatgagcgagatctggcagactccggcctcggcggtgaaatggaagggtgtctgctcgtcgtggcagaccgagatgggcatgccgcattgcgggcacaacgagtgttcgtagtcgtcgagcgcgagcatccattcgcgttcggtctcatcccattcggtttccggcgtgtagccggtgatgcgcctatgctcgtccctttccacccgatacgatggttcccagccgagccagcgtttgtagctgatgccgagcttctggcagattcgcagttcccttactgtctgcggattatccgcgaggctgattcgagtgcgtcttttgggtcgatgagcttcgcattcagatcacggatcgcgtaccagatcggggaaatctggccgtcggacagttcggtcatgacgttcgccagctcctccaccggggtttccggcacggtcttccgggccatgagtttgatggcgtcggcgcagatgtcctcgatgcgctgcttcggcaggccgttctcggtgacgatgttcgcctcgagcacctgacgccactgggaaagaggcagcgcctccaaggtgatgcggatggtgtcgtccttcacctcgtcgcgcagcttgtcgatctgcttggcgatgcgtttgacggcggcgttgccgccttcggtcacatgctgcgccatggcgcgctccaggccggcccccaatgcggcgacctgttcggccttctcctgatccaagatcagatcgacgtccacgcgcttgcgcttcacttccagagccatgattatccctttctaaaagtttcagatcgcctttctgggaatgagaagagagaatgttcgtgcggggccagaaaggtaagaatccccgcatggaagatttgtcagccgccggcaggcggtgccggtgccggcagcgtcgcctcgcccttggcgcgtgcgttcgcgccgctcgtggtgttgtcaaccacggtgacgatctggccggacgcggtgtccaccacggtgtcgtaatccaccatgggcttcgcattggcggcggtgatcttgtagcgcctctggaggccggctgcaagggcctctttcacggtgacggtctgcccgccattacgggccgttgccgtcaccgtcagaggcgtcagcctcttgccgaggccgcgatcaccgccgtctcggactcccagccgggtgccttcgcgaacagtggtatcttgctgcggatcatggtgttcgcgtccgggttgatgacctgcttctcaccgcagatcaccgatacgacggtgagcttctgaccggcggccagcggcgcgtcggtggccatgccgcgacggcgcacgatatagccggcattgccttcggccatgagggtgacggcctcgttctggtccttgtgctccgtgttcgtgttgtcgatgacctcgatgctgatgtcgccggcggacttgcggcccggagcgccgaaatcctggatcgagttctcgcgctggtcgcttacggtgtcctgtgacggttcgaagatccagccgccgagcatgacgtagttcgagatgtcggtgccggcctcgagctcggcgatggtcggcgccttgatgtccttgatcgtcggcacccagatggtggtgatgttgccctcggcgctagtgccgggaatctctgtacccagtttcatggccataatgtgctccttaaagcaaaaggccaccccgtatgggatggccttgaagacttttggtgaatgattggttgactatggtcggctccacgtaaagcggaacctcaagacgcgcacctggtagcggcgcgcggtgtcatcggcggtcaggccggccgcgtacgcgccggaatcctcgtacagggtgagctggccgaccgtgtagcccggcggccgggtgggggagcggttcgccagcgcgggaatcaacatgtcgtcacaccagatgttcacgctgtcggcggtggtgctgacggcgcgaacctccaggagcgcggagtgtgcggcgaaccgcatcgtctccgccgccacatgacggtcggtggagacgcgcgcgatgatccacggcggcatctccgactccaacggctcctcctgccggtagaccctcacgccggacggcatggagggcagcaggtcgagcaccgcattggtcaagtccatgacgctcataatccgatggctcctatcagcatgtcgtcggcggcatcggccacgtattcggcgagcgtgggcagctccgtctccgcagcttcgtagaagtcatgggttccgccgcctttcgcggtgccgaagaacgcgatgttgtccaagtcgctggccccgccttcgcgcgggctcacgtccgcgtacacggtggtgccggtgctacccatctcgtagccgatgccgatacagctgatcgcgtagttccatgaggtctgcaggtcggagatgatgacttccttgacgctctgcgcgcccttcttcaccgcctgcgcaaccttgaccgaagccatggcgtgggccgcggcgaccctgcggccgaaagcggtcagctccgaagcgtcgattgtcacgtcactcattgctgttgcccacctccttcacgttccaccggcatgcggtcgcatgcgacttctcggactgcatgttcagcaaccggagcctcctgcccttgagattcgggtcattggcttcggttatctcgcacacgtcaccaggcagcagcccagtggtgccataggggaaatgcacgtacatcgaccatacgggggtgacggcacccaacgcttcgacgatgccgccctccgtgttctcggcggccaaaccacccgaagtctgcaccttgcacttgccctcatacacgacgttttccgtcggagccggaacgccggtcaccggatcggtgaccgtgccgcctttgtgggcgacacggcaccggtcgagcatgaggctttcggcccggcgtctaccagccgccaaaacatgagccaggtcgggcatcatccctccaaccggttggcgtgatggtgaacgcgcctgtcgaaccagaatcagagggggcgagcagcgcccactcgtcatccagcagaccgatggtcgccaccgcgttcctcgtgccgaacgactgctgatagtcgtcgatcatcgaactcgaggatgtggcaccctcggggttgcgcgcatagcgcgcaacggcgatggcctccacatagtccacggttttctggtcgatacgcacgtcggctatgagctggtcgaggttcggatagcgtttgcggatgacgatttccgcgcccgctatccatgcctcgatctgcttgacctcaagctcgtcggtgataggccgccccagttgggcggcgacatcctgcaccgatgtgaccatatcgcggccctcctgactcggttacttggcgatgccggcggctttgagcgcggtcacgatggccgtagcgccggcgtccgccgcgagggtcacctggacgccggaaagcgcctttgcgaatgtcgtagacatgagcggcctaccgtcaggcggtgattttaacgaaacgggtcttgttcttcacgatgaagccgcactcgaactcggccaggaagccgagcatgttgcgctgccacagggacaccatctcttcgccgaccttgacggtggcgatgtcggatgccttgatggtgatgccgcccacaacgccgaacagggcctgactccagtcgccggccacgccgaggatttccggggcggcggagccgccggaaactgccgccttgtggccccacggggacttgtggacgggagcgccgagcacgttgccgatggtcgtggaggacacgtcgggggtgatgagcgggcggccgttcgcgtcggtggcgccgagaatcttggcctggccctccgggctcatggcccagccgttcaggttgcctccattgacggagatcttctcgtacaccttcataaagtccgcgtaggcgctcttgccgagggagacggcctgcgcgtcggcgagcgtgtccatgccgtcggtggagggtgccgcgatggcgccggtgaggaacgtcatgtcgacggtcttggcgacggattcggctgcctgcgccttgatcgcgttccacagtgtcgccttgtcgcgggcgaactcggtggacacggtgatgattcgcgccatcttgtacggcttgaggattcgggagccgacggtcgggttgatgaccggcttctcatcggtctcgccgacccacttcgctggtgcggcctcgccgagggtgtcaaaactgatgccggagcccggaagggagacgcggcgggcgagctgcatgaccacgctggacttggtggcgtcctgccagatttcatcggactgctccggggtcagtttgacgcccgtgctggtgcgattcaggtcgatgcctgccattttgggaacctccttggttcgatattggttagatgctgattcccagcttgctgaggattccgccgaactgggcggcgttcacctgattgcggtcggctggtttgagtgcttcgccgggcagcagctccgccaacccgtccgggtcggtctgctggctgtccgtctcatggtcgggagcgagatacgggtgctcggagatgagcttgtcaatcgccttggtgatggtcttgtcgtcctcgctgccgttgaggtcggcgaggagcttgagtgccagggcgggttcccgtagtttgccggacgcgagtttctcgaccttcagctgtttgatggtctgcgcctgttcggcgatggtcttgtcgcgttcggccaacgcggcctcggcctttttctgtgcgcggatcgcggtattgcgttccgttttcatgcggtcgatggctcgcttgccggcgtcccccaggtcttcaggttccggctcggtgccggaatcgtcggtttcggggattgtaccgcttcactgtctggccttgcttccgggtccgtgtcggtagggtcggccttgggtgcgttgtcggtgttttcaccggtgcccgttgaggtgtcgccggacagcatgtccaacgcctgctgtgatgcggactggctttcgccgttagcatcccctgcgggggcggtgccggttgttgctgcttctgccatgatggttcctccagttgctggtaggtggttataaaaaagaccgcagccatgggcgtgcgggcgaaatcttggttatcggagtatccagccgtagtttttgagcatgcgatacgccttgtcggggtcgtcgccggctatctggtagatggtttcgggcatgagacgggggcggtccaatcgcgtgtagcggcctccgcgttttgcttccctcgcgtagccggcgttgcgcatcgcccagttcgcccagccgcgcttcgtcgtgccctcgatcgtgtatttgatccggcggtcatagacctgcgcggttcgcacgtcgcccttgtgccggtaggcgttgacgagctggctcacgtcagcgccgtccttccatgcgcgcgcgttcgccctgctgcccagcgtgtgggcgagctcctcgtcggacaacgagtcaaggtagctgttcgcgtccgcatagcagcctttcggcaggtcgcccgcatagcaggcggtgcaatcgcagttcgggtggcgttggaacgcgacgccgccggacggtttgcccgccagcaccacgcatctcccgcagctcggcggggttaggcagcgcacgtagcccgcataggggttgcggcttcgcgcggacacggcggctacggccctctgcgtgtcggcgatcatggtgcgagaacgcatcacgagcatgtattcgatgccatgcaacgcgaccgaaatcgaggccccccgttcgatgagctgcttgccgcgcacgacggcaccccacatggtgtccctcgtgtccatgccgtcgccgttcactccgacgaatcgttcgggttcgaccacgtaggcagccggctgcaggtagccgtcgaacgattccatgatcgccggggtcgcctccaaggtttcccgagcggtctccagctgcgcattgtccagcagccggaacagggccggccccatgcggtagaacgcatcatcgaaatcgggtctcgcatggcgtcgccacagggagacgacctcgcgaatggtcctattgctgcggcttcgcagatgccgcgcctgcgtcaccgcctgacgtggcatcacctgacccgccatcgtttccggcatcgggcacctccggtttcagatacgcggccaacgactcctcttcctcccggcggagcaggctcgtggcgcgtttgatcttgtcggggctccaacccaattcctcccacgccatctcgcgcggcagcagcggacggccggcggggtcctgcaccgagtagagcttcatcaccgcgtcggcacgctgggcgacggtcggggtgccggggtcatgccacagagcctcgcactggtcgaaccgttttgcggtctccactcccatcatcatcgcgatggcgatgcgagcggtctccttggcctgcgcgccgagcgcgcgctggtcgcgttcgatgcttttgacgagcttcgcctcgcgggaacgtatcgcgtcggcgctggccgcgtcgtcggcggccaggccgaagtagttcggcggcaggccggacgaaccggcacacaggcgcgcgtacatgtccaccatcgctgtgaagttcgtcatctgggcgctggagaattcgaatgttttcgcgttcgcgttatgcaacgcccacacgcggccgaaatacgcctcccaggcgggcagccgggtgccgttctcgtccacgaaatcgcccttggtggcaccgagcacgccgcgctggggcaccgcgtgtgtctcctgcgccaattgggcgttggtcaggtcacgtgcgcacgagtcggtcaggtcgatgacgtcgctgatgcaggagacgccctgcaggcgtggccacggcatgtaggccggttcgcgggtgcgccagtttcggaaagcgggaacgaccggcacgatgccgatgtcgttcgcgacttcattctccactcgccacgccgcgtccatgtaaatggtgcgtttgcgcgtccatacgatgcggcgcacggtcatgtcgtattcgtcgcggatgcgctggtaggcgatatacacgtcgccggtcaccgggctgcgcagggtgatgatgtcctccgggctgacgctgcgaatctccacgcccccgtcgtcgtccttggacacgaccttgaagctgcggccgaacagttcgaaatcaagataggagctctggtcctcgaccatgccgaaccgctgccacaactgccatgcggcctcggccagcctctcatcgtcgcctacgcgaaagcctttcatgtcgagacggtcgacgcggctgtccgccacgacgcgcggccagttcactatcaccgtgaaccttttcagttccgggggaatcgccagcccgagctgcttgagatgctgagcgccgtcataataacggttcagcgtatcgtaacgggattggctggtctcaaggatcaagtccatgctctgggcggtcccgtaaagccggccggaaagaaaagccatcagtcatccctcctttttcaccatcggaacacgacgatcctgttcgaatcgttaccccagttgagcgccctcatgtcggacgccgcctcgtgcgcgaggatgtcggccatcgctatatcgattttctgattctcgctcggcttgccgagcacgtacttgtcgccgggcttggcgatcttgcgcgccgccatcatgtgcagtttcgccaccgggtcgccgctgtgggtggtggtgccgtcggtggtgtcggtcatgaaacgggtgagcgcatcatacatgcggccggtacggttcgttggccactgcaccaccacatcctcgccgaaacgaacactccaatcatcgataagcgactcccacaaatgagggtcgcagtagaatcgcctgaccttgaaatgattgaacaggtcggaaacggcggcgtcgacctcgctgcgtgggatccgtccctcccattcgaccgggttccagtaggtcgggcgcctgtccacgccataggtcggcgtgaaccggtatccatccacggtctcggcgcgaatcgccgaccagtcgccggactgggaaccgtcgaagccgaggcatatctcggtatcgtcggccgggtacgggcgttcgtcgatgccgtcatcgtagagggcttcgggcatgtaggagccgaggccctgcacgagttcgcagccgaagaagcgacgggcctgcgcggggtcgcgtggcagcagttcctcgcatgtcgcctcgatcgcgtccaggttcacccacggcgagcccttgtacacgaactcgaggatcctgcgccggtcggccctgtcggtgaagtccaggttggggtcgtgccgggggaagaacctcatgatgtccttcgccgtcgactcgtaggtagactggccgaagctcgcgtccatcgggtcccacgggttcgtgagctccagcatgcgcccgtccatgccggtgacgccacgcagcaccgtgtccgcaacctcgaacatgccggagcgcttcgtgtacacgcccgactcgtcgcacagagcaaagttcacgggattgcccagcttcgagcgggcggaggcggtcactgggtcgatgcgcccgccgttgggcaggcggatgaagccctcgcgcaccttcatcaggtcgtccagatggccgttgcgcaccatggtctgcaaaggccggtacacgttcgcggtctgctcctcactgttggcgagcagctgcaccaacgcggtgcgccggggcatgcccatcggctctcccggccggtactcgtaggagaagccgcacccacacccccagtcctcgcagcggaactcctcgccgccttcggcccagccgcagaacacgcaggggcccacggcctcgaagcaggccacggcagcgccgaacggcgacttaccaagcttctggccgccgacaatctggccgcgacgccattggaacgcgccgccctgcaacgggcgcgacgcattgaaccgcgtaccggccttgacggtgtagaagtccaccgcgttcgccaactgccagcccacgaggctgaacggcttgttgaggtcatagccggagggcaccacgcagtgggcgcgagtccatgcggccatcaggaagcccagcgaggctggaggctgcctatgttccgccatacgacacctcgcttattcctgcatcgactgccattcgtcgcgcggatcagggaaatcgactatcttcgcgcttctcctgcgcgcctgcggcttctcgtcggccacgatgtgccaaccgttcagccgcagcccctgaggggtgagcccgatggaatccgcgtagcggcacagggtcgtacggtcggcggccttcgcgtccgacgactcgcacagcacgtactgacgcacgtacagggccaccatgtgctgcaggtacttgtactgcgggcggctccacgcatacccctgcgggtagcgccacaattcgttccacacgtcacgctcgcgctcgttccactgcgccgaggccgcgtcgtcgggctcgcgatggaagccgtcatcgtccttgaacgtgaaccagacgacgtaccgcggcagcgggaacttcgggtgaggtcgcctgtagccgttcgcgggcagagcgaacaggccggcggcgcgctgctggaacgcctctgacgaggggtcgggcatcctgcccgccttcgcgcgggcaccaccgctgggcatggccaatcacctcttccttcgacgtgtaggcagcggcgtcacgcccatatttctcactacgtcccgctcgttcggctcctgttggagcgtaaacagacggtcgcgggccgccctcatctgtcctgttccgcgtagtatctacgattcgccgcctcccaaacctcttggctgcggttcggggagggtcggtccttgtctcgggccaatctctgtctgaaatgtttgaaacgcaaaaacttgcgagtcccctcaccggcggtctacgacccctgcctcggggtgcctccccagggggtggaagtgtttcgtcgtcgtgttttcgccggggtatgaggtttgtttttgttgttggcgtcgttgtcgtgcgtcagcgattccagtgttcgcgcatgcggttactgttgattgctccggcttttcggttgcagctcatgtgttctggcccgttgtagccgttgcgtttgtcgttgtgtcctaagtcccattgctggtcgcgtgtgattggctgcttgcatcgtgggcagattggaacgatgccttggttgatgagtgcttgccatcgtgcgcgtccggtttggtgtgctttgccgtagcctcgttgtgctgctgtgcctcgctcgtgctcgtgctggtgtgagtgggtggggcagtatcgtgtgccgactggtatgagttgcgggcagttgtgatagctgcatctgcgcagggacattggtgttccttcgtgtgagcggggagttgttggtggcttgggcgagattcgaattcgcgagagagtgtcagtgtttactccctgtcgtgctatcccagcatgaccggttagtcctctaccgtacgcaagccgtggcgggccgactggcaccggcgctttggacgctgccggcggagtactctcagcccatgagatatgactggatatgcgaagagcccaaccgtttggttgggctcttcgacactaatccactgacattatgcggtcacagtcagctctttgtcaagttcgccactgatgacgagccggtagacgctgctgtatgaaatgccttggggcgtgacatcaagcttgcctcgggatttccacacggtgagcgtatgccttttgatggcgattcccgtgtccgcgaacaccttggctatctccgccgccgagccacgccgactgtcatcccagcagagcttttccaaacgtctcagtttgacggtctgcacacgctgctcggtaccgcatatggggcatgtgacccattggtcgtttgcacctgcggcgagcatggtcccgcatagttcgcaggtgccgatttcacggcgttgttcgggcgggtccagaacaaggtcgattttccgggcgatgccgttgatggtcgccatgtagaatcctgcgtccgcgaacgtggcaaggcgtgcatgggctgcgcatgcgatgagcgtggcctcgaggtcctccatgcgtggatccctgtgccagtccaaggcatcgatgacatccaaacaacgccacagttcgcgcgccgtcgcatcgagcatgtccagcaggtcgagcacgtcaagcctgataggcgtcgggggagtggccgtctggatgcgcacgggcgaatgcccgcccggatgcaatgtcgcgtcgaggctgtcatgcaatggcgtgacatcatgcgccaatcgcaggagcgtgccggcgaaacgcatctcgcatgctgcgcacagtgaatacccctcttcggttatcgtcttgcagttctggcagttcatgctaagccccttccggctggtcggctagaataatgcttgcttctcatcgccctggccgaccacggttggggctttctcatatttgagccgcgaatacggcatgtcccagatgcgtttgaattcatcgagctcccttttcgtgaggttgcgtccgccccacggcttgcccggcggacggtctcttttcggcggcttgaacggcttgacgctcactcttgccaagcggcacatgtgaccagcgaggtattggccgtcaggcctgatgcccgcactcccgctcacgctgcgcagcaacggatagccgactgatggcagccagacaacccgcgtcaacggccggccgaggattatcgccaccgtcaggtcatcaccctccacaagtccgcagtcccacgactcccacacgctctccctgtcctgaatcacatacaggccacacccctcgcagaccgtgaccacgagcgggctggatttcgggatgaacgcgcgaagccatgctggtttgcgttcacgggccctccgcttgccgtcgctcatcgcatgacgcctcctgattgctggtcgataagctcgaagctcatggcttcgatgtgctcgccggtgcaagcttcgacgcatagacgtttgacgtcaccggtggtttcgactttctggatgatggtctgttccggcgtcgggttcatggtagcagcggcggtgaggctgatgacggccagcaccatcccgccgatgatgacgctgacgatgacgaaagcgagcctgatggtggactccacgctccatttctcatgcctgcgcatttttgagatcctccttgttgagttgtgtttcgatttcgatgcacaggtcgattgcctgctgccatccggtttggtagccgatgacgaacgcctcggccggactgtcgttgcccagacccgatgaggccagcgcgttgagcgcctgttgggtgaggtcaatcggttcgcccatgagtcgccttcctgtgcttgcgttcctgcctccacacatcgtgcaggcagaagaacatttcgatcgtgctgattgattcccagaatccgcttcgcgggtcgcagcaccaccattgcccgcagatcgggcaacggtagtagcatcctggcccgtgcgggtcacatcgttggctcatgcttcctccgcgtcgctcatgagatgcagggcccatctgcccaaggcgtccaatactggtttccgcacggattcgtcatgcagcatgcggggatggcatctgtacagggctgactgcccttcggcttcgacgctgccgagggtggctgtggtgccgtcttcctggtcaagcatgattctgattttcttcatgattcctcgctttccgtgtagcagttcgtgtcaagccagtctgcgatgaggcggaagtccttggcccattggatgcgggtcttccgttccagctcgtccttgggtgccggtttcggctcttcgaagttgagcagtccgtattcgggttttttcaggtagtggcaacgagcgtgcttgccgttggcggccgaggcgacccgcttgtagttgatgagctggaggatatgcagcatctccaatgctttggtcggatcgaagttcggcgtctcggggtctgcgtcgaaccgcttcctcaattcgggcacggtgccttctccgttgcacagctcccatgcggtcgcttcgatctgctttctgaatgtgagtgccattttggtctccttgggttttgagggaatatctagtgttgttgaggggtgtttttgggcttttccgaggggcgagccttagcttttcccacacccgaccacacacgtagtgtggtcggggagtgtggggaagagctagtctcggtggctcagtttttttgggaagagctgggaaacgttcgggaaaaacggaaaatctagatgtcgaggtggttcccatcgtccaattcgctcacctcctccctgctcatacggtccacgaaagaatccgactttgggtcgtctatctgccggtaggggcgtgccgaccggtagcatgcgcggttgtgtctgctggcgcggttcgtcacatacccctcctccagcagcagtctgatggctttcgacataatcgcggtcttggcgccggagccatccgatttcaaggcgtcgaacagttccgattggcttggttcctctatggcgttctcgacgagctgactgattttctccatgagtccggtgggtcggaagtcgtcgcgtttcgtctgacggtcctcgctgggcatcatgttgggtcgtgcgatggtgacgtgcatgagtttcgggttcgtgctgttgatttcgatgcgtgctgcttcgcgcaggtgcgagccgttcgaatcccaactgacggcgcagtgctcctcgatttcactgatgcggtccttgccgcttttgatgacgatggtgccgcgtacgcctttgccgactggcttggtcatgttcgccgagtagctgatgccgtcgatcaatgcgagtttctgcatgctgcctccggcgtaccggccgcggttgtcctttgacttgacgacgtggtctatcaatacgacggcgggtccgcaggccaatatgagtcggggcatggtgttgtaccaggcggcgatgtcgtcaccggaattcgagtcgagtcctgcataggcgaggcagctggtgacgccgtcgatgacggtgagcgtggcggtgtcggcgtagccgagggtctcgcgccagccgtcgaggctggtggggctgctaggcttggcgctggggcgcacgtagtggaagtgagccactatctgctcgccggtcacgccgagcagcaggaggcgtttgaccacgtttctggcgctgtcctcataatcgatgtagatgacatcatggctactcttgagttcctgtgcggcggctatctgggcgatcatgcttttgccgcagccgggttcgccgtgcaggtcgttgaccgcgccacggtagaagagtccttggccgtcctcgcgttggaacacggttggcgttggcggcagttcgacgccggacgccaactgggtgaggtcctcgaaccgccaactggaggaggttttatttgcctcgtaactttccgttgaaccgttttgaacctgagatgcggtggttgaaccggtttgaaccggcgtcgttccaacgttttgaacctgctgtgggtgactttcccccatttgattcgcaatcgtgttttgggtgagttcgttgaactcgccgggcagcatgcgttcgattttcgactgttcgcacgggtccgcgtgcgactgtatgccgttgaccttctccatcgcgccggagagtatcgccgcccattcgcgtgccgcctcacgctccttgcccggacggtcgggtgctatctcggcgatgaaccgtggtttgagctggttgatggcgtcgagcgcgccgcgatggccttcctgcgcgaagttcaccaatgcccatacggcctgcaacgtggtgtcgtggcgactgcctttgctggccgggtttgacagcgttttgttcaaaaatgtgttgatggctttgcacatacgggtgtcgtatgtgccggtttcgtgtgaaatcagggtattgaaggctggtttcggcgtcgtatgctccggtttgcgcaggtagtccacccacttccacggcagggtagccagatcgctgatatgggggatctggctggtggtcgagccgctgggagtgtaccagcagtacatctcgccggaagggtgaatcgacggccagaccacgctgtacctgtggccgggctgcaggatgtcgacgccctcgattgcaccgcccttccacgcgagcccttcgggcaccttgtagaacaggtggcgtgccggcgagtcgatgccgtgcgccgtgctgctccacgtggccggcaatgcgcccagttcctgcgagagctcgctgatgcctttcgccccgtccgccttgacccgatggccctgctccgcgtcgatgtccaacacgagcacgccttctggtatgacgatgcccgtgttcgcgttcggggtcgcctgagaccagacctgtacttgttcgtcggtgacgggtttgcggctgcgtcccgtgaaaccgctgggcggcggggtcttgtggccttccggcagggggatgacctgcatccatccagccgcacggtacaggggtgcggctgccgcgtatccgtagatgtcggtcatccttgaaactcctttgacgtgatgtgaatatgtgtggtgccgtgcacgcctttgcatgcgtgccggccgcttggatacggctacggcggtcgggactggactcagtccttgtcggaatccttgctcttgtgccagcccaggagcacgagtctcacgctcatgagctggaggctttccgagtcgacgtcacggaaaccgacctgatcggaggcaagggaatccatgtccttcaccagttcgatccactggttctgcaggtgtttcagcagctcgtccactagaactcacctgtttccggcatctgttcggaacccccgtggtattggggttgcgcctggtcggtgacggccgtcaccgcttcgaccggcacgcccaacaaggcggcgatctcctgcggcggcttgcccaacgccttcaactggttgaccttcatcggatccacctgctgctggccgagctgcacaggctgaacagattgctgctggccctgctgtgcgggcgggttccacgggtcggttggggccggctgatacccctgattcggggcctgtgccgcctgctgtgcggcgtactgctgctgcgggtaactttgctggggctgctgctggaagggctgctgtgcgggctgctggggctggcccatggcgagatcggccggcgactggtgttcgatcacgtattcgaacagtttcggcggctgtggcagattgcccttcggcccgtagccggtgaacgtggccgtgaaccggtcgcccggtttgacctcaccggccttcttcaaaccggcgttgtgcaatgcctgcagccatgcgcggcgctgcacgccccaccccttgatatagacggtgcggcgtccgtcatcatcctccacgttcgggtcgatgatgccggtgtcgatggtgaccaatacctgcaggcgaggcgagccgtcgttccagaacgccggctgcttggtctggaagtcacgcacctggttcgcggtcacgttctcgatgatgccggtcaccctcgtgcccggcatgctgtccttcgtgaacgcggacttgccggactgcgagtcgatctggttgagcatctgctccgcgctcatcttcggagccatcggagccggctgatagccgccatactgctgctggctgtaagcctgctgttgcggatatccctgctggggatagccgtactgttgctgtggttgttgaccgaacattgtgtttcctttcgttattcggtgaactggtattcggattcgattagggggatgagttggagccatttgtcgggcacgtccggccacggcttctcgtcgaactcgggaagcgcgctcatatccggccacacgcgccccttgcatgagaagcacttgtcggggcccgccgcgggcagttgctttatccagctgtcgcgcacgcccacgccgtccgcctgttcgatgatgtccatgaggttgacgagcagttgggctcgggccaacgcccatttgccgggctccgggccgaacctcgtctcccagggcaacgcatcacccagactggtcttgttgcggggcaggaaatagatgcaattacgctccaccagttcgccctcgttctgcagtcccatgccgtagagcgaggcctgcacacgatactgctggctggggccgtgcgccttgaccttcgtgaccgtggtgttgccgacgatcttccagtcgatggtgctatgggtcttgcgatcccagaggtcgatcgaaccggtgacgtcgtagccgccgtgcaggccctgcaatcggcctacggtgacgcgatattcgctgcgccagcgctccccgagtccggtcacgctgtcctcactcgtgtagaggaactggtgcgcaggctccctgttcagctcgcggaacatctgctcgaagtgcgcgtgcacgcacgtgccgatgaacggcagccaacccggcgaacgacgctccggccaacccgccagtttcgccgcgagacagtgcacgcagtccgtgcccagttcggacgggcctatctcacgctgcagctcacgcggagcgttctggatatccgcttcgatgagctggcggatctccggccacaatcgtggttcctccatcgtgtccgtcttggttttcggcgttgccggcggcttgcccatatcgggcgccgactgcgtcatgggcggcacgtcgacgggtatcgcgtcaccctgctgttgggcttgcgcgacggccaataccgcctcattcatgctcacggttcttcacctccttcaaaaactcgttgatctgttccttgatgtccgtgagtgcggtccggctgagccgtgtaatagccaccgcctcgtccgaattgtcgaagcgcagcgtgtaggtgcggtcgccgtccttcgcgatggctgccggcatgctgccgaaggccatcgaatgcacggggaagccggtcttgccttgcgtctccagttcgcgtatggccttgtggatgcgtctggcgacggtgaggcccagctcgtcgagctgctcggaacggatgacgtacaggtcgtcggtcagctcgttgccgtcctcgtcacgcaggtcgtagtcggcgataacgctttccacgatctgggcgatgcccaggctggacagttccgcgctcatgagaccaccaccataggcttgccgctcatcgcgtaatcggccaccgcgtccgccgacagcagcttctccaactggctgagcggccgcggccgcaactggtaggctccgggatacttggtggccgggtaggctttttcgaacgtgccggcgttgatgcggcgcgcgcccggcttgacctgcaccttcaggttgccggcctggtaggtgccgacaggatgcgagtcgaggatacgggccttcagctcgtcgacctcctcctgacgggacgcgatctcggcctgcagttcgacgatgcgagccgcctgcgcggcgaacaatccttggcgcaattccccgtccgggttcacggcctctgtgttttcaatggttgatggagtcatttgatgtgcctttcacgatgatttgggcgtaggtgggataccacgccgtctgatgcttggtctggttcgcgtgccggttgcagcaggtgaccgcctcgtccagtccggtgggcttgccgagtggcccgcatgtcctgcaacgcggcatccaaagacgccggtcaggcatcatgcctgtcctcggaggcgaggcgtagtccggcgatgatgtccgtcgaagcgtccgggttgcgcagcagcttcgacacggccgcgccttccttgacggtcagttgggcgacggcgatggccgtcgcgatggccgtatgctgctcgttggtgagcatgatcttgtcggacagcaacagcttggtggccttgtcgatgaacgtgctggccgcgttcgtgatgccgttcgccggcggcaccaaagccgccagttcgaaactcagatcctcgtccgctatcagcacctgctgcaccagacggggttcgttgatcggcttgctcatgattgttctccttgcttgttcggctcccgttcggggagcggtttgatacggatatagaggtgcggctcgtattcgtgcccgcaacaggtgtaggggtcgccgctcttgcgcctccggtaacggcctttcgccccgtacacccacatgtcgggcatcctcttgcacgcatgggattcgacgacctgcgcgtcgtccacgtaggcgacgccgttcagcgagtccaaaaccagcttcagcaggttgtcgagatccgggcggccgcgatggctcatccagaattcggcctccaacctgaccgggcactggtatggtttcgcctgcgggtatttgagccggaattcggcgaacaggcgttcctccgccctgacggtgcgtttcggggtcatcgcgtgcccgttgtagacgcggggacgccccttcggcaccgggtcgcccggcagacaaagagtgaactcactcggctgttccatcgccaccccacttcaacaggattcccacgaacacgagcggcaatacgaccgccaatgcgagcgagccggttatcatccactgcggcgtacccaccggactggggatgcgactatgcgtgccggcgaaaccgaccagccaaccctcgaagaacgtgaccgccagcagaagcgcggacttctgcccatccgacaaccgtggcttcggacgacgcatacgcttccttctgcgcaatgcctcgatgctcatttcacggccctcgacttctccatggtcacgatgccggccagatcaaccacgtcggactcgacctgcaacaccttgcgcatgatcttcaggtcaccctgcatgtaggcgtcatagccgatctgatgcgccacgtcgaacaggtcgcccagcatgtccgcataccgctgccacttgtccgcctcggactgaggttccggctggcgcgtctccccgtccaaatccttctccaattcgacctccgtatcattcaggagctgctccatgagctcctccaacgacatgtcctccggaacctcgacgccgatggcgtggataccgctaaccttgtgttctgacatcactgatttcctttctgaatttggttggtgatgttggtgccggcatgaaccttggacagtgcaacgccggcgccgttatttcttctccccggctttcgaatccggggaaacctatttgccgtagaccagctccttgcgggtgatcgcgcacttgttgttcctgtaatcgatgacctcgcgtggatcccacaccagacgacggccgatccttttcggggccggcgggtatttcccgccccactggtcatgacacgaccagatgtaaagagtgctcttcgaaagattcaggaactccgccaccttggcgatgggccagccgtcctgtgcttctatctgcttgggcatgactcaccacgcttcttggcgagcaggccgcgccagtccatggtcgacgcccattcgaatacccgcaggtagtccgtaaaaaaacgcggagaacatcgatggaatccagctaggagtgcaatacgcccttcgcttccttctggtcatcgaacgtccattcgctccaatcgggatagaacgaaccggtcaccccgtcgaatgtggaatacgtcaggtcgaaccacaggtcgaacataggaaccttcgccttgtacaccgtcaggaacaggtcggcctcatcgttcggatcccaggtcaattccatggggaaggaatgtctgtaagagtccgacacgatagggtaggcaagagatagacgaagctttttctcaaggagagcgccggccatcacgccaccccgggagtcgaccctggctgcgcccgtagatgaaccggtcgatgaaccagttcacacccttggcggtgaaccgcgcgcactggcggtcaagcttcccgttcgccttgcgagacatgacgggtttcagatagccgggcttgacggccttgacggtcggcgctttcgaacgcagctcgatatagccggcaccgcgcagtatcccgtacacggtgtcgcagttcatccgcttgtcgatggcttggaaatgacgtgcggcctgtcttacgctcatcgtcccgtccgccgagacgaatgcctcgcccaacagggcgagaggcctcattttctcgttgctggcacggagttcgagattctcccggcgggcttcgccgagcaggcgggattggatctggttcgccttcgccagaatcaacgactcatcatccatgctgttggttttgaatcggatggcggcaccctcgttgaagtacttgtccaatgcgtcggcggcttcgcactggtaggcttcgatcttcgaacgtagttcgggcttgactttgccggggttgatgttggcgagccacatggtcatcgtgcgacggtcaatcatcgccatctcacggttcttgccgtccgcaccaaccataggcataatgactacggttgcccacggcttctctttcagcttgcgaagttgcgtccagtagtccacatcgaggttttcgcacatgcgcctcagcgatgccatccatgagccatccttggccacggcttcgatggtgtcaccgtggaacgggaccttaatcagggaatcgctcatttgaggtcaccgtcctccgcatccacggcctccacctgttcgatgctttcgacgttgttgaacgggatgatcgtcgtcatgctctcgtctgtcacagcatcagggtcgttgagccatgtggcctgatagaacgcgaagctgacgccgggaagaacatccacatcagccgcggacaattgacgatgccccttgaccccggttttgatcagggttgccacgcaggggaagtcgtcgctccaccatgaggggaggtcgaaggtttcgatttccttgttgtcggttagaatggcgttgttcatttgaaccttctttcatttgatctcggcatccgtggcagcggatgccttttcttttgcctgggtggattcgatggcctcggcgagaacctgagccggattcgcgttaagagcgatggcggttttgatgaactcgcttagggacatgtcgtccgacttgaggtgtttgcctacggtcatccggttgaggccgaccttggaggcgatatgcgtcttcggcacctcatcgagcaaggcttttactcggaggctcttcacggccgaagcagctgcgttgttggctgatgcaatcatggtttgtatattggcacctgccaacaaataaagtcaaacgcttcggcgtgttgtcatgtgacaacagttcttgtgcggcgtttctagctgctgtcaggtgataacatttgcacatggcaacaaagattgaatggaacagtttcgactatgcggcaagagacgtgctggacgagctgctggacaagctaggggtctcctaccgcgaaatggaaaacatgacgcaaggtgaggtgacctacagccgtatcagggatataaagatgggcaacaaggccctgtgcgcttgtctgaatttcttataatctgcgatgtttgtggcgcagaccccgtgcagaccgtccggggcatcatcgcggaggcgaagcgtatcgaagaagagcaagagcgcgagcgtcgcgtggaggagacgaaacgtatcctcaaggacgacccgatggcgttggccgccgatatcgatggggagaagagcaagtacgtcgaatacggcgacggggatgacccggcatgagacacctaccgttgaacatgcacgattcctacggcggcatgcgcatggccatctacgctgccggactcgacgtagaggtgcgcagctctcccagcctaccgggcaacatgatgggctgttactgcgaggccacacgcaccatcctcatcgaccggcgtctcccatacgtggccaaacggtgcgtccttgtgcatgagctcgtccactggttgcacggcgacgaacaatgcggaatcaacgaaacccgcacccgcatggggacgaacccgcgtaaatgggtgattgatctctttgattctgtttatagtggggattcatgaggacaagaactgtgatatcggccattgacctgttttgcggcacgggaggattgtcgctcggtctgaaacagggcggcgtgcgtgtcgttgcggggatagacaacgcggcttcctgcgcctacccatatgaggagaacatcaaggccaaattcgtgcggaaaagcgttcgtgaggtcacgggcgatgaattgaagcgactgtggggccgttccagtgtccgtctgcttgccggatgtgcgccatgtcagccattctcgtcgcaacggcgtggagtggacacgtcgcaggaacagtcatggccgttgcttctggagttcgggcgtcttgtcagggaaacgaccccagactacgtcaccatggaaaacgtgcccagactccagaaatccgaggtcttcgaggaattcgtgtcgatccttcgggaaacgggatatcaggtcgcccattccgtgctattcggccccgactacggtctgcctcaacggcgcagaaggcttgtgctgctcgccggacggggaacagacgtccctatcccatccccgacagtcgacaaggactcatacagaaccgtctccgatgcgattcaggatctcccgccattgtccgccggagagcatgatccggacgaccggctgcatttcgcccgtaatctcactccattgaacctccggcggatacaagcctccgagccgggaggcacatggaaggactggccggaagagcttctgctggaatgccagaaaaaaacgaccgggtccacgttcaaatcgttttatggacgtatggaatgggacaaaccctcaccgaccatcactacgcagtcctacaatcccggcaccgggcgattcacccaccccgagcaggacaggacgctgactctccgcgaggcgtcacgcctgcagggattcccggactcgttcatgttcacgaagccgggagagcccatcacgttcaccaacgtcgggcggcttatcggcaacgcggtgcctcccgtgttcggcaaggcaatcgcacgccagatcgtcgcagtggaaaaggaaaagaggaatcaggataatgaatgataaatacacgctgaccgtcgacatcgccacggtggattccctgggcaggaacctgtattcgaacgcggcagcagtgctgtcggagttcgtcgccaacgcatgggatgcagacgccacccgcgttgagatccagttcgatccgaataattccatctcgatcttggacaacgggtgcggcatgaccgacggggaactcaactcacggttcctgacagtgggataccggaaaagagtcgtggaaggcatggcttcgcccagattcaagcgtccctacatgggacggaagggcattggcaaactgtccgcgttctccctcgcggacaagatggtcgtttcctcgagaaaacaggatggcccgtctcacgggttcaccatcgacgcgaaggaaatggagaagagtatccgcaacaccgatcccgcaggaagggagtaccacccggaaccgctggccgacgccgccgcggaattcggcgaccgtgccaacgggacgaaaattgttctttccgatctgagggtgaaacgggtatccattaccgaacgggccctgcgccggaggctggcgaggcgtttcgacgtcctcggccttgcgaacctgcccgaggatcagggaagattcgtcatagaaatcaacggtgagccggtcacgtacgaggatcgcggcgatctccagaaactgcagtacatatggtatctgggggattacgaactgccggacggagtgcaggtgtccgccgaagccgaaaaccgcatcaaagacacaagtatcccggggcatgatgactggcgtatctccggatggataggaagcgttgccaagcccgccgacagggtgttcgaagccgacgacgagagcatgaagaacatcatagttctcgcgagaaagaggccgatccaagagggactattggatcacctcgattttgacaagcatttcgcaagctatgtcaccggtcagatccaagccgacttcctggaccaggatgatcaggaggacattgccacgtcggacaggcagagactagtcgaggacgatgagcgggtccgcgcgttcaatgcgaagatgaaggacatattcaacgcggcatcggacaagtggtcggaattgaggagcgatacaaccaccaaagccctttatgagagcgttcctgaggtcagggaatggattacctcgcttccgtcggatcgcaggagacccgcacagaagatgatttcgcgaatatccagcattgacggcctgaatgacgacgaccgcaattccctgtatcagtcgtcaatcgccgccttctacaaactgcagcagaacgatgagatagacaagctcaaagacgttgacacgatgagtgaggcgcagctattcaccatactgtcctcgtatgccagatttgaggaactggagtatggccaaataatcaggacgaggctttccgtcatcggcaagctggaatatctgttggaccacaatgaactcgaaaacaggactagggatttcatcgcggaaaacccatggcttttggatccgtcatgggagcgtgcgacggaagacctcgtcaaggaacagtccttcaaaaggatagcgaaggaacaattcaatctggatttcagcgacgacgccgccgacgaccggctcgacatcaaatacctggacggaggcggacgacaagtcatcgtcgagttcaaacgatacggaaggaaggtgaagataagcgaactgacgctgcaaattgagaaatatgctcgggcaatgacgcggctgttgcagcaagctgacgcgcgggctggttctggctcgcatgcgtacacgaacgattcaggaattgacgcaagagtcaatgtgataatcattgtcaagcacgtgtacagcgacataaaagacgaaataatgcctgtaaaggccgcgaacgatcgcgttcgcatcttcaatgcgcgattcctgtacttctcagacatggtcgagaagagcaaggagagatatcaggaattcacggagaatcccgcccagaatgatcttgccgccaaggcgatacacgccttggacaagataagctgagagatcccgtttttggacatgttccttgagaggaagcgagaaagatgatgagcgcccgactgctgataagctcttcgttgagctacgggcagatgcgtatggcgttgtacggattcgcgcccggtctgaccgtggccagcgccctcctgccccgcaggctggacgggctctatcgcagggagcggacacgatcctgatcgaccggcgcatcacctacacgcgcaaacgctgcacgctggtgcacgagctcgtccactgggcgcatgacgacgacacgtcgaaagggtgcgagggcagtcggatcgaacggcgttgccggcggcggaccgccctgctgctcatcgacccggcagagtacgcgctggcggaacgcatgtacggcggcaaccccaccaaatggccagcgagctcaacgtcaccgtccaagtcatcgaagactacagacaaatcctcagcgagataatccactaagaaagaagaaaaccatgaaaaagacaatcgcactgctggcagcggcactgttgctcgccggactgaccgcctgcggggaaaacaccacatccgacgcgccggccaaaacggacggcacgtcaaagaccgagaccaagaaggaggagcccaagccccagccggccgacctgaccggcacgtggaagcaaaccaactccaacgacccgaactcgtacatggaggccaccatcagcggcgacaccatcgaggtcaactggattggcaccgacgccaagagcctctactggaagggcacctatcaggccccgaccgaggccggcgactggaagtggaccagccagggcgacaccgagaccatggctcaatccctgctcgcctcgcaggacgccaccaaggacttcacctacagcgaggccgacggcgtgagctgggagaccaccgcgctcggcaccaccatcaccgtcaaaaccaccaaacaataaaaaatgccctgtcggcgttgcagcgtcaacagggcggttgaaacatcgaccagcttgcttattggaaaggaggacgcttcaccccttatcctacacggggcgaagcatacccgaaatgctatttgcgtttacgttttacggcgtcaataagctgaggaccagcggaaaagacgccaactatgcttccaatgaacgtaccgacattgtttccaaaggccgcgcaaactatagcggctccaaaggccatccaaggcaggaacgaaaaggcaacggaagtaatgagcatactgaggttttcggccttatggtcagcggcctccattgctgttgctgcttttctgtccgatatctcgacgtccaacgatttttcggccatggccagtatgcgatcagcggcaccgggaagtaccctctcataacctgcgtattcttcgacggaaggcagtgggccagagcgtgccgcaatcgctatcgcgttgaggtcgattccttgtccatcgctctgcgcaggctgtcgcccaccatttcccaggctttcgtctggagctgtactgctgtcgccggcgtgaacgacctccgctccaccttgcgagtcactactatttgcgcgcccctcgtcatgcccttcaggattggattgttgctcattatccatcgaccatacctttcctttaattcgcatactatccgaccaaccctgagattccaagtggacagcatggaggtggactgatggcgaacgtcaccagatacaaaacctcaaagggcgaaaaccgctaccgcgtccgctaccggaaacccgacggtacgcaaaccgacaagaggggtttccgccgcaagatcgacgcggagaactgggcggccgagcacgtcaccatcgccaaggccaccaacagctatgttgacccggaggacggcaaacgacgtgttggagacctctacgagcaatggctgaaggagaaatggccgttttggaaggaaaccacacgggtcaacgccacggaagcatggcgactctactgcgaggagcgttgggccgatcgtcggatcggcaccatcacccgcgccgaggtccaggcgtggatcagcgacatcatcgcgagcgccggcgctccatccgtgagacgcccgtaccagaccatgctcggcatctgccgcatggccgtccgggacaagctcatactcgacaacccctgtgaaaacgttgaactccccaagctgccgaggcgcaagagccgtcgcgtgtacctgaccatatcccggctgctcgcattcgccgacgaatgctccaggggaaagcatctgggagcggagcggcgggcgctcgtgctgacactgggcttctgcggattgcgctggggcgaggcggcagcgttgaaggcccgtgacctggacttcggtcggggagtgctgcatgtgggcggcaacctcgtgtacgtcggggcaagatgggtcgagggcactccgaagaacagcgaggaacgcgacgtgcccatgcctctcatcgtcatggaggcgttgaaaccgatgtgcggggaacgcgaaccggacgaaagggtgtttcgtgatctgcggggcggcccgattatgaagcagagcgcggcaaagacgaccggctggtggtatcacgcgctggtgcgcctgggctggccgaaggaggaatggcccacaccgcatgacctgcgccataccgcggcatcgctggccgtgcacgccggggcgaacgtcaaggcgctgcagcggatgctcggccacaagaacgcgagcatgacgttggatgtgtatgcggatctgttcgacagcgacctgatggacgtggcccgtctgctcgacgccgcagtgcaggtggagacgggcatggaaaaatgtgggcaaaatgtgggcaaaagcgttttggagcccgtatgaaaccctcagaaacgttggaataacgccattcccgtgaatggtggttcttctgcaagttaaaagacgcactgagctgagagtggatgcgttcttggctcccctcagagaggggagccaagtctgtcacttcagcagggaacgacacatggagcggtattcgttgacgtagccgccgccgaagaagacgcaatggccggcgatggggtagagctgccagagcgtgatacgctcctgccatccggccttcagcggatgtacggactggtagccctcggtgatttcgctcagatagctcatgccgaacaggtgcagcatagacagatcctcctcgcgatgaccgccatgtgccgccggatcgatgagcacggcctcggactgcccggaatcggcggtccacatcacattgccgctccacagatcgccgtggatgcgcgccggcttgtcggctgcggcgcggcccatcaggtccggcagcgcttcaatcacgcgctcagtcaactcaacatcgcgcttatccagctcgccacgcctcacaccaaggttgaccatcgggcgcagccgtccatcagcgaaatagctgatcgggtcggtccactcgccggtatccattttcactgggtcctgcaatggtccgaagtagcatgtgccgttatatccgtcaggcgcagacccgaaatattcggcaccagtatcatgcatatgggccagagccgcaccaaaagctcgtgccgcctgaggcgtgggggacgcgctacccacacgttcgatatccagataatccttgccccagccgtatacctgcaccacgcgcgggccgccctgcgcatgagccgctcccaaccattcgagccctcggccctcgcattcgaagaatccttccggtgcgaatgccctgcttttgcgatacgtggccataatgctcccttcgtcgcttacgtactatatccactttcattgtagaagccgtggatgttaccgattcttagcgttgttctacaccccttgggtagggtgttcatcgtcatagcacatcaaatactcagaaatcacgaggggttatgaatttcttccaagcgatcattctcggcatcgttcaggcgctgaccgaatatctcccggtatcctccagcgcgcatatccgtattttcggcgatctgatgctgggctctgatcccggtgcggcgtttaccgccatcatccagatcggcaccgaactggcggtgatcctctacttccgccatgacatcatcaacatcctcacccattggttcggctgcctgttcggcaggaacggcaaggattggaaagcccgtatggggcgcggcgacgaatacgccacactcggctggaacatcatcgtcggttccattccgatcgtcatcctcggcttcacgctgcaggacgtcatcgaaacctcgttgcgcaacctgtggatcacggtgaccgtgctgctggtgttcggcgtgctgctgtgggtggtggacgccaaggcccggcagaacaagaccatggacgatatgacgtaccgtgatgcgttcctcttcggtctgggccagtccatggcactgattccgggcgtgtcccgctccggcggcaccatcaccgttggacgtgcactgggatacacccgcgaagccgccgtgcgcctgagcttcctgatggccattcccgcggtgttcggctcggggctgctggaaaccgtcaaggccgtgaagaactacaaaaccgatgcgatgttccccggctgggggccgaccctcgtggccatggtcatcagcttcgtactcggctatatcgtgatcatcggcttcctgaagttcgtatcgaccttctcctacaaggccttcgccatctaccgcatcggtttggctgtggtcgtcgccttgctgctgattgtgggcgtgctgccggccatcgatccctccgtggcggctgcggcataagacagatcaatagaagcaactcaatataatggtgctcccgccggcgggagccgtcagcgaagctgactgatgatggtcactggaatatgccagcagaaccaccctcagtctcgctacgcgagccagctcccgacattttgtgcgacgtgcacatgctcccgctggatgaacagccctgtgggctgttcatccagcgggagcatcaccatatatgggctaattacccatctggcgcagaaatgcttccgcttctttgaccagttgttcggcctggggcgctcccaaagaagcctccgcctcggctttctgctgcaagtcgtagtcgtgctccaaatgctccacataatcatgaagctggtcattacaacgaaccagtatcgatgcctgagccttccactgttcggctttctgcttcagatctgccgtatcgaaggtgaagccgatatgcttgcccaacgcatccagcaatcgcatagtgccggcagaacattcgtcgctgcccaaatattgggggatggacacccacattgaggaatgagcaaagccttgctgcgcggcggccacatccagaacagtaggaatgcccaccgggccgttatacgaccggtctccttcgcactgacagtctccgtcgctgacggcgatgggcaacggccgagtatgcgggcaatcggagaacatcgaacctaacgtaatgattcgattgacatccagctcatcggcgatggccagactctggctacagtattccttccaccgatagttcggttcaggggcgatctgcgcatagatatgctttcctgcgtccaacatgatgtcgtagaacgtggtctgcggccagataagattggtgcgtcccgaaacatggcacagcataggacgggcaacctggtagtcatagaaatcatcacaacggatatgacgaatctcgcgggactcatatcgcttgaccagatggcgcaccacgttcgtcgccgcctgacaggcatcattccatccctcgaatgcggcgatcaatactgcgccggtgtccttcgctgcttcactcatacctctagagtaactggagttcattgcctgaagcgcacgctttagccataagcgagagtatgcaattacaggcgacacgccgcagctggacgaactacacgcatgtgtgtatagtaaacactcgtgcttcggcggggagacctcgccaaggaaacacacgcggacatagcttagttggtaaagcgcaaccttgccaaggttgagaccgcgggttcgagtcccgttgtccgctctaggtccgtgagttgacagaccttacggtgggttagccaagcggttaggcagcggcctgcaaagccgtatagacgagttcgactctcgtacccacctctcagaccagcgaagcaattcaatgggatgaagtatgacccgggcggttggcgcagtggtagcgcacttccctgacacggaaggggtcacaagttcgaatcttgtatcgcccacgaaagtcgaagcaattcgactggatataactgaagaaccgagtattcgggcgattggcgcagcggctagcgcacttcgttcacaccgaaggggtcgtaggttcgattcctacatcgcccactggattccgcttctcacggcggattcctttgcggacatagcttagttggtaaagcgcaaccttgccaaggttgagaccgcgggttcgagtcccgttgtccgctccacaacgaaacctcgcttcggcgaggttttttcgtattggttcagatgctggtggtatttgtcgtacgcccaacctatcgtgtcctacgttgattaaccagtccaggcctgcacattagtaccgcgggccccgatagcaaaggacagatcatggcgcaagctaccatctccataaccgtcaacggcgaagcgaaggaggtggaagcaaccaccaccggcgtagaactgttcgcggaagacaagaacatcatcgcggtcaagatcaacggcgaaaaccgtgacctgtacacgccgcttgccgacggcgacaccgtagagcccatcacgctcgattccgaagacggcctcgcgatcatgcgtcactcagccacccacgtcatggcccaggccgtgcaggaggtctatccgaacgccaagctcggcgtcggcccggtgatcaaggacggcttctactacgatttccaggttgacaagcccttcaccccggaagacctcaaggacatcgagaagcgcatacagcgcatcatcaagtcctcccagtccttccgccgccggtccgtgaccgaggaagaggccctgaaggaagaggccgaccagcccttcaagatcgagctgatcgaagacaaggaagcacacctcgacccggccgccgccaccgagatttccgagaaggaactcagcttctacgacaacgtcgaccgtgacggcaatgtggtctggaaggacctgtgccgcggcccgcacctaccgaacacccgctacatcaaggctttcaagattgagcgttcagccgctgcctactggcgtggcagcgagaagaacccgaccatgcagcgcatctacggcaccgcatgggccaccaaggacgatctcaaggcataccagacccgtctggaggaggccgccaagcgcgaccaccgcaagctcggtgccgagatggatctgttctccttcccggacgagatcggccccggcctggccgtgttccacccgaagggtgccgccgtgatcaacgcgatggaggactactcgcgcgagatgcaccgcaagcaccactacagcttcgtgcagaccccgcacatcaccaagggcggcctgtacgagacctccggtcacctgcactggtacaaggatggcatgtacccggccatgcacctcgacgaggagtacgacgcggacggcaacgtgaccaagcccggcttcgactactacctcaagccgatgaactgcccgatgcacaacctgatcttcaagtcgcgccagcgctcctaccgtgagctgccgctgcgcctcttcgagttcggtaccgtgtaccgctacgagaagtccggcgaggtccatggcctgacccgtgtgcgtggcttgactcaggacgattcccacatctactgcacccgcgagcagatgaaggacgagctgaccagcctgctgaccttcgtgctgaatctgctcaaggacttcggtctgtccgacttctacttggagctctccaccaaggatccggacaagtacgtcggctccgacgagatctgggaggaggccacccgtaccctgcgtgaggtcgccgaggcatcccacctcgacctcgtggccgatccgggcggggccgccttctacggcccgaagatctccgtgcaggcccgtgacgccatcggccgtacttggcaggtctcgaccatccagctcgacttcaacctgcccgagcgtttccagcttgagtacatcgcgaaggacggcacccatcagcgtccggtgatgattcaccgcgccctgttcggctccatcgaacgcttcttcgccgtgctgctcgagcactacgctggcgccttcccggcgtggctggcccccgtgcaggtgctcggcgtgccggttgccgacgagttcgccccgcatctggccggtttcgtcaagtccctcgaggatgagatggtccgttgcgagatcgactactccgatgaccgcttcggcaagaagattcgcaacgcctccaagtccaaggtgccgttcatcctcatcgtcggtgaggaagacatgaacaacaacgcggtgagcttccgcttccgcgacggcagccagctcaacggcgtaccggtggacaaggctcgcgagcagatcctcgccgtgatcgccaagcgcgtccaggtgaactccgccgacgacttcaacgccgctgtagctgagtaaaggaatacatgatggctgacgtgcgtgtcgatgatccggcggacttcccgcctcaggaagacacggtcgaacgactgtggaccccgcagcgcatgacctatgtgctgcgcaacagcgaggatcgtccgaccaaacccaagtcgaaggaatgtccgttctgcgccggaccgaagaagtccgacgaagacggcctcatcgcctggcgcggcacgcacgtgttcgccatcatgaacctctacccgtataacgtcgggcatctcatgatttgcccgtaccgtcacgtcggattcatcaccgaacttgacgacgccgaattgttcgagttcgagaaggccaccaccctcgccatgaaggtgatggagaccgtctcccatccggacggatacaatatcggcatcaatcagggcgaggtagcgggcgcgggggtcgcggcccatctgcatcagcatgtggtgccgcgctggaacggtgacgcgaacttcatgcccatcgtcgcccaaacgcgcaccatgccgattctgctgtccgatcagcgggatgcgtatgccaaagcgtttgcacagctggcttccgactaccatctgccgctcgtctgataccggcacgataccctcatgcatctggtcgaaccagcgcatgattcaaaaagacaatcgaaaacatcacgggtatgtctgattaacggcctacaatcgtttcgtttgacatcatccgtttattactgctaggagcattatgtcaggtcattccaagtgggcgaccaccaagcacaagaaggccgccatcgacgccaagcgcggcaagctcttcgccaagctcatcaagaacatcgaaatcgccgcccgcctcggcggtggcgacccagacggcaacccgtccctgtacgacgccatctacaaggccaagaaggcttccatgccggccgacaacatcgcccgtgccgtcaagcgtggtgccggtgacgaagacggtgccgccaactacgaggacatcgtctacgagggctacgctcccgctggcgtgggcctcatcatcgagtgcctgaccgacaaccgcaaccgtgcggccgccgaagtgcgttccaccctgaccaagggcaacggctccctggccacctccggctccgtgtccttcaactttgagcgcaagggccagatcgtggttccgtccgaaggcgtggacttcgacaagctgttcgagaccgcagccgaggctggcgccgaggatgtcaccgatgacgatgaggtctacaccgtcatcaccggcccgtccgatctgttcaccgtgcgcaaggctctgcaggacgccggtttcgactacgattccgccgaccaggtcatgcagccgaagaacgaggtcgagctgagcctcgaagacgcccgcaaggtgtccaagctcatcgacaacctcgatgatctcgacgatgtgcagaacatctactccaactggaccgcctccgacgaggtgatggcccagctcgacgaggagtaatcctcgtgatcatcctcggcgtcgaccccgggctcacgcgctgcggggtcggcgtgatcgaagccggcgagcaccgccggctttcgtttattcacgtggacgtggtgcggtcctcgccggacatcacccaggatctgcgtcttttggccatctataacggcctgtccgagaagatggatcgctttgcacccgatgccgtgtccatcgaacgtgtgttcgcccagtcgaatcgcaacactgtgctcggtaccgcgcaggcggccggccttgccatgctcgccgccgcgcaacgcggcatccccgtggcgcttcataccccgaccgaggcgaaactggccatcaccggcaacgggcaggcgcagaaggtgcaggtggaacgcatggtgacgcgtgtcctgaaccttaccaagatgccgacgcccgccgacgccgccgacgcgctggccttggccatatgccatgccctgcgtccggcgggggcgctgcagggcggcgagcgtgagcagcatctgaccgccgcgcaacgccagtgggccgaggccgcgcaaaactccacgcgccgacgcaagaacagcgatcgaggtatgtagtatactttcgaacagatgttcgaatcctgaataccgaaacgttcaaggagtacctgtatgattggcatgctgaccgggcgggtggaatcggttgaaaccgacaccgcattgatcgacgtcgggggagtgggctatgagacgcgcatgcccgccaccgacttgggccgcctgcacgccggccaggacgcctgcgtcttcacgtatctgaacctctcgcaggattctgtcacactgtacgggttcctcgaccgggactccaagagagtgttcctgcagctcatcaaggtctccggcataggaccgaaggtggcgcagtcgctgctgggcacgatgaccccaagccagctggcccgcgccatcgccgacaatgacgccgccgcactggccaaggcgccgggattgggcaggaagggcgcgcagaagatcatcctggagctcaagggatccgtcgatctgaaccagtccgatgacgcgtcggccggcaacgctccataccagccgaccgtcgacgccggcgtggagcaggtcgtggaggggctggtctctcttggctggcgtcagcaggacgctcagcgggccgtcaacgaagcctgcgcagagaacgatgttcccatgccgctggcctccgacgatgcgccgcgtgtgctgcggctcgccttggcccgtatggatagggggcgctgatgaacgagacgacggattacggcgcctccaacaccggtgccaacgaggagtcgttacgcatggtctcctcgcagccgatcggcaacgagccggccagcgatgaggaattgcgcccgcatgtcctcgggggattcatcggccagccccggctcaaagcccagctgcagctgttcctcgacgccgcgcgcaagcgggacgtgccgcccgatcatatcctgctcgccggcccacccggtttgggcaagaccacgttggccatgatcgtggccaacgagctcgaagtgccgattcgcgtcacttccgggcctgcggtccaacacgccggcgatctcgcctcgattctcagttcgcttgataccggtgaggtgttgttcatcgacgagatccaccgcctgccgcgcgccgccgaggagttgctgtacatcgcgatggaggatttccgcgtcgacgtgatggtcggcaagggtccgggcgccagctccattccgttgaccctgccgcggttcaccgtcatcggcgccaccacgcgcgagggcatgttgccgagtccgttgcgcgcacgcttcggtttcaccgcacatcttgacttctacccgcacgacgagctgcagaagctcatcgaacgttcggccaatgtgctgggcgtgaatcttggcgacggctcggctcgggaactcgcgttgcgttcgcgcggcacgccgcgcatcgccaatcgtctgctgcgccgtgtgcgcgattgggcgatcgtgcatgacctgatcgaggtgcggtcggatgacgtcaaggaggccttggccttataccagatcgattcggagggtcttgaccgcctggacatcgccgtactcgacgccatcgtgcgtaatttcaatggtgggcccgtgggactgaacaaccttgcggccatggtgggcgaggagtcggagaccgtggaaaccgtatgcgagccgtatctcgtgcgtgagggtttcctgatccgcaccccgaaaggccgcgtggccactgagaaggcctggcgacacctggggattacgccaagggatgatgtcagcaagcccttctagacttttcctgtttgcacacttggcgacatttcgtcaatgccgttcatctgaaggagttttccgtggaacagtccattatgcttatcgtgatcatcgtcgttttcggcggcatgatgtggtggcagtccaagaaggccaagcagcagcagcaggagaaacaggacttccgtcgcaacctgcagcccggcaccgaggtcatcaccatcggtcaggtgatcggcaaggtcgtcgaggtcgatgagcagtacgaggagatcgtcatcgactccgagggatccaagctgcgtttcggtttcaacgccatcgcccgcgaatacatccgcccggcctacgtgtccgatgccgaggtcgacgagaacggcgatccgcttcccgaccaggatgccgggaccccgaccgccgacgagtccgggcagaccccgatcgaggcgtccatcacgtccggagagaacgatgcggccgaggacatcgactccccggccgccgcagacgggaccgccacgaagtaggccgtacgatttggcggcgtcgcagcacatcagtacaggagggtgaatattatggcacagtcggacatcaccatcgacgcattggacaaggtgggacggcaggacgccgaatatctggtgtcgttggtgcgttccatacccgggttccccaaggaaggcatcatcttccgtgatttcattccggtgttcgccgatcccaagggcctgagaatcctgctcgaggcgcttgaggcggccctgccggtgcccgcgagcgaattcgattccatcgccggcctcgagtcgcgcggattcctgttcggcccggctctggccgcccgcatgggcaaggggttcatcgccgtacgcaaggccggcaagctgccgcccgagaccatcggcgaatcctatgatctcgaatacggctcggcgcgcgtcgaaatcgagacggatgccgtgcaggcgggggagcgggtacttatcgtcgatgacctcatcgccacgggcggcaccgccaaggccgccaccgatcttatcgacaaggtgggaggcaccgtggcgggttatggtttcgtgatgcggctcgaaggcctcgacggcatcgacaagcttggcggcaagcccgtcagctcgctgatggcgatgccggcctgagcgttcgtctcacccaacatacattcggtttttaaggtccgtcatgtactgtgtacagttacatgacggaccaattacatagtcagggaaggatcgatggatctttacgaatatcaggcgcgtcagctgctcgaggaacaggacattcccaccccgagcgccatcttcgcccagaactcccatgaagtcgcggaagcggcggacgcaatcggctatccatgcgtgatcaaggcgcaggtcaagatcggccatcgcggtcaggctggcggcgtcaagatcgcccacaaccgcgacgaggccattgtcgaatccgagtccattcttccgatgaccatacacggccacaaggtctccggcgtgctcgtggccgaagccaagaacatcctgcatgagtactatgtgtccatctccgtggatcgcacctcgcgcgacttcgatgtgctggccaccgccaacggcggcaccgaggtggaggagatcgccaaggagcatccggaatccgtcaaacgcctgcacatcgacgcgctcggcgatttcgatctggccgcggccaccgagatggcccgcagcatcggcttctaccatgccgacgtcgatcaggccgcgcagattctgctgaagatgtggcgcgtcttcaaagacaacgacgccacactcgtggagatcaaccctctggccaagatcggcgacccggacgacgagtccaccaagcagctgagcgccttggacgccaagatttccctggacgacaacgccgccttccggcatggtggctgggagcgattcgtggattccgtcgtccccgaccccttcgagcagcgcgcccgtgagcacggactgcattacgtgcatctgcacggcgaggtcggcgtgatcggcaacggtgctggactcgtcatgagttccctggacgccgtctccggcgccggcgaggagcagggcagcgatgtcaaacccgccaacttcctggacatcggcggcggcgcctccgccgcggtcatggccgagagcctgcagatcgtcctgtccgacccgcaggtcgaatccgtattcatcaacatatacggcggcattacttcctgcgtggaggtcgccaacggcattctcgacgccgtcgccaagctcggcggttccaaacccatcgtcgtgcgcttcgacggcaacgcggcggccgagggtctgcatatcctcgcctccgcgaacaaaccgaatatccatgtgtccgaaaccatggaagacgcggcggccaaggccgcgcagctcgccggtgaggcgattcagtccaaggaggttctctgatgctgttcatcgaagacggcgctccggtcatcgtccagggcatgaccggccatcagggcatgacccatacggcgcgcatgctcaatgccggcaccaatatcgtcggcggcgtgaatccgcgcaaggccgggatgcacgtcaccttccccggtgcccaaggtggcgccgacgccgatatccccgtgttcgccacctgcgccgacgcccgtgaagccaccggcgccaaggccagcgtggtgttcgtgccgccgaagttcgccaagtccgccgtggtcgaagcagtcgaagccggcatcgaactcatcgtggttatcaccgaaggcattccagtagccgattcctcgtatttcgtcgaactcgcgctcaccaggggcgtgcgcatcatcggaccgaattgccccggcctcatcaccctcggtaacccaggcgtcaacctgggcatcatccccgacggcatcgtcggccgcggcccgctcggactggtctccaaatccggcaccctcacctaccagctcatgggcgaattgtccgatatcggcttcaccggatgtctcggcgccggcggcgatccgatcgtcggcacgacgctgctggaagccctgcaggcattcgaagccgaccccgacaccaaggctgtcatgatgatcggcgaaatcggcggcttcgccgaacaggacgccgccgcatgggccaaggagcacatgaccaagccggtcgtcgcctacatcgccggtttcaccgcccccgaaggcaagcagatgggccacgccggcgccatcgtctccggtggcaagggcaccgcccaggacaagaagaacgcactcgaagcggcgggtatccccgtgggcaagaccccgggccaggccgccgaaatcatgcgcgacatactcgccaaggccgacatcgactgatcggttccgaccaatcgtgatgaaagccgtgattcgccaatgggtgcggggagccatagtcgctctcgcatccatggccatctatgccattgcattaggctgctatacagcgctgatgttattggtcgtctccatggaagagggcgccgacaatctcaccgtcggcacaacctcgctgacacaggccgttgtgcttctgagtgagggatcgggctttagaaccgattcgttcaccctcaccatcacgccattgatgttgactatactgctgatatggctgatcaatgcactcaccatgcgaatcaaagcatacgggccgcatgcgtatgttgccggattggttgtttggctcgggttgaacgaggtattccggcaatccgtacacctaggtcttgtcgatgaccagtggcttgtgttgctgaaagcagccatcgtattctcgatcggtttcctatgcgcagccgtaccggaatcagccaagatgcgagcattcagggactggactcgcaagcaggtgccggcggacatacgccactgcctgaaaatcggcgtcgccttggccgtcgcgatactgggcatatacctggcaattggattgattaccgtcatcgtatgggcggtacgcaaccatgccgctgtcgtatcgttgttcggattgtccgggatggaaaccggttcacgaattctcaccaccgtcgccatgctgatctggctacccaacgtcatgctctgggctgtttcctggctcttcggcggcggattcgccatcggtgatttggccagtttcacgttatggctcggccaatccaaagagcttcctgcaataccggtattcggtattcttcccgaaccggtcagcagcgaactatggcgtaccgttgccttgaacgcgcctctcgccatcgctgcgctcgtgggcctgctggctgtattcctgccgcaaggattcgcctgcagaccgttgaatatacggaatgcgtccacccgcggcccagtactggtttcgctgatctactccgctgggtcattctgcctgagcgcgatgctgatctcactggcatccacattgctgttcgctctgtccaatggatcgcttggcgatcatcgtctcgctcacattggcgtcgacgtcatggcctccaccagagtcgtcggtcattcgaccgcattgggatttaccgcggcatggctactcgcgctgattggcacagcgctcgttttttcgataggctggttggttgggaggatcaatgattcccgcaccaccgccgcgaccccgaagaccgtcatcgtccgtcaggcgcggtccctggcgtcacaaccacaagaatccaaggaggaacaggatgacaaacacgaaccgaccgatccgtcgggcactggtctcggtctttcataaggaaggcatcgaagtactcgcggaagcgttcgtgaaggccggcaccgaagtcgtttccaccggttcgaccgccaggaagctcgccgagctgggcgtcaaggtaaccgaggtgtccgatgtcaccggattccccgaatgcctcgacggccgcgtcaagacgctgcatccgtacattcacgccggcattctagctgatatgaccaaccccgaacacgccaagcagcttgacggcttcggcatcaagccgtttgatctggtggtcgtcaacctgtacccattcgccgacaccgttcgctccggtgccaacgaagccgacaccatcgagaagatcgatatcggcggcccctccatggtgcgtggcgcggccaagaaccacgccaccgtggccatcgtcaccgatccggccgattacgccttggtcgccgagcgtgtggccgacggcaccggcttctccctcgacgagcgcaagtggcttgccgccaaggcattcgcccacaccgccgcctatgacgccaccatcaacgaatggaccgccaagcactggccgaagccggcttcactggacaccgccgaagtggacaaggacgatcaggacactgaaatcgattccgccaagttcccggcacgattcacccgcacctgggaccgcgcccacaccctgcgctacggcgagaactcccaccagcaggccgccctctacattgacccgctcaaccagaccggtttcgcccacgccgagcagctcggcggcaagccgatgagctacaacaactacgtggacgcggacgccgcctggcgcaccgtatgggatatggctcccgccattgccgtggccgtagtcaagcacaacaatccgtgcggtctggccattggcgcgaccgtggccgaggcccacaagaaggctcacgcctgcgacccgatgagcgcctacggcggtgtgatcgcctgcaactccaaggtcactcttgagatggccgaaagcgtgcgcccgattttcaccgaagtcatcgtcgcccccgactatgagccggccgcgctcgaactgctgcagaccaagaagaagaacctgcgcatcctcaaggtggccgagccgccgaagggccacgaggccatccgccagatcgatggcggcctgcttgtgcaggacactgatctgatcaacgccgtcggcgacgatccggacgcctggaagctcgtggccggcgaggccgccgacgccgacacgctgaaggacctcgtgttcgcatggcgtgcaatccgctgcgtgaagtccaacgccatcctgctggcccacgaccaggccacggttggcatcggcatgggccaagtcaaccgcgtggactcctgccatctggccgtcgagcgcgccaacacactggccgatggtgccgatcgcgccaccggtgcggtcgcggcatccgatgcgttcttcccgttcgccgatggtgcccaggtgcttatcgacgcgggcgtcaaggcaatcgtgcagcctggcggctccatccgcgatgaggaggtcatcgaagcggccaataaggccggcgtgaccatgtacctcaccggcacccgccacttcttccactgatcgggactctctgaggagagcagctcagccaaaacgcacaaaggtgggattccgcctggacccgttgacgggtccaggcggaatcccacctttgctattcgcctgctattgtggtcacgtaaccgttcgacagaaggaatcgcaacatgcacaaccatccctatgtatccgaagcacatgagggcaagccatggtttgaatggtgcgtactcggcgtcatcgccgtcgtcacactgctggttgcttttggatatacgatggccgccacggtcatacttgccgtgacggccatcatcaccgggcttgttcgcctgattcttcaggacaaaagcccatggaaagtgcgctcagtggcgttcgactccttcatcggcatcgccttgggaatcggcctgctgattacctacttcagcttctttggactcttcggcaacatctttttccgctgaatcgccatcagacgaggcggcctgatcgaagaattcgccatcgtcgagtgtgtccgcgttcgcatcggcatccgtctgtggaagatcggcggcagccggcactttgggagtggtcatcatctgagcgatgatcatgaccaacgccaccacagaggcggccaagaccgggctaatccagaatacccacagctgctgcagcggattttgcgtaaggccctcattcatcgcggccagtgcgataccggtggaacgggcgggattgagaccggcaccggtaaccgggtagctgatggcggcggccagaccataggcaagacccaaggcaatgatatgacggtccgaggactcgccgtgatcacccagagaagacatggcggtggcaacgacaatcagagaggcaacgacctcgacgacaatcgccaacgtaatcgagaacgtaatgccatactgggtcagcagcgagtaagacacggagccgttttcgaaaccgttaacggccggagtcagccacactttggcagctacctgctcggatgtgggcagcagcttgaccacggcgaagccggcggcgatggcaccgatgacctgagcgatcacatagaggatgccatccaggattttcgtcttggaaaccagcacggaggctacggtgatggccggattcagctgaccaccggacacgcgggagaagatggcggtgactgcggcatatgccaagccggtagccaacgcgaagaacacgatattgatgccatatacggccgaaccccatgtggagaaggcgtaaatcgcaaagcacagcaggaagctgccggccgattcggcgcacacgcgcagagccagcggctgttgcttggtttcttccatgattgttcattccttttcatctgttggaagacgggcgaacccgcacaaacggttgccagtctagcagcagtcctacgttgcggtatgatatatgggttggaattggctgggattccagtccgccaactctaaagtatgtatacaaatcgacagtctctgcgatgacagaatctgtccggccacgttgggagaacgatgccaaacgcatattcccgcgctgcgaaagcgcaagacgattccaattccattcgactccagaagctgcttgcccaagcgggattcggttcccgccgcaagtgcgaggacatgatcaccgaaggccgtgtcgaggtcgacggtgaactggtcaccgagctcggaactcgcgttgaccctcataagcagcaggtgcgcgtagacggttcacgcgtacgcgtcaatccgaaccacgtcactctggcactgaacaagccccgcaaggtgctctccgccatggacgatccgaagggacgctacacgttgcgtgacatcgtgggcgacaagtacgagcgcatcttccacatgggccgtctcgactacgattccgagggtcttatcctcatgacgaacgatggcgaactctcgcagcacgtcatgcaccccaagtacgaggtcgaaaagacctacgtcgccacgctggagggcaagatctccggtaccgtgtgccgccgactcgtgaccaccggcgtgcagctcgatgacggttggatcaaactcgaccactgcgccatcatcgacgcctcccgtgattacacgatggtcaaggtcgtgctgcactccggcaagaaccgcatcgtgcgccgcatcttcggttcgatcggtttcccggtcaagcgtctggtgcgcactcagatcggcccgatcaaactcggtgatctgaagcccggttcctaccgcgtgctgtcccagacggaagtccgttcgctgtccaaggaggttggcctgtgattcgcgttgccatcgacggccccgccggcgtgggcaagtcgtccacgtccaaggcgctggccaagtatttcggatacgcctaccttgacacgggcgcgatgtatcgtgcctgcgcttggtggtgcttgaagcagggcatcgatctggacgccgaaaccgtggatgagcgtgtcatcaccgaagcggtgggcgagttcttcaccggcgaccatttcgatatctccgtggacccggacaacccctgcgtattcgccgacgacgaggacatctccgaggccattcgttcctccgaagtctccagccatgtctccaaggtgtcgaacgtcatcccggtgcgcaacgtgctcatcgccgcccagcgcgcctacatcgcccgcgaggcgtcggccgactccttctccgggggtttgggcatcgtggccgagggccgcgatatcaccactgtggtgtccccggacgccgaggtgcgcgtgctgctgaccgcccgtgaggaggtccgtcaggcccgtcgcaccggccaagccgtcaagggcgtgggtgctgaggatgtggccgcgcgcgacaaggccgattccaaggtcaccagcttcctgaccgccgccgatggcgttaccaccatcgacaattccgatctggacttcgcccacacgctcgatctgctcatcggtctggtcgaggacgccatcgagaaccaggaatacgagcagtatgccgccaatctcgaaggctatgagttggacgagggcgatgaggatctgatttccggccgtggtttcacggaaggtgcgcgcaaggccggccccaagccggtgggcgtgctggctattgtaggccgtccgaacgtgggcaaatcatccttggtcaaccgtatcctcggccgccgtgccgccgttgtggaagacacgccgggcgttacgcgagaccgtgtgagctatgacgcggaatgggctggcaccgacttcaagctggtggacacgggcggctgggaagccgacgtggaaggcattgaatccgccatcgcctcacaggcacaggttgccgtgaccttggccgatgctgtggtattcgttgtcgatggtcaagtgggcatgaccaccaccgatgagcgcatcgtcaagatgctgcgtgccgccggcaagccgatcgtgctggccgtcaacaagatcgacgaccaggccagcgaataccttgccgccgaattctggaagctcggcctcggcgaaccatactcgatttccgccatgcacggcaggggagtgggcgacctgctggacgttgcgctcgacaagctcaagcaggccgagaagacttccggctacctcacgccttccggcctgcgccgcgtggctctggtgggccgtccgaacgtgggcaagtcgtctctgctcaatcagctggcgcgcgaagaacgtgccgttgtcaacgatttggccggcactacgcgcgaccccgtcgacgaaatcgtcaacatcgatggcgaggactggttgttcatcgacaccgccggcatcaagcgacgccagcacaagctcacaggcgcggaatattattcctctctgcgcacgcaggccgccatcgagcgctgtgaattggcgctgatcctgtttgatgcatcgcagccggtatccgatcaggatttgaaggtcatgtccaccgccgtggatgcgggccgtgcaatcgtgctcgtattcaacaagtgggatgcgatggacgagttcgacaagcagcgtctcgaacgcctgtggaacaccgaattcgaccgtgtgatgtgggccgagcgtgtgaacctgtccgccaagaccggctggcacaccaaccgtctgacgcgagccatggataaggccttggaatcctgggatcagcgtattcctacaggcaagctcaacgccttcctcggcaaaattcaggccgcccacccgcacccgttgcgtggtggcaagcagccgcgaatcctcttcgccacgcaggcatccacgcgcccgccgcgtttcgtgatcttcgccaccggcttcctcgagcacggctaccgccgctacatcgagcgttcgctgcgcgaggaattcggcttcgaaggcacgccaatccagatctccgtgaacatccgcgaaaagaagaagcggaagtgacacgcgcgtaatttgccagatttcatatatctggtagattatctattcggtgcttttgcaccatcgggccgtagcgcagtttggtagcgcacttgactgggggtcaaggggtcgcgggttcaaatcccgccggcccgaccgattagccccggaattccgccacttttgagtggttgtcttccggggcttttccattttcaaacaacatgagacaacatgacgacggacttacctttgtaagccattcgtaatggattaaacatggacttcatcttggcgtgttattggaattatcaccgacaattcaccgcctccgcacccccgtcgtatgcgtttgcggcctataggaacttttgtggtgctttagactggttttcgttgtcagtcggtggtgttggggtatcgcgtggtggtgtggaattcgttccagtcgataccggtcccgtatgcgggcgcgacgctgtcgtccggttcgggcgtcgttgccttttcgcccttccgcagggcgtcggggatgaatgactccggtcgtgggtgcgcggtcttcatgtagcatacccattcgcacgcgcggcgcatgtgctcctcgggcagcccgcgatggttgcgcaatacgtccttgacgaccgagttgacgccgccctccagccggttcgtggtgcgcgccaccggaccgcccttcagcagttccggctcgagataggcgaacagcctgccctcgcggaacagcctctccagccgccggtagcagcgccgcagctcctcgtgcgtccaccaccaccggtgcctcgacgccttggggttggacgggtcgtcgcgcgcgtaggtgcgttcggcgatgaagtccttccaccgttcgtgccatgcgttgagggcctcgccccacctgacggcctgcccggccgtctcgaccgaggtgagcctgtcggacagcctcttcagctcgcggccggcctggagcctgggcctggacgtcaggtccgtcctcgtgttgcgctgcacgtgcaccaggcagcgctggatcctcgttcccggccacgcctgcgtgcacgccgcctccgcgccgcgcagcccgtcggtgatgagcacgtccggcgcgggaagccgggagaacagggccaggtatgcggccttggactcgtgcgcgcaccactgccagtccagcacctcgccggtttgcccgtcgatggcgatgatcaggcaccagccgtggcccatgtacgtgccgtccgccatgaccgtgtggcgcctggcgtccggcggggcgatgcgcgggcggatgcgccagcaccatgcgattcgtttgcgcagggcgcgggcgtcgcccgcggagtccgccgccctttgggatgacggccccagcagccaggaaaggaactcctccagcgtccgctcccgcctgcgccgccgctgcggcatcgtcgagctcaaccggcaggccgggcatttccaccgctggacgcccttgccggtccgcccgttcttcttcatcgcacgcccgcacacggggcatctcttcgctttgctggatggtgttctcacgccatccagcccaccaccgggggcgcatcattttccacgcgacaaaaatgacaggccgacacgcctgctcccacaaggccgggccacggttataagcaccacaaaagttcctataggccgcgtttgccccaaacaggggctagactggttcctattgatttgacgaaagggacccgaattgaccgaaataaacgataaggcccaactggatatcgccgccgctgacgacaccgacgccgtcacctcggacaccaccgaagaaaccgtaaacacccctgaagtggatgagactttcgagctttcggccgccaagatgcgcgagcatggcatgagcgaaaccgccatcaaccagttccgccatttgtatgacgtatggcgccatgaagaagcctccagctggattcgtgaggacgacatcgagccgcttggccacgtgcccagcttccacgacgtctatgagaccatcaaccacgacaaggccgtggacgccttcgccaagaccgcattcctcaagctcaatggcggtctgggcacctccatgggattggacaaggccaagtcgctgttgccggtgcgtaggcacaaggccaagcagatgcgcttcatcgacatcatcctcggccaggtgctcaccgcccggacccgtctgaacgtggaactgccgctgaccttcatgaattccttccgcacttcggcggacacgatgaaggcgctcaagcagcatcgaaagttcagccagcatgacgtgccgatggaaatcatccagcatcaggaacccaagctcgtggccgccaccggcgaacctgtgagctaccctgtgaacccggagctggaatggtgcccgcccggccacggcgacctgttctccaccatctgggagtctggtctgcttgacgtattggaggagcacggcttcaagtatctgttcatctccaattccgacaatctcggtgcgcgcccctcgcgtacgttggcccagcacttcgaaaacacaggtgccccgtttatggctgaagtggccatccgcaccaaggccgatcgcaagggcggccatattgtgcgcgacaaggccactggtcgcctaatactgcgtgaaatgagccaggtccatccggacgataaggaagcggcccaagacatcaccaagcatccttacttcaacaccaactcgatctggattcgtatcgacgctttgaaagacaagctcgctgaatgcgatggtgtgttgccgttgccggtgattcgtaacaaaaagacagtgaatcccacggacccgaactccgaacaggtgattcagctggaaaccgccatgggtgccgcaatcggtctgttcaacggttccatctgcgtccaagtggatcgtatgcgcttccttccggtgaaaaccaccaatgatttgttcattatgcgttccgatcgcttccatctgacggacacgtatgagatggaagacggcaactacatcttcccgaacgtcgaacttgatccgcgatactacaagaacatccacgatttcgacgaacggttcccctacgccgtgccatctttggccgcagccaactcggtttccattcagggcgactggacattcggacgtgacgtcatgatgttcgccgacgccaaactggaagataagggcgagccaagctatgtgccgaacggcgaatacgttggcccgcaaggcatcgaaccggacgattgggtgtgatttacaacacggtagaacgataaaaaagatattatttttgtgaaatggcgctcaactgcggaaaaagcctctaagatagagtgagtgtggggaaactcatacgcacttataacgaaacaataactatacgtgaggactaatggcagagggcacaagcggacgtcggcgtttttccgacaaatggggcaagcacgagctggacgtactggctgtgttgtcatccgcgttcccgcaatggctcacatcccgccaaattgcgcagcgcgtcaaagcttacgccgactcgtatggagagctggcagatcaggccgccaaggccgcgttcgccaagcagttccagcgtgatcgcgccaagctcgccgctatgggcatcgccatcgaatcacggcagcctgagtattcgtccaagtcggaaggccaggacttcgcgtcctaccgtctgcagttgggcgacgaaccgcgcatccgtctgatgttcgagccggaagatatgccggtgcttgccgccgccaactatctggctcgttcgatgtcgatttcctccgaaccggatcattcccagctcacccaacaggcgtcgcgcaccacgccgcgtgtgccgcagacccctattcccgggctcggtttggattcgattgcgcctggcttgggcacgcagcccattccggactcgctggtcaaggttatcgattcgcgtcgctttgccgccaccgttgatgtggacggcgaacacctgaacgtggcctacaccgattccgacgatttggccatgtttgtgctggagcatccgggtgccacgattgtcagcccgcaggaggctgtggacgcctatcatcgccgcctgcacgccgccagccgattcactctggccgacgaatccgccagccctgtaagcgcctcggtggtttccccatcgattagtcgcgatgttcgtgagccgggtgatcccgagtcgatcaaggcccagaacaagaagaacggatccgctttccaaacgggcagcgaggtggatcgtcgcctgcgtctgatgctgttcctctccgctcacttgggtgaggaattctcgatgagcgagctggccgaacggttcattggcaagccgaagaacgaggacgagctcaagaagtacgtcaacatcatccacaaggacatcaacacccttaccaccgtctccgatgacggcgagatggcgggcagccagttcttcgatatcgactggccgctgctggatgccgagggtattgtttccgccaccaattcgttgggccttgaacgtcttgccggcatttcgccgcaatacctcagcatgctcaccgcctcggtcagttacttggcgcattcgccgttactgccggacaagcagcgtgggcaggccgaatccctgtatgagcgtttgcaccgccatgtcagcccgggccagaccccgtggctgagcctgaccggctatgagctggagccccgaagcttctccatcgtcaagcgtgcgatcaacaccgattcgttgttggacatggagtattccgatggtaccggtagtacccgtcgcaagctggtggcccccgccaagatcttcatcgacgaaggcgtgtattatgccgccgtctacacggatgtcggttccgccgcccccaaggacaagaaggcctacgtctccaaagacaagaccatcgacaaggccaacggcaagccgcgcatctggcaggtgctgcgattggcccgtatcgaaaaggcggaattggtcaagcccaccaagcagatcaacatcccgaacatgccggtgagcgaactgcgcaagtggagtttcgacaacggtaccgacgcggtgttcatcaccgatcagcgcgatctggcattcatcaagacattgccgggcgctaccgtcgaacaatgcggtgccggtgaaaaggtgcatctgaccgtttcctccgattcctggttcgtggccttctgcattgcccacgcgcgtcatatcacagcggtcgccccggaaacgttgcgcaccatgatcgtggcacgtgccgaacgcgaactgagcatcagcgagaacaagtaaggagcctttcatgccttggtggatatggctgattctggccctgttcatgctggccatgattgttgccggactgatctatacagcccttcatggaatacgtgccttgaaagacatgtctgacatcggtggccaactcggtgaacgtgtggccgcgatgggggagtctggcatttctgccgacaccagcgagccgcctctgtttactcagccgctcagcgtggcacagaatcgttatgccgaggcccatgcggacgtgattcgtcgcaaggccgccaagcgcgagcgccacacccaagcatgggcccgctggaagcgattcaacaactaacggaaagcagcaatggcacgtcaccaacaccataagggcaatgccgattcccagacgctgagcccttcgcagcggtacgcatcattccaaaaagtccaacgccatcgggcatccgcagcagcgcgattcgccgaatccctgcccttcgaactggacggcttccagaccgaagctaatgatgcgctcgaagccggcagtaatgtactggtcgcggccccaaccggcgccggcaaaaccgtagtggcggattttgccatttacctcgcccaggaacgcaacgtcaaagccttctacaccacaccgatcaaggcgctgagcaatcagaaataccatgatctggtcgacgtgtacggcccggacaaggtgggcctgctcaccggcgatacctcgatcaactccgaggctgacatcgtggtcatgaccaccgaagtgctgcgtaacatgctttacgagcgttcaaccacgctgaacgcactgcgctatgtgatccttgacgaagtgcactatctggccgaccgattccgcgggcccgtgtgggaggaagtcatcatccacctgcccaagacggtcaagatcgtcggcctgtccgccaccgtgtccaacgtggaggatttctccaactggatcgcctcggtgcgcggcgacaccaagctggtgatcagcgaacaccgccccgtgccgctggaacagcacgtcatcgtgcaggcggacgaacacaccgagcccgaggtgctggatctctatcgccgcgacggcaacggcgagcagaccaccaagctcaacgccgaactcatcaaccggctcgaccagctggaccgcaaggccgcacgccggcgcggcgaggaacgccccgataagcgcaagagcttcggcagaggacgtggtggcaaaggcgtcaagaaccgtgccccgaaagcggaacgccacaccccgcgccgctgggccgtggtggatgagcttaacttcctgggaatgttgcccggaatctacttcatcttctctcgcaacggttgtgaccaggccgtggaacagtgcatcaacgccggactgaagctcaccaccgatgaggaagtgaccaggattcgccgcatcgtggatgagatggtggaggggcaactcactcaggaagacctgaaagccctgcagttctccaagttccgcttcgcgttggaagaaggcttcgcttcgcaccacgccggcatgatcgctctgttccgccagatagtcgaacgattgttcgaagaaggtctggtcaagatggtgttcgccacggaaacgctggccttgggcatcaatatgccggcccgttgcgtggtggtcgagaaactcgagaagttcgacggcactagtcatgtgggcctgactcccggagaattcacgcagctcaccggtcgtgccggtcggcgcggcatcgacaccatcggccacgccatcgtggtcgaccatcacggttttgtgcccgccacggccgccgcgttgtcatccaagcgtgtctacccgttgcactccagcttccggcccacgttcaacatggccgtgaacctgctcaactccagcgactacgagaccgcgcgcgttaccctggaccagtcgtttgcccagtgggaggccaacgaatcggcctggcagttggaatcgcagatcaacacactgaagaacgcgctggccggatacgaacaggcgttcgcatgcgaacacggcgacttcaaacagttcatgaccctgcgtatggagctgagcgatatcgagaaggaaggccgccgcaaactgaagcacgaagtgttcctgaccgatcaggagcgttcacgcgccttccagaacctcgaccagcgcatccgcgatttgcgcaaggcggaacacgagcatccatgccgtaattgcccggacctccagcagcacctcaagtggggccaccgctgggcccgcgagacccgcgaactgcagcgcgtcaccgatcgctacgactcccgtaccgggtccgtggcacgtcagttcgatcgcatctgcgatattctcaccgggcttggttacctcgaacgtcatgaagatgcggccggccacatcgacatgacgttgaccgagaaaggctcgctgctgcgccgcatctatagtgaacatgacctggaactgtgcgaggcgctgctcgccggcacgttcgacaagctcgacgccaacggactggccgctgtgctctcttcactggtatacgaggccagacgaggggagacagtgaaccgaggcactacccgggcggcatctccgggcccatcgccatcgcttcgtccaagctcaagggcatctgtgaagacatcgatatcctgtgcgaggatcacggtctggacgagatgcagcggccggactccggcatactcgacatcatgtatgaatgggcggatggcggttcgctgggatcgtgcctgtacggcaccgacatgaccggcggcgacttcgtacgcactgccaaacgactggctgacgtgctgcagcagatcgctgtcgcccagccgctgccgttcgacgggggagagcggctggcaggcctcgcccacgaagcggccgaccagatcaatcgtggcgtggtggcctactccggcgtggactgacggggctgtttgacgggagtttgtcagccgacgtcggaagcttggaatagcggccaagtccgaacggttgcgtaaattagtagggttaaagatctttcaaggaggatgccgatatggcagaacgtagcctcaggggcatgagcatcggagcgaaatcgctggagtccgacgacaacgtcgatttcgccgcacgaaacgatgtggcgtatgtatgcccgaagggccaccgcaccatcctgccgtttgccgagggtgccgaaatcccggacgagtgggagtgccgttgtggttccgtggcccaccgtgagggcgacgccgaccgtgagggcgacgaaatcagcaaacccacccgcacccactgggacatgctgctggaacgccgtagcgaagaggaactggccaccctgctcgaaaagcgcctgcaaatgcaccgtgacggttggattcccgactatgagtgatctcctactgaacaacacgtgaactttatgcccagtcatcccgactgggcataatcattgttggaacaagtcgcatattgtttgacgaccattcaaagcagtcgacatgaacaaggggagtggaatctcaatggcacagcatccgatgaaagtggtcctgttggatctcgacggcacgcttaccaagtccgacggcggcattatcggctccgtcatcaagaccttcgaagaacttggacgtccggttccggacgccgccgaactgcgccgcttcattggaccggcgatcatcgaatctctgcgtcgcaatcatgtgcctgcggaagatttggatcgggccgtggatatctaccgcagctactacggagaccgtgccgtgttcgacgatccgaacgagcccggcaacaaggtgcccggacgactggtgaacgtcgtattcccaggcatccgtgaacagctgctcaaactgcatgccgacggttattacctggcactggccagctgcaagcccgaataccagtgcattcctatctgcgaccatttccacctgaccgaactgttggacggcatctatggtgcctccaaagacaattcccgcctggacaaagatcaggtgattcgatactgcttcgacaaaatcgcgtttgatgccgcagcgggggacaaggccgtgatgatcggcgaccgctacaccgacatcgacggcgcccacgcctgcaatctggacgccattggctgccgctggggctacgctccggctggtgagatggaagaacacggtgcctacgaaatcattgagcaacctgagcagctcgaagacgccgtgaaccgatacttcgagatgcactgactgattgctcccaccggcgggagcttctaacgacgctgactgagggtgcttactacatgagtagaagcaccctcagtggcgctaggtgaagcaacccctgccaatcgaagcgtttcttcaataaccaatctgacataacgtacattaagccagccggcaccacggaatggcggaatcacgcgcatctggagaacatcatacacggcatgtgtgcctaagtgtgcctatcccgtgtcgggctcacagcaaggccacccagtcctccagatccgtcctgcggatgcgggccgtcgtggaccccttctcgaaatgcctcagatcgccgtgcacgaccgcggcgcgcaccaccttctccgggatgccgcacagggccgccgcctcggggacggtcagcgcgagacgatgctcgacggggacgaacggcttgtcggccatgtcaggctccttacgacgggaaacacgatggacacccatggatatgcgtttcccgcaaaggacgtctgggacccgcgtccggaggcggacggacgccatgcgtcacatgacggccgacatggacgccttctccctcagctgcgcgtacgcgtcatgcaggatgagattgcccggcacggtcgccagcaggaacgcgagcaccgcggccacgaccgaacggaccaggcccttcaccagcctgaccgccaccctgaacgcgatccaggagacgagcaggcccacggccagcgtgaccgcgcccctcgccccgacgggcagcatgccataccaggccacgacggaatcaaacatgacggaacccctttccggacatccttcaccgaacccgtcatatgcgtcccggctctgacgcatacgcgcgtgcatggaaaccccattgcacgactaccagaaacaggccatccggttcgccctgaaggcgttcgcctccccgtcccgcggctgcggcctgttcctcgaacccgggctcggcaagacgctgaccagcatcgccgtcatggacatcatgcacgcggccgacccgcacgcccggttcctcgtcatagcgcccgcattggtggcccgcaactcgtggcccgacgagctcgaacgctggaagggcatgcactccctgacatgggcggccgccgtcggcacgccgcggcaacggtcgaaggcgctggacgccgacgcggacgtgaccgtcatcgggcaggacaacctcaaatggctggacgggaaggtgggggactggccgtggaagggcatcgtcgtcgacgagctgtccggctacaagacgccgagaagcaaccggggactcatcctgcgccggcacgcgagacaggcgaaatggacgctcggcctgaccggcacgcccgccaccaaaaacctattggacctgtggggcgagatcgcggtcatcgaccggtccgaaacgttggaacggtccatgacccgctaccgggaccgctggttcacgcccggacgctacatcgacatgggcggccgccggcagcccatcgactacacgccccgcgacggcgcccaacaggagatcctggacctcatcgaaccgttctgcctgagcatgaaggcgtccgacaggctgcccgggctcccgtccatgatcgagaccgaccattggctcgacatgccgaaaccgacccgggacacgtacgaccggctgcgtcggcagatggtcgccgacctggatgacgggacgaccgtgaccgccgccaacgcgggcgtgctcaccgcgaagctcgcccaactgacgtgcggatgcctgtacccggacgcggacgatccggaagggacgatccggcacgtggacgacgtgaagctcgacgcgctcgcggacatcataggcgcggcggacgggccggtgctcgtgttctaccagttcaccgacgaactggaacgcatgcgcgcacgcttccccggcatgcgcgaggtgcacgagcaaggcgtgctggaggaatggcgcaacggccgcgtcccgctcctggccgcccacccgcaggccgcgaaatacgggctgaacatccaggacggggggcatgagatcgtgtggaccagcctgccctggtcgttcgacgactaccgtcaggcatgcgaccgattgcaccggcaagggcagaaaaggacggtacgcgtccaccggttattggagtcgaacaccgtggaccgtcgcaagctcgacgtattgaccggccgcatgatgctgcacgaggcggtcatggacgcagtggaaggagagacgacgggcatcaatatttgatatgcgaatcaagcagggagaccagtccgggcgggatcgcggcgaacatgtccggaacacacacggaatcgaccatcgcgcgaagcgatggtatatccatgcaggtcacaccacccggccatacggcagtagtcatgtcgggggtcccatgcccgcccggcggggtcacgcacaccacccaatacgatacgacgccgtatcgggccagcagaccctgccaccgttcccgctgctcccacatgttcgggctcatcgatgtccacgcgcggccctcggagtcaagcacgaacgcgcgtctcgcccggctgacgcgcgccagatgccactcatccacattcaccattcttttgggtggggttgcccggtatttcaatgccgggaggaaccaccctcttctttgttccattcttgtctcattacgcgcatagtgatgtaatcgtaatcatgtcccagaaggtcgtgatagaaagcgtgcagatacggggagccgccccgtatctcggcatgtgcgtggcctcggacggacggcaaatccccctgtattcaaccaatcccgacatagtgatgcgttggctgtgcgacgggtggcgttgccgatacaaccagttgcgttcccgtagaaccaaatgggataaaaaccttggcatgagcattccgttgggcgggaagccggacatgcgctccgaccgtcaggtaagactggagtgctcatggttcgcagccatccccgcaatggtgctgcaatccccgaacaggatagagaacacggactggtggagcgcgaacaaacgccgcaaaacattgaagaagaagcatcggaacccgggcatgacgccccggttcaaaaaacggcgtgacgacctgtatttcgtctgctggcacaacaagggcgcgaacgcgaactaccgtcagttgaaccggcgtcacggcgaggtcgtcatcaccggacagaaccccggcgcatatcgtctggacggccaacggtgccggtacagcatccacatccgcgtccgcgtcagccaacccatccgcgactatacgagcgtcgacgtgaactggacgagacgaacactcgtgttcgtcaacgacccgctgccgataggccgtgagcgcacgggtgcgatggtcggattggacaggggttgcgtccacacgctcgccacgtccgacaatcgtttcatcgacctccccaaagaccggttgaaccatatcgacaaggagatacgccgccgtcagaaggctcaggcgcgacgaatcgccatgtccggcgaaaccgtcaaacaataccggcgtcatgcgagccgcacctacgagcgtaccggtcgggaaatcagccgactgtacgcgaaggcacaccgcatcatagacgactggcagcacaagaccaccagcatgctagtccgcgaatacgacctcatcgtattggaagacctcaacctgcaaggcatgagccgcaaagccaaggcgaaaccagacccggacaggccgggcgcgtttctacccaacggacagtcggcgaaacgtgaactcaaccgcagcctacgcgccgcaagcctcgccggaatcgtcggcaaactcgaatacaagacccggctgaccggacgaaaccgtctcatattcgtcaaccccgcgtacacgtcgcagacatgcagcaagtgcgggcattgcgccaaggagaaccgcgaaagccaagcggacttcgaatgcaggcaatgccacgcgcgcatgaacgctgacctgaacgcggccaacaacatcctcaaacggggattgaaccatctcctcggcttggacgaagccgggcacgccgaaacggagccagacgcccaacccgcctatcgcgggaaggacgcttccgccatgacgtgcgaaacctcaacacgataacaacacgtgttggaatcccggtgtttcaacaccgggaggacgtcaagtagctcgtatccgaaccgcccatgataccgtttcccctccgtcatggatctccgtcaacgtcgtttcggcatgggatatgtcctgtcgaaccagtcgcctgcctgttcggccatggcgtccggatcatacccgtcgccccacgtcccggcgtcgttgcgcgccgattcgacgaacatgccgcgcgcgtagtcgcgggcctgggagcgggtcatggtctcgccctccagcgtgtacgtgcggcggcgcggatgacgcacgaagtcggcgtacaggcgcgcgttcggcccggggaacatgccggcgacgctcgagatcgacccctcgaccggatcatcgcccaacaggcggcggatctggcccgcatggctggtgttcatgccgaactcgtcgtgccaacggcccggcttcaggccgtggggcagggtgggcgcgtccacgtgccggtcgcgcatggcgtccatgccctccgcccggtcggcgcgttccgcctcgcccatgcgcccgtcgcaataggaggcgggcggcgtcacgtccatgccccggacgcgcccgtgcccccgtcatacgtgcccgcatacccttgcggaagccccttcgccctatggcttctcccgtgcctgtccatgaccatgtcggcctccccttccgtgtatcccgcacggcctatgcgggaacgttcgcgagaatgtcggacacggcgcgcagatactcgccgtacgtgcccccacggcccgggatccggtcccatgcggcgcgcagcatgtccggatcatgcacgcccccggcccgcgaccagcggccaagccgcatgcccgcccggatcatgcccatgcccatgcccagcgagtggaggatctccacggcccccagcatcggccggccggccgccagggcctggctcgcccgcggatcgtccaatatgaggtcgaggcggccagccaccccgtccaggacgccgcccgccgcctcgaggcgcgcggacctgacgtccacgcccaatacggccagctccgtgtcggtcagacggttcagcatggcgggcgtgatcccatgccgttcgagccattccgcggtcacctcgaacggttcgccgcccgcatggtccataagcgccggatcatgatcctcgtccacatcctccaacggggcgaaacgacgccgcttcgccccgaacagcgcctcccattccggcaggccgccgcatgcgagcaggttcgacgagcccggacgcgagttgcgcccgtcatggtaaggcaggaacaccatgctgctcacgccgcgctccatctgaccatggacatgcgcgtccaccgcctcgtcccacaggcgttccctgacggcgcgcgggggacgccccgacgcatgatcgttgcggtattcggcgagccgtcgctcataggcggcgccggcgcgcagcagtttgacgctcacgcccagctccctgtggaggatcgcctccttgctgcaccgtttgcagatcatggtcaggagcgtgggcgtgaccgtctgccccttcgccatgcatttcatggcctggtcctctatccattcgcgcaccaggtcggaggcgcgcgcgtcgtcgcgcagcagtccggcgacgcggcccgcgggcgagttcgacctggtcgggtcggcgtatcggctgatgatcctctcccattgggcgggagtgcatgcaaggttatcgtctgacatgcgggcgcgtatgcgtcccgggacgcataccatgcgtttcgccaccaccccgcatcccggtcggcgcaaggcgacacgccgtacgcggacgacccgcatagccggacctcatgttcgacgctttcgacgaatcatggtggtcggccggatcggccctcaactggtgggacagccgcgtggccgacccgcccgcatggctccccgaccgggagaaggcgctcgcatggctggaacggcatgcccccgtcaccggggcggcgctcgcgctcatccgctcgcacaggacctgcgagacaagccaactccacgagctcgacccgagactgcccgccgacccgcggtccacgctgtggatgatgctcgccggcatgcgcctcatcgacctggggttccccatcaacgtgaacgggcgcggcggatggggaccgaaaagcgcgggcttcatggccgtccgcctgcccgtccaccacgcgatcgacccggagctgcgccggctgggcctcacgcccgtcgaaatcgcggacatcgggccggggccgttgcgcgggcaacgccagtacgaccggcacaacctgatctgcacggggctcgccgtccgcgcccggcgcgacgggtggctgaccgcgggggaggcgtggtgccggttcgaccggatctgcgacgatccgctcatggggcggggaggccccgatctggcgctcatcggcgagggcctgctcgcatgcgtggaactgaccgcgtccaccggacagtcattggaagcgaagttccgccggtgggacaggatcctcgaccatccggcctgccggaacacgcatgtcctgtggctgtcggccggccgcggcgacgggaacacggggatcctggaacggttggacggcttgtgcgcggcacgctcccgccagcatgcgggcgatgcggcgtccgtcatggccggcggtttcatgacggacgggtggacgccctcacccggcatccccgtccccctgggcgggtggatgggacatgacatggacaggctcggccgcgtgttcggcctgccgaacgccgcctcatggcggctgccggagcgcatgcgcgggcattggcatggctgagcgacaggcgggtggccggaacgcatatacgggggtatgaccggaatggattgggatcgcgcggcggagagcatcagccgtgagggcgggacgcgcatgatggacgcgtacgccatgctggagcatgatgcggaagtgttcgcccgcgccgccagatgcctggaaacactgcccggaacggaccggattctaatggaggacgcgttccgtctcatgggacggttcggcggcggcctgacgcccgcccaggcgtcgatcctgtgccgtgcgggcatgctcgccaccaggcgggccgcggccctcgacccggccgcctaggccggttttccccatgcacgcgggaaggccggatgcggggagaacacacgccccccgcatccggccttcccgcgtgcatgggcatccggatcacatggtcgcgtccgtgtccccgtccggatcatgcggcttatgccgggacgcgaaccatgcgccgacggccgccaggacggcggcgacggcgatcatgatcacgcccgtcacgcccgcgccggtggcggcgagccccgcatcgtattcgacgtgtaccttgtagacgacggacgtcagcccgtcggcgctggtcacggtgagtgtcgtgtccgcgccgtccacatgcttggtgacgctcatgcccgtctgcttgtcccacgacggggtgaccacgtagcgttccgggttggcgacgcccaccgtgtattcgagcctgtccggcgagaacccggcgacgtcgcgcccgtcgacgctcagcccggtcaggcccgccctgtgggtcgccccggtcaggtaggtgaccgtgacggtgcgcgtccggtaggtgacgccgtcgggggcgagcaccccgatccggtatttccacgtcatgccgtggtcgcggcccggcgtgatcttcacgatctggcccaggtatgactcgtaggcgaacgagccgccctccgggatcaggtattcgtcgcccttctccgcgtggtacgtgccgtccttcgtccatccgacgcttttcagcgtggccgtgtccgggccgggagcctcccgggtgccgcccgtgtccttcggatcggagggtttgaacgcctcgtccgcggtgggggtcctgtggtcgcggacgagcgtgaccgtgtacgtacggttcccgccgtccgggccggtcaccgtccaatgctggacggtgctgtgcgcggtcagggtcgtgtcggacgccttcaccgtctgtccggccttcgccctggggctgaccgtgaccttgtcgtcctcgcccgcggtgatcgtgtattcgaggatgtcgggatcccacccttggatgggcttgccgttgacgagcagtccgtcgagggcggcgtccggcgcgtcgacggttctggacggctgttcgaacggctgccggatcgtgaattcgcgggtcacgatggtgccgtccgtcctggtcgccctgatcgtgccggtgaacacgcgcatcccgttatcgccgagcccggtgggtttcaacgtgaccgtcgcgtcgtcgccgctggtcacggcgggcgtgtactggtcgccggccgcggcgtgggggagcgtgggcagggtcacgtccaacggggtgtccgcggcggtcgcgtcctccaggtcgacgccggggatgggggtcgtgttcccgtcggcggtccgatgctccacgccgatgctgagtttcgcgttccaggcgcggctggcggtcaggttcaccgtgagcgtctgcccgttgtcgagcgtgcgcgtggccgtcccgctcatggtccatacggggccggccgcgcccgacgggtcgagcgtggccttgccccaggcgacggggagcgtcgatccgtcggacagttccaccttgtcggtgacgggcatgttgtccctgtcgagccggtggccggtgtcggtgacggtccattcggagccgttcttcgaaccggtgaaacgggtcccgtccttcaatgtgatctccgtgccctggacgatgcgtatggggatgcggaacgattcgccgccgtgggacgcggtcaggacccgggtcgtttcggtgacgccggccagcgtgttcctgatgtcgggtgcggcggccgtggtcgacacttcgatccggttggacgtgctgccgcccgtgatcttctcgtccgtgccgggcgcctggtccaacggggcggcgggcgtccatgtcctcgacgcgtcgtcgtaggtgagggtccggccgtggaacgtccagttgacgatgcgcaggcccgcgaccgcctggtcgaggccgtcggcggcattggcgagcgtctggtcgccggccgtgccggcgtccagtttcctcgcgtcgccgatcgccttgtcgagcgcgtcgaggctcgcctggtcgtacgcggccgtcgcgtccttgtcggcgcggatcgtttcggccttcttcaatgattccttgaaccggtcggcggcggacacggcgcggaacgtgtaggtgcgggactggttcggatcgggcgcgtcgagggtgacggtcagcggatcgtccttggagatggattgggtccatccgtcgggcagtccggcaagggtgaccgcggtcgtgccggcgggcacgtcgccccccttcccgttggccggatcgaatcccgtgacgacgccggtgccgcctttcgcgtccctccaccgggccgtcacgccggccaggccggcgatgggcgtgcgctgtccggtgcgggtcgccgccccgcccgccgtcggctggtccgccatggcgggcgcggccgtcccgccggccagggtggcggcggcgagcgtcgcggccagggtcctgctgattcgtttgtccatggttctccttttccgaatcgtcgtgcgggcctggaaccggccccgcacgcgtcggcatgcgtctatgcgcgactgcgcaacgcatacgatggggcatggatgattggcatgacagggtcctggccctgctggacgggtcgggggacgcgcgtcgggccgcgttcgacccgaatcctgtggtgcgcgcgcacgcggcgggcatgccgctgcccgaccgtgtcgtggagcgtctggcggacgatccggcggcctgcgtgcgcgcccgcgtggccgcccggcccggcctggacgcggcgctgatgtccacgctcgcccatgaccaggatgcgcgcgtgcgccgcgtgctcgcgacccggaccgatctggacgcggagacgctgcgcgtgctcggcacggatctggacgcgcgcgtgctggaggcggccggcttcccggaacgggcgcgcctgatccgcatgctccccgtcgagccggacgggccggacgcgcggagggggttcggatggcggcggtgagggagaacacggtggaacgccggttcaacatgctggcgagacggcatgggggactgtccctgaaatgggtgtcgcccggacgattgggcgtgcccgaccgtctcctgttcatgcccggcggcaggctgtatctcgtggaactgaaacggccgggaggaaagcccagggctagccagaacgccatgttcgcgaaactcgaaacacgcggcttccacgtgtgggtcgtggacgatccggacgcgttcttcgacatgatcatgggggatggggtcggatagtccggggcgcgtcttcacggccgcaatgcatgcgcgacggccccgcctcccttccggaatgcggggccgtcgcggtttccatatcaggcgagatcgtcggcaagcgtccggtcggtgaacccccagtccgccacgttctccaacgagggatcgtcgatgacgccggtcaggtcccggtcggtggcgaaatccatgcgatgattcacccacgtgttctccctgatggtcatgatgtccagatcgtcgtcgtcggattcgctttccatgatcgcgtacacatgccacccggcgggcacatgctcgcgggggaggcgttcgcagtccatcgcgtacccgttgacatggctgccgtccgcgagcgtgaagtcgatttggcgggccaggtccggccggtcgaagatcgcggccagatcatgcgggtccggcgtgttccggggcgcggccacatcccccgatacgccggcggcgttcttcggctcgtaccggccgccgtcgggcgttcccttcggcctgtggctcctgttgttcctgtccatgaccatgatggttttcctttccttttcagcgcaggccgctcaggaccggattgccggccagtatggcatgcatgtcggaatcgtccggataccggtcgcgcagcaccttgaggctcgccaacggcaggctcggattgccggccaggttcaggtcggtctgacggtcgccgcgtccggcgaacgagcccagcagctccgacggcgtcctcggattgtaggcgagccgcctgtccaacatccggattgttcaaggatgcaaggcttgaggcgagcgcgaagtcgagcttcgggctcatggccgcgccgaacgcggcctcgtaccggtcgtaggacacgtggctcttccagtcggcgagcgtcgccatgtccatgcgcggatggctccacacgcgttctcggatccacgggtccgtggtcctctcgtcgatggcgtgcagcgcgtcgggaccgcaatgcggatggcggagcaccttgcccgcgaacacgctgctgtcgcgcggatggatgttgacggcgagggcgagcgtcgaatcgtccgccgccgggttcgcggccacgcggccggcctgctgcatgtgcgggtcggcccacaggctttccttgacgagttcgggagccgcgtgcgggttggagccgaccgcgtcgacggccgcgtgcctgacgcccggggtctggtcgcgcatccagcccacgcagcgggcgcggaacgcgtccgacatgacggggcgcatgcaggcgccgaacaccgtgtccgcgcgtgccgaattcgacttctgccggaatacgagcctgtccacgtcatcctccgtgaggttcggattcgacgcgaggtacgcgtccacctcgggccgatgggcggccatcaggccggtgaggtccgggccggaggcggtgcgaatgtactcgatgtcatccctggtgaggggttcgtgcgcgccgatgatgcgggcggacgggtccgcgtccatgggcggcatcacatcatccggcccggccgaaccgtttttcgtctcgtattggccgccgtcgggcgtgcccttcggcttgtggctcctgttgttcctgtccatcaccatgatggcctcccgtcggtcggttgcgtttcgccatgttcctatgcgtccccgagcagcaggcccggccagtccacgtccggcggcgtggtgaacgcgagcatgtcgagatcatggtgcttcggttcggattccccgttggcgagcatgaagcagaagatgctgggactggcgggcaggagcccggcgagcacgccgacgccccacatggcggtcgccgtctccgccgtgttgtccgggtcgcccttgtaccggggccgggagtccgggtagcggacctggcagacgaccccgcagtccgcgcccggcgatgccttccacacgttcctgcatgcgcgcatggcgcgcgtctgcatggtcttgcgctcccgggccgtcaggcgcatgttgctggtcagccatgagtcctcgccgaacgtggcatgggccagggtcgctttcgaaccgggcatgagggcgagcagccgggacaacgggtccgtgtccggccccaatgggatcacccagatgaacagttccgcgcgtccgcccggcagggggcgggggtccctgagatagcaggtcatcacgcgatggtacgggtcgtcgtccggccacagcccctcgtcggtgccagcgtcgatcaggggcttcagggtctcggccgccagtacggggctttcgcgtcgcccgcccacggtgacgagcatcatgtaccggttgacccggggcgcgcccgcggccttcatctcccgccacacctgccgtccgtaggcgcgcaggcgtccccgccgccgtttccgctcggtcacgtcctcgtcgccggtggtcgtcatccacagggaggcggacaccgtgaacgggaccgtgtatggtttcaaaccgttcatgcggcgcggctatgccggccccgggccgtgtatgcattccggccggcctgtatgcatccgtatgcatccggggatgcatacattttttcttcccgtttcggcttggttccaacgttccggggatggtccgggggcgtgtatgcattgtatgcatcattcccttatagaggattcgagaaaagggaaggaaaccccttatattgatgcatacaatgcatacaagagaaaggaattctattttttcctttatatataagggttttcgggctttttccgggctttttctgtatgcatccccggatgcatacagatgcatacacgcatacaaacagggtcggaagaacttcacaatatcgtaaaccctgatggaacccgtccgcggggacgcatgccctcctgcatgaacgatcgcatcgcattctccaccgaacacttcaccgtccaccgtctcgacgacccggaacgcccctaccggatcgacaacggggcgggctccacgcgcctcggcgaaccggcctgcgtgaccatccgcatggactacggcaaggcccgcatcacatggaccggcatcggcgccaaggacaccggcgacgcccgcctgttcgccggcctcgtccgcgaggcgtgcgacgtggccgaccgcatcaaccacagccgcgaaggccggcaggccgcccggctcggcgacgactacctcgaatcgttgggaatcgaacgttgaaccgtttcgaacaggcgctcaccccctacatggaccgtcgcgtgctcgccgcatgggtgggcggcagccacgcgcacgggctcgcccgtccggacagtgacatcgacctccatctggtgctcgcccccgaaccagacgacatcctcctcggccgaaccgaccgtaccaaaggcctgcatgggccagacatcacgatcaccacgcccatcccgctgctcacgggactggccaaaggcgcgcccaacacgctcgaagcgttgagcctgcccaacgactgcctgcttctggacgcgggcctcctgcacatgctcgccccattggcgggccggctcaccagccggaacaccatcgacatggccctgggcaacgtgaaaggcaacctccacctgctcgcccgcgacggcctcgacgaacggaaacgccgcaagctgcagggcgaaaccatgcgcctgctcgcctccatcggacacgtgacggccggccgggacacggacacgccctggccgtgccgtctcgacgccgacctcgacgttctgagggaaatccgcgaacatggcatggatgacgcggagctcgccgcccaactgcccgacatgttggcatacgcgtcctcccgccgtctccacgcacccgaccggaagacgatccgcgagacggaacgactggtcgccggactgatgaaaggcctggtcgacggcacgacggccacgttccccatggaaagcgtgcccgccatgctcgaaatccgttcacggatgcgtcctcatacgtcctgaacactgattgggatacgacccggttcgatctcgactggttcaaaggcatcaacgcggccatgacacgcaccgcggccatgctgccgggcgtgttgcgcgacagaggaaacgtgatcgtcggcacgaaatacggcacgtacacgccgaccgtccccgacccgatcatcctggattcgtggatggagtcgggcgcatccgataagggcgatcccctggacgcggcatcccacctgttcgcccggctcgcgaaggcgcaaccgttcggcgacggcaacaagcgtggcgcgctgctcgccgccaacgggctgcttgtcagggccggttcgccgctcatgctcacggtgcccgtgaaggaaccggaacgcacggggttcaacgatctgcccggcgcccggtacatgcatgatgatgatcggatcatcgtttggctggccgattggaacagggcggacccggagatcgggacctggatcagccccggcgcatgatgcgcgccagttcggccgcgtccatgagcgggccggacggttccggaccggtcgggcgtgccgggacgccggatggcatcgcgtcatcatccgttccaccatccgattcgggatcggcgcccccgccgccgtactcgtcgaggctttcatcccatctgtccttgatggcgccaaggaacgggaacaggcggtaggtgtccgcatccctgaacctgatgcggtccataatcacggtgttgaaatgcgggtcgtcggccgtggtctggtcgaacgaatccaggtacgcggaccggtcgatgccatcgggcagcccgagatggtcgcacatccacttgcccagcgccttcgcgtcgtccgtcccgtccggcaggacggggaaatacgtcttgaacacgaacggtgattggccttcgaactccgcggagccgacgcccttggacacgccctcgtcgaacacgttctgcggacattccggcacgctttccgcgatgttgaacacgaggccccgctggttcttcgacgcgcgggcccccatgagcgccttgttgccgatcgcgcttctcaggctcggcggcatgccggtcgccgcggacgctacctggttcaggagaatgacccggtacccgtaggctcggcccaccagcaccaggtcggtgacggtcctgaggatcagttccttgacctgcgcgtcatgcttctcctcccagacgggcggcaacgcggtcttcggcaggctgcccgccgacttgtgcccgaccgtcagctgggtgaactcgtcgcagacgacgagccgcaacggcatccgcctcttctcctcgtcggtcagctggtaccagttctggtagccgcgccggcggaagaactcagcgcgcggcccgcccttgtcgatgtcggccatgcacgtcttcaatacgccgagcgtctggagcaggctgtcgcagccccagccgttctcgtggatccaggggcgcgcccaataatagtcggcggccttggtgaaatggtcgcagacgaacagctccacctgtccggtggccagctggtcggcgatgatgtcgttgccgaacacgcttttgcccgcgcccggaaggcctcccagatagatgctggggaggccttccagtcgaggatcgcgggctccgccgttttgccgggtctggcgagcctgacgccgaaacgtgtgcggtccctgtccgcgcccagatggtcgaacgggagttgcacgagtctggggaacgtcctgggcaggccgggatggatgtcgatggtcccgttcttcggatcggcctcgaaccaccatccgaggcgtccgatctgctcgcaggcggcatccaccttcgcatcgtatttgtccgcctggtagacgattccgtcgtcgaggatggcatgccatccgccgtcctcgacgggcgtcatgcgcagatcccagtcgtgcaggcccatggcggcggccagctgcccgcgtgcggtggcctgcgcgtccgtcaaacgttcgagcagcgccttgccctcgtacgggtggaacacggtgagccggtatccggggtatttcgtctcgtacacggcctgcacctcggcgcccttgctgggcttcgaatgttcggcgctcaggttgatttcgaggctggagtcgtcgcgcatgtcgacgctggacgactgccggtcgacaaggacggcgacatgccggtcccggtcgatgaactcgaggcgggcggccttggcctccggatgcccggcctgccatttcgctatctgccggtcgagtagagcccggtggctgccgttgttcgccggatcgaagtcgacgctgccccccgcccgggtcttcacatggacggggtactcgtattcgaatctgatcatgcgggccggctatgccgggcccggacgcattcgggaaggcatgcgttcacccgtcagttctcgatgggcttccattcgccgccgttcgactcctcgaaccgtcggcgggcccgtcgctcccaggcgggcgagccgggcttctcccggcagatccagctcatcacgctcgacggtttgacgccgttcgccgtgatgatcgtatggtccaccggatacgtgctaccgtcgctcatgtgcccgattcccggccggtcatgctccatgcggaacgtgtgggtcttcgcgtccgccgtcacgtattcgatgcccggatcccagcgtgccagggcgagcgccccggtgacgccccggtgtttggcggccaggcgcagcatggcggcctggccgacgtcggggccgagtccggcgaacggcttcacgattctctcgtccgggtcgaacacgtcaggatccgcggccatgaacgcccggtactcgtgttcgtcatcgcacaacgcgtcgcgcagctgccggtagcgtcgggtcggtttcctcccgtccaacagttgttgctccagtttcctgaactccttggatttccggtattcgcgccccgcctgcgggttccagccgtcctcctggagttcgcgcagcgtgtcggcgaacgccatcttgtcatcgaacgcgctgccgttgatcagtccacggtcgacgttcttcttgtacaggtcgcgcatctcatcgttcaacggattcagatgtccttccgttgccgcagcatatcgggcctgtttggtctgggtgcctttccatgcggcttcgtagcggcgttcggcggcctccccgtcgtagtcgcttacccaattctctggttgtggtcccttccacgtgtccgcctgttcgtctggccgtacgggctccaatccgagattgcggagctcccggttcgggtccaatgcggtttcgatgatgtgttgccgggtttcctgttccaatcgcgcgcgatcataggatttcaccggtatgccgtcataggcggcctgtatgtggttgatgacatagtcagcgtgcgagccgtccggcatccgtggatcgtatcgcaggttcgccacgatcaacggcatgtcatcctcttcgtccggcatggcctgccggccgaccagcaggttcaggcgggtcgccgcataacccgcgtatgcggcgacgtccggatccatcatgatcgcgttcatcgcgtcgtccatcgcatcgtccagccgacgtccgccggccgacggcgggacgatgtcgtcgccggccgcctgcgggccgatcgtgtcgaacgtgcccgccaccccctggggcaggcccttcggcctgtggctcctgttgttcctgtctaccgtcatggtcgtctccgttctacgaataccggatcttgttccggctgcctgctatacggggcggggtcgcatgttccggcctgcatcctcctggacgcaggttgacatcctccccacggctaaagccgggggattcccttcacagcccggactccaacggaacttccggcctgagttgagggggttgacgcttcatcgggccgccaatgcggatcctccacgtccaaggcggtatccccgcccgttttggctaaagcgcggctgagaatgttttcagccgcgttgacgtccgcgttcgccctatacccgcacttgacgcaatggaagaccgcttggctctcgcggttccccttggcgacatgcccgcactcatggcaggcttggctggtataggcggcggggacgatggcaagacggccgccattggcgcccatcttgtcctgaagccgcttcgatatgcgaccccaacagttgattaaaatcgaccggtcgagcccggccttggccttcgcgccgttatggaggtatcggcccggattcgccggatccggcctcggcttcggccgcttcgtcatggcttggacgtctaggtcctccatggcgatgagaatgttggccttggcgagccttgtcgtggtcttctcgatccagtcgttgcggcgacgaataatacggctgttcagggcgttgaactcggacaaggtcttccgacggcgcttcgactcgaacttggcgatcctgccgcctctggcctcgttggtccggtcctggcgggtcatccggcgctggaggtatttcaaccgcttcagctcggccttcgacggcttcggcatgtccctgaaggtcctgtcggacaaagccagagtgtgcacgcagccacggtcgatgccgaccatgccgttgcccattcttggcaatggcgatggcatattgacgaacacgaggctacgatgggtccagtcgacatggacgctggtgtagggccgtatcggctggctcacgcgcacatggatgacgatgcgccaatagagcttttcaccgggcttgcgccatcttgtaggattcatgccggcgatgacgaccacaccggacttccggccggtccgatgaaaaagcgcgttgcctgtcttggaggcgttgcgccagcagacgaaaccaaggccgcgatgccgcgacttgaaaccgggaacacggcctccaatggtcttcctgcgtttgagtccggcgaaccattcggtattctcgattctgtccgtgctggacagtatgggcgccggaatgcccgccatccacgagcatcgaagacgggcctctttatccgaaagcaaatcagccacgttggggccacccaaaggctccttgacccagtcgatgatcccgccggcctcgtccttgacgggcacgttgtgcgggcgctgctcgcgcctttggttgaatcgggtgcgccatccgtcgcacagccataccatgacgcgctcgggattacgggtccaacagggattgccgcagtggtccactcccaggaagacgctcgcgccaacgtgcttgacgccgtcgatgcggaccttctggctcatcgtggaccacctccttgcatcacggtcctatgcgtcccggccttgaaccccagcgctgaagcgcggggcatgaattttttcggtcatggcgtgcacggctggttcacgtcgaaaccgtattcgtccccgcatgacatgccgccgaacggcatccgggggggtgagacggcaacggtcctgccgtctgacagccgaccggaaaaccgtgcccctgacgcatacgacggggcatggggtcatcaaaacaccaccggtggctgaccggcgcgaaggcggcgaaggccgacgaattctacacgacgtacgaggcgatcgacagggagctgagacactacaagacggatctgaaagaccgtcacgtgatctgcgactgcaacgaccggcccgacaggagcatgttcgtctcatggacgctcgaccacatgaacgaatacggaatcgcgtccctcacctgcacgagcttccaacccgaccatggcaccctgttcgacgacgggacgcccgccatgcaatggcatgtcgacaacgacggccgcggggggggtattcgatcgcggacctggccgcccgcccattggacggcgacggctccttcgactcgcccgaatgcgaacacctgctcgaccggcccggcgcgatcgtcgtcaccaacccgccgttcagccacgccatccggttcatgcgcatgctccgccggcatcccgcgaccgactacctgatcgtcgccaacctgaacctcaccaccgccaacgacgtattccccatgatcaaggagggacgctgcctcgtcggcctgagcatccactcgggcagcatgttcttccgactgcccgacgaccgaccgaagacgggaagcatgatccggcccgacggcacggtcggcgtcaacagcatccgatggctcaccagcctcgccgccgcacgcgccgacaagacctggcctcccacgggacacacgtaccggggacatgaggacgagtatccggaatatgatgcctacgacgcgatcaacgtggactccatgcgcatgatgcccgacgatcacgacgggccgatgggcgtcccgttgaacttcctcgaacattgggcgcccggcaacgggttcatgctgctcgacaacctcgacgacccgacgatcgacggacgtcgcctgtacaagcgactgctcgtcagacggacgcgggacgcatgatccacgccgcccgcgcatgcaggcggaaccccgtgggataaaccgccgtccacgaacagcgtgatacgaatcttgttgaaggacgaacgggacgccggccggttcctcacggaatgccgtcaacggggactggacgcgcgccctgaggaacgacgccccgtcggcacggtcaaacgcgtcgggcctgaacccgccgccggctcgacgcgcatccgggccggcggcatatcggcgtcgccgccaaccggaaggccacgaacgcggccgatggaagatccgcagcggacaacgccgcggattcgaaaaccacgaatacgaggcccggaccatccgcgagaacgacgaatggcatgtgtacgcgcgccaatgacgtccctgttctagaaccccgtgtcagcgaacacggaagccaatcccatcgaatccacgcgatcccacaccatatccgggatcgtgaccgtccggccgtccggcgcgaccacatgatccgaccgatagcgtcccgcacgcgcgcaatccatcaacgcgcacgccacatccggccccgtcacacccggcatgaacgcgggcgacgcccacacgccccacaaccccgacaacgggcccaccggcacaagccgaagcgaatcggcctgcacgcgcgccggatcatgctccagcagggccagcgtccaggcgcgcgcatccaaccgggccatgcgcgcgcaccaggccaacgccagcgcggaccagcccgcccggcgtacgcccgcacgcttcgccagcatggacgcgaacatcatgcccgacccgtaggcggacacgtcgaaccccagcagtcccgcatgcccgcgcgcccacagccaatcatcccgaccgggcggcgacggcatgcccacgtcgggcagacgcgaggagggcggcgcccagtccagccaggatgattccagcaggccgggcagcagccgcgcgtccatgccatggatccggttcgccgcgtccgcgatccgaagcaacggcaggtcgtccggtccggccgtcatgtcgtcgaaactgacggtgatcatgcacgccttcccttccatcgtcccttgcggatcgggtatgcgtcccgcatgaaggggatatcccggcgtccgggcatggaaaccatgccgaaacccggttttttgcaaggaaaaacgatccctccccttgatgtgatgctgtttggtggtgtggtttttgccgtggtgtggtgtccgtcatgtgtgttcttggtgtcggtgtcctgtcttttttcttctctgatggctgatgggatggtgtcgtatcgtgttttcctctcctgttttttcttcttttgctcttcttttcttttccttttctttgtttccttttttcgttttcgtccgcggcatgcgccggacggcgcgcatggcgccccctgtcagcgggcgcgcctggattcgcggatgatgctggacacgccctggaacagtccggtgaggaaccggatccaggcctggcgcatgcgcgggtcggcggccgggcgtcgtggcctgtccgcgtcgtcggatcgcctgggcggttccggttccgtgtcgggtcggggttcatgcgggtgcgtgtcttcgcgtgcgggcggcctgtcggcggggcgtggggggggagcggcggatcgtcgtggacgacatgccatcgttcgtcggccgcctgttcgatgcaggctccgtcggggagatgcgcgatgttcgattcggtccggtaggagcggcgtgcgtgggtcgtgtcgtccacgcattcgacgtgggtttcgttccctgtgcggctgacgcgtgtgggcgtgtatgagcgtcggatgtcgaggtgggcggcgcagtcttcggcgatcaggtccgtgtccacggggtgcggccagacggggcgtgtgtccggcatggcgtcggcgggcgggttcgtgccggtcgtctcccaggggtcgggtcgggggatgatgacgcacgcgcggtccttgaacaggggtgtggcgtggctgcggatccaatcgtggtcgtgcatgtgcacggcgagcatgcggcgcgtgtcctcgtccgcgtgggtgaggatgacgagccgttggaggcgtatgtcgtcgcgtccgtagcgcatgtcgatggcctgctggggaatggtgtgttcgccgaaccgccatgcgatgtcgccgggggctggggcgggcatggtccgggcgaggcgttcgagttccatgagttcgatgcggtctggcggttcgggcggacggacgtcgggatcgggtccggcgcccgtccctggctcgaatgttccggccacgccttggggcaggcccttcggcctgtggctccggttgttcctgtctgtgctcatgcggtgcgcctatgcgtatgggctggggatgggatggttggggatgcgtgtcgccacccgggtccagggcgcgtcgcgttcgagcggcgtggcggccacgccttggatggggcgcaggccggtccggtcgcgtatccacaatgtgttcggccggtcggcgtcatggtagatgccgtagcccatggtggcgggcgcgtccagggggtcgccgaacccggtgatgagacgggtgtcgtcgccgtggatcaggtagtggcggccctgcctgttgcggacgatcatgctcgcatgatcgggttcgaacaggacgttttggacgcgtcggctccggtattgcatgcgtggcttcatgcgcgtccccttgtggcgcgtgcgatcgcgtcggcgatgtcatggcgtgccacggggtcggcggccgtgtcccatcgggtttcgaccatgatgctggcgagacgtatgtcgtgtatcccgtcgggggtgatggcgccccggtgtgcggtgttgacgccgacggtgaggccgcggcccatgaggagcgcggcggcgcgtgccccgatcgcccgagatgcgggatcgttgttgtggccgatgatggtctgggtgcgcggctggtcggcgtgcagttcgaatgggtgcggttccccggggtaggtgtggacgtcgatgatcgtgcatcgtccgtacgtgtcgagcatggtccggcatatggtgtcgagcatgcggtgccatggcgtgtacaggaggcggaaccgttgtccgcgttccctcatgccgggtgcctgtccgggcttgtagaggggatgcccgtcgatgtcgcgtgtggggatggcgcccatgccggccttgttcatctcctcccggtcgtcggggtatcgttccgggtcgcaccacatgcgggtcgtgtggtcgagcatgatggtcgcgtggagtcgggcggcgatcatgaggccgagcgtgtccgcatgccggtctcgtacctgttcgcatgtctggtcgaacgcttccgcgtccgccaggcgggtgcggtcgaacccgtcggggacgagccggcccgcgtgcggcgtgtggacgagcatgggcgtcgtgccctgccggatttcgaagagtggcttgtcgttcatgatggttccggctatgcgtcccggacggcatggcgcataggggccgtgtatgagcattctcgacatcggcacggccggctggcgcgcgttctggagttccgtgaccgcgccgggcgcgttcggcgtgtacttcatcgtcctcatggtcgcgctcctcgtgggcttcgcgttcaaccgcacccagtccgcgttctccatgggcctgcgcgtcctcgcattgctcctgtccgcgatcatgatcatgggcgtgctcggcgtgctcggcctgaacatgaccggattgacgcccatgatcaactggctgctcgaacaggtgcaggcccccgtctacatcccggaggcgtgaccatgcggcgtggcgatgggggaggcccgttccggcggttgctgtccatgatcgcgaccatggtcatggtgggcgtgctcgtcgtcgtgctcgtctcctcgggaggctggcggaccgtgtccgagacgttcggcatcgggaacccggacgcgtccacggccgcattgaccgaaccgaggaagggggatgcgggacgcaacccggacgccaaaagcctgtcgggcctgctctccctgttcggcgtccatacgggcggggaggcggacgcgggggcgaaggacacggggaaaaccccggacacggccccgacgggggatgcggccgcatggcggacccagttggacgcggccggccggataggcacggcgaacgccaggccgggcggctacgaccgtgagacgcggttcggcggctgggcgccgtccggctgcgggaaggcgaccacgagggacacgatcctcgcccgcgacctgaccggcgtgaaaaaggactcctcatgccgggtcgtgtcgggcacgctgcacgacccgtacacgggcgggaccatcgggttcagacggggcgtgaagacgagcgccgacgtgcagatcgaccacgtggtgtccctgtacgacgcttgggcgtccggcgcccgcgactgggaccaggcgaaacgcgtcgaatacgcgaacgatccggacgtgctcctcgcctcggacgggccggcgaacatggcgaaggggagcggcatcgacgtgaacggacgatccgaatacctgacgcagcatacgggcgcacccgacatctggatgccggacaacaaggcgtaccggtgcgactacatggcgaaaagggtgtcgatcaaggccaagtacgggctgacgatgaccgctcgagagaaacagcagaccatcacctacctcgcgcaatgcgtggcgggcaaaaaccagtagcaaaggagattcgaccatggtcatggacaggaacaacaggagccacaagccgaagggcacacccgacggcggcagattcgagacggggacacgggcggcgcgtcgggtgacgtggccgcgcccggcatggatccggccacgtgcctgaccgtccgggggtttgacgatgcgaaccggcgcatggacggatggtacgggcggctggcgggcctggagaagtcgggcgatgaccacgatatccggaggatacgcggatggtcggccgcgttcgaccgatggcagagaatccacggggacgaggtgggcgcgttcgtcgcccggcgcggcgatctgatctcgtcggacagggaggcggccgcgttcatgctcgcccgccgcgacgtgcttcgcaagacgtaccccgaattcggcgagctcgaccggcgggtcgacggggagatccgcaggctcgaacgggagccgaaaccgtcgagggagtacgtggacgcgatcgacgcgttcgaatcctacagcaggacccatgcggacgagatcgccgcatacgaggagaagcgcggcaaggagctgtcaagcgccagggaggcggccgcctacatgctcgccaaggccgggcttctcaacgagtcgatcaggcggggcaacatgctcgccttggcggacgagcatgactggggggcgttgggcgaccggatcgcggagggggatggcgcgcaacagtattcccatgcgctcgccggccgttacgggctcgatccggaacaggagcggatcctcatggaggacacggacgcgcatctcggcgaggaaagagacccgggacaggcggctcgggagatggaccggcgctaccgtctcgccgcccggctgctcggcaacatcgactgacgggaaagggattgggggaatggctcagctgatcatcggcggcgaatgcacgaccctgcgggagacggacccggacacgctcgcgctcatggccgtgcatgcggccaggaaacgcggcgtgagggccgcgctcgcggacgaccggggacgcaaggtcctcatcgtcctgcccgccggcccgttgggacccgccatctagaagacttcggggatgcgggtcagcatatgctcccgcatccactgctagacggttctcggtcatctggctcgcagcaacggaccagccggtcgccgaacccgcgtctgagcgccggatccaggccgatcacgccgattcccgcagtgaacgtgccggcgacatgctggggcagccccttggactgtctgtcctgacatccattctaaccgttgccgacggcatgcgtccccgcgggggccgccatgcttccgcgccggatcggcgacggaacgcatctaatagtggatgtactggtattcgtgcgtctgtttcgcctcgatggcgcgtcggaacgggccgacctgcccgttcacgttcgcttcgctgatctcgatggaaccgtcgccgttgaccttctccacgatggcgacgtgcccccatgcgttgttgacctgcgcgggagtgaacacgatcacatccccctgccgggggtgtcgtccacccaatagccgagcgccttggcggaatcggcccacatgccgccatcgcccagccggctgccgaccggcaatcccagttgcgtgcgccgcacgtacgcccaccatgtgcattgcccgtacgcgtatgtgttgcccgtgtcgccggtcgcatggtccggatcgaatccggccggcgtccggtcctcgtcgcgcccgttgatcaggtcgcggaccactggattgtccgcgtggatgatggtgagcctgcccttcggccggtcgcccatatcccatgtgccgtccgccgtcaggtccgtgcgcgtccggtcgcggtccgcggcggggaacgggtcgggacggcccttcacgccgatcgaggcgcggaccgtcgtgtccgccgtcgcgggcgcggggttcgcgagccatgcgcccatgcccgatgccgcgagtgcgaacaggaggagcagggcgatatgccgctgcctggcgcgcccgcgccgcagtctggtccggtcccgtctcgtgtccgccgtcatgtccgtcctcccatgccggatccgggtatgcgttccgttcaccgcgagccgtcccccgatccggagacgtccgatccgccggaggcttccgaaggcgcgcccgtgtcccccgatccggaggcggggcgggcgccgggcgcccggttcccatgctccctgagggtcgcgcccgtgccgggagcccccaggcgaggatgcgcggcgtgccgtccgggtcggcgaccagcaggtcgtacgagtattgggattgggcggccgaaccgtcgcccgcgtccgcgtgcgcgacggtgacggtgaccctgagcgccgcccggtccgatttgcgttcgttgcggtccacgttccccttgtccaggtaggcgcccccgtcgatggtggccgccgtcaccgacccgagcccttgcgcccgataccaggcgttcgggtcgggatcgttgacgagcacggtcagcatgtccgaatcggagcccatgaacgcgtccgcccatttgcgcacggtcgtgtccagcatgtcggacgcggtcaattgtccgagcgtgtccttccacatgcccgtatcgcccttgtcgtccgcgcccgccaggtcgaggcgttccacgctcggccagccggacaggcgcccgtcgggcgtgatcgtggtcctgacccgccaccagccgttcgcggagtccacgatcagcgtgttcacgctcaatgtcatgtccctggacccgtccgacacggtggcgtgggattgtccgttccagctgacgatccgcgcgtccgcgcccaacgcgcccttggcgagccattgctccgtcagcgcccatgattcgacgcgtcccgcgggatcgaggtccgtggcgggggcgggtttcgacgcggcgggcgggtttgacatgaggtaggcgacgatcaggagcagcatgatcgcgatccaccgctgccatttgagcagccgcaggccggtgaggcggaacgcgcgcctcgagaactggcggtccgggtcgccgtcgcgtttcgggtcgggggcgcgccagcccgcgtcctcgtcgattcttttccttcgcatgatgcggccccctatgccgcatagggggccgcatcatgacgtcggaaggaaaggatggaagccatgcgaagcgtggaagtcgccgccgcaccccagatcgtgcagcccatcagggacggcgtgtcgaagctgtgcggtttcgtgacgggcaacgcggcgctcgcgaccctgctcgtcctggtcggcgcgggcgtgatcatcacctgcgtcgtgctgctcgtcctgcgtaaatggtggccgtccacgcagatcgggcaggcgttgcaggggggaggcacgatcggatggtgctgcgcgggcatcacgttcggcctgtgcggcatcctgccctcccagatcctcccgttcgtcgccgggctggtcgccatgctgttccagatcgtgttgaacatcatcgcccaggtgttcggactgtaggatcatgctgttcgatctgacgtcggtcagcggccagcgcgtctcgcaggtcgacgaactgcatctgggcggacgccaatgggtgtccagcacgaacctgttcatcgccgcgacgggcgcggtggcgggcgcggtgctcgccacgctcgtacgcgtcctgccggccgccgccggccaatggtggccgtacctgctgatccccgcgggcatgacggccgcgctcgtcctgttcgtccgccggcgcagcgtggcaggggagcgcaacatgcggcgcatcgaccggatcatggcgcgccggcacggcatggatggacggttcgtccgtccgggaagcctcgaaccgtacgatccgggcggctatgagctcatcgaattccacgaccacgtgatcgaccgctgacaacgaaggaggatcccgcatgggattcatgtcggacatgatcgtcctcgccacgcaggacgcgggcggcgggggcgtcacgccgggcgcgcccgccaatgtgggcatgctcaacacggacgtggtctgcagggcgctcgactgcctgcccgtcgagcggtgggcgacggccaccctgtcgggcaccagccgtgaggatttcgcgtcgaggatcgtgaacatgctcaacttcacggacaccatcggcaattcgctcggccacatgatgaacgcgttgggcaacggcatgtgggcgttggccgcgaacctggccgacggtggcgtcctgggcggttcggacagggcgatcgccgtggccggcccggccgcgaacacgatggcggccggcatctaccgggcgctgttcgatccggcgaccatcggattcttcctcgccatccccatcctcgtcgccatcgtggccgggatcgtcgccgtctacatgcggcaggggacgggcgtgctcgccagacggctcgtctgcctgttcctcgcgttcggcctgttctacatgatgggcgcgacgagcgccgcccatccgacggacgcgtacccgggcaccccgtactggctggtgtccacggcgaaaagcgtggtcgacgaggcgggcggcggcatcacgaaggcgttcaacaacgcgttggaggggacgggcggactggtcgccgacccgtccgaccagtcgaacatggcgtcctgccgacggtacacgtccgtattgaaccaggcggcccgcaagaaccggaacgccatgtcggacggcgtgaacctcatgtgggaggagaccggattacgcgcgtggatgcgcggctcctacgggacgggcgagaacgcgagcaacgtgttctgccggatcctggaataccgtgcgggcgcggacgcgcaggcgatgagcgacatcacgaccgcgggcatgggcggcgtgaacgccacccagcagaacgcgatcgcgttctggccgaccatgatgagcacggcgaaggacctgcgcgcccagtacacgctgaaactgcccgcggattccaccacccagatgctcgaccggtgggtcatgctgtggaacgtgtgcaaggtggatgcggacggctcgttcaaggatcgcgcgggcttcaagttcgtcggcgcgatcgagaagaaacccctggcgggctccgcggcgggcgtcgtcagccggaaagcgggcgggccgctcgcatcctcctgcgaggcggctttgaccggcgtcgacccggacgggaacgacacgtattatgtgacgcgcggcgacggggacaaggcgaagcccgtcgttgacgattcggacaagacgaacaggcgcagcgagatcgcgaacctcgcgctcctgttcgacgtgaacacggcgaccagcggctggcagcagctcgtgtttacgaacggcggcgggaacatgcagcagaacacggccgcctaccggctcatcgaccagcagcacgggaaaagctccctgggcaccctgtcggaggggttcctgaacggcgtggccggcgaggtgaacctgatcgtctggggattggggtgcggcagcctgcagacgctgagcatgctcgtcgcctgcctggccgcgatcggcctgttcctcgcattgctcctgctcgccgtcagtccggacgcgggccgtcgggcggtcggcaacgcgctcgtccagatgctcgcatgggtggcgggccccacggtcgtcgccctgttcggcagcctcggcatcctgttcaccaacatcggcatgaccctcctgggcatggtcgacgcggacgggaacacgcagggcggggtcctgcgcctgctcgtcgcggcgatcttcctgccggtcctgtacgtgaaggccgtgaagctcctgtgcgtgaaggtgtggaggatcggcaacccgttcagcctgcccggcctcgcccagctcgccgggttcggcaacgcgatgaaacggggcctgaccatggccgcgggcgccgcgatcgcggcgggcgtgtgcgtggcgaccggcggctcggccgccatggcgctcggctccgcgggcatggccatgaaggacggtgggcgcggcgggctcgccggaaccgtgatgaacggggtgaaggcgggcgcgtccccggccatgcacggcatgacgggcggcggccggtcggccggcgggcacgggcccagccaggcggacaaggcggccatcgccgcggaggcgaaggagacgcgggagagggccgaatatctcgcggaccgtcccaccccggacgagaaccggctcgcgaccacccgatacgagaacaaggtgcgcgccgaattggcgaaatccctgcagggcgacgagctcgaaagccaggtcaggaaggtgatgcgctccgacacggcggccgaggacatcggccagctcgccgaggacatccacgagcaggcgaaggccccgcagcccccgtcccggcccgcgttcgcccaggtgtccccgcagtcgcgcatgcgcgccgcgaacggccccgcgaaccgggcgggcgagcggccggccgggcggccgggggctcgccccgacgcgcccgtccggccgcccgccccgtcgaagaacagccccctggtcgacttcgggaaaggcaacaagctgaccgtgaacaacgggttggacgagcggacgctgatgcgcgtcggcgaacgcctcttggacgacatgcagcggcgcggccggacgcgccgccacgcggccggacgcgccgccacgccggcccgtccgatccgcatacccgcgccgaacagcggggcgacgcgcgcgctcctggaacaggaacgggcgcgcggcatggaggagcggcggttcagccgcgccgaacagcggggcgacatatcagacgagagcaacgatccgaactaccggcggttcctcgccgaacagcgggcgaacacggcacggcataggaggggcgcatgagcgaacacaacccgtatctcctgtccgacccgcgactgctcgaagccaaccggaccgacgtcgcctaccagctggggcatggcacgccgcccggctggctgctcgcccccggcacgggcccgctgcccatacccgaacccatggccgtcagaccggattcgccgcgcaccatggaactgctcgccctcccgttcgcatggctgcccgacgagatctgggcccgctacccgcatgagacggaccctgggtacgcgacccgcatcaccgtcgccctggacgcaatgggcctgctcgccgacacgggggacggcgtctggtacgcgtccgtggaggacacgccatcggacgcggacacggcggcccgcacgctcgcagccctcgacggggacgcggacgacgcggggacgatgctgatcatggagcggatgcgcgcgcgcatgctgaaagcctggcccggcgggtatccggccggcgagcagatcgggttcgcccggcagacggccggcctggcgctgacggccaatctggcgttgacgggcatgcgcgccctcgacatggacgcgcacggcgaccgggagggggcgacgggcgtgatccgcgcggccatgcgcgtctggcccggcctgttccccgaccggcccgaccgggacgcgctcgccgcatgggtgtcggacctgcacggggacgcggtcgcggcgatgcggctcctccatcgcatggggttcgcgtccgacacggacatggaggcgttgcgatgagccgcgaatcggaggacagggaacgcgacaggttcgcgtcggacacggaccggtggtcgccatgggcggccctgatcggcgtgggcggcctggcaggcgcgtactggacgctcctggcgcgtcgcatgcgcgccgcattgtcggaggattcgcccgaatacgcggcggacacgaccgtggacccgtggcatgcgggggagcatgcggccggcctgatacgcgcgtttcgtgacgtccggatcatggcgggcgcgcgcctcgtcccgatcctgtgcctgtccggcctcctgatcgtgctcctgatcctcatgaacctgcgcatgccgaagcccgacaacccgttcgaccgggatccggtccgcctgttcccggacgcggaccggacgtggatccgcatggcggcgggcggccggtgcgagcatcggggcctgttcggcctgctgcgatgccgggggccgatcgagcatatggaccatcattacccgtggtcgaggggcggggccacggaccggcacaatctggtcggcctgtgcgcccgccacaacctgcgcaaatcaaacgggataccgaccctcctgtgcacgtggctgctgtaccgggcgcgcctgaaatatttccccgcccgcctgcgcggctacgcgtggccggacgggcgggcgcatagcgtgcgggacgacgaccggaaggagctggaatgagcgttgacaggaacaacagggcgcacaggccgggcggcctgccgcaggggtatgcgggcacgttcgcgcccatgcgggccggcggcgcgggggacgtggtcccgcccatgccggcccgccgacgggcgcaaacgcgcggcgtggaggacgacgcgcgcgcctggggtttgaaggagcggatcgaatcgctggcggacctgggcgacggggagcaggcgcgccggctcgcccacgaggcgggcgccctgtgcgcgggcgactccatcccgttcgcggacggcgcgtacgcggccctgttcgacgggcgggagctgacgacggtgcgcatcgacgggccggacatccaggacgtggggttcaggccggaaagcatccgcgcgtgagccggggacgcataccggggcgtgacggcgcgccgacgccgccgacatggaccaatcgtgaaaggagccatgggacatggcagaccagaaccagcaggcggaacgcctgaacttcgtgaccgtgccgggaatcgctaacttcccgcacctgttcgaacccgattcgaagaacggcaagtacacgctgaccgtgctgttcgacaagaaggatcccgcggtctcgcagatgatgcgcgacctgcaggccaaatgcgcggaggcgatccggcgcggcatcgacggcgaacccggcagggacggcaagtcgtacgcgccgttctccggccactccatggacgacaaggagtgggtggggcgcctgcgcctgcccgtggaggacggggacacggccaagttcgaccgcggcgacaacgtgggcaagctgaagaaggacgtgtacgaggagtatgagggccgttgggtgctcaagaccggcacgaagaccgatctcgccgcggccggctgggtcgtggattcgaaccgtcgccgtctgaccgccgccgacctgtattcgggcgccatcgtgcgcgtcaacgtgtggctgtacgcgtacaagcaggacaattcgggcgtgggagccatgctcaacgcggtcgtgaagacgggcgacggggagcgtatcggcggggagaccgatccgctggccgcgttcggcctgccggacgcgcaggatgcgtcgaacccgttcgcgggcatgggcgtctgaccggaggggaggcgcatcatagcggatatggttctcaccccgtatgagacgttcgacgaatcgtcgggcgtgcacgtcctgtgggattcgagccgtgacatgccgtcgggcatgacggcccgcgagttcgaccggcgtgcggggcgtctgctcgccctgctgccgcgcgcggcggccggcccggccggcatgcgcctgcgtgcgggttcggatcatgcggggccggacgcgcacccgtacgatgcgaccgtattgcatgtgtgggagttgtggcgtatggaggcttcggggctttcggcgcgcatcccgggcctgtcggacgcgttcgtgtccgcggacggtctcgcgaacctggtcgtggaggaggagtcggacctgtccgatgccgcggccgccgcgacgggcgcgggctggccgctgctgcgcgtgtggatgcgcggcgagacggatcctctcccgtaccgtttcctgctcgtccgcccctagacgggggtggatcccgggcccgcttggcgacgtgccgtgcgggccctttttcatgcccggcggaccggatcggatgttcccgcctgtcggaccgtcggtccgttttccggtatgcgaatggccatggcgtcgtacaggtcgtcgatggtgacgccgagcgcgcgggccagggcgcgggcggtgcgcagcgtcatgttgccggggtccgcgcgcccagggcgcggccgggcgtattcgctgatcctggaggccgcgatccccgtcctgcgggcgagttcggcccgggtgagcccggcggcgtccccgagcgcgccgaggccggccggccatgtccggcacatgccggcgaccgccggccacggatcgtcgcgggggacggccgcggaatccccgtgcggccggttgcggccggtgtccggatcggtttcgaacatggcggcccgggcggacccgtccccgtccggggcggcgacggcgaccctgcgcaacgggatggcggggttctccacgaccgcgaggaacggcgtctcgcgcatcacgcgcacttccaatcccagtccggcgagcatgtcgagcgtcgccctcacgttcccgtcttccatgcgatcctgcgatccgtttcgccgggctccccgggggttcgcgatgccgtggagccgcatgcgcgggaccgtgtatgcattccggttcgcgtgtatgcatttgtatgcatccggggatgcatacaaaaaaggcttggaaaaagcccgaaaacccttatatataaaggaaaaaataaaattcctttctcttgtatgcattgtatgcatcaatatatggggtttccttcctttctttcgaatcctctataagggaatgatgcatacaatgcatacacgccccggaccacccccggaacgttggaaccaagccgaaacgggaagaaaagatgtatgcatccccggatgcatacggatgcatacaggccggccggaatgcatacaggcccgatgcccgccccggcggacgcatacacggggcccatgagaccattcatcgaccatgacggcctgaccctgtacaacacggatgcccgccgcctgcccgacctcctcgacgcgcccgcggacgcgatcgtcaccgacccgccctacgagctcggcctgggcaccgcgggcgaggtgaaacgctgggactccaccggcatcgccttcgacccggaattctggacggccatgctcggcacggtccgccccggcgcgttcgccctcgtgttcggctcgccccgcacctggcaccggctcgcctgcgccatggaggacgcgggctggctgatccgcgaccagatcagctggctgtacgcgtcaggcatgccgaaaggcgaatggggcgaccatgcggtcgaccgggcgctcggcgtgagggacgaccggaccggcgtcatacgggactccgcgtccctggaacgcaacgtcgcctacacggaacgctacgaggcgaagacccgcgaggcgcggccctggcgcgggttcaatccggcgctcaaacccgcatgggagccgatcctcgtcgcccagcgcccccgcgagtccatgctcggccgcaacctcatggaccacgggacgggcgccctgaacgtggccgcctgcgccctggacgcggacatgggggagctggggcgccgctaccggctcaacgcgaccgccggggggcgtccggacgcgccgcgcggcggcgacacgttccgtgattcgggcacgcccaggcccatggggccgcgcataccgggccgccacccgtcgaacgtcctcatggacaaggccatggcccggctcctgcccgccgacgcgccgcgcttctactactgtccgaaagcgcaggacaggcccatacgcgccctggaacgcctcgtccgcccccggacacgggacaaggcgtggaaggcgtgctgcgcgcgcctgggactcgaatccggggcggacgcgtaccccgcgtgcctgctcgacgcggaggcgctcgccctgaccgtgccggtgggcgaaagacggctcgcccatccgaccgtcaaacccctggacctgacccgatggctcgcccgcctcgcatgcccgccccacggcctcgtcctcgacccgttcgccggctccggcaccacgctggacgcatgccggcgggaaggcctgcggtgcgcggccacggagctcgaccccacgtacctgccgctcacggccgaccggctcgaacgccccgcaagcctcccgctcttctagcggacgggggaacgcatacccgggggcacacaacaccgtggaaacggaggaacggcaatggaagactacatgaacctggcccacgagtgggtcgcacgcctcgaaggcggcgcgggcacgtggatgaacgaccagaccgccgaccggctcgccgccggcctgaacgatcccaggggacgcgacatgatggcgctctccctcctcgacccgacgctcgacgcacgcacgctcgccgcacgcgccgcggatcccgcgcgcctgcccgacggcatgggggaggcgatggacgcgctgcgccgccgtcccatccccgtcacgcccaggcccggccggctgacggccgcgcgcgacacgctttcgacgctcgcggggacgaggcccggatgcgcggccggcgccatggacctcgcgctcctcgtgttctggctggccggcgacaaaaagggcctggacgcgatgctcgcccggcccatgcccgacaccgtcgtcaacgtgatagtccggttcgcccgcgaccatgacatgtggcccgcgggcgcggccgtgccccgcgtctaccgggcgcccgagctcaaggcctgatactccgcctcccatgcggccgcgtccgacgcgtccacgccgagcgcatcctcgatcaggcgcacgtccaggccgcgccggcgcgcctccgtccatgcggcgtgcgcgtccgcgccgcccgaggcgaacgcgtcatgcgcgtccatccggttgaccacgtcgtcgaattcgccgggcgtccggtcgagctccgcacgtccggcggccagcatgcgttcgaagtcctcgcgcgcgttgaacggtttcccgtccgcgtccaggcggggcgggcgtccatggtattcggggcgcgcgttcgacccgtcggaatagtacatgccgcgcccgtactggacgcccctggctatcttctcgtggatgaagtcgcccatgttctcgtcccagatccggtcgcgctgccttttgtcgggcagtcgtccgccgtgttcgcgcgcgtacgcgccgatccggtccatgtaccgtttgccgacgcgcatccggtgggcgctcagattgtagggcggccgggcgaggatcgcctccatgcgcacggggcgggtgagcgcgtagccgacgagcctggcggagtagcatcgggtcgggtcgccgatcacgttgcggcgcagcgcgtcgcaccggttctccgcgattctgcgcgccatgtcgaagcgttccgcctcgttcggataccaggaggcgagggcgcgcatgatccgcccgtagtgcgggcgtccgtccgcgtcctcccggtagaccgcgtcgtcgatcatgcgcgcctcgtcggccgggtcgagcaccggctcgtcccggtagtcgaacgggttgccgtccctgtcgacgcccggcctgacggctttgagccggtcttgcagccacaggctggtcggatcgtgttcgacccgccagttcacaagcctgacggccctcttgtgcccgtagcgtttcgggtcgaggtcctcggcggcgggcggcatgacgtctccgcccgacgtgccggacgccggctcgtaggtgcccgcgtacccttgggggaggcccttcgcccggtggcccctgccgttcctgtccatgaccatgcggtccgctatgcgcccgtcgggctgtgccgggcgcttggcggggctccacggggtttcggacggcctgtccgtcagacgggaatggtcgtcgggtcgatgccgaggtcgacggccgtgagcaccatgtcttcgaacccgtccgcggccatgtccggggcggcgcccatgccgggcgaccattcgagacgtcccatgtccagcagggattcgaaccggcgccgcccgttgaacccgtaggggcgtccgccggtcgagttcgacccgtcggacaacggggtgggcgtcacgtggcgcacgccgcgacgccgcttgtcgtccaggcgtcgcatcgcgaccgcgtcccacgccttgtccggatcgtcgccgggatgcgcgtccatccactccagccacgggatgccgttctccagcaggcttttcggcatcagcccccgggcggagagccagtgctgcggcgaacagtcgagacgccggttgtacgcctcccgcatgtccggcgtatgaccgtagcgcagggccgtgcgctccagcccgtcctccaggcaggcggcggccatgcgcccgcccgccatgcgcccgtacaggcgcgtgaaccagtgttcgagggattccagttgggtcatgcgccgttgcatgcgtccccgaggcgcatggtttcaagaagattcgacgccgggaagccggcccggccggggcatgccgcccgccgtcgaccatgcgaccgcgtgcacgatatcgtattccgtcccgttcatgcggcgcgtcgcccacgggccggaagcggggggagggtctgccgtgtgtgacatgcccatcggccggcaggcgcgccacgtcgccctcccctggacggcgggccgcggaaccggaggccatgcgtcggggacgcatgcgcgcgggcatgcacgagaacatcatcggttgggagaacctgcccgcaagcctcctcgcccgcatccgggacgggatcgtggcccaacgggacggcgacgaatggacgcgcttccgccccgcattggccggcaggaccgatgcgggcgaaccctacatcgtggactcggactgcgtcgaccattgggtcggcgacggctccgcgttccccgacccggacacgccattgcccgaggccgtgcggcgcgaccccatgccgggcgacctcatccgcctccacaagaccgacgacccggccatcgccgacatcggccgctatgagggccggtcggcgatggccgggtggatgaccgacaacgggccctactacgcgcgcgaatggacgctcgacagggtcgtcgaacaataagggtcgcgtttcgcatacgacggcgtatgcgaaacgaaacggacaaaccattctcatggttcgcggacgatatgccggtattgacgggaaagggcttcatgcccatcgaatcggtgggcatcggcgatctggtcctcaccgggtcggatggttggaagccggttcttgagaccatgaccgaaaaacgggatgatgccattatcctgcacgggcagggttctaatgggataatctgcgcgccggaaagcatgtttatggcgggacaccgtttccagggcccctgggacaacgcaaaccgcacctaccccaccctgttcgaaaaggacggctggcggtctgcttcgaacatggatgctcacatgtggcttaacgtcggccggatcccggaattgcccatcccgtcattggagaacgtcgtgttcgacgaggagttcttctatttcgtgggccgtttcctcggcgatggttgggtgtgggaatcacgggatggaagcaccaaccagcaggtgggcgtctgctgcgggttcagggatgtcgaatccctgatgccccacatgaaggcgctgggctggaagttcagcgaacaggaccagaggaccggccactactggcgttgctacgacaaaacgaaattccactggttcgaggacaatttcggccggggagccatcaacaagcatctgcccggctggacgttcggcatgaaaaaggaatggcggcaggccctgttacaggggtactgggagtcggacggcaacccgatccggaacggcatgcacgcgacctcgatcagccgaaaactcatactcggaatcaagaccctggaggctggactcgggcgcgcatccagtatttccagccatgaacccaacagagtgtgcctcatcgagggacgcagggtcaacgaacgaaccaattatctgatcaacacgtatgaccggatccgcaaatccatcatctgcgaccgaggctattgggctcacatgcgcaaacgcgaggatatgagggaaaccatcaccatgcatgcgctgaccctcgaagccgactcgtacatggtggacgggattctcgtcagggcatgatgcggggaacgcatacagtcatgtatgcagaacaattctgaacacaacggtctcatcggcagcctcttctccggatacgggggattggatctcggcgtcgacatggcgttgggcggcggcatgcgcgtcgcctacacgagcgacatcgaacccggcccctgcgccatcgagtcatatcacgcgcacggcgacgactgcccgaacctgggcgacatcaccggaatcgacttcgagaagttgcccgatacggacgtggtcgtcggcgggtcgccctgccagtccctgtctcttgcgggtctgcgcgcgggcatgcatgagggcacccggtcgggattgtggagctatcaggcggatattctgaaggcttcgaagagtcccctattgctatgggaaaacgtccagggtgcgttgaccgccacggcctccagccgcgaggatctggcggaggcggaccggcgtgcgaaggctttggggaaggcgggcctgtgcgcgtgcgtgacgccctccgtcgacccgccggacggtttcacgccgcccgacccggatgcggagggggcgaagcctttggcgaccgtcctgcgcgattatctggaagccgatccggagaagtgcgcggccgtcgtctgcaaggcgtgcggccggcatgtgttcgaaatcaacggcgacacggtgctggcggatggcgagcgattggacggcgtgcatacggcgcccacgatccgcgcgttgggccgtgtgctgggcgatctggcgaacctgggttatgacgcggtgtggcgaggtcttgaggccgccgacatcggggcccctcaccataggctgcgcatcttcgtgaccgcctggccgcgcgacccgtccacggcgcgcgagccgtcgaatgcccggctgaggcgtctcgcccaactgccgcccatgaggccgaagggccgcgcctgggccgtatgggatgcggacagggacgtgtggacgacaggggagccggatttgttcggcgatgtggacgtgtatatggacgcgtggccgaaatcgggcgtcatggcggcgggccgcgtgtatatggtgcccggatcgtggcttacggtccccgtgccagcggccggatcggctttggtgacgccgaaggcgacggacggcgcgaagggcgggccgaaccagtcatacgggaacggggatgcgccgctgcccgcgcaggcggccatgctgccgaccatcaaggcgggggatgcggggcatacggggccgaaccagcggttcggggccggcaacccgagcctggcggcctcggtcgcgggaatcggcgtccttccgaccccggcggatgggttcctgtacacgccgaagcagtcggacggggtgttcgccgccccggccacgtcgggccgcccgttggacaggagcacgttcctgtccacgcaggtgcggctcatggacctgccgggacgcatggacccggagaaggtcagggagcatgattcgaggctgccgacccagatcgaccaggcatcgttcgccttgaggccgtctgacgcatacccgtggtcatggactgatgacgacctgtggctgctgacgccgacggtgatggacgcgacccggaatacggtgcgcggctgttggaggccgggggagaactggcgtggcgtctcgttgaacaacgcgatcatggacgcgggcgaggtgatcgcggcgggaacgcgtacgatccacctgtccgacgaggtcacctgcctgccgacgcccacgtcgaacgagtggaacgggggcacgatgaggcccgcacgccgggccgtcatggggcatgcggtcacgtgcgccgactgggcgaagaagagcgacgacatccgcctgttccccacgccgaactgcatggatgcgatcatgccccggtcttcgaccggcaatctgagggaggatgtgatgatgaggaatgtgaccgtgctgtccacgccgacgagcagaggcgggaagggcagcaaccagaggaacagtgaggactgcatgcccgtggccgccgacaacatgagcatcaccgtccccggcccctatcatggcggcctgtgggggttggacgacggcaggggcgtgcgcttcggccggttcaccgcggcgatccgccgttgggagcgggtgtccggccgtcccgccccctgtcccacgcaggcgaccggcggcctgcgccgctggatcggggcgaacgccgccgaccccacactgttcgaaccgtactggctcgcccgccacgccccgttcgacgcgcatccgaaagcccggctggaccagccgatacgcgaccgcatgctcgcccgctggcgtgaaaccgaccggggatgagcctcatcgaccccatgttctggcccggctgcaaggacatggacccggacatcccgatccccgcgacccgcctgcccgacaaaagcgtgctcgattattggaagacccggtccgtgggctcccggttcccgtcggcctcccacctatccccgaggttcgtggaatggatgatgggtctggaggacggctgggtcacgaatccggcgatctggcggcatgtggacggcaatcacaggaacctccaactgcgcgccctgggcaacggggtcgtgcccccgcaggccgccatggcggtcgactgggcgctccgcgtacgcgaaaggctcgccgtttgacgcccgtcaacgtctgggcgtggacgctcctgggcgtcgccgtccgcccggccatacccgcgtccatgcgccggatcggtctgatccggtccggcgcatggatgggacggcacggtctcgtccacgtatccgcgtgcgcggcaatcctcgcctggctgctgggcgcggacgtgtgggggatgcggctcgcctgcctgacgatcggcgtcgccgtcggcggccggctcccgtccccgccgcatgcgtccggacgtccggatcgtgacgggacgggcgcgaggaacctgcctggccgcgtatcatacgggcccatggaagacgacgagatcgaagtgaggccgttcctcaaagacaacgggccgttcgcgggcatgccctcccgtttcctcggcagggggtggaaacgggttccggacgggcgcggactgccggaacggtccacggtccttcgtcggatgggccttgtgttcgtggtcggccgggtcaccggactgttcgcctgcatcggttacggccggcccgccgaacatccggcgatacgcatgatggcgacccgtatcctgccgtatccggattggacgtgccggacgaggggcgcggatcccggcatgttcgctgacgcgtgcatgctgcgctacggggccgacgtgctgacccgcctgtcccgtgacgcatgcgccaacgcccatccgcgtctggcgtgcctggtcatgcgatgccgttgcgccccgatccgccgggcgttggcgcatgcggatcgtttcaacccgctgatcggggcgaacggctggggcgaggacatcgggctcgcctgcgaactgtatgacgcgacgctgcgcgaatacgggcccgtcggggcggtgcggcgcctggccgatctgataggagggttccgcaggacggtgcgcggctgatcccggccatcctatcgaagcgtgccgggcccgtcgccatccaagcccggcacccgcatcccggcggcgtcacgtcttgagaggggatcgggatgcggggcgaaacggtccggacggctgcatgcccgcatccccttgatcccgtttgttttcagtcgtcgagcgtgcggatcgcgttcttcagggtctcccggatcgcgtccaccgtctccctggcccgtcgttcgcgttcccccgcccgtcgttcgcgttccgcggtcgcggcctgcgcgtccttgcgccgcgtttcgatgtcggcgagggccttcgcgtgctccttcttcgacgcgtcgcgttgctcggcgaggtcggccatcgccttgtcatgctccctcttgtgttcctcggcgagcccgtcggcggtctgcttcgcggattcgacgatgtccccggccttcgcgttcgcctcgtcgaggatgccttttgcctgcgcccgcgcctccgcgatcgtgtcgcgcgccgtgttcctcgcgttgtcgacgagatcctgcgcggccttgccggccgcctcgaacgggctttccgcccggtggcgcagttcgtcgcgttcccggcaggcggcctccaattgggcggtcagccgcgtgttcaggttcctcaggttgtcggcgatcgcgatctgccgggcgaggctgcgccggtatccggccgtcctctcctcgtactggtcgaccagacggtccacatcctccgtccggtatccgccgaacgcgacggtcgcgatttcggggcgcgtgttctcctgcggcgcgtacgactggggttcgtatgattcggtgagctgggctcccggctcctggtcggtcatgacggtttcctttccttgcgggtgcggggacgggcgtcccctgctgcatgcctcccgtatgcgttccggacggacgcatacgggaggcatgaccccgatcgccatcctgttctggccggccgcgggaatcctgctgcgccggctcgtccccgccatgctcctggacgcgggccgggaacggtgggcgcgggcggcgggccccggcccatggcccgcgcgtctcgccctgttcgccgccgtgctcgccccgttcgccgccggcggcgtgtgggcgccgcgcctcatgctcctggccgtcggctacgcggccggctgggatgccatcccccgtccgcatcacgctcctcggatacttcgggcaggtttcgggaaagaaggccttcataatcgaagcgttcctcttccatcaattcgccgaattggtcggaggtgaagcatggactgaatacgtcattagaaaggagggaaatcaaggatatgagcataccggttcttgacaaaaccctagagtcagaaagcattacggaagaccagctcatgcggatgatggaaaatgctatgcgcaatagtctggaacatggaatcgatccgcgtgacgacgatttgattcccgccgaggaatccttcaagggactgtttttctgacatttggatatggcacaggggcttaccgtcgtttttgactgtaatatatacgtaactgcagcgcaggcaataggctattcaggttccttggctgatcttgaacacattgcacctacactcccgttttatcggcgtaaacgtgctgaatccctgttgtgggcgctaaaaggcggggcgggacctgtcaaattccacgtcggatggagcaatcacatacggtgtgttacgcgcgtgtcagctcgtctgaccagaaggacgatttgacacgtcaggccgaccggttgaaggcgttcgcccttggcatgggcgtcgagaagcccgaggtggtcacggagacgggttccggcatgaacgacaaacgacgcaagctcaaccggctgttatccgacccgaccgtcggcacgctgatcgtggagcatcgcgaccggctcgcccgtatgaacatgggactggtggagagcgcgttgaaggcgcagggacgccgaatcatcgtggtggatgacacggagccggacgacgatctggtgcgcgacatgaccgaggtgctgacctcgttctgcgcgagactgtacgggcgtcgtgccgccaagcaccgtgcggagaaggcgttggaggcgatgcgcgatgagcgcgtatgaggccgttaggattcggctcgacccaaccccacggcagacacggctgttggagtcccatgcgggtggtgcgcgtttcgcgtacaatctgatgctcgcgcacgtccggcgccaaatctccttgggtgagaaaccggactggacgttgtacgcgatgcgccgctggtggaacgagtggaaggacgaaatcgccccgtggtggcgagagaacagcaaggaggcgtacggcagcgcgtttgaatggctgtcccaagcgttgaggaactggtcggacagcaggaagggcaggcgcgcgggccgtagggtgggctggccgaaatacaagtcgaaacgctccagtgtcccgcgtttcgcatacacgaccggcagcttcggccttatcgaggacgacccgaaggcgttgaaactgccacgcatcggacgcgtgcactgcatggagaacgccaccgaacgcgtccacggcagacgaatcgtgcgcatgaccgtcagtcgccatgcgggcttctggtatgcggccctcaccgtcgaacgtcccaccgaaagcgttccagcgaaaaacagaaaacagaagaaccgtaatcgtcaggtcggcgtggatttgggcgtcaggaccctcgccaccctctcggatggcaccacgttccccaatccacgcaactacgtccgcacgcagcggaaactccgccacgcccaacagtcgttgagccgccgcgataggggcatgagccatggatgcgggtcgaaacggtacaacagggcgttggagcgtgtgcgccgaatccacgctcgcatagccgcccaacgagccgacaacatcggcaagctcaccacgtggcttgccgacaattattccgacatcagcatcgaggacctcaacgtgcagggcatgagccataacaggaggcttgccaagcacgtactggacgcggacttccgcgagttccgccgccaactggaatacaagaccgcacgcgccggcacgaggctccatgtcatcgaccggtggtatccaagctcgaagacctgttcgaactgcgggacggtgaaagccaaactgtccctgtccgaacgcgtctaccattgcggcaagtgcggacttgtcatcgaccgtgatgtgaacgcggccatcaacatccaagtcgccgggagtgccccggagacgttaaacgcgcgtggaggaagcgtaagacagacccgccttgagtgcgggacaatgcggcatccggcgaaacgcgaaccaagcggcggcgacagtcgcgtgagacttggagctggtctcggcaacgaggccatgcagatgacttcgctctagcgacaagctaaaacaaagtcatctacaacggaacccgttccggcctgacatggcgtccgggccgttcccgtcccatgcctcccccggcccgcatagacgcgcgtgcggggatagacgtacgccgtcccccatccgacagaaaggaaacatccttatgggttcgactcatagcgacagacactgggcgcgcacgctcgccgcggcgggcgccgccctggcgaccctggcggcgggcctgctcgtcgcgggcacggccgacgcggccaccatgcgcgacccgttcgaacgctccatccagaacggcaaccccggtttgtggacgaacgtgggcacgatcacgttcagcaacgggaagaagtacgagaacatggcgcagtcgctgggcgtcgtcgacagggtcaacggcaagaacacgtactgcatcgaggccgacacgctctacacgggcacgacgggcgactggggcgattggaccgacgagaggaccaagccggacgcgcagcggctcgcctggctgaccgacaggcacaacggggaccgggatgatctcacgcaggccgcgatcgcgggcctcatccaccagaagctcgacccgatgggcaacgaatacctgaacggcctccggcagctcggctgggcggacgggcccagctgggacgcgtacacggcgaagatgaacagcctgtggacggaggcggtcaacggcacgcccaccgacctcgacatgcaataccggtacacgaccggcaaacgcaaaggcctagtcaccccaagcatcacgaacgtgaacggtgttgaaattgcgggcatccaatacacggcgatcctgaacggtccggccgtgttcgaccagaccggcacgaacacgatcagcggcaccaccacgaacagcgccattcatctcccgtggaccgccaccggcaacggcaaggtaacggtgtctgtactgcataagattcctaaggcggccagactgtcctccccgaaccaggatctgatgggactgtccgatccggagaccgtgtcgaagaacatcacgttccaggtgcaggcgaacttcaagccgaccatcgaatccaaccagaccgatcatcgcatcgaatacgggcacgcgcccgaggacgacctgacctggcatgcggacccgacgggcggcgactggatcgccggcgccaccgtcaaggccaccggcaccctctaccatttcgcgaagaaacccgtcgagggccggacgaccgtcagggacggggtgaaggccgcgaccgcgaccgccgccggcgacagggacggagccaccagccatgtggacgcctcctccatcaccatggaccccggtttcgtgaaggcccacccgggagcctccccgtcgagcctgcccgccaccggctggtacacgtgggtgtgggagatcacgcccgacatgcaggacgccaacatgaggcagtacctgcccgccgactacgactggtccgacaacgtgctggaagcggagaccacgctgcacgcgcgcagcatgcagccgaccatcacgtccagcgtgtccgccgcctacaagcatgatcagagcaaggtgaccggcgccgacgggatcgaacggcccgccgtccagatcggctccgcggccgcgtccgacaagaccgacgtcgtctacctggaaaagggcggcgtcatccgcgaccaggtcacgctgggcgtggccgacatcaacggggacggcaagaccgacaccgccgactggctgcacaccaaggacggccagggcgaaggctgggaaacggaagccaaccagatcacgatccgcgtgaacggcgcgctctacgggggcatgacccgcgaacaggccgaacaggcgcagaaggacgcggccgcgggcaagaccgtcgaactgcccaagcaggccgtgaagctcgccaccaccacgttcacgacgaacagggcgggcgactacctcctgtccagcaagaagggcgagaagccggccggcgtgtggaaggccgagaacgggatcgacctgacgaacctgccgtccggctacgccacgttcgtgtacgacatcacgaacagggatcaggacacgaaggcccagaccggcatcgaaccgtccagggactacccgttcgccaaggacgtgcacgaggccccgttcagcaaggacgagaccatcatggggcgcctcaccccgaagctcgactccacggtcagctccaaggagatcaaggcgggcgagaccaccgtcgacaggctcgtcgtcgccaagaccaacgaaaaggacgtgtggcccacctacccgcagtcgaacgtcaccgaaggcgaaaccccgaagggcaccccgctgagcctcgacttccacggcgtcctctacaaggtgagcgacgatccggcggccgcgatcgagcagaccgacaccgtgcccgacaacgcggtgaaggtccacgagaccgacatcaaggacgtcaccgggttcggcacctactcgacggactcgttcaccctgaccgaggcgggcacctacgcatggcattggaccatgaccccgagcctggccggcgaccagaaccataatccgctcgccgctttggcctggcgtcagctcacccacggcaaggtgcagcatgcgttcggactcgcatccgagatcgtgcgcgtccggaagcccgacacgcccaggtgcgaggtgtccaccagaagccagggcgaggtcacgatggagaacggcagggccgacctgcacgacgagctcctgctcaggaactgcgagcaggcggccaaggccgaattcgaactgtggaagcagaccaacggcgaccagtcgggagacgtgctcatcaccgtcaccggcaaggtcgacgcgaaggacggcatccactcgccgaccgtgaccgtccgcgagaccggcacctactactggcgtgagaaggtgtacgaccagacgggcaggctcgtctcctatggtgacgcgcgcaagccgaacgagaccgtgaccgtcaaggagaagcctctcgcctccaccggcctgggcgtcctgcccgccgcccttgccggcatgctgctcgccggcctgggcgccgcgttcgcgctgcgcaaccgcaggcgcgcctgacacgcgtgacggcaaggggtgccgcatcccccggcccatgacgggccgcaggggatgcggcacccggttcgcttcctgtttccttttcggatggggttggatccgggcgaacaacatcggcatgcgtgacttcgtgttcacatccgcccgcggcaaccccgtctgctccagcaccgaacgataccaatggtgcaaggcgctgaaggcggcgggcctgccgcaggtgaagatccattccgcgcggcattggatggcgacgatggccgcccgcgcgaacatgccggacgacgcgcgcatagccgtcatgggccacaccagcatgcagatgaccatgcgatacacccacagggacgccgcatcgttggggcggctgatggccgccgcgatacccgacctgcacgacgggatcgagatcatcgacgcgacgccggcacgcggatagaagacagccgtgttcgcggacggatgcctcatgacgcgggatgtaacgttccgatattagaatggggagaccggtgagatgcatgggagcgtggcagatgtctgacgatgagggtttgatgcgggagaacgccgcactggtggcgttgcttaacacgatcgaccggaagcgcgattcgtggtcgtccatagccgagaccgtcgagcgcaacggaagcgccctgaaggtgctcatgcacgagatcgacccgcgtaacaacccgttatatgacgacgaggatccggatgatttcgagaacggggagccgaccctgttcgatgaccgggacatacctgtttcgcgggcaagggctgcggaacttgagtccgccttcgacgcggcgctggacgaagtggactcgtgggagcgtcgtggtctcgacttcgtttccgtcctcgatgaccggtatccgaacaggctccgccaggtcgtggacatgccaccgttccttttcgcggaaggccgcatggtacaggacgagcttggcgtcagtgtggtcggttcccggaaggccgacgccgaatcgctgaaattcgcgcaggacacggcttccatgctggtgtcatgtgggttcgccgtcatcgccggactcgcctctggcatagacactgcggctcatgtcagggctttggaggaaggcgggcgcacggtcgcgttcatcggcaccgggatcaccaaacggtatcccagggagaacggaacgctgcaggaccgcatcggacgcgacgggcttgtgctttcgcagttctggccggaccaggggccgaccaagtacacgttcccgatgcggaacgcgtcgatgagcggatacggtgtggccaccgtcgtcgtgcaggcgtccgagcattccgggaccaggatccaggcccgtcaggcccagcagcatggtcgtcccgtgatactcagggacaccgtcgccgacgggactgaatggggaaggaagctggcgtccaggccgggcgtgtgtgtggcgtccactgtcgacgacgtaaaggcgagattgcatgaccttctgggaatgggacgtgcgctcgaggaatccgtggacatgctgttgtcggcaggcgcatcgaggtcgaatgatcagtagatacggattagcgcttgaccgcgccatagacagcatggccggcagctacctgaaaaccgtgaggtacaagtcggtccacggatacctgtgccccgaatgcggagggttcaaaggcgccggttattggatgtgccgcggctgctcactcatccacggcagtgcatccgcccttggtgccgggcacctcctcgccgaccggctcgcattcggcgtctacgccccggaaccaagaagccagtcgttgaagatgatgtacgggtacaaggacgagcatccggcgtcacccgactaccgcacgctcgtcagggcgattctggcattgggcatagtcggacacggggattgcctgaacgcggtcgccggaggatcgccagttgcctgggcgatggtaccatcgaccaggcaatcaccgcgatacgggaaaccgcacccgttccatgagatagccacatcagtcatgggaggtctgcccgaggtggaaatcaccgcgtcggaaggtgagaaaagacgcttcgacccggagaggttccacatcgaatccgcacccgacttgaatgggaacgtcctgctcctcgacgactcatgggtgaccggggcgaacgcccaatcggtcgccgcatgcctgaaaaccgccggagccgagcaagtatcgatatactgcgtcgccaggatagtcaactacaactatctggaatcgctgtcaccggacgcggtcgcactgttccagaaaaacgtgcattacgccggcggattctgcccatggaacagaaccagcgaagcaacggacggatgatacgccacacacgccctggcgctcgcgggagaggccgtggcgttttcacatgcgtatcgtgtcgtgcagcatgtcctgataatccctgacgacctgcagcgtcacgtccagctcgcacgcgatgcgatacgcatcaccctcgcacaacgcttcggcgctcgcgtactcgaccggggcgatgagacgcagcgcggtctgcctgcgcgcccggcgttcggccttgacgccatacggggttcctgcgccagtacttccccttgtcggccggtgcggggcgtccgcccccgccttaatagaacatttgttcgaatattggttcggttttgttccgggaggccgacctgccaaccgttggtttcccgggggacgcataccgtggggtgattgaagccggggcaagcgccaggattggatgaatccccgggatgtgaggaaaccgaccggaacaagccacgcatgatgctatcatcgtgcgcgtagcggaaacatgaaagaggagcataacatgagcggattggatcccgtgccccggcccccggtggaaccgtcgggggccggccgcgccgtcccggagccgaagcgtccgaagtggctggtcccagtgatcgcgggtggtgctgccgtcgttgtcttggcggcgggcggtatcggtggatacctgtggtggagccatcgtcagctgaccgaggcgtccggggaatgctctgtcgcgtacgacaaggcggtgaaggcgcaggggaagctgacggaatacctgaagtcggatgcggtgaaggccgcgatcgcggtcaagggttcggaggtcagggacgcggagacggtcgccgtattggcctcgaccgtgaagaccgcctcgaatacgaagaccgatatccccggatgcccgtccgggaacctgaagggcatccgggcggcggccgcgcagctcgacaagaccgcggacgtgtacgcgaagaccgtgagcgaggtcaggggcaaggcggatgcggtgaacgcctcgaagaccgacaagaccgtcgccgacgcgaccaaggtcctggacgactccaagggcagggtggaggacgacaaggttcgcaccgcattggagaacgccatcaaatcgagggacgggaaggcgatctcggatgcggtgaaggcggtcaacgactccatcaaagccaagtcggatgcggacgcgaaagccgaggccgaaaaggaggggcaggcggcggagaacacggcccaggcgccggacaatggctcctcctacacgggcgatacgaccggaggccacaccggatacgcgcaatcccagggcggaggctacactcccgcgccgcagcccacaggtaacggaggcgggtacactcccgcaccgcggccgaccccgcagccgacaccgcaaccctcacaaggcaacaacgggggaggttccggcggagatgacggctatgaggacatttgctgggcgggtgacaccagtggcaagcccttcgtccaggtgccctgcaactgactcttttctttccgcttgaggggtgtggcgcatcctgatatgggatgtgccacaccccttcacttttttatgacctatcatcgtgcgcgaagcggaaacatgaaggaagcattatgaacggatcgaatcccgtgcccctgcccccggcggaaccgtcgggggccgcccgcgccgcctcgaaaccgaaatggatggttcccgcgatcgccgtgggatgcgccgtcgtcctgctgtcggccggcggcggatacctgtattggagccacggccgtctggcggaggcgtcggcggaatgcgaggccgcgtactccaaggcggtgaaggggcggcgggagctggccgggtacctgaagtcggacgccttgaagaccgcgatcacggtccgggattcggaggtcgaggacgcgaagacggtcgccgtattggcgtcgaccgtgaaggccgtttcgactatgaagaccgatatccccggatgcccggcggatgggttgaagggcatccgggcggcggccgcgcggctcgacagggccgcggccgcgtatgcgaagaccgtgaacgaggtcaggggcaaggcggatgcggtcagcgcctcgaagaccgacaagaccgtcgccgacgcgaccaaggtcctggacgactccaagggcagggtggaggacgacaaggttcgcaccgcattggagaacgccatcaaatcgagggacgggaaggcgatctcggatgcggtgaaggcggtcaacgactccatcaaagccaagtcggatgcggacgcgaaagccgaggccgaaaaggaggggcaggcggcggacaacggctcctcctacacgggcgatacgaccggaggccacatcggatacacgggcggcggctacacgcaatcccagggcggcggctacacgtacactccacagcagcccgccggcaacggaggcgggtacactcccgcaccgcagccggcgccacaaccgaccccgcagcccccacaaggcaacaacgtgggaggttccggcggagatgacggatgggatacttgctttactggtgataccagcggcaagcccggtatccaggttccctgcagctgatttcctgtttccttttcggatggggcggtgtatcccgttatgggatgcgccgcccctttcacttttccatggcccggccatgcccaccctcgtctttcagtaggagccggatgtggcggataggacgtccgcgtcccctggacggtcgttcttccagatcatccacaggacgagcccgaccaggggatggagaagccgaggacggcccagccgaaaaggcctgtgtcggaggagttcctcccgtaggatgccgtcggctgcgggtatgcgggttgtgtgggcgtcgcgtagttcggcggagcccatccggattgccgggcatatccgggctgcgaccgcgcgtaggcgggccacgtcggctggaccggctggcatgccgtcggcgcgacccttatgcaacggtccgacgggatcatgcgtcatgtcgttccatgagggaggcgagcaggttcaggccgatgcccatgcccgtcagcgtcgcgcccgtgcgctccatgccgggatgcccgagcatgaacatgccgatcggcaggagcgtgccgcccgcgaaggacagggccgggaacacgggggagggggcgcattccacgtccgtatagtcgcggacggctttctccaattcgagcatccgcccgtgcgcgtcacgccatgcgtcgggatcggcgggcgggtacaggcgtgccgcgagctcgcatctgaccctcagacgggtcatctggccggccgtcgcggacgtgcatgggcgggcgagcgcgtcctccatgaccttgagcgcgtcccgggcgaggatgagcgcggcgtgctcacgccaatccacgtcgacggatgttgcgacgggcatcccatgtcgtccgccatgccaggggcggaacgccttggaggggatgcgtgccccgacgccttccgcatgcctgtggacgaggaatccgggatggcatgcggtcagcgtgtcgccgcatggggccgtccacatgtgggggcccgtgtttcgccatccggcgagacgcagccggaacgccatgccgcggattgggtcggtgccgcgccaatgccaggcgcccgggtcgatgagttcgagttcggtcatgccgcccatgatggtggtcccccgcgacgcggtcagcggaactggtccgtccacaccgtgtacgcctgccatgcgatcaggcccgtcagggcgagggtcgccgtccagaacacgcttccggccggatcgcgcatggcgatcatgatgagccggaacacgagggcgggcgtgagcatgagcgtcagcgcgaccgtatggaaacgtcccatgtcgtcctgttcgaacgcgaagccggcgtaccattccaggacgaacgacggcagtgtgcagaaggcgaggatgccggccgcccactgccatgcgtcgggtatgggccggatgcccgtctggtcgaggtagagggggatgggggcggccaggagcccaagatgccatagccagtaggctcccgggtgtgagaagccgcgatggttttcgtattcgtttcccgtcatgcgtgcgggtatgcgtccgcctgtcccttcccctgcttgtctctgggatggcgtttcaggccgcgtcgcatgccccggatcaggaggatgaggatgatggcgtagatgacgacggtctggtcggcgaccgtgccgccctcgaacatgaccttccatacgacggtcagggacggggtgagggggagcaggaggagggcggcgagcaggcgcgtccatacgatgcggccgcggacggacatggtccatgcgccgatccggcgggggaggcgtttcagccacgcccacaggcgggcgggcgtgtgtttcagccgatcgagcatatgagcccccggtatgcgtgcgcgtagcggagcgtgtcggccaggcagtgcatgacccgatggtcggtggacggttccatgccgggcagggccgcggggttccacatgcggaccgcctcgcagacggcgctgatgtccagggaccggtgggagcagccgtcgaggacgccgggcatccagctgtcgagcatgtcccggtcgaagcggacggtgctgccggcgggcaggaggcggaccccctggccgaggtgtcggaccacgtagtcgcgtgcggacagggcggcggcgaacatgttgggggcgctcgggtgcgcgcattcggcgagcagcccgttgggcccgtgcatgctctggatgaattcggacggtttgccttcccagtggacggtcgtgtggaacccgtcgtccaccggcttcaggtcggggccggtggcgatcatgccgatctcgaggatgggatccttgcgcgggtcgaggcccgtggtctccgtgtccacccacaggaggcggaccggcttgtcatcattgtcgtgtgtgctcatgcccccgggtatgcgtcacgcattccacgggtccgggttccacgggaggatgcgcgccggaggctcgggcatgggcgtcgcggaatcgggctcggggagggggtcggccgggccggcggggaacaggttcatgtcgagcacgtccatggtgacgccgagcgtggccgccatggcgcgcatcctcccgtagctcatggaggccgggtccaatgcgccgcgctcgtactgtccgatcctcgatccggtggtgccgagcgcccggcccagcccctcctgggtgaggccggcccccagccgcaatggtcggaggccgatgaggagcgaggcgacgaggcgcgccgccgcccgcgggtcgtcgggaagggaccgggaggcgtgtcctgcaggcgcgccgccgttcctggcatgcgtacgggccgtccatccggggccggcctcgacgtatgggcagtcgggcgggttcgacgggttgtcggcccggaggcggggcatggcgtccccgtattcggggtaggcccgcggcccgtccacgtgcagcccgtatcccctgagcagggaggcgagcccttccagcctgtccttgtcttccatcgcgggactcctttccctccggagcatacgggccgggggcgacgccgacagtacacagacggactgttttgcgcgaaaacagttcgtctgtgtactgtcggcatgcgggggcttcctgtcggacagtccgtctgtgtactgttttcacgcgaaacagtccgtgtatgtactgtcggcgactctcctccgtggaggccacggccgcatggacagtccgtctgtgtactgaaatcgtcgaaaacagtccgtctgtgtactgtcggccgcccctcgtcatgcccgccggggtcatggatccccccgtatcagggtcggaagggtccgaaaaacagtccgtcaatgtactgttttcgcgcgaaacagtccgtgtatgtactgaaatatccgaaaacagtccgtcagtgtactgttttcgcgccgatgtatgcatgtatgcatctgtatgcatccgggaatgcatacaaaaaaagcccggaaaaagcccggaaacccttataaataaaggaaaaagaaaaaccttctatctattgtatgcattgtatgcatccttttatagggtttcttttcctttccttcaatcctctataagggaatgatgcatacaatgcatacacggctccggaccatccccggaacgttggaaccaagccgatccgagaactatgatcgtatgcatcccgtcacgcatacagatgcatacagcccggccggaatgcatacacggcccggagcccgacggacgcataccccggcgcatgaccgaagacctcatattcgacgcgaaggcgctcgccatgctgtccgaaccccagggcgtctcgttcctgaccggcaaggcgggcacgggcaaaagcaccctcgtcaaccattggcgaagcacgctcgcgccgcgcaacacgctcaccctcgcgcccaccggcatcgccgccctcaacgtgaacgggaccaccatccaccggttcatccacgccaagcccggcgtcacccccgccgaggcggcccgcaagggacgcgagaacgcccgcgaccccctctaccggatgctgggcgcgatcgtgatcgacgaggtcagcatggtgcgcgccgacctcatggactgcctcgaccggttcctccaaggcgcacgcggcgacgggcggccgttcggcggcctcaggaccatactggtcggcgacctcgcccaactgccgcccgtcgtcgacgaacgccgggaagacgccgcgttccggcccggcggccaatgggacggcccctggttcttccaatcccacgcgatcgcccgcctgctcgacaagggactgctcgccggcgtcgcgctcgcccgggtgcaccgacagtccgaccccgtgttcgtcaacgcgttgaacgcgttgcgcgacgggacgcccggaccggccgcgctcgccgcgatcaaccaacggacgggagccccctggacgcccgggggagcgtcgtcctgtgcgcggccaaccggcgggccgacgccatcaacaaggcgatgctcgaccgtctgcccgccccgcccatgcgcttcgccgcccggacgggcggcgaatggaaccggaccctggagcccgcgccccgcctgctcgacgtgaagcccggcatgcgcgtcatgatgctgtccaacgatccgacgggtttgtgggcgaacggcaccatgggcgtcctcgagcacgtggacccgacgggtccggtcgcgaccgtccgcatggacgacgggacggtcgccgacgtgggcgtccacgcgtgggagatcgtcgtgccgcgcatcgtccgcgaccccgacgagcccgacaagcccgggcgtctggagaacgtgacggtcggctcctaccgtcagctgccgttcaggcccggctgggcggtcaccatccacaagagccagggcaagacgttcgaccgggtgcggctcgagctcggcccacgccccctgttcgccgccgggcaggcgtacgtcgcgttgagccggtgcacgtccctggccggcctgagcctcgaccggccgctcacggcacgcgacgtgaaggccgatccggcggtcaaaggcttcatgggccggctcgcccgtcccaggccgcccatgcccgtgcaggacagcctgttctgaccgggatcgaaaaccctgtcggaagtggacacactgctcgaatacgcgacggatcgcgaactggacatcctcaaggagcgtccatggaaggcatcccacatggtcgacgaggctcgccgcctattgggacgcccgtgcggcgcggatccgacggatccggatcggatccgcgccctgtccggatgatggtctaacgccggcgcgtcccgtgcctgcgcctgttgcggatcatggctcccgcggcaagcaggcctgcggcgagcatcgcgtacgccgccggcatgggatcgtccgggcggcctccggtgaacgggagcgtcgtcaacggggtgaccgtgttgcggaacacgggggccgtggccgtcccgtcgtaggtgacggtggcggccagccgcccgtcgtcggcgtcggcgatggtgacgcgcgcccggtggacggtcgtgtccgccttgcaggtggggccgcacgtgtccttctccacgatcaggtagtcgcgggacacggattgcctcccgtcgagatccttggccgtgaaccggatcggttggaacgtgatgctcccgtccgctccctcgcccattaccatgtttggtaggccccgatggtcggggccgggtcgccggttccggtatgactttcctgccctgtcgtcgatgatccgggggtgttgtcgccgggaacggggacgcccgatgaccgctgataggaaccaggccggctacacggacgcttcaggggcgcatggcgcaggtctcgtcgtaatgtgggtgcggcgcgggcgtccggactcctccgagcccgcggcgaccggaaaaccttcatgacgggaggaacgatgatgaccccggacgacatcgacgtgtgggtcggcctggacgtgggcaagagcgcgcaccacgcgcacgccctcgaccatgacgggaacaccctgtacgacaagccgttgaaacaggacgagaaggccatccgcacgatgctgggcaagctctccaagcatggccgtgtgctgctggtcgtggaccagcccaacaccatcggctccctgcccctgacggtggcgcggaacatggggatcgcggttgcctaccttcccggcacggccatgcgcaggaccgcgcagctgctgcccggggacgcgaagaccgaccgcagggacgcgcatgtgatcgcgtgggccgcgctcaagctgcccgagacgctcagggacgcgggcccggatgacgagaccctcgccgccctgaagctgctcgccggccacgacgaggacctcgcccacgaatccacccgccacgtcaaccgcctgcggagcctgctgctgcagacccaccccgcgttcgaacgcgcgctcaagggcgagagaatcacgcgcgacgcgacgctcgcgctgctcgaacgatacggcgggcccatgggcgtgaaacgggccgggatcgaggacgtgaaggactgggccaagtccaacgggcttcgcgccggccgcatcatcgacgacatgttcaaggcgatcggcgagcagaccgtcaccgtgcccggcaccctcatggccgagaccatcatcccctccatcgcccgcgacatcaagacgatcagggaccggcggcgcgaggtcggccgccaggtcgagaagctcctggaggaccaccctcttctcacggtcccggcgtcgatgcccgggataggcgtcaggaccgcaagcaacatcctgctcggcatcggcggcgacatcgccaacttcaaatcgtccgcccatctggccgcctacgcgggcatatcgcccgtcaccggccaatccggcaccagcatcaaaggcgaacggccctccaggcggggcaacaaacgcctcaagaacgcgctgtggcagaccgcgttcgtcgcatccaccaaacacccgccctccgtggcctattacaagcgcaaacgcgaacagggcaaacaccacaacgccgccatcatctgcctcgcgcgtcggcgctgcgacgtgatctacagcatgctcaaaaacggaaccctctaccaggaaccagccctcgtagcctgaaccgggccacacgggaaaggacgccggacgccaccggcagggcgaagcgcgcccacgacagccaaccggaatcccgacacgtcaactccccaaggagttgacaaaaacataggaacacccctgatcggatgaaacctggcgggtcctagtgaacgttgcaaccgccactggaacccgccccaacctcaaaagcatcggggggcctcccgcgccatcactgttcgcaaggggccgctatgcgggaatccggaaaggccatgggccgcgcataggcgcgccgcatgacgaggaaacgcattgtcagggagacgggcacgttcgcccggcatatgggcggcgggttcgtgcgcacggtcaacggcgccgcatggctgtacatgaggatgcccgaccagccgtccgtcacggacgcgtccggcatggaggaacgtttgaaggccgcccgccccatgctgtcgatactcggcgggctcgccgaccggacgccgcgcgtcccgttcgccggccgcaaggccatgaagggcttgtaccggcgcgtccacatcctcgcggtcagcggctcacgccccttcgaacccagccccacgctcgacccggacaaccggctgcgcctcgccgccgaacaggagaggctcgccgtgcgcgaccggttcaccctgttcggcgtccgcctgaacacgggcggcgggcagagcggcgtgaaagggttcctgaaaggcgtcgccgacgaggacgggtggacgcccgacgacgcgttcgaacacgaccttcaggacatgcgcgccctcatggaggacgcgggctgccgcatcccgtccgacacgtcgatgcgccgcgccatggcgttctggcccaccgaccgcaagcccgagggactgcccgtcatggtcgagcacgaccacatgcacacgttccccgactaccggtccgcgttcgtcgcggcccgcatgcgcgagaaggtcgacgactgccgcaaatggtcggcgagaatccccggctcctaccctttgaccgtggtcacgctcggcgtgctccccttcaaaggcgagaacaacaccgcccccggctccgactgggcggccggcctcctggacgcgagccggtgcggggccgtcgcgatcagcgtgaagggcctggtcgaaccgggggagatgacccgcgaacaattggacaaggacgcggacaaggtgctcgacaaggcgtacgagcaggcggcgggcggccgcaaggcgaacctgggcgtggcgcgcgaactggaggcggcgaacggcgaataccaggcggacggcaagccgtggcccacgctcgtccaggcgcacgcgcacgccgcactgcccatgatcgtggaacagtcgaaccgcgtcccctatccggggcacgtcgggttgaacccggaccggcaggaggccgcgttcgaggacatgcagatcggttccgacgacatgatcgaatacgatccgtcgcccctgtactggccggccccgatcctcgcgttcagcgggctcgcgggctgctccatgacgggcgacgattcggggcgcggcctggactccgacctgccgggcgcgttcgtgggcgtcacggaggcggacgggcagccggtctacgattcgccgttcgccgcgtccagacgcagcgggaaagcgatttccataatcgtgggcagcacagggtctggcaaagcggtttccctcggcacgcctctccccgtgcccccgcagaaaaggttccccgagggcggcctcgtgccgttgcgcgacctcgaggacggcgacatgctctatgcgcgcgacgggaagacctacccgattctcggcatgagccccatcggggacgacgacatgtacgagatcgtcctgtccgacgggcagaggatcaaggccagcggcgaccaccaatggtgcgcgtggacatggcgcgaccgcaacttcgcccgcaccggcaaacaccggaagagcctcgaacgccgcgaacgggtccggaaggcgcaggaacggctgcgcgccatggccgccggacacggcatggacgaatggtgggactgcgaacgcatctggcgcgaggtccggaccctcgtcgcgccgttcgcgggcaagggcggggagacgtgggtgaggaacgcgctccgcttcgccgacgtgccctcccgcatgcagcccggcaggacgcgcaacaggcccaggggacgcttctacgagcccgccccgctgctcgggcacatccgcgacaggtgggagcacaccgtcggcaacggtttcggggccgaagccagggcgctgcggctcgccaggctcgacgggctcatcgccgaccctcccgccgaaccgatcgacacggcatggctcctggaacggttcggggacctcggcgtatcgaaaagcgcattcgagtccgccctgagatcctacgacgggccgcgggcggagcctgcggaaacggcccgtcgcatgcgcgtcgcatggcccgcgccgctcgccctcgcccgcctcgccgaccgcatcggctggcggtaccgggacgaacccggtgccggacacggcgaacagaccgtcaccacccgcgagatgctcgacgaggggctgctcgccgacggcgggcaggcgaactgggcgatccgcgccacggcccccgtccagggcgtccgcacggacctgcccatcgacccgtggacgctcggcgcatggctggccgacgggtcgaagaccggcggcggcttcgcctccgacccgtcgaacggcgacctcgaccacctggagaaccgtctgcgaaccgccggatacgaggtcacccggagtacgtacgacccgcagaagacctacgcgaaacgccttgtccgacagctccgggcgaacgggttctacgggaacaagcacatccccgaaccctacttccacgccgacgtcgaacagaggctcgaactcgtgcgaggcctgctcgaccaggacggcgccatcgaccagaacgggagcgtcgagttcacccagtccatcgaccacaagccgatcgtcgacgggctgacccgtctcctgcgctccctgggcgtcgtcgtccacgaggccacccgcacgaaggccggatacacggcggacggggaacgccacgagacccgcgaccgcctgcgcctcacgttcaccacaagcctgcccgtgttctccctgccccgcaaacgcatgcttctccccactgaattgcgcgagacctcgaaatggctgtacgtgaaaggcatccggccgatcgccgactgcccgcaccgttgcctgagcgtcgccagccccgaccgcacgtacctgatcggcggctacgtgcccacgcataacacccggctcggcctgcatgtcgccgcccaatgggggcgcctgcccgaccccgagcatccgggcatgcagatccccgtcgtcttctgggatccgaaaccgaaatcatccgacttcgaaccgttcgtcaggaaacgcggcggcgtggtcgtcaagctcgaccggccggaggcgcgcggcatcctcgacccgctgcgctgcatccccaggcatatgacggacacgatcgtgcagacgtcggtcgcgatgctcagccagatcacgggcggcgcgaacccggaccgcgcctgggagatgggcgtgtccagcatcgtcggctacggtttgcgccacggcgccgactgtctgggcgaatgcgtgcgcctcgcctgggaggagtatgcccataggggacgggaggcgaaggacatcgacccgctcgtcgaaaggatccggcccgtgttggaccgtgccgtcaagaacgacccgttgatgccgctcatctacgggacggagccgggcggacgccgcctgtccctctcccagggcatgaccctgatcagcgcgggcgcgttgaacgtgatcaccgacaaggagatccagggcgcgcccaccgacgtgcagcgctgggtgtgccgcatggccgcgctgggcgcctcctgcctggtgatcggccgcaacggggccgtcgtcatcgacgaggcgtggagcctgctgcaggaccggttcggccggagcgtcgtcgaccgtatgggacgcctgtcccgcgaccagcattacatggtgatgatgctctcccagaaggccgacgagttcgtggacgcggggatcgaggatttcgtcggcaaggtgtatgtgctggccgtgggcgcccgcaacgagggttcgggccgcgacagtcaggcgcaggccgcctgccggctcgcgaaccagccgttggacgggcgtatgcatgcgcgcatgatgcatgacaagtatgtggatccggattcccgcgccccggactgggagagcctgtacccgttgagggatccggagacgggcgggctgctgcgcgggtcggtcgcctacctgcaggtgggggatgcggcgagcgcgatacccgtggtggtgcgcgtcgacggttccctggattaggagcgtcgcagggtgggcgcgtaggcgcggcgtgtccaccatacgccgtgcccctgcgcgtccatgctgccgttggcgaacgccgtgtcgccgtcgagccaccagttgacgcgtgtcccgtccccgggttcgacgtgcaggttgggtgtgtggatgccctgcccgtcggggtcgaacccgtggtcgcgcaggccgtcgatgatgcgggccagggtctgcgcctggccgatggtgagtcgttcgtatgcgtcgttcatggggtcgggtatgcgtcacatgctggcgtccgcgttgccgggcgccggcatgggcgtgggtgtcggctgcggggccggcgtgggcgtgggcgtcggcgtcggctgcggggccggcgtgggcgtgacggcctggggcgtgtcctgcgcctgggatcgctcctgttcggcctcccgtcgcgcctccgcctcctgttcggccttccgtttcgcctccgcctccgccttctcctcctgttcggtcttctgctgctcctgtccggcctgcttgtcgagccgtccgaattcccgttccttcgcggccaggccgtccgcgtccccgggcgcggtctcggcgagcgtttcgagcgcggcgagcgtctgccctccggccttcggatggtttttcctgcttgccgcgatccggccggtcaggtccctccatgcggcgtccagcgcgttccggttcgcctcggcgagcgtgcgggcgcgggtcttgagcgtgcgggcccgggccttgagcgtgtccgtgtccgccttgcaggacgtgtcgggcccgtcgccgggtttcacgccgagcgtcttcgcctgccgggcgagcccgtcccatgttccggcctgcgcggtgagcgtcgcgcacgcctcgtcgtgggccttccgctgccggtcggaggcgatgagcgtgcgcgtcgcgacgacgccgcccgccaggagggcgagggcgaggatggcggccgtgccggcgatgaggatgcggcgcgacgggatgggccggcgtgcggaggccgggacgggctcccgcatgccgtcgtccggcccggccgcgagagtgtcggtgccccagtcgaaatccgcggggatgcgcacgctggtgccgggcacgctgacgagccgcggcacggggtcgacggcgtctggtccagccgtcgtcggatcggcgtcttcggatcgcggcccgtccccgccggccatgccccaccagtcgtcgtccgcgtccatgtcgggggtctcacccgtccccgtgcgcgccgggatcccggccggcgggcccggcatggtctcctcggcgtccatgccccaccagtcgtcgtccgccccgtcgtccggcatgggatcgggcgcgtcttcggatcgcccgtccctcccgtccatatcccgtcggccgtcgtccacgccgaccgtggtcgcgtccgccggatcggggtccggtgtcgcgtccgccgcatccgatccgctcccggaatcccaccagccgtcgtcggcgtcgggtttccgcgtcgcgtccccgtcggccggcttcgcgacgggttcggcgagaccggccccgggatcggcggcgaaaggattgaacggcatgcgcgacgcctatgcgcgcatagcctgcgcgcatgagaccacgatcgcgcaccctcatagccgtcgccacgctcgccggcatcatcctgaccgccggatgcgcgcggcagaagaccgacacggggaagaccgggacgaaaccacaggccatgacggccacgcccgacgcgaagaccgtcgaacacgccgcggcgttcgagagacgcctgcgcgaatggggcgccgacagcaccatccgcgccgacacgctcgcgcgaaaggacgcgggaagcgtgctcgcctcactgcacggcacgccgcccgcggacgatccgaccacgggcgaaaacctgcccgcccgccaggcggacgcgggcccgcacgccgccaaccccgcatgccgcgcctaccggcggctcgaccaggtcggcgacacgggcgaacgcgcctggtgcgcggacgggctcgacgcggccgcatggctcgcccgcatcgcctgggggtacgggagccggtggacggacgggccgcactcggccgcggacgggacgggcgtacgcgtgaccggcaccgtccgattcatgtacctggccggcaaccagaacccgaacacgttgcacgtggacgactggtgggggatcacacccacctggatcgactatccggtggacgacaggctcacggtccgggacgggcggatcacggggatccgccaccggcaggccgacccctggtggatcgacccgtggctcggcgtatgggacacggacatcggcgaccggatgaacggccggggaagggtcggcatccccgtgaagggcgaacccgactgggggacgctgaccggcgacgggctgaccgtcatcccgcccgaaacccggttcatggccgacgaaaacgtggacatgagcctgtgggggagcatccccgtgcgggtcggcgacggccagtcctgccagaacccgggctactgctagagcttccagctgtccttccagaagaacccgttgccggaggccgccgcgtattcgcctttcgtcagccaacgcgcgttgtagctggtccacaggcccgcgcccccgtcgttgaagttgccttcgctgatcatgatcttccagccggacggatccttgtccaccttctccacgaacgcgacgtggttgttgccgccgccccagaagcagacgcccgcgcccggtctgggctcgtcggaacgcgtccaccccttcgtgcccgccgcccagtcggacagttgtccgccgttcatcgtgtgcgggttgatgacgtccccgtcgtgcaccagccatgagcgggccagccaataccagtagcactggtagttgcccgcggcctgccagtcgaggggaggggcacccatgtccccggcctggcagatcttcagcttcgtggcgcacatccacccgaagtcatgcgtgttcgtgggcgcgccgcccacgtccccgtatttcgcgttcccgtcggacgaatcatccgcatccgcgtcgcatgacgcgtccgtgtccgccgtgtccgacggggacgcggcgtccttcttcccgtccggcttcgattcggccgggaagtcgatgtcggcgagctccttcgaatcgtagtaggcgcgcgcgtactgctcgcgttccttctcatgccggtccgcccagtaggggcgcccgtagccggccatccaggcgacggccgcgtcctcgggattgtcggcctgcagccaccacgtgcgcaggtcgtcgtcgatgggctcgtgcccctcggccttgaccgcgtcgaggaaatggttgttgaaatcggtctgcgcggtggcgacgagcatgcggatctgcacgtccgcgtcggaatcctcgcccgacacgtggttcgcgtccatccagttgcggatcttgcttcgcggcgtccactggttcagcccatagccgcgcagcatgggatcgggttcgccgatctgctcctgcgcggggttcatgcccgattcgaactggatgacgccgagcacgcccgccgtgctcgccttcgaatacccggccttggcgaacgccctggcgagggacgcggccacgtcgttgggcgtgaccgtcgtgtccgtgtcgtccgtacagtcggccgtgtccgccatggtggccgcggccatggtggtcatgcccgcgggcgcggccacgaccaccatggcgaacgcgagcagcaggacgagcaccggcgggctggcggcgagcaggaggggcaggagacgtttcatacatgcccggctatgcggccgggacgcatacaaggccggacggttgaccatcgagaaaggggaccacacccatggacgagacgatcgaggacatgcgccgcctggccggcggcattgaggcctggcttgaggacaacgagtacgatcgacgccgagcaagggcgcgtcatgccctgaacctgttcaaagaggcgggcgtggagccggcccgcgtcgcccaggcggcggacccgtcgcatgcggccgccctggcgctcggcctgtacgacacgtgcgtgaagacccatgacctcgagcacgcgcgtctcctgaaccgggtggcggcggaactcacggaggccgtgtgaacggggggcgcgaggcgcgcatgtggccgggcgtgacggtcgcggtcgtgctcgccctgctcgcgttcatcatcagcttcgacgcgttgcgcgccgtcgggctcgcatgcgggatcaacgcggcgctggcgtggatgttcccgatcatcatcgacgggtcgacgctcgcgttcacgtgggcggcgtgggcgttcaagacgcggcgcatgggcaccctgtacccgtggctcatgctcgtcctgttcagcgtgatcagcctgatcggcaacgcgctgcacgcgcatcccgtcatggtgaacgggatgctgctgcccgactgggtgccgccggtcatcatgaccgtgccgccggtcgccctgctcgcgaccacgcacatgatcgtgctcgccgcgggccgcacgttcgaccggcaggccatggccgagaccgcggcgtcggacccggccgggccttcggcggctccgacgccggaacccacgcccggaatcgcgcccgaaccggacgcgtccacgccggacgaccccgcgcccgccatcgagacggatcacgatacggaaccgggaccggacacgcccgggccggccgacggggagccgttggggcaacgctgggcgcaggccctcggcgacgccggggacagtctcgccgacaggatgctcgccgcgcacgacgcgcgcccctgacgatccggaccgaacaaaaaaaggggtgtcgcgcccggacggacgcgacaccccttttcccgcatgtcggggacgatcctaacagacgggcatcaccaattgctccaccgcggaatcgtcctgttcgaacaggacgggcttcatctcacgggtcttcaccaccgacaccctgtccgcatccatgcccgcaagcacggtcagcaggtaatccgcgttcagtttcacgttcacatcccccgtgatgtccgcctccaggagacgcacgccctgcgaatccgcatcctgcccgtcgcccgcataccggacacgaagcatcccgtcccgctcatccaggatcagcgggataatgcccatgcgcgagtcgaagcagacgcttttcagcatgcgcgccgcatccatcagggcgcgcctgtccacgaccgccacgcccgccggctcctccggtttgtcgaacaggcggtccaccatcggatactgtccggcggtcagcacgatcgcgtccgtgaacccgcccgtatccacgaccatcatccggtccgtgaacccgatcgcgttcacccccttcgcgttgcgtttcacccaatccgcgtccgccagccattcgccgtccggcatgccgccgaccgggatggaccggcggccggccatgtaccggttcgtggccgtcgccgtcagcaggccgccggccgcgacgaatctgacggacgcgaggaccggctggtccctcgtgccgcccgcctccggggcgacgctgccgcacaacgcggcgtacgcgtccgcgtccacgggcaccatccgctccggggcggccggttcggccggacgatccttctcctcgccgacacgcatgcgcagcgacgcctcgccgccacgcaacgtcagatacccgccattcgtctccacgccgatctcgcccgacggcatcgcgttcgccaacgcgttcagccacaggcccgacacgaccgcggaacccgcctccaggacggtcgcgtccacacggccatgcgaccactggctgtcgcccgccgcgctgatcgccaggccgtcatccgcggcatccaacgcgacatacgggttgtcgcgctccagcacgcgcgccgcatgcgcgaccatgttcgcgaactccctcgcatcgaccaataccctcaccatcatgtcctttccacacgaaaacaacggtttgcgacccgggtatgcgtcacacgggcgcgcccgcgtcgaaatgggggacggacaggatcatgggaggcaggcccgccatgtccgggggagggccgaccgtgcgcaccagcaccgtgtgcaacggcaggccgcgcaccgtcgccggatccgacccgaccgccacggcggacgggcccgccgtcagatccgcgcgcaacacgaacgtgccgaccgtcatcaggccggtcaccgaggcgagcagcccgccctccaactggaccgcgttctgcgtgcccgccaccagctgcacgccgtacgcgcgccccttctcacgcagccaggcgaggatgtccgcgttgccgccccccgtgtcgccgtccgcgcccaacacgtccgtcagctcgtcgaccaggacgcgcaccgcgcgcccacgcgcctgccagcccgcgcaggaggcgacgatctcgtccttcaggccgcggaacaggagcgcgccgatcagacgccgcgccccgtccggcagatccgcatgccggccgtccacgccggcccggaccgcggcgcccaggttgaccatgatgcgcacgtcgcccgcatgcgcggaccggcggatcacggacgcccaggacaggacgcgccgtcccggcgcgaacacgcggcccgcggacgcgagcacgtccatcttgttcatgggcgcgcgcagcaggccggcgagctccccgtcgcggatcttcggcgtccccttgtccgacacgccgccatgcaatcgctccaccgcgtcccgaaccccacgcgtgtcgcacgcgaacacgctcgcacggcccagcatgcgcgcgtccatcaccccgttacggcccaaaaggcgcgccgcatattcgacccagcccgacgggacgggaacgttgcacgcgttgcaccgcgcccccagatccgccgccgccagaccctccagggcgacgaacgtcgcgtcacgcaactggatgcgcgactgggggccgatctgctggacgcccaacgcggcctgcatgagatccgcgaaccggcccgcacgctccacgttcgacccggcgcccagcaggtcgatcatcggcgttgccggatcgttcacgtcgatgacgagcaggcccgggatgagacgcttcagcacgggctgcgcgtccacgcccttcgattcgaagtcgacgagcacgtcgcccgtccgatgccggccgcccatccacccggccaccccatgcatcatgttgcttttcccgccgccgggctcgcccatcagcatcacgccgccgtacaacgcgtccacgctcatgcgcaccgtgcgccgttccgcatccacgcccaggacgggaccgtcgcacccgtccaactggtcgggcatgaccgtcagcgcgctcaccgacgcgttgcgccggcccgacggggccgccagggcggccagcgcgccgcacggcaacggcagcgtggaccgttggaacgcgtacgcgtggacgcggcgcttccggcccggcccgtccgcgttctgatcgtcgcccgccatccgggtcttcaggtcggcggcgcgcgcccaccgtctgcgcgcacgccaccagtaatgacggggcctctgggacaggtcgttcacgggatcacggcgcagacgccagcggaccgtcgcccccgccgtcatggcgagcatgagcagaggcacggccatgagccagccggccgtcatggacgggagcatgacggccggcacggacacgaccgtcaggaggagcatgcacagaaggaaccccaggccgggacggctcacatgcgcggacaggcccggcaccagccccaggttcaacgcgttcgccgcccgcttcgcctgatccatcgccgtacgcggatccgcgccgcccgccatcacacggcacgcgcccaacccctcgcccctgagcttcgacgtgtccgcctgcatgttgtactcgtcgcccagccagtccgacaggcggcccgactcgacccagccgagccggcgcacgttcaccacgatcaccgtgtcctcgcccgcatccaggcggggacgttccaggctcggctccccgtcgcgcgccgtacgcgccagggacgcgctgatcggcacgaacgcgtgcgcccacacacgaggacggtccagcacgtccggccgcccgcacgcgcggatcgacgcgttcgccgcacgcgctaccagttcgcccgccttctgcccataccggtcggacacctccacccaccggcgttccccggccgccaccagacggcacccgtcgtcatgcctccaccagtccagccatccgggacgcgacgacaagccgatcgcgtcggccatggccttcgcgtcacgctggaaccccgcatcatcatccgtctcatccgcgcgcggcgcgggaaccagttcgaaccacatgccccgccctatgccccggaacgcatacgcgcgcgtgaaaggaggccggcatgcgcatgcgcggcaccgggccgcgacgcgcatgccggacgcatgatgggcgaatggaaaccgaaacacaggatggccgacgatccggacgccagggaggagctcgaccggcatgtgcgcggcatcgactggaccgacagggccgtcgaattcggatcccgggaacggatgctggtcgccgcatggatgcagcagaccgatctcgtggcaggcgagatgcgacgcctctacccggtcgaggagcagcgggacaccatgacccgctgggtcatggtccgcgtgttcgagaagatcaccggcacgccggtcgaatcgaaaagcacgcaatggaactggaacggcctgtgggatccgaccgaacccacgtcgttctgcggatgggtgcggcgcatcagcctgccgctcgcccaatggaacgcgaaacgcgtgctccgttccgggacggccagcgcgagcatgttcgagaccgaggacgggcataatcccgtatacgacgacgcgtcgagcacgagcgtggccggcggcaccgtgacagccgccccgttcgaacgcaaccccgcgttacgcgtccccaggcccgtcggccggatcagggagcagatgatgcgcgccgtgaccgacggcacatgcgaggacgcgatccggatcgcacacgagacgggactgtggcatcacacgctcgacacgctcgacacggacaccgcgtgcacgctcatgctcgcccccatcccgcaggacatggcgcccctcctcgaacacgacccgcacccatggtccggcatgcatgacgccgtccgcctctactggccgacacagaccagccgccgacgcgtctggcagcccgacctgaaacgcgccgtccaacgggtcgccgccgccaacaacgtcaccgaattcgacgtgatcaccgagctcggcaccatggccgcccgcctgatcagcgactaggagcgtacatgcgcgaacgggtcgggaccggacaggcggaacgcgtgcccgccatgcgcgtcacgcatgtccaggctgatggcgagcagccatgcggcaagcctcgcgccgcccgtccgctcgtccaacagccaggcgagcgtcagggatccggcgcgcgccccatccaccccgcaccattcggccgcgatccgcgcatgccgtttgcatgtcgccgtccgattgtcgaacgcggcctgttcgacacgccagatgtgcaggcgcagcagcggcctcgatcccaacgcgtcgcgcagcaggtcggacagggcgtgcgtgaaatccccgcgctccgccttcgcgcgcaccgcgaccaacgcctccgcgcggaccagtcccgcgtcacgtgccgcctggacgccgctcatcgcatccgggaccatggcagccatgaccgtcccccctccgccgggttccatgcatccggatccacgcccatccaaatgcaggcgccgcgcagccaatccggttccatcccatgcgcccacccgcacgcatgcgagtcgatgagacgacggctcgcctcatcccactcgtccacgcccccgtattcggcgagcccgtcgagcaatgcccgccaacggcgtgccggccacggcttcacgccgggagacgcgaccgccaccgcgcggatccggtccggacggcggatcgcgtccaatgcggcaagcccgtcgtccgtctgcgagccggactggcctatcctgaacaggatgcgcgcgcccccggcctcgaccatgggacgcatgacgccgcccgcgaacgaaacgggatcgtcccacaggcgcccgtcgacacggtccgcgtccacgacgaccatgtcgcacatggcccgcagtccgatgatcgactccaggtagtcgtgggtcatgtccctggaatgcgggtcggcgggtccggcgagcagtgcgaacatgccgcccgtatccctgggcctgacgagcgcggactgcaatccgtcgacgaacgcgtattccaacgccttcgaatcggggatgttcagccaggcgcgttgggactgctgtccggggttgccgtcgacgagcgcggtgcgcagccgggcggagccgagcgcgtgggcgagcatgcgggcggcggtgcttttgccgatgccgccggatccgccggtcacgaacgtgatagccgcctgagtcatggcgggcggctatgcgcccccaatatccggttttttgcaaggaaaaatgattcctccccttgatgtgatgctgtttggtggtgtggtgtctgccgtggtgtggtgtctgttgcgtgtgttcttggtgtcggtgtcctgtctttttttcttttctgatggctgatgggatggtgtcgtatcgtgttttcctctcctgtttttcttcttttgctcttttttctttttcctcttttttcgtcgttttcgtccgcggcttgcgccggacgtccggaggccgcgccgccgtctgttcgacggggcgtggcatgatgcgtcgcacgcgcataggggcggcgtgacgatacccgtctctggattgaaggagcaatagcatgtcgatgttcgatggtgatcggggttggaacggtttcgacccgcagcccgtcccgcagccggaacccgtgccggccgcgccggaacccgtgccggatgttccggccgtgccggaaccgcagtccgacgcggggccggcggagccgaaggccgtggaggcgaggccgcgtccgaaacggtcgcgccccgcgttcgcgtggaccgcggatcgggtgcgtcaggcgcgcgaggcgctggccttgctggacgacgggaggacgcgccgcgtggtcgcgtccgccgtggacgtggacgcggacgatgcggaccgtctcgccctggccgtattgaagggtggcctgtcggcgccggtcggcctgcttgtcgcatggcatgacgagacggatccgctgcgacgcgcaatcctggtcggccaggcgttggagaaggacgtggcgggcgtcaggcgggccgccaggatcatgctcgcgttggatccggatctggcgggttcggtcaagccgacgggctcgtcgcccaccgacttgcagtacgctttggcgtcggccgcgccgggcctggatgtggatgcggtcagggggttggtctgatggtgatgccgggcatgctgtccgcgtcccggacggcgcgtcttttggacgtgccggaatcgttcctgggggccttgtccgagcatcatgcgctgcccatgcccctgtcggacggctcgtatgacgcgcgcatggtgagggtggcgatggagcgtctgccgtggctgcgccgtctgggcgtcccgttgtgcgacagggagctcgcacggatcgatccgcggctgaccgttcccccgttcagggggttcgagtgggcgtcgcgccggtactgccggctgtgggagtgtttggatcatgcgtgggggctcgccttctgaaacgcgtccgcccgccggccccgtttttttctggggtggcgggccttttccgtttccatgggggacgcataagcgcgcgtatgagtgatggaccgttgatgacgttcgacccggcggcgggcgtggcccgtgcttcccttccgcggcccggccgcgcctcgttcagcatgctggacaagtggatgtcgtgtccggcgcgctgggcggcggagaagctgatgccgaaaccgcggttgtggggcagtccgctcgtcctgggcggcatcgtgcacgccgcgttggagctggcgtgcgccacgccggacgtcgtcgcaccggattggcgggccctgtgcgccaaaggcgtcggcgtggagtacgggcggtggaggatgcggggttggggtgacgagccgatcccgtccggcgtggcgatgccggacggttcgcccgccatgcaggatgattgggtggctgcggccgcgttgaagctgtcgggttttgttttgacggacgcgttgggccgcgtgttggagccggccgcgttggagcaggatttggaggcggatgtcgacggcatcccgttgcgtggcgccgtggactatcgcgacgtggacggcacggtggtggattggaagacgggcggcacgccgaagtaccgtgacgctcgccggcggcatgcggaccagctgcgcctgtaccggctgatgctggatgcggacggcgtgtgcgaggtgcgtgcggcgcgtgacgtgtatgtggagcatcatgcgtgggcggcggcggacctgtcggatgcggcgtgcacggacaccgtgtcccgtttccatcatgcgtgggacgggatcgtgcgtgcgacgggcgcggacgggtcgggcgtcctgccgttgaggccgtcgggcctgtgcgcctggtgtccggtggcgcgcgcctgcccgctggcccggatcgtaccgtcgggccagcgggacgccttgtcgagcgtcggcccggacgatccgcgcgtcgggttcgcggggacgcataccggcggttggaatcatgtggggaaggagcctgtgatgttggatctgttcggattggacgcccccgtcgcggaggcgaaaaccggggaggtgaaacccgcggccgtggcgcgtccgcgcgccggcctgcccgaaccggcgccggatccgtgggagacgccgcaggggcgtgagacgatggaccggtggatgggttcgggtccgggtgaggatccgtggaacccgacgccggaaccgaagccggagccggccgccacgccgaagccggaaccggaggcggcggagccggctccggcggagaccggggtgacgctgacggaacgcaaaccgtacgacccgtcctggtcgaacggccgggcgaacgtcgccggatacgggttcacccaattgacgctcacgttcgcccgcgccggcctgctcgccgacgggcatgcggaacgcatccgcccgatcgcgctggaactgctgcgcgtccaatgggcggcagcgcgcaaggcgtatgggccgatcgtgcccgacgtgcccggactggccgacggccggccggaacgctccgccctgttcgcgtggctggactccacgctcgcccgcgacgtggaacgcgtgatccgcctcatcctcgattccgacggggacggggaggggacgctggacgcccggttggaacgcatccgcgcggccggccgccgcgcggccctcatgctcgccgaatccacgcgcatgctgcgcggggacgcatagcgggcttcggaacattacagaccttgaacggaaaggaagacaacatggtccgattgaacggtaagggcggcgtcgaatacgcggtgcgccgcgacacggacggcgcctggctgtacgacgccgaccttgacggcacggacggcgcatgggagccggacgcgcagaacgccacatggtgcgcgtccaaggaggacgcgttgcacgtggccgacctgaacggcctgaccggcgtggactacgcgctcgcggacggctgttccctgtgggagcgcgactgggtcaacgaggaggagatcggcgaggactgggagccggccgaaccccgacccgtcgcatgacggaccgttccggcgcaggaagggggccgtccggtcccgcaaccccatcggggcgagcggggatcggacggccccctcttttcttccatgatcgtcacgcgtccgcgtcccgtacggcccggtactcgtcgacctcacggtcggggatctggtagaccgcgtggatgaacgcgcgcatctcggtgagccgtttcggcttcacgtcctccatgagccccgtctgcctgctgcgacggcggcgcgtgtactgggtgtgcgcgcgccgcgcgtccatggcgtccatggcgaggaaacggacggccgcgtcacggctcatgcacttcctgtaggcgagcatgcgcgccgcgttgccctgaccgcctttgcgccggctgtacgcgtcgagcagcagggcgccctccctgtccgtcctcttctggccgatcagcccgatctcgaagttcacgtcgtcccaccggtcgtccgggttcgcgttgccgtggcacaggttccagaacgccctggcctggatgtccggatcgtccatgcgggcgaacacgtgggccatgcggtcgcactcctgcttcgaggggacgccgtcggtcggctggtagagcatcctgaggtaggcgcgggacgcggcgcccttcggttcgggcatgatcccgctcttgcgcttcccgtcccggtcggtccattcgccgtgcaccggtttgccgtccttgtcccttttgatcttcgtgtagttgatgaacttgaacgcgctcgccttgtcgtccgggtagccagcgcggatcacgttcgcgctcgcgttcgcgtcctcgtaatgcagttcgcgcaggatccggtccgccgtgtcccggtcggcgcgccgggcgaggctcgacgcgatcgtggatgcgggcagatacctgcggttcgggctcgagtcgatggcctgccggcgtgaatacgcgttcgcatgacggttcatgttgcggatgaggcgacgccggtcggcagccgggtattcgcccaggtccgtctggaaggcggcgcgcaccgcggcctgcgttttcggatcgtggcgcatcaccgtcgagtcgagtccgggcacggacggatcctcacggaacaggatgttcccgtccccgtcgtacaggatcgcgccgtccggcccgtattcgacatggtcggccatgtcgagcaggccccgcgtctccgacgcgcttttcacctgtgtatggtcggtcagcgcgcgcatgcgcatgctttcgctcgccatggcgatcagcgggtcgggcggggccacgtcgccgcccgcatccccgcccgtcctgtcgaacgtgcccgcatacccctgcggcagtccgctcggcctgtggctccgcccgttcctgtccacgcccatgatggctcctttccgtggtcgcttgcggggacgcctatgcgcgggccggcataggcgcgcgcatggcataccgtcggaacggccggtcgcggccgaaaacgaaacgggacgaaccgtccagcccgcacgcgttcgtccgtgtcctcacgctcgccgtcgcgctcatgctgaccgcgttccgcctgccgggcatgaccgtctggtgtctgggctggctggcggcccgtctgacggcccggcgtcccgtcctgtccggcaagggtttgaacggccggccggcgcccggggacgagagggagcggcgcatggaggcgtcatggcgtcgcgcctcccggtggctcgacggcgggctgtctcccctgtatgcggatgcgatgcccgccatggcgatcgcatgcctcgactacgggtggatatcgtctgcgtccggcgcgtggcgtccgatcatggcgggcgtggacatgctggcctgctggctggccgtcatgggcgtcggccagcagcggcgtgacatgacctgcaccgtgcgcggcctggattcgaacatgcggcgcatgcgcgtcagatgggcgaggaaacgactgccgtggatactcacgggactgggcgcgggactcgtcctcggcgtcctccaatccgcttggacgggcgtctggtggcccatccccatgctcatgtgcctgggcgccgccgcccccatgtggcccgcatggagggcgaaccggaaacgcttccatacggattacgagagccgtctcatggtcggccggtggatcgcgggcctgaacaagccgccgttcgacgcgctgcccgggggcgcgcacgacacgcgtgtcggcgcggacgggtcgcgcgtcttctcattggacgtgtcgaacgccgtccaatgggcgaacgattcgaccgtgaagacgttcacgcccgtcacccaggcggacggcatgctcgcgggcttcgcctacatgggtcgcgacaggacacgggtcacggtcgccgtctgccccgcggacgcgcccgacccggcggacctgctcgccgaccggacgatgctcgaagcgcgtctcacggtcgacgagacgcgcatgggcgccatgtacggcgcgttccccggacgcgtcacggacgtgaggaccgtcgccacgagggacggcaggcccgcggtccgttcgttccgcatcgacgggtcgaacgccgactgggacatgatctcccgcgactggctgaaaggggccgcgcccggcgcgttcggcgactggatgaacacggagaacatactggtgaccgcggatcctggcggcgggcacggctgggcgagcgtggacgcggactgggactcctatgaatgggacgtggagacgatgcggacgctcatgtccgacacgctgacccgccgccatgacgatccgggccgctacatgcggctgatcggcgaggacaaacggttgaaatcgatcatgtcgggcggcctggaacccgtgaaactgcccgcccccgaaacgatcttccacgacaacacggaaaccatcgccgatccggccggctggcggatcatgtcgtatgcgatggcgataggccgcgcgtacacggccgccgactacatgcgttcgaacctgcgcggcgcgttctcggaaagcccgatcgcggacttcctgccctggctggaaggagaccggccccgcgcccgtctcctccagttcgtgcacgcgcccaacacggacgacaaccgggggctgccggacacgctgcgcgctttgaccggcgattcgagggcgcgcagcctcctggcgcgcgtcatcgtgtcgcacgcgtgcgcgcaggtgttgaaaacgcctccgacggtgggcgccgccacacagttgggcgtcggccggaacacggtgtggcggatcccgatccgtctggagggcggtctgaccgcgtcggatctgcgccgcgtgcaggagcggctgaaaagcgtgatgggcgcggacgagacgctttgggaatggcgggaccaggggcatgcgatcgtgtgggcgggcggtcggatgagcatggacgcgcgcgactggcgtcgccgatcggatctggatcggatgatccggctccggttggacgaggcgtgggccgcgtccagggcggtcggcgcggacgggcggcccgtgaccacgttggatgtgcgggacgggggaggccggctcgtccgcgtctcgttcacgctgccggccgggcttggcgtggagggggcgctgacccgtctggacgcgttccgtgcgacgagcgggttcatgtacgcgcgccgtgtgaacggggatgcgccgttgacgctgctcctgtcccgttcggatccgctgccggaacgggtcatggcggactggcggctcatgggcgcggaaccggattcgacgggcctgccgttcgcggtcggcgacgacgggagcacggtcctgttcgacccgcatgacacggcgcatctgctgatcaccgggcagacgatgagcggcaagacgagcgcggccgtcaccctggtgaacgccgccctgttgcacggctggcaggcgttcgtcggcgacccggtgaagtcgggcaacgatttcgcgcccgtgaaaggcaaactgtccgggttcgcgaccgggttggcggagtgcgcggccatgctcgactggatcgaccgtgaggggcggcgtcgtctcgcattgcagaaggagcatggggtggagaacatcgacatgctgccggatgacgcgcgcccccgcaggatcatcgtgttcctggacgagttcgtgagcctcctggaactgtcgaagggcatgaaaaggaatccgacgggcgacccggatgtggacaacatgatcatgatggacgcgtggcgcgaccggctgaaacgccggatcggggcgagcgtgagccatatcctcacccagcatcgctcccaggggatcacgatgatcctggggtcgcagatgatgaacgcggagagcatggacgctttgccggacgcgggcctggcgaagaaccagatgggccgcctgttcgtcggcgcgggcgacgtgagggggaacgtgagcgcgcggaacgagagggaggggaaccggctgatccgtcaggccatggattcgggcggcatgccgaaaggccgcggcctgtacgagcgtatgggtcggggtttgcagatggtgcaatgctggtggtgcggaccgatcccggacgtggccgctcacatgcggggcgtgccggacgtgacgccggtcgactggtcggatctgctgccggccaaaccgaagcaggtgggcgtcgtcgaccaatcgtcggacgcggacggggatacgacggtgaacgtcgccgcggacccggatgacgatgattgggtgctcgactagggaaggcgtacgggcggcaggagcggcctgtacgccgcattcgcatgcccgtccggatcgtatgcgcatccggggatcatgccggtggcattcgaggatgcgcgccggcgtgacgcgcatcctgagcgcgcatccgggcagttggccgggcgtgggcatgcccgtcggttccgtgtcgatgatggtccgcgtacgcccatgagaacgggtcggggatcgcccggtccgcgatgtcatggcggatgcgcccgggacgcatacggggcatgccggcgggtccgtgcgtcgaatgatgagacgggaccgtcgatatggtccacttcctcctatgatggagggttggataaggaagtcccggaagaaaggattcgaacatgtcacgcaaactcacatcagtcgcggtggccgcgacggccacgctcgccacgctcgccgcccccgcggtcgccatggccgacgagaccacgaccacggatcaggccagtcaggcgatcacgcaggcgcaggacagcgtcgcgcaggcccaacaaagcacggcggacgccaatcaggcgatcgcgcaggccgcgcctaccggcgtgaccgaagcgcaggcgaaggccgacgccgccgcggccgcgttggacaccgccaagcggaacctcgacgacgccgccgcccagcagcagacggccgcgaacggccagcagcaggcccagaaaaattatgacgacgccaacaaggcccagcagcaggccgccgaggacgcgacgaacacggccgacaagatcgcggccgcgcagcaggccgccaaggacgcgtccaacgcgatcaatgatgcgaacaaggccatgcagcaggcctccggcaaccagtccaaggccgaaaccgacaagcaggccgcacagaccgcgaaggatgaagccacggccgaatccgcctcccatcagcaggctgccgacaaggcccagaccgatatcgatgcggccgacaggcaggccacggacgcgcagaagaaggccgatgcggcggataccgccatcagtgatgcgcagaagaaggccgaccgggccgatggggacgcgaagcaggccgcgagtgacaaggccgccgccgagaaggagctgacggaagccaggaggcagcaggcctcggcgaccggcgacaagacgaaggccgacgaggcggtgaacgccgcgcaggccaggctggatgcggccgggcaggccgaggccaaggcgcttgaagccaagcggaaggccgacgccaaggtcgatcaattgtccaaggatgatggaggtctttccgacctggccgcgaagctcgaagcggcgaagaaggccgcagccgatgccgcggccgcccagcagaaggcggaacaggcgcggaaggacgcggacaagacggcgtccgactcctcttccaacgccacggcgaagcggcaggccgccgaacaggcgaaggccgaggccgaccggctgaagcaggtcgcggcggacgcgcaatcgaagctctcgcagggtgcggtcgcctacttcggcgaccggaacgcgtcggacgcggtcaaggtcctcaccgacaaggacacgaccctcttcctgtccagcatccagaacggggcgaagggcgatgcgaccagcctcgacaacatgatcgccgcgctctcgtatatcaaggaggcgaaccagcttcgcgccaaggagggattggccccgttgaaggtgtcggacacgctcatggcgatgagcatggcgaacgtcgactggtccgacgacaacatcggccattccggccagttcaacgtcggcgagaacatggcctgggggttcaaggacccgttcgacggctggtacacggccgagaaggccagttacgagaaggacatgaccgacggcgtgctggacggcaaggacaaggacgggaacgtggtgggcgggaccggccattatctgaacatcgtcaacaaggggtatacggtcaccggcttcgcgatcagccagaacgggacgaccggcttcgggaccacgcacgggcagacgttccaatacgcggcccccgaccagtcggggcgtgtcatggacgtggacgcgtatctggcggatctgaccgcatggcgtgattcgctgaccaacgcggacgcgaactggcagaccgcattgtccaagagcaagcaggccgcacaggacgcttccgatgcggccgaggcgctggccgccgcacagcaggccgcgcggaaggccgccgaggaagcccagcaggccgcacagaaggccaaggatctgcaggccgccgccgacgaggcgcagaaagcgtatgacgaggccgtgaaggcgaacgcggacaaggccaaggcgttggaggaagccaggaaggatcagacggcgaagaacgaagcgtactccgccgcccagcagtccaccaaggaagcccggtccggagccgccgccgccaccgccgcccagaccgcagcccagacggcagtggacaaggcgaacacggcggtcgccgccgcgcaggcgaagatcgatgccgccgacaagctggcccaaaccgccgccaagaacaagacggatgcggaagccgcgatcaggcaggccaacacggacaagacgaaggccgaagccgacctggccgacgccaaggcagccaaggccgaggccgagaaggccaagcaggccgcgctcgaagccaagaccgtttccgacgcgaaggttgaagccgccggcaagcaggtcaaggccgccgacgaggccatcgccaacgccaaggccgcatacgcgaaggcgaaggacgatctcgacacggccaccggcaagctcgacgatgcccggaacaccatcaagcgtttgcagaacgccgaggagaacctcaagaaggcgaacgcgaagctgacggaagcgcaggcgaagctggacgaggcgaacaaggccaaggatgcggccgacaaggcgtacgagaaggccaaggccgactatgatgccaagctcgccgacaagcaggcgtccgacaaggagctcgccaatgcgaagcaggccgaagccgaagccaagaagaaggccgaggaggaagccaggaagcagcaggaggcccagaagcaggccgaccaggccaagcaggacgccgaagccaagaagcagaaggccgaacaggccaggaagcaggccgcaggcgtgacgaacaatggtctggcctccaccggatcggacaccgccgcaatcgccacattggcggcgatcatgaccctcacgggcgccggctgcgtgctcgtgaaggtgcgtgccgccaagcatgcggacggatggcatgtgaacgactgacggattccaatccgtcgggaacatcaaggacccgtctcatccgcgaagcaacatcacggatgagacgggtccttgatccgtatgggacggctatcgacgtccgttcccttgacctccaacatgccggccggatatgtcatgccgccggcaggccgcgaacccgatgatcagcacgccggacatgacgatcagcgagatgatgatcgcctgtttcgtgtcgccgggcaaagggggttggtcgggcatgctcgcacacggcgaggaaccacccataccggttgtcactcgaactccggcttgtatccgtcgtccaccggcgtatagccagcgccgaacacttcctcgccggtgagccgcgtaccatcgtcgtcgtgtagcctctccacggcctttcggtacagggtgaagtcctcctcggtccgagcgaccgaagtggaacatccgcaatcgcaatcccctgtcatgccacgtttaggctgattgtcttccacgtttttcccgttctcttgaatgccactcacaaacagggtatccgacatttaagaaaacagtggaaaggccggacggggaatcagctcccctgcccggcctttccactagctcacggtcgtgtcagcgtccgtgtcgcggcgtcacggcatgacgcctacggacggagtacgcgaccgtcaatcccactcccaagagcgtgaacgcggacaacgccacgatgggcgcggatacgccggtcttggcgagttggcgaatcgtcttcacgatggccggtgtcgccggtggaatgtaggagttgttgaactcgggtcgggttccggtgacggtgaccatgccggggatcgcggacggcttgtccccgacggcatccccttggtcttgtcggccttgtcggtcggcgtggcgggcatggagccggaatccttctccgaatcgtccgtcgggtcgtattcgactttggcggtcaggttgccttgcaggtcgtcgcccacggtgacgatcacgtggtgttccgtcctgtcgtaggtgacgttcttctcgccggtgttcctttcccgaatcacgtaccggtgttcgccgcaatcatccactccatcattgtctcgaccgtaggtgagcggtttgaaccggatgtcgccgtccttgtcgttccgttcggtgtcgatgacattgcccttgtcgtccacgagttcgaactcgaattcgtcggccttcagcccgcgtccggtcaggttcttcctggccgcgagtccgatcatgacgttccccggctggtacgtgttctggaagaggatgctcttttcgctggctttgccgttggagtaggcgacgctggcggcgagcttgtggctcttcgtgtcctcggtgacggtgacggtgacggtgtggacggtcctgtcgtaggtgacgccgcccagattgccgtcctgttcggtcacggtgtacgtgtacacgccggcccggtcgaacgtgagcttgtcgaattcgagggttccttccccttcgcggacgtccgtcgccttgtcggattgcgcgtcgcgtggaacgcgggcgaaccgtttggtctggaggaggttgccgtcggaatccttcaattcggcggcgaactcgccatcgttcagatcacgtccggtcagacgcttgtccgccttcacggtcacgtcaacgggtgtcggcgtgtacgtgttgccgaatcggatgtcattggcctgacggtcggcggttgccgcgagcatgccgccttggtcggtgacggtgacggtcacatcgtatccctgagtggagtagccgatggtcttgtccgttccggcgacttccttcacgtgatacgtgtacgcgccgggcatggtgtagaccatttgtccgaatgtgaatccgcttcccttgttggtgacggttactgttccgttttggcttccggctggcattggcatgtcgttcatgctgatggcgttgccgtccgaatcatgtgcggataccgcgttcaactggaactggaattcaccgtcttgtggaacgcggctggttgccgtatccgtgttgacgatgtttttcacgccgctgatagagtatccgatgttcttcggactgtaatggttggtgaacgtgatgttcttgccgttagcgccggtgatcggggtgatggtcttggatacgacggccagcttgcccgtatggtcaacatccttgaccacgtaggtgatggtcgcaatcgtcccgtccgtggtgacgcccggaacggtcgtatcctgttccgacatggtgaacacgtaggtgccgacgagcgggaacgacagttggtcgaatcggatgttgccctgctggtcgttccgtttcgtctggtcggcgttcgacacgttggcgggcgcggactgttgttggagcgtgaatgcgaagtcttcgcccttgagcgtgtacttgttgcccttggaggaggccatcgtcttcactgcggtcggattgtccgtggcgggttgcgcatggtacgtgttggtgaattccggaatgttggttccgttatcatacttcacgtcggccaacagttggccttcgccattgtcggtgacggtgaccctcacgtggtgtttcgcggcatcatacgtgacgccgcccctgtcgccgggggtttccccgatggtgtagtcgtacgttcccggccgcgtgtaggagatggcgtcgaacaggacgtcgccccgctggtcgttggtcttcgccgtgccgacctggccgcctgtcttgtcctcgacgcaggtgaactcgtattgtccggcctgcagtcggatgcccgtatggtcggggtcgttgagggtcttgtgcgcgcggaattgcacgctgaccggttgcgccttgtacgtgttcgtgaactggatggcgtcggattggacgccgtcgcacgtcgtgttggcggtgatgcgacgggtgaacgtggtcaaatcgtccgtgacggtgacggtcaggatccaagtgcggctgtcgtaggtgactcccgcattgtctcccttgcgttccttgacctgataccggtagacgccgtccgtggggaacgcgttggagttgatttggacggtctgcgtcctgttgtcggcgaacgtgatggtggagggcaccgcgttcgcgggcgcgccgtccaacgcggtgatgtccgcgacgtacctgtccctgtcggtccaagcgccgttcggacgcccgtccagcaccttgaccgctttgaacgtggcgggcgtggcgggcatgagcgtgccgctcatgccgtggtcctcgttcgggtcctcgtacacggcggacgtcatctcgtccaacgcggggaacggtttcagcgtgatgacgccggcgaccatgttgccgtgcgaatcgttctcccggtcgctgtcggagtcggtcgcctcgctggcgtccttcgcgttcttgacggtgacgttctgcctgtgccaggcggtgccggttttcggcgtgaacctgagcttgaacccggaacctgccggaatggaaccgatttcgtagtggccgttcctgtcggtgacggtggtgcagggtttgccgtccacactggtgactgtcctgccgttgccatccacgagggtgacggtcacgtccgcgagaagcctgtccgaatcctgtcggatgccgtcatgattggtgtcgaaccatgcgacgccgttgaccttgcgttccacgacctgcgtgaccgcgtccaccttgttgtcgccgtccgcccaccggttcacgtacgagtccgccgccttgttgcctgtaggcttgatgctcaggctgaaatcgtagcgggcgttggcgggcaggcttggcgaggtgaacgcccatgccaccggcttgctgtagccgtcggggatggtcaccttgcctgtggtcgcattcaccgtggcttcagtccattgttggacctgttcgcgggttatcttcgtcgcgtccacgttgcgccacttctggtcggtcgtgaagtaggctttgacgccgttcatgcttgcgcccgcacccgccttgacggtgagtccggccatcacgtagtcgccgtgatagttggactggttcaagcccttgcagggcatgacgtccaccgcatacgggtcggttttctcgtccttggagaagttgcccagcatgttcctgaatcccaacgggcggttgatgtcgttcagcagcgggtcggcgcgggtcgccaacgcggtcgcgcgcgtgcgggacacgcgaaccgtcatgtcggctatctgcgcttttggagccaatgggggagccatgttgcgtttcgactggatggtcgcatggttcgtgaacgaatcgttgttcctcacgtcatggtcggggtcggacgcgtccccgatggtggtggaatagtggatgacggtctgcgtgccggagtcggcgcgcgccccgttcaccctgatggtcatggtggtggtgccgtccttgtttgcgacgatcgtcggcgtgacgggggtgccgccggtgaccgtgcccttgtcgggcgtatgctgcgagtactggccgccgaccgtcatggaaccgtccacgtaggtcaggctcttgggcagcgtgtcggtgatgatgtagtcggtcgtgtattgtccgccgtccgtggtcgtggacgtgtcggcggtggcggtgagcttccagtccaccgcacgctgttccttgtccaaatcgtagacggttttaacgttgcctgcctcgttggtctgctcgacctgtttggcgatgtgcggtgtttcgccggctatgtacaggctgtcgcctttcagggtgtcggcggtgtcgccgccctgataggcgccgttgtcgtcgaacgtggcgggacggtacgtgtcgccgctgtaggtcaggtcgggtttcacgctgttcgcgtattcgggcagtcgggtggtgagattgtcggaccatcgctgccattgcgtgtccggcgcgtccgcgttcaggttcgcggtccgggcgaggctgttgcgcgtccagtaggcggtttcggcgacgatgggtgtgaccgtgccgattctcgcggtgtcgaggatgcgggcgggcagggagacgatcggcgtgaacgttcggttgaagctcgtgccggtcgggtccaccgtgttgtggtcttcgaacagcatgccgactatcgtgccatgggttttcgcctcgttgagggtcggatagtagtcgaggccgctgattttcgtgtcgcgctgctccctgtagtccttccagttggtgccgtcttttttgacggcgtaccagtaggggattgcgttcgaccgtttggctgccctcatgccccacgtgaaaacgttcatggggatggtcggctgcgtgtcgggatggtcgtccaccggttcgatgctgttcgggtcgagtttgaccaggcccatgcccatcacttcggcgtcgccttcggactggatggtgatgttgtggcctatttggaggcgtagtttcgacccctgtatgagactgtcggacccgttgccgtagtcgggttgcgtccagtcgcagctcgtgcccgcatcgttccatgaacggtcgttgttccagcacgtgtatcggacgcgcgtactgtacgtgcccggcatgcggacggtcatggccgaacccgcatggtcgtcaccggtggaggcctggttcgaattgtcttccgccgtggcgagacggtctccgctgacgccggtggccgtcaatcccatgtcgtccatggtgatgttggccgtctggtccacgttcccgtaatattgcgccacggtccggccgtcacggctggtgggtgtgatgaactgcaatacgtccgtgtggatggctccgacctgcatggtggagcagtccgacgtcatgtaatccgtgctgcatttattatgtgtgccgttcagtttattgtggatggggaagacggacgtgtcgtacccgtcgaacgagacggtcacgtccgtgccctgcccgccggtcttggtcgtgattgtcgtgttgccacgcgccaccctgtcatatccgtccgcacggtcggcgacgcccggagcctgataccgtaggtcgcccatccatgcgaacgtccgcccatacttcgaatcttcgttgtcgatatgcccgtaatcgtagagcaacggctgccaacggcgttccatcggatgcttcgtcccggtcttcgtatcatccgaatactggttggacaagcgaagcctataggtgatcctgccggacggagcctccaaccccttcaaacccttcgtccggtcgggccaacgcatctccgtgaccaatgcgatgcccaaacccaagccggtcaccttgccctcgtccttgttgggcgcgttcgccgcacccgaggagaagtcgaacacgcccctgtccacgttgccgtagttgaccatgcgcacgttcaggttgagtttcgcgctgacggtcacatccttcggcgtgtcctcggcccgtttgtgcgtgcccgtgttcgtcgggttcgaggcgtcccatgcgggccacgccttgacggtcggatggaaccggtagccgtggggcgcgcccttgacggcgaccgacaggccgatggaaccggtgccggggttcacggtcggcgactggctggtcggctccaacagacggtagcaggtgtacacctgcgtgacggtcccgttgatggtttccgtggtgagtttcggctcgtagccgggcgtatggtccacccagcccatcttctccgcgtcgaacgtgaccttatcggccggatacggcagctcgaaccggaagccgacgcgcgtgcgccgataatagtccatggtcgagtcgggggtgagcgtgtactcgtagtcgtaggtcaccgtatcgtaggagcggacgatgtcgttgttctcgtccttgtcgtcgccgcgttcgttgtccttgtcgaacggcgcggtgccggtgatgcggtcggtgagcctgagcctgctcacggcggcgctgtccgtgtcgagcatgtcgtggacggtcacgtccggcgcggcctgacccgcgtccgtctgcggagcggattgcgcgggcgcaccggtgccggattgtttgtccgccccggttccggcctcgtcgccgcctgtggtcgtcttcacgtcgggttcggcttggattcgcgtggacgtgcctatggtcgtatcgtccgcatacgcggcggaaacggccgacgcacctgagccgaacagcgtcacggacgcgagtatgagcgcgacgatctttctcagaccggttttcatcgtctttcggttcctttcggggatgtgccgtgaatgaatacggctgttccaatagtgtgtggaggatgggtcccaagtacggtttgcaggagagttcccggctcacgtcgtccgaccgtctccggtcgggtgacggtcggacggcggggatggggccagtgtcagggcggccagcatgctcgcggccgcgcaggccattgccgtcacgatcttgtcgttcctcatggttccctctccggcagatccccacgcgggatccgacggagggggcctatgcgggcgtgcacatgccgcgcagacgcccgcaggcgagcgcgtcgtccatgccgcgtcgcatcccatcgaggatccggcatgcggccggatcgccgtggcgggcgatactcgtccattggacgacggtgagcatgccgcccatgcccgtcgcgatgagcgcgtcgtacgcgtgggtgtcgatcagctcgtccaggcggcgtcccgccaggacgggcatgtccgggtgcagccggtcgtggacgatcatgcgcgccacgtcgcccatgccgccgcgcatgtaccggtcgagacgcaggggtccggcctcgtggaaccatcgttccgcgggacggcggacggcccgcgtgtccgccatgatcagccggtccggatagcatgcggcgagcgcggccgcgacggcgggcgcgggatgcgggtccatgccgtcgatgatccggtcggccagccggtccgcgtccggggtgagcatccacccgtatccgtccgcccactcgtgcaactgcctgtattcgtcgctcggatgttcgggcatgtggtcgatgaacgcggtgtgccgttcgccgcgcccgtcgatgagcgccccgcagctgttgtcgtccctgcctgccgtccggtcgccgcgtcccgtggcgcgcgtcgagaccaggagccgccattcgtccgtgctcatgcccatcatcggtctccttccaccgagcttctcacgcttttcacgatctggagcgtctcgcgttcgggcagcccgctgatccgcccgcgttccatgatgtcccgggcgatccgctccccgtcctcgggatggttcttccaacgcccgtaccccaccggtagagcgtgtcgttgcgccgtccctcggggatggggctcatgtccggctccccctccgggcttcccggcatgccgggggagggcaggtcgaacgcggccgccgtccgcgcgggggcgggggcgtgacggggtttgtcggtcgcgtcgacgcgttccgcccagcgcaggaacgcgtcggacaggtcggggatccgatcctcgggccggtctatcggcgtgtagcgtcgcccgtcgggcaggacggacccgcccatgaccacgtagccgtcgcggccgatcttgaagtcgatctggcctccgttgtgcgtcctggatttcaggcgcgccccgtcagggatgtgatagaggaggtgcacgccgccggacggggtgcgcaccgcgaacgtgcgcggcaggggcggcgtcccgtacgggccgacgtccgtctggatctgctcccagccggacatctgatcctgcttgtggcagtcgaggtccacccacatgtagtcgtcggcgacggtcgtcccgtagatcggcttcgacgggtcgatccggtgcgacatgtccacccgcggatcctggcatgcgtccttccaggaatggtggggcacgtcgctggacgggctcttgtccgcatggcaggggaagatccgcggatccgcctcccggatcatgtccgcccacgcgtccgggtccgtgaccttgagatcccggtcggggacgggccgtatcacgggttcgtcggcgggcatgccggacacggcggccgcgcacgccttccatacggcgtgcaggccgtcgccctcgggggcgggccggtatgcggtgtgcggacgcccgtcctcgctgccgatgcgcgtgctggtgcgcaccaggccgatgttcttccagttgacgcgcatgccggggtcggggatcacgacgcccgtgtcgagcacgctgcggatggcggcgacctccatgtcggacaggctttccaagtcaatgaacgcgacggaccggcattgccggtcgccgatcgtcagccatgtgatcgcgccgatcagcatgaacggccagaacccgtgtttgcggcggaacgggagataatggcgggcgcgcgtcgtcggcgaggcgatggtgctgaacgcgaagcggcgttgttcggcttcggagctggacacgggcagatggtagttcgtggtgatcaggtgcacgctttgcggcatgccgtccacgctgttctcgccctggcggcgcgcggagaaggggagaagcccggtcaggagggtcttcaggttcggcaggctcttctcaaacctgccgtgggtcggatcgtagtcgtcggacagggcgagcaggtggctcatcaggtcgcccatcttgttctcggcgctcatggcggtcggctgggcgagcaggtcgaggctcatggtcgtggcctggtcgccgagatgctccatgaggtccttggcgagcgtgcttttgccggtgccgcccggcccctggtacacgtacgcgcattccggatggctgcggaggaacggggcggcgagcgaacgttgcaggttgagggtgctgtccgtgtcatggccggtccactggtcgaggatccatccggcctcgttcgcgagcgtcgtggcctgttcgcacgtgcatccggtctccaccgtgtaggtcatgggctcgtcgacccggttcggcgtcatctcccggagcgtggccttcctgaaatccggttcccggcattcgaggtctttcgcgccggtccaggagcgggtggcgccggatcgggtctcggtgcgcgtccacgcgccggacacggggtcgtgttcgaagcggatctccccgtccgtgcacacgaagctgcatccgcggcgtatggtctgtccggcgaggaggagcgagtccttgacccatccgtcgtctccgtccaattggtcggccttggccttggagccgccgtaggcgatgcgcacgggtccgatgggcgcccatcggctgggcgcgcgttcgacggtgtggtcgggcaggacgcgccggtagaggatgcccttgccgggagcctgcgggtcgggcaggacgcgcaggtcggggtcggggcacacgatctcgctgatcatgcggatcgcccacatgggcatgaggccgctcggatcggtccatgtccatgtgctcgccccgtccctctgcacgaggctccgcagcgtggggatgccggccacgccggtcgcggggtcgccggccatggggtggatggtgttgcatacgccggtcacgcccgtcgggttccggagcagcacgtgctggtcggcgacgcgggcgaggaacgccccgtccgcgtgcccgggggtggccgggcacgtgatgccgggacggccgtactggttttcgatcatgcgcacatgtatgcgtcacgtgaggggcggggccggacgggcatggcccggggctttgcaatatcgtatagttttccgaccctttttgtatgcatgtatgcatctgtatgcatccggggatgcatacaaaaaaagcccggaaaaaggcccgaaaacccttatatataaaggaaaaaataaaattcctttctcttgtatgcattgtatgcatcaatataaggggtttccttcccttttctcgaatcctctataagggaatgatgcatacaatgcatacacgcccccggaccaccccggaacgttggaaccaagccgaaacgggaagaaaaaatgtatgcatccccggatgcatacggatgcatacaggccggccggaatgcatacacggcccgcataggggatcgccgcgaccggggacgcataccgtcgcatgccaccgcacggacggtcggcgacgagacttgaaaaccgaagagcgacatcaggaacattcttgtccaaggcgactcatacccgcatgggcgtgaggacaagaccttggatcaaacgccacccctgcaaggtggcggcagtaaagacatgggtcggatggctgatgttcacgccattcgacccatgtcacggggctgacaggctttcgatggcctgccggagaccatttgctacgtgccggaggccggcagggacaaccgtcatcgaccttgccgcaagaacgaacgccaacaccgtttcttcttcccgtttcaccctcgcagcgtgaaacccggctttgactccattgccgattaacgggtcaaagccggagaacttcgaatcggactggtcggacagtcggacgatggattcgcccggccagcatacgaacatcgtctacaagccgtgcgggttcgccgaacgcacccgtccacggatgagcgtcaagcgtcggatacgcacgtgacggcaagcaatggttgacggcaggccagacccgggttcgattctcggcagctccacgaccctgatccatctcccatgagcttgtgcagactcacggtctgcgggtacagatgaacggggcacggtacgcatcgcaccgtgacgggcaaaagcgatgcaccggtggcgtggcccagcggcgacggcagcagactgtaactctgcgacagagaaacaccggaggttcgagtcctcccgccaccactatccgcctggtcgcaaacaggcggatcaacgacaggcggtttgattcgctgtcaggccagtcccattggatcgacagagaacggtagaagccgggatgacacctggtcatgagacgacgggattccggtcggtttcgtagcccggtccagcagaacggcccgaatcaatcgggtaggccggcggagcgaagccgcccgaagccactcggccggcggaacgcgttccgtcggcctgccgtccggggacgcataccatgccatgccgccgcggacacggccggcatggcatggttgaaaaccgaagagcggaaacaatgaacgcgccatcgggacagcggcagcccgacggtctccaaaaccgtagacggaggttcgactcctccatggcgcgcgaagcggcggacccgtcccggcgggatccggacgggtccgcgcaggcccgtgccgcgaaaacggcgcgcccctcggaccggacgatggcatgcccctcctcccggtccggtcccatgtggcgggtgcgtgggggtcgtcgccggacggccgggggtttccggcattcgccccggtagctcagcaggcagagcgtccgcctcgtaagcggaaggtcgccggatcgtgtccggcccggggctcgaagcggctcatggcgtgaacgccgcccgcacgcgacgccgtacactctccgcgcgcgggaacgatggcatgcgagacgggttctttcttctgcctcgtccgggaccatgccagcgccatgatccgtttcccatccccgcccgtgcggggacgcatgccgtcgcatgggcggatgcacgcccttgtagctcaggggatagagcaccggattccggatccgggtgtcgcccgttcgaatcgggtcaggggcacttcggggccgtcgcccagtggcagggcgtcccgtccgcaacgggaaggtcgcgggttcgaaccccgccggctccacgacatgcggcatgccgccgcgtgtaagcgcagacattccgaggaacgacgtcacgtcaagacggcgcgcccccgcgatggaatacgcagacagcggcctcccgccggccgcgcgcgagacggcggggccggccggcccgtccacgggccggcccgtgcggatgtggtgcagcggcagcacgcctgcttcccaagcaggagaccgcgggttcgaaccccgtcatccgctctatccggaaaaccaggacaatggatccgatccaacaatgggactcgtaaccgccctttccatgtggacgcttccggagaaaacatggacgaacagcctcggcatgggcacgcagcgtcaaggaataaggaaacatgccatcgcccctctagttcagcggtcagaataccggacttttaatccgtttgtggtcgtgggttcgaatcccacggggggcacgatgcttggtacatcgccatgcataagcgcatcaatctattatcagataggctgcggcagcttcttcttccggccgcgcgcgaaacaggggaaggaaaacacacagtgcgacggaccggggaagggcctataacccagatcccataacagtccgtcgtacggcgcctttgtggcttaaatggtagagcaacggtctgaagcaccgtggatgctggttcgattccagacggaggcacgaagcaatccatccgatcaatggactgctttcagggagtgatcgaacaatcgcatcggaaacgagacgataagatgagccgggcccggcagggtggtttgcgaccgaaccggcggcacgtccagaggggatctgacatgatctcgtttgtcctcgacgttgctggtaaaacccaatccagtctcccgattcccctccatctgtcattcaggacggatggggaggacgctctttttgcagctatggtctgcggagcgacatcaatgaggaccatgccgaacacggcccggcacaggcgtacgtcgttaaaggaacgaaatgtgccatcgccctcgtagctcaatcggattcagagcgttggtctacggaaccagaggttgcgggttcgaaccccgccgagggcactcggaacaggaagctactccgctacctatcttcggcttcctgctcctcatgcgtcggtagcttaacggcagagtaccggtctccaaaaccggtgggtgtgaggtcgagactcacccgacgtgccaggacggtattgtttggctccttactcactcacggattcgtcaagccgaatgataccgtcccacccggttccgatcgtcgtttgaaggatttcctattctcttcggctgttcgaccggaaccatcgccccgttggcggaactggtagacgcatccggctcaaacccggattcctgacggagtgggggttcgaatccctcatggggcactatccggtggatgcctttcatgctcgcttcgaaagattttcatcggatattcttccgaccgtcaagcctggtttctttcttccttcattgacgggcgcgacggattccagccgccccggagtcggacggcggaagaaaaaacgactccacatcatcgtggatggccggtttgaaaacagataaccaatgcgaaattactcctttggaaaagggttgtcgatttttttgaaccacccggccatccatcatccgcttccgtagctcagtggaatcagagcagacggcttctaatcgtccggtcgtgggttcgaatcccaccgggagcaccagatccacagaatacgtcaaccagtttgttccttcgcgtggatcagtggagtagtggcagagcggtcgaatgcgactgtcccgaaagcagcaggggcgcaagcccccggaggttcaaatcctccctactccgcgaaccccgcatgaaaatcgttcccatgaggggatcgaggtttggccggtgtgccccgtactgaaaacaccggcatgggatggtgggccgtgcggcaaaggcgcagtcctgctaagactgttggggcggaagtccccggcgagttcgactctcgcaccatccgctagccgatcaacaatgtgttaggccacgggatagggcctggaatccagtcagcaaaaacaggttttggatcggcatggcggaacgcagtcgggcatacgcgtccgatgcgttcgcgcacattcctccttggtgtaacggcagcacacgggtctttggaacctttggtcctggttcgaatccaggaggaggagcttagcggcagcacgtcgaattgattttccctctacactcgattcgatgtttgttgtaccggacatacaggaggtcaggcgtcaacccaggccgcgaaaacgacgccacgcccttgtagctcagtggatagagcgtccgtctccggagcggaaggccacgagtccgattctcgttgagggcacgcacgaaactccgccaaccataatgcgtggagtcctcttcttctcttctctctcaaaccgtcgcgcctcgtacggttcgtgcatcacgaggcaacgcccttgtagctcaacggatagagcgccggtttcctaaaccgggcgcagccggtccgactccggccaagggcacgagtgcggcatttgatggtttgacactctcaaaaaatcgaaaccattggagtcccgaccggcctccgttgtaacgaatcctcggtcaggcgaaccgcatgggcatgcgatcatgacgcgcggccatgcggggcattggtgtaaatggacagcacgccatcccctgtgggtggaggtccgggttcgaggcccgagatgtccgctaaggaatccactgaaaaaaaaatcaaggtgaagcgtgtccgtggattccttttcgcggtgttggcgcaatggtcagcgccccggtcttccaaaccggtgatgcgggttcgattcccgtacaccgcccgatacgattccatgcccgttgggagttcccggcgggatgtcatgaccatgcgggtcgtgtccgatggtccgcgtctccgtttgttcgacggacacgcagaccatcattagcgcccatcagcctatgagtggccgatgcgaacagtcccccgtcggagggattggcgtgaatccgataaagcctatccgccgagtgcggacaaggtttcctgagacgtgggcgaccgtgtctcttgtcagccgaaccacaggatgtgggaacgatttcggtggagcatgggcgccacggcccgtgatccccgtcatgccccatgccgcagtacgcgcgtccaccgcaggcatgggtgcagggatccggcacaagcggccggatcgatcgtggaccgcgcgggcatatccctgcgggttgctcgcgcaacgctttcgtagcccaaccggtagaggcgacagtctaaggaactgtccggtccgggttcgaatcccggcgaaagcaccagcggaaacacgggcgtcaacgccacccatgcaggtcttgaaatcttgcctgtttcgggaacgatgtattatgagaccttcgcataactggggccgatgaccaatacagcgcccgtttccgcacccaacttgcgaatatgatgtcaacgccgccacccgcccgctgccatattgtgacggagtggaacgatgggcgcagacgaagggtttgcacctcaacgaccctgcagaatcgtcaccccagcatcctatccgcagccacacgttagctccgccaccgtgaaccgagtagcggtggatgccgttgcagcggcgtgagagtcctgcggtcctgcaagacgcggcaggatggcatcccataattccaaacgcttaaggggattgccaccgtcatccgccaacggcggaaagcaagggtcgtcccggtgcgccgggatatgagtcgtcggctggaatgccgatggcggtggcttcgtcatccaacaggtaggatgcgccgctcggcgtaatgcgggttcgaatcccgtcgaggcacgatgggcccagtgtccgcatgtgattcagctgggttcccgaacgggagatagtttgcgatcggtggcatgagtcgatcgcaggacaagcactcctttgctcgcatggcccatccgccgttcctcatgccagaacggttccgcccctcccgcgtcgcgggaggggcttttccgttttccggacgcataggagcaggcatggaaagaaaatcgttggcatacgacccgtttcagccgataggccgattctgccggcagatcgtggacgaactgcgcaagaccgtgactccggccgcccgtgaatggctggcctggagtatcgccgcattcgtgttcgtcatcccgctcatggcattggccgcgggcatggatctcggtatcggcagactcactctcatggtgttcggatgacggtcgcacatcccgtgaaccttgccatgctgatatggatgggcatcgccctgctcgcatttcttctcatgagcgtatggacggacgatccggagcgtcgcagcacctacctccgttgggctgtcgcgtatctgacggccctgatcgtcttcatcgccatcttctattccgaagggaccctatggccgttctcatcgtcgttctgaaaaccatcgtcgccgtcctgagcgtcctgctatccctgctgatcctcctgcacaagggcaagggcgggggattgtccgacatgttcggcggcggcctgaccgccaacgcgggcacatccggggccgcggagaggaacctgaaccgttggacggtcggcatcgcgaccctctgggttttgctgatcgtctcgatcagcctcgtcgcaaaaaccatctgacgaaacaggaaaggaggaaggcttgtttcctccccgccctgaagggcggagtctccacaggccaaacaagatgaaaaacaactggttctgccccaactgcgggcaaccgatggaagcgcaacgccacgtggacaatcccaccggcagcatcacatggacaatcggctgcctcaacccggaacacttccacacgcgcggatacgtgaacgccgccatcgccgaaatccaactcgagaaactcctccaccagtgaaatacattagcatcttcagcggaatagaagccgccaccgttttgccgtgagggtgcccccgcctttaggcgtggggaggacgtcaaggtgggggagggcatgggcccgccctgtccgcatagcggcatgcgtatccggaaaaaacgaaaaggagcgatcatcatgatttccgtcatatgcctgttcgcggggttcgccgcgggcttcttcaccgcatccatgtgcatggcctcccgtcggggcgatcgcatgcggccggacgggcgctgaccaaattggcggcgcaagccccgccttttaaggctggggtcaaccgggggacgcatacgcggggcatggaaacgtacgatacgggacgggggacggccttggaaagcgaattcgaacacatggcggatctggtgctcgtcatcctgtgcgtggcgggcggcatgctcatgtggcagacccatggctggctcatggccgtcagctcgatcatgttcgccgcgggcggcacgctgctggccgtccactggtgcgcggtctccatgcgccgcatggggaggacggccgatgatgcgcccgtcacgactgtccgcctcctacgcgagcctcctgcccgcgttgaaccgtctcggctaccgggcggacgtgagggaggcgttcgtctgcgggtcgcgttgcgtggtcgtcgtgtcgggcgcgcccgccacgcgcgtcctcaacgacggctcatgggagcgcgacgacggtctgagcggccccgatccggccggcctgctcgccctgtaccgcgacgagcgcgcccatatggccgtgaggaaccttgtacgccatgatttgaagggcgtggcccgcgacatcctcgtcgccgacggcatacccgtcggcgtgatcctggacgtcgaggaacaaggcggcgggctcgccgtctcgttccggcgtgtcgaaggcgtgcccgaggacacggtgatacacgattggacggcgcgcgccaaggccgtgcccgcattgttggaggagatcgcgtgaacgatgagcagttggaacgcctggccgaggcgcacagggagggcatgagcgccaccgaactggcgacgaggacaggcctgccatggcggacggtcgccgacgcgatttgcgtgacgcgcgaccgtacggtcgggcccataccccatgtcgtgttcctgcaacccccatgcgcgcgccgatgatcgggataccgcccatggccggatccgactggatgcggcgcgccgcatgcacgcgcatggagcccgacatcttctacccggtcggagacggggcgtacgcgcgtgagatgaccgagatcgcgaaacaggcgtgcctgtcctgcccggtgcgggccgaatgcctccgccaggcgttggagacgggcgaacagtacgggatctggggcggcatgaccccggaggaacggcgtgacctggcgcgccgggacatgcggcgccgtcgtttcgccgccgccaggatgcggggcgtcgcgcgttgaccgcggccgtcgccggcctcgtcccgctcgtcgacgccgtccgccacccggtcccgttgaagatatccatgcggcccatgctgggcgcatcatgtgacgcatacctttcgccgaccgggaatcgtcgtttcgaacaaggaggggtccgtatgggtctgcatgttccggagggatatcatttcctcggcgaatgggggcgcgcgtggcgcgatccgaagaccgggtgctggacggtcgcgggcatgcgcgagggttcggagggccgtgtcgtgctgtcggacggggaggcgagggcgttcgcccgcctggtatgccgggacgggcctgcggcgttcgccacgccggccgaaaacgagacggccgtgaacgccgttgagggcgcgggcggcgaacaggcgcgcatccacgccgccgaagccctgcaccggttggggcgcgtctgatggacgcgtactggctgggcgtgctcaccccgttcgcgatcatactggcggttctcctgctgtggctggccggcagcctgttcgccgcgatcgtcggctgggcgtggaagcaggcgcattacgggctgctgaagaagggttggatcgccgaggactacgacgaggattcaggggaatggaccacccgccccggcgcggaacgcctggcggccgccctgacccggtacggcgaataccggatgtttccatgcttcggctggatgatcctcatcgtccgcgaccacaagccgaacgacaaggaacatggcagacggcctgacggttagcgcgttccctggcatggtcgccgatctggctcgccgaccatgcccgcatgttcggcgagccagatcggcgacacgacggtcctgcaccggtatttcgacgaccgggccaaggccgagtaatgggcgatccggttcgtcgaccggctgaaacgccgcgaacatcccaaggaaaggaacaaggcatgagcgaattcaaaatcatactcaccgacacggagcgcataatgggtggattaccacctcgacaccggcaccagacgcgatggtccggtcacggcgcccgaaatggtcggaaccgtcgaagtggcctacgtgtggcttgacaaagaccttgaggaccgggaatcgaccgtcaccatccccacaccctgcaactgtccggtctgcggcgccccgccggacgtgctggaggatgcgctggccgaattcgaagacggggacagggtcgcataccgggtcgtctgcccggaatgcatggccgcaaccggcatcaccggatatctgccggaaagcgagagcgcgcacgcgcggctgatccgcgaggcgttcgacaagtggaaccggcacgaactgcattggaggttcagctgatggagcttgtcgaatacgctcaggcggtggaccattcgcggatgccattgctgttgagggtcctgaatgctctcggttggtatgccttcctcgcggacattccgctcatggtgtatgcctattgcctggtgatggcacggaacggctttcctaatctcacgatggacgagggcaggctcgtcggcgcatcggtgctgctgccgttcgtcgccctcgcgctcatgtccccggccgagaactggaacccccgaggcccgaagccgaagaccatggacgagtatgtgggcgacgtgtggaatctcgatggtctcgcgatcgccgaacccggatatatggacccgttgtccggtttcccccgaatcaaaggatcctaccgggtttcatggaagcggaacgggcggcgcgtcgaaggcacgctgggcatcgacggggcaaacgtcgaactgcgcgataaccaagggatgattgtttccccggtgaatccagggacaccggtatggaagccgggcgcgaaacattcgaaagggtagccgatggaattcaccgacagcgacgaactacgccgcgatattctcgccaacccgtatctgcccgagcatctgcgcgaacgggcgaagaacgatacaagcgaacactgccgtgccgaggatgccgacaatctgctggaagtcgaccggctcgcgggccatgggctcgtccgcttccacatcgaatccggcaacgcatccatgcacgtggacgtgccggatgatgccgcccgaagcatcgcccggtggatcctcgaccatacggacgagtgaaggagcacatcacgaagaatatctttttcctggattccgtcatcggactcatcgaacgggacaaagcccatgccatacggtttgcacggaccggggcggctctgatgctgattgcagtgggaacgctggtattcggcgcttgtgttctcctgacaggaatccctcttgtcgttctggttgccgcgttcgcgatctgctcgtttatcggaagccaactgttcggcggcgcgattctggtgatggaggaagaccaacggaaacgaccaacacaacgggacgaacggtaatgaaaactcaagtgcgcacgtccgacgcaaatccgttccgtccagggagctctccacgttcatcctgcaccgggatacgggcgccacggatccggatcggccgttcaaacacgaatgctcgtgcggccgctgggtcaccgctttggactggcatctgcacgggtgctggacgggttccgaatgccagtacgacgagcctccaagcgtcctccacgaatatgagaggtttctcgcatacgacctgttgtgcgaggcattggggcaggtcggagtgctggcgcccatccgatacgaacacccatcccgtatgggaagagggaggaggaacccatgcgtggtttcatgcgattcatcggattgggccgtctgctgacggtcggcgcgatcgcgttcgccgtcaccctggccgcggcgctggcggcgttcctttgcgaccggctgggcgtcggtatcccgtggcttccgttcggcctgcatgcggtatccgtgctgggcggactgaccgccgcggtcacgctgacggccgccgacatcaggaacgacatacggcgcatcggcaggaacatcgaagcctcggaacgatcggaacgcaaatgagcgtattggatatgaccggcattcccgacgacggttcgctcgaggatcaattgaagtggcgccggtatgcgaaccgggtggacgaactgttcaagccggacaaacgcaagcgcgagaggctggtgaaggcgctggaaggatactcgagggcggcgcgtgaggcacgccggctcgcctacgaattgtgggcttcggagacggaatggttcgaaggatgcaagaggcaggcggccgacgaacaggacatcgatctcgaatacgatccggaacccgacacggatccggatctggccgcgttctggcaacggttggaggagttcgcggactgtgacagcactttgatggaatcggcggaatcggccgatgggctgatcgggctgctcgcaggcggagaacgccggccccgccaatagtcgaacaaatgttctaacatgtgggtcgtggacgaccggcatctgaccccaagagacaaaaccgaactcggcatccaggcccggctcatcgcccgggcgccttgactgggacagcacggagccatggacgccgcgcatggcctatctgtggcagcggatcgccatggaacgcgcccgcctcaagagacgccccatacgcggccatgccggacacgtcggcgtcgcccggtggacgcccgcggaacgcaggcccgccgaacccgcgaggatcagcccatggccggacgagccgcccgacctcgactggggcgacgacgatgccgaaccccgaccggcgcgggacgcataccccgcaccatgaacgacgagaccatcagatcatatctgaccgcccgcgacgtgccggccggcacggacccgctgcccggatgcgtggcatgggcggacgcggacccgcataacacgcgcaccgtcggcctgtccgtgcacacgatgaccgacccgccggtcccgttcaacgcgttcgacggcctgttcgccgccgacgacccggacggggagcacgggttcgaaccccgttacgagccgaccgcccgccccatggcgggcgtccccgtgttcgccacgccggccgccaccgccatggacgagaggaacacggaggtggcggtggatacttgtggacaacaacaaggtcggtctcgccggccccatgggatcctgctaacgagtaaggaatcttaatgcgtaaaacaatgacctatgagcagttggaattgaacggctgttacgcgatgctatgcgaggccttacgcgcatggcatcggatgcaaaaggaccatcttcgggagaccgccgcgaaggtcctgaaggacgtatacgggtacgagttccacttgaacggcggcggctgcccatggcgcctcccctccgtcgaccatgagtgggcggcgaacgggatgcgggcgctcggcctgccggcggacaggttcgaagacaacgccatcgtcctcgcccgactgcttgacggacaggcggggactatgagctcgcttcggggcgcatgccggaaacaccggagaccgcgtatggttccgatgtcgacaggttcggcgtggtggagcaattccataatgcgttccgccgtatcaccatcaactgggacagtgccttggaccgcaagaccatggacgcgaacctggaacggctgctgccattggccgcgcatacggtgcggatcgaacgcgagggcggcatcccggacctgcgccccatgctcgagctgtgccggaagacgcacaagcagtaaaacgccgcaatcacatccggagccgccctcctgacggtcctcctgatggtctcgaaccttttgcccaactggatcaaagcctgccgctcggcctgtccgactccgacatgggcatggcatccctgggaaacggggcatggatcaccccggcgggcatgaccgtgacggccgccggagccgcatacgcggccatacgccgccatgtcgcacgcaaggccattcggacggcatgggcgggaggcacggcgtctaccgcccgccccatgcctccccgcgccggacggtagacgaccggagaagaacacccccggccaaaccccacgcaccggaacgcatacccccgtcggacggcgcataggatccgcgtcgaaaacacgacccgcagaaacgggagaggagacgcgcatgggcgcagacgatccgatcagggacaaatacacgcacgccataaactgggactacgccagccacgacccgcagatcctacgattgcgcgaacagctggcacgcgaatacgacgcggcgaacgggatcatgatccccctcgaccccaaggacacgatgtccgcgttccgcaagatcgccagactcgtcctcgacgggctcgccgccaagaacctcgtcgcccggcccgacctcgtctacaaggccatgttccccttccccgacacgcccggatacgcggacctcgtcatcctcgacgcggtcacacgaaccctcggacgccatgaggacggggaagagcgttgaccggccggcacacgcgcccacgcccccgcacgggacggcgcatcctccagctcctgtccgggctgagcctcacgctcgccatcctgtgcgcgtaccacgtcggctggatatggtggggcgactcgctcgacagcatccacacgcagcagaccctcgccgcccgccacggcgtcaaggacgtggacgcgggcgacacgacccggatcgcgaaacccagggacggcgacccgcccaaggagaccgaacccgcatacggaaccgtcctcggatggatgtggataccccggttcggcaacgactggaaacgcgccatccaggaaggcaccgacacgaacgtgctcgccaaccaggggataggccactacgagcacacgcccatgcccggcgggaaaggcaacagcgcgtacgcgggacaccgcacgcccggcgacctgggacccgccgacacgctgcagcccggcgacccgatcgtcatccagaccgccggacactggtacatataccgggtgcaatcctcatggatgaccacgcccgacgacatcggcgtgctcgaaccggacggggacgcgcgcaccatcacgctcaccacctgcaaatggtcgctcgacgaggccgacagcctgtccgcgcgcctcatcgtgcgcggacgcctcgaatcctggtcggacgtcaaggacgggatccccgccgaactcgccgggacggccgcacggcccgccgcgacggcacgcacgaccgtcagccgcgtcatacggcatatgagtgccgccatgcccgtcagccgcatcctcgccgtcatggcgggcggcgtctggctcctgctcgcgggcctcgcatggctcatatggcatgggggcaggccccggcgcgaaccgacatggaatccgctgaccctcgcctggcgcctccagacgggacccatcccattgcggaccatcctcttcatcctgttctggaccatgatcctgttcgccgaatgggcgtggctcagcccctggctcgacgcgacgatccccctgttctccaccagcccgtccatgacgggcgcataggtggcgcgcatggacgacaggacgaggaccatgaggccggtgcgggtgagcggcggcacgcgacgccggcggcgcatgcggcgcgccgacccggacgtgcgcgtcctgagacgatgcaggaccctcatgctcgcgatcacgcccatgtggtggatcatgtggggcgtgttcctcgcgtccgcgcccataccccggcccatggggatcgggatcgggctcatcgtcctgacggcgggcctgctcgcccccgcccccatcatccgatacacgcgggaagcgggaaagaggcgcggatgaccggtgggagcgccgtatcacggtctgtctgctggcaggaatgttcgccgccgccggaatatccatgctcatgatagaacccgtcccgagcgcctacgccgggatgaggccgtccgacgcgagcgccgccgtcactcggtccgcgttgtccgggtccggtgccgcatacaacggcaagccgttcagtcgtacgttcaccgcagaacaggcgaagcaactgcaattcatccactattagaaaggacttccccgatgggggacaggaaacttgagacggtcgccagagaggtgttcctgagcattccacccgccgtcaggacgggcgtgttcatcgacgttttcacgccatgcgactggcatcacgccgcccgctgcatggtcgattacgcggggattctagacgacccgcgcgaaccgttcgcccccgcctgcgacatgccggtcatctgcacgaccgccgtcacggaaaagaccgtcgtctcggacgtgcgcccgctggcctatctgcccgacgaggcgtccgtctacatgctggtagtggacatggagatggactgcgtcgaagtggacgtcgaaaggaacggaatcgtgtacgtggaaaaccgtcccgacgccatcggtcaggcgtacgccgacctcgccgacgacctgaacgacgccgtaagcgaatcggagaagttcgccctgtacgattcgttgaacgcggtctaccagttcgcataccggctttccgaactgacccagcggcatctcgtcttggaaaggagccggacttggaaactcgcggagtgagagtcaggttctcctcccccgcgcatgagaaccggtactggtggacgatactcgaatgcgacggacggtacgtggtgtgtgtacgcgaacgtctcgccttgccggacggcttgctcgcgtacacggtggccgatcggcggaacggaacacgcggccacgttaaggacgaacgttcgggcgtcaagggcgcgtgccgtccatccgacgcggcatggctgctggaacaggcgaaagcgcaggggattaccgacaccgagccgctttgtgtagcggaaatacaaggagaagcattcaactaacgcacgggcgtaacgcccacgaagcatcagaacaacgccgcgtcgggcatcctgaccggctggcacgaggggatgtgggtttgagattcaccgacgacgagaaccgcatcctcgaactgcatgtgaccgactggtgcgacgtggacatcaccgaacgggcgctcgacgacatgggcgaacccggactgttcggcaggcatgtggctgacgtgcgcgaagtgctgcgcagggcgttggacttcgcgaaataccccgacccgagcctaggctcgacgataaggacatcctaccggcttaccgacaaagaccacaccagttccggctggtaccaaaccggcggcgacatgctcatgagcacacccgaactggtcttggccgtcaaggatggtgtcgggttggtgagcaaaggacaaggaaaaaacgaatggaatctctaggaaaaaaccgactcatacacaggaaaatcacatccattacgctcgcgctcctactgggcgcgggcggcatcgccgcactcccccgaccgcgttggccgccgccccgtcgaacggaaccgtgtcctcgacgcgttcgttcccgaagcaatccgtggtgcgcgccgaccccttccaagagtctgtgagcaccgacgtgcagtccgacgcggattggggtggcatcgaaaccgttgcaagctagtttgtcctggtttgcaggacggtcctgcggccgtccgctccgagtcttgcgcggttttcgccgccgcttggttcgcgcttcgtcggggtccgcccgccatcctgacgggtggcgggccttactgcagcattagtcccagcatcgcccgtatggccggaattccaacgatttccggccatacgggcgcgtatgcgtcacggacggggacgcatacgcggttttggaacacaggcccgcgcatcgtgcgcgggacggaaaggaaccaacccatgacaggcatcgaaccatacgactggtcggagatgacgcccgacatgctgctcgcccacatggccggactggccatcctccagaagaagatcacgaaggcgctggacggggcgaaacgccagtatcttcgcacgcatgacgcggacagtccgagggagaacgcggtgttcgccggcctcgacgcggccaccgtgctcgtgaaaagggacggggaaggctcctacaaggtggacgatccgctcgcctacgcggacttcctcagccactacggactggactgcgagggacagccggccgtcatcaccgtcaactacccgaccccgaacgccatgggcgaacgtttcctcgaacgtctcatccgcgaacacgggggagagataccggacggcgtgaaataccagccgggccggtccggcggcgtgaccgtcaccctcggcaagggaatcgccgaacatgcgttcgactcggcggaactgtcgcgcctcgccatcgaagccgccgtctgaacaggcgcatagcaacccggcaaacgaaaggaaaaccattccatgccacgcaggaaccttgagaaaaaccagccccgcccgttgaaggccgacgccatgttcagccgcaaatgctctcgcacccgctacgcgacccccgtggacgcccggatcgcgctcggccgcctgccggaaggcaagacgatccgcaaatgcccggaatgcggcggctaccacatcgtcgaaccgggcgtcatcctccgccgtcgcggcaaggagaccaggtgagcgcggtcaacgagctcgaacggcgcctggccgccgaccgcccgcacgccggccccgacgaacggaccgaaacattccacgaggtgaaaccggaccgtccgccctcggtccggcccacgggcggaccgagggccgcgaaaacgaagacgcggccgcgcgacccgtggagccccgtgccccggccgacccgcacggaatggcgtcgcgccctgacgcccatgatcctgcaactgctgggcgtgctcctgctcgccgtcgtctcgttcatggccggccagaacgcgctgggcgtcatcctcctgctcgccctggccgcattggccggctggcgcgccgccacctgggactggatgcccgcggacaccgtgatgcgcggcgtggacgcgacccggccggtccgcgtcctacgcgtcatcgaccccgacgatccggagacgcccgtccgggtcgtacacgcgaaccgccggtacgcgatctggtggctggacgcggacgccatggtcaggaccggcgtgctcctgacccgtcccggcctcgtgtccgtcgccacgtcggacagcacggcggtcctgccggaagggggcggggcgtgagccgcaccctgttcgccggcgacctgcatgcgaaaggcgacctgctgcctttcatctcgaacatggcagaccgggagcatgccgaccggatcgtgctgctcggcgacatatgcgacgactggcatgtgtcgaacacgggcatgatacggttcatggaacggttcgcctcatggtaccgggccgaatccgggcgacgggagatcgtcccgctgctcggcaaccatgacgtcccgtatttcatgcaacgcggatccgcctcgttcgcgcgcgtacgcgcccaggcgccgggcttcaaaccaggcgcgcagcgccgcgtccacgagctcatgaaggacatcccgacgcggatcgcatggacggacggcacgatcgtcgccacgcacgcgggactcacccgccggtggggcgtccgccggttcggacacgcctggacgggcatgaccgccaggcatatcgccgacgggctgaaccgcctgtcggaacatcccggaagcctggccgccctgtacatggacgacgacggaccgttgtgggcgcgtcccggccacggggactacgacgaccacctgacccaggtgtccgggcatacgcccgtcccgtcggccggtaacgtggagggcgtgtggctgtgcgacacgttcagcaccatgccggacggcacgccgatcggcgaccggagcatgctgctggcggacgggaccggtctgcatgaggttccaccgtacggccggtgagacgcttcgccgcatgcacgcgcccattgtcaagatcgtccccttcccctcgcaccacggacgcgtcccatgcccgtccggggacgcatgccacgggcatgaacgacaacgatcagctattcagggccatcatcaccggtcatctcggaacacggctcatggacgcctggcgggattccacggacacgttcgaacgtctgccggacggcacgtgggctcccgccccgtacgacgaaaacatggcggacgggagcacgcccgtcgcatgggaggacgtcgccgaccccatggacccgaagccggaccgtaccgggtgcgcgctcgtcacgctcaaggacgcggaggaccatcatcacgtgctgctcgtcaaaggcgtcaccgtatgcgagctgctgcgagactggacgggatacgaatatgtcgattgagaccatccgccccgaagggccgtccggtgaatggacggtcacggaccgtctcgactacggcgggaccatgctgcgcgtcgccgaacgcgacggccaccagttcgtatgcaacgggaccatccccgtatccgaagccggcccgccgttcgtcggcacgctcgcggccgaactggaacgtcatccgttcgacgtcctcgaccgggccgccggccggccgatcatcgaagcctaccgcgcccgcctcatagcccgccatctgttcgacccgttggatccggactggacccatgacggacacccccacctgtatctcatcgacaggaccatgggcgtcgacgggctcgcccgactgccggaggaccgtctcgcccgcatggacgggcatacgctgaccgtcgaatgcttcgacacggaccgtcccgtcctcgagttcgtggccgacggacggccggtcgaatatgttgtgcgccgcacgccttggacgggacggccatggacgacgtcctgacattgggccatacgggccgttaccggatcgactggatacgccgggacgacgggagcattcgctaccgggtcacgggattccggcttgacggcgacccggaggagccgccccgcgtagacgcgcggcccacgcggggcggcggcgtccggctcacggtccggcgggatccgacgccgggcggaacggtcacgccggaatgcctcagacggaccgccgcatggctgacggacgtcgccggcgaactcgaccggatgcgcacgcttctcgaacttgacctggacaggagaaccggtcggtcgaggccggatccggccaaggacgcgcgggaggcctcgaagaggggtccggatggggaaaacaccgccgaacccgcccgacaaacattgaggcaatacgtacactgcgaataaccttggaggacttggaaaatgcgttgccgaatctgtgacggattgccgccggaacaccggccttacgtcgtctggcacaccggctgtgacggttgcgaggaacacgaccgggattattacgacgaaggtgtcgtcgtatgcgccgactgcatcgaagcgttgcgatacgccggtatcgggcttgatggggacgcgtgcgtaatcgacctgcaatgctcgttggacatgtgggcgcaggatacgctctggtacgccttctggacgccggagcgtgtgaccgtatgcgaagctgactgcgcccgccgttatctggaccgttccgggaacaaggatgtggaccccgcatgggattggctgccaaaaggcacatggtccgatgtggacgagttcaaggccgatttgggttccgccctatgccgtcgtttcctgaccgacgacatggacgggcttgccgccgcgtatctgaaacaaggcgatggctgggtgtccaccagcacgcaagacgtacggaagcttgccgaacggctgggcggggacgcatatcggcggatatgagcgaagaaccattctgacggcatgtttcgcccatcgaactggctggacgcaaataccgcgccgtcacagacaaagccgcactcaactgaacgagaccggcaggaaggaatacccttggaaaacagtgagctgaaaaacaggaaaacggaagccgtggacgcaatcatcgcatggttggacgagcagatagacaggacggaaaaagacatgtccgccggtgaggacgattcttcctggcttgccgacagtgaatacctgcaagcctatcgaaacgcccgctcgcacatgaccatcctacgtgacacagacgaatacacggtgcaacatctggccgaatggtgtaggggccgcaggaaggaggcggagaagagtctgcaacggctgttggaatcaaacacgccatacggggatgatgcgataacctgcgccgattcgagaaggttcgcctaccaagtaataatcgaccattgcgaagaattcgccaagaccgacctcaaaaaggttgcttaatgccttcgaccatgaaaaacatcatccagtgcgcggtcaataacgctctgaattggacaaccagttgacaaacgcactggacgcttcggattccgatgcaccgtccgagtaccaagaaggactcacggacgccttcgaccgagccgaagcagccttccgccgcatcttcgacgtcaaggagaaatgatgttcacgagacaggaaacggacttgagaagactactggcgatgctactgattttcgcatgcctgctgtgcgccggatgtgagggggcggaaggagcgacacgggagacgaagtccgacacatcggtctcccagtcgggcgagactatcaccgattgcaaggactacgattacagtcggcttcgcgaatgcagaatcaacctgcatgacgggcgacaggtcacatgtctgatattaagcggagatatcagaagcggcatgtcctgtgactgggcgaacgccaaggagaccgaatgacccgacatgtcagactcaagaccccatgcccgttatgccaaggccgtctggacgccgtcgtccggcgtatgccgctactgggctggcatatggtcggattgacgtgcgggcacgggtgcgacatccgctggttcaaccgggacatcgatttcagccgctcatggtatccgaccgccgaagactgtgcggaatacccagacgacttcctccgtggctgcgtcgaatatgtgaacatgctgctctcaaccgaatgtccgaaatgcggggagcgcccgaaaatcgggatgggaccccgcatgtgtgaacgtttcccgtccgtatcatgccggtgcgcgagcgaatggggaggcgacctgtgcgaggcagcacgcgaatgggcttacgccacgggcgtgtactggaaatgtctgaaacgttgagagaagtcccttcggacttccgccaaacccgcccgattggaatacccggaaggcgtgttcaccacggaaatccggcagaacgacgaaggcggtttcctgctctacgtcgcatacgttcccgcagacggggagccggaggagaacccgcgcaacgaggccgtggtgaaggcaatttgtatgcatgtatgcatctgtatgcatctcgggatgcatacaaaaaaagcccggaaaaagcccgaaaacccttatatataaaggaaaaaataaaattcctttctcttgtatgcattgtatgcatcaatatatggggtttctttcctttttctcgaatcctctataagggaatgatgcatacaatgcatacacgcccccggaccacccccggaacgttggaaccaagccgaaacggaaagaaaagatgtatgcatccccggatgcatacggatgcatacggcccggccggaatgcatacacggtccggaccgcacgcacggggacgcatacccggggcatggaatacgagatccacgcgacccgggacggcgcctacgggcccgtcgactacacgaccccactgcccggcgggctcacgttcgccgacatgctcgccgccacgcgcgccgcggcggacacgacgggacggcccgccacgctcgtcgacgacgaaggcgaaccggtcctgaccatcgaatcggacatcatggtcctctgaccgcgccccatgccccgtccgaccactcgaaccggcggggaacgggccatggacacggtttgaatatgacaaggtcacaggcatgaaagacggagcctacgacgaaaacgagcgcatgacgccggtcccccgaagaacacagctccaggagaacgctcgccatggcacgagacatagccaacgtgaacaggtatgaggcaagcatctacgacgacgaaaacgagatgatcatcaccatcccgcccgaacaatacagcataggagtcgcggcatgagcagcagaaaactcgtcagcgtacaggaaatcaccaacatcgaacccatcgagggagccgatcgcatcgaagtcgcccgcgtattgggctggcgtgtggtcgtcggcaaggacatgggattgaaaccgggggacagggtcgcctatttcgagaccgacagtctcctgccagcctatgacccgcgttacaagtcgttccaggctcgcggtcagaagaccatgatggtcggagccaaggaaatcaccggccatgtgctgcgcaccatgaaactgcgcggagtctactcgcagggcctcatcatgcgtttggatgaactcggattccggtatacgccggcagtcggcacggacatcaccgataagacgaatgtgctcaaatacgaggagcccctaccgatgggcggtgctcagatcggccggttcgacgccccctgctccaagtcggatgcgccacgtttgcagacgctcaccgactactgggatgaaatcaagacattgaaggctacgccgaccgtgaaagtcgatggcaccagcaccacgctcagcatggacgaacgcggacatgtccacgtgtattcgcgcaactgggagctcgaccccatgtccgcgaacatgcggctcgccaaacgattccagttggacaagatgctctggccgggcatggccgtccaattcgaactgtgcgggcccggcatccaatccaaccggttgaaactgccggcccaacgcccgttcatcttcgccgtatggaaaaaccatcgcaagatcgaccgcgaccaatggccgacgggaatgccgaatcttgccgtacctcaactcgatgaacacgagtgggcattgacgggagcgtggacgacatgatcgccaaggtcgacgggttgcgcggcaacgtcaccaaagaccgtctggacgagggcatcgtctggcatctgcacgaagaccagcgactgtccgagggattggcgaacgagctgggagccaaccggtgcttcaagatcatcaacaacaagtacctgacgaagaacggactatgagcatgccatacccatctttcccgctcgtctccgcccccgcctcatatctgcccgtgccggtcgatctggtcagtcggctcgccgcattcactttgactcacccgaacgagccggatggcatcacgactcgaaaatcctgaaaggagcgataatggccgaaactgaccgcatcgcccgattggagaccgcattcaccggacgcaacgcatggaacaccggatggcaatgggccgatagttatggtgatctgatctacaatcacccggacggttccaaacgtgaactgggttcctgttatgaccgggacaagctgatcgcgttctcgaatacgctcgacggctcacatggaaacctgctgaagcacatgcgcgacaagaacccgctcaggtcgaacgacccgatggcggatatcatgatcggcatcctgcgccagaccagcccggaactgctgcgccgactgtccgatgacccgcagggattccgagacctgtggtcatttgtctggcagcgggcgaaggagcctcccgaaccggcatatctgctgctcgacgggaaagacgtgaacgagtgcaggaaggcggcgctgaaaaccatcaaccggtaccgttcgttctaccggagcctcgacgccgaactggataggctcaccgatggcggatacggatgcatgatcatgtatgagaccgccatccaggccgaaatcaggttgaaaaggtactcatgggacgagcggggacgctggtgcatgaatccgatgatgacactctccggcaatctggagattctgctggaacctgattcgaccgactggcgtcacaagacaccgcacgtgcatgggaccatcagcaccggtttcgcctaccgtccgaacgacggccaccagtgggatgagccaaaacatcatgcgacgcctgaacgtctggccggcgcgatcatccgacagttgaagggcaagggcttgctgtgaaaaccgtttgcatcgatatcgacaacacgatcgccgactacacgaacggtctgcgcgactacatccgcgaatgcggacatggcgaggacgaatgcccgtgcccggagccgacggcctacgatttcacgctggccggcggatggccgttcagcggggatccaaaggcgttcacgtggtggcatacgcgcgccgtcgccgacggcttgtactccagagaagaaccgtatgcgggagccgccgaagccctggaccagctgcacgatgcgggctggaacgtcatcatggcgaccggccgcgcggacgactggcggggcgaaagccaacgctggcttcataggaacggcttccgcttcgacggctactataacggcgacaagacgatcctcacgccggacgtgctcatcgacgaccagcctgccacgttggaagcgatggccgcgaagggcatcaccgtgctccacccggatcatgcgtattgcaagaccgcgccgggccgcacgttccgccgttgggccgccgtgcccctgatcctgggaggcgcgcgatgaagccggaaatcgaagtcgaacgccgcgccggcatgatcacgggcgcctcatgcgggcatacgagcctcacctggctgccgtccgccggccgacacggcgtccgcacgtgggtgctgtccaccgccgacggcggcacgatccgccgaatccggttgagtcccggcgaaatcggctgtctggcgagcattctccaaacgatcgcgaatgagggaggccgcgatgacgaacccgttggatgagagcgccgtgcccctgatcctggacgaacccaaacacgggaagggcagggggatatcgatgacgatccgcttcacatacgctcttcatgtcggaaccggtctcataacggaaggactgaattgatttacgacgttacacccatcaccttcaaccaactggatctgctgtcggccggacacccgcagggcgggttccagcagaccgggcacatggcgcatctcgccgccacggacgtggcagccacggatctgatcggcgtgacccgcaacggcgttctatcggccggctgcctgatcgcgtggacgcggggccggcttggcctggaaggcagcatctggctcggaccgttgtgcgcgctcgatgatccgaaactcctcgaacacatgacccggggtatccgtctcgccgcacgccgccgtcatgccgtgtccgtcacatgctggccgaacatcgaataccaaaggcatgacgctgtcgggaacccgatcggtgtccccgacacgacgatcctcgacgcctaccggtcatgcagctggaggcatcagggattcgacaccggatacgggaaagtcatcaaccgttggaattggatcagaaccttcgacggcatcaaggatgagcggacgctgctcgcctcatacaagccgcgcacccggtggagcgtgaaccgggcgagaacatcaggcgtgcgagtacgcgaactcggtgcggatgagcttggcacgttcgtgaacatcgaacggaagaccgcaggacgacgcggcttcacggcccgcgacgaagactactatcgccggttcaaggagacattcggaagccgagcccatttcctgctcgccgaaatccatgccgacgagcttctgaccggcctgaccgccgaacatgacaggctcgccgatcggctggattcgctgagaaccaaatacgaagcgcatgccacgaaccggctcaaacgccagattgacgatacaacccacaacctgaccgccctggaacgccgcctcgacgaggcgcgcgccttgaccgcacatggcagcgtgatcccagccgcctgcgccctgttcgtggaacaccggcgtgaaaccgtgtacctgacagccggcgctctccccgaataccgggcataccaggctcccgccctgttggtccacgaaggaatgctccgcctgtgcgtcaacagtacccaaccgcgacgcttcaacatgtacggcatcaccggcgtattcaacgacccggatgacgaaggccgtggggtattggaattcaaacagggattcaacgggcatgccgaggaactggctggagcgttcatcctgccgaccagcacgatccgatacaagctcagcgaagccgcgcacacaatcaaaccgttgagggaagccggccgatgacgaatcctcttgacgaaagcgcgaaagccgcaacccgatgggtggagaccacgccggacgccgtattgcactcctgcggactggtgaacgcctaccagttgggctggatggacggggccggccggtgcgcggacaaacaggcggtcaaacgggtccgccgcgcattggaacgatacccgtggctgaccaagggccagcgggaaggcatcgcgaccatcgcggtcagggccgcatacggcatggaatgggaggaggatgacgatgggtgaaaaaaccagaacctcggcggccgtgttcgcgctgaaacccgaatgggcggacccataccctccggcgcgaagacggtcgagatccgtcgcggccacatgaaccggatgatcggccggacgctcgtctaccggacaggcaccgggctgatcgtcgctgaaacccgggtgaagggcatgcacgccacccccgccggacgtgatctggcgcgcatacggggaggcgtcccgcatcccggaacccgtgttcgacggatacgcgcagggtgcggaccggctggaatctcccatccgctatgagaggccgaagaccctttccgaggtcgggctgaaacgcgcgccccaatcctggtgctatctgccggaacccgtggaaccggccgtgccacggccgtccacggatcacgcgcaggaggccgaccgctgacgacggccgccgaccagtgggagccccgccgtttcgcgaccggggataacggcgaccgggcgcgcgccatatccgggaggttcacggaactgatcgccgggatcaatgaaaccacgatggaaggagtgaactatggcgaaacgcgatgacgacgcgcgcatggtgagccggcgcgaactgaagaacgcggtcgccgaatacctttacgggagcggactgcccgtcgacgtggaccatatgggcgacttcctgttcgatgacaggatggtcgaaaccccggaatacgaaatccggttgaaaggggaatgacatggcttcaaaggggaacgaatcgaggcagattggccgccgcgaactgaagaaggcgttggccggatacctggacggcagaaacgggcgcatcgacatcaacgcgatgggcgactacctgttcgaccggatgaatccggtcccgatcgtcggatactgccgccgctgcggcgacgaatgcttcaacctggttgacggactgtgcccgctctgcacggacgaactcgaatacgaacggtcgggaggataccaatggtgatccgattcaacttgtcgcgctgaggattctcccgcctcttagcggagcgtaggcgggagaatcctcagcgtctcttcttgtgctatcacctcgattcagtcgtgcattactgaatcgaggtgatagcagtgaaattggaatcaaatcatcattcggtgttcctcatgcactaccacctcgtgctcgtcgtgaaataccggcgaaaagtattcgacgacgaaatctccgcccgtgcgcgggaaatcttcgagtacatcgcgcccaagtacgggataaccgtcgaggaatggaaccacgaccaagatcatgtgcatatcctgttccgcgcccagcccaagacggaactgtcgaagttcatcaacgcatacaagagcgcatccagccgcctgctcaaacaggagtatccgcgcatccgtcagaaaccctggaaggaatatttctggagccgcagcttctgcctgctcaccacaagaggcgcgcccatcgaggtgatacgccggtacatcgagagtcagggacgcaaatgaacacgacgacaatcacacgacgtagggcgatcaggttcgcctaccccaccaaggggcaggcgaacctgatcgaccgcaccatcggctgcgcgcgcctcgtgtacaacctcatgttggaaacacgcatcgcctcctaccagtcccggttcggcatgcccgacgcgcaaggcaaggaaccgccgccgacgccaagactgtacaaggacgactatcccttcctcatagacgtggacagtatggccctgtgcaacgcgcaaatgcacttggacaaggcataccgcagcttcttcgccaaccccaagtcagtcttcccgaaatacaagagcaagcaccgctcccgccagacctacacgaccaactgcatcaggaacaacatccgattcgagaacggaggcacccgactcagactacccaaggtcggacccatcaaggttcgccagcacaagcgcatacccgacgactggaaactcaaaagcgtcaccgtcgagcactgcccatccggcaggtacgaggccactgtcctgttcgagtacgagacccaagcacccgaacccgtacatcccagcaccttcgtcggattggactattcgtcgcatgacctgtacgtgaccagcgacggggagcacgcgggatacccgcgcttttaccggcaatggcaggaacggctcgctttcgagcagcgcaaatggtctcgcatggtcaaaggctcagccaactggtccaagcagaaacgcaaggtcgccaaggtgcatgagcgtatccgtgacatgcgcatggacttcctgcgcaaggccgcgaaccgcatatccgaatcctatgattgcgtatgcgtcgaggatttggacctgcacgccatagcgcagacactgcgcctaggcaaaagcaccatggacaacgggttcggcatgctgcgcgccatgcttgaccgcaaactcgtggagcagggcaaacccggcttggtcaaggttggcaaatggtatccgtccagccaactgtgctccgactgcgggcatcggtatgcgggcgccaaggatttgagcgtgcgcgaatgggcgtgcccggagtgtggtgcatggcacgacagggacgtgaacgccgccaagaacatcagagacgagggacgacgcctttccctgcaatagtaggatgacagtcgtgaaccgtggggcgcacggggatagcctgctgatactggcaccgctgggtgtcttgaacgggaagctcccacctcaaacgtccgtcaggacgttaggtggagggagcacgtcacatacgcgctccacgtcgaaaccggcctcgtccatgtgtggccgtcgaagggcgccaggaaccatgacatcggcttcgagtcggactgctcgcggtacggctggcggccgctcccctcatgggaggcgcgtcccttcatgggaagcctgaccggcgagaccaggatggcgttcatggtcggcgcatgggccggaatgcacccggaatgcgtgcactgcacggtccgccaattggagcaggcgcaggccgaggtgccggccggttcccgacgtcgcgccgggcgacgcataccgtcggacgcacgcaagggaacggaggcccgatggcaagaatcgaagaaacattcgatgaccgtgaccggtacatgatcgaatgcgacgaccccgactgcgaacaacggttcgacgacggccaatggtatgcgtacgaggacgatctgctggccgacgcgaaggacgacggctggcagatcctgtacgccgacgagcatcccgaattggaacgcgacatgcactactgcccggcgcaccggctgcccgaatgcgtgacatgcacgaacatcatgatcgattcgaccggctggaaggacgggcaatgccccgaatgcatcaaggaggagattccgaatgaacggtcatgatttcacgcgcgaacagaacatggaggcgaggatgacgctggcggtcgcccgccgcgggctcgccgccgccatccacgacgcggagaacgggataggccatctgtcctgcgacgatccgaagattatggaacaggttcgcgctcattggcgacgcctgtgcgacacgtacatgaacgcggacgcgatcatcgcggacctggaatcctgcgcacgtcatctcacggatggcgacaattgggagccgaacccgatcgccgacggcatgaaacccatggagatggccgaagggtgcgcctgcttcgtcgcggagaccccggaccgggtcctcatcatcccgtcggagccgacgccgggcgagaacacggcgaaacgtctcgcgaacacgctgaacgccctgacgggggatgttctcctggatgcgaccggcatccgcctgctcggcacccaattcctgttcgcctaccataaccggctcgacaggcccgtcgatcatggcgtgaacctgaccggcatgcggttccccgaccggctcggcctgctcgaccaggcggaacggtatccggggttcctcccgttgcgcccggtcgtcgccaacgggaccggcgcattggaacgggcgggacgcgaactgtgggcgatcaccgcgcatacgctcgaccggctgccgcacagacggttcttcgtggatctgaccatgttcgcggaccggccgaagatactcgaacggttcgccgtccgctacggaaaatacctgaaaggcaaccggaccgccctgaacgtgaccatcatcgacccgaccggcctcgtcgcccgccatatcgccaccataaaaccggaatgggattaagcaatggggcatgttcgaatcatgtgggttggagcgaatcttctcgcactcattcccctggcactgctgctcaggtcaaaggatctgagactgggaggattgtatgcggccatcgcgttcacgatcatgttctcggagctggtctcatggctgttattcctcggcctatccgttttggaaggaattctctgatggacttatatcccatgcgcgaaacggtcccaagaatcaagggaaccgcctgcctgacagtcgggttccttgattctcccgttcgcgatgctcgccgccatggagcttgcggccgactcacccaaaacggacggctggacgtgacggcgtcgattcccgcgctcacgccagaggaagaacaaccgccgttggatggatgcgaaggcgactggaaagtcaaatgggatacgggacagggaaagctctccgtacgaggcaggaaggccatgctggaaggggaatcattatgaaccggctgatcctctgccttctcgtgaccctgataatcgcatgcaggatcggactgctcctgatgtccatctggtacggctggaaggccgtcaccctgggcctcattcccgggagcctagggccgttcatcctatacggggcggtatccattgcaaccggctgggccggattatcgaaagttgatctgcatgtgaaaaggacgaacgaatgatcgacccgaagaaaaacggaaacaggacgctgcgcgtccgctacgatagcggcgccatattcgtcggtccggcgatcatcaccgacgaggggatacgctcgtcctgctgggcggagcctcatccctgctcgtccgacgcgcggacggaagcctgccattgcacgtggctgcggtggaaacgccgccggaggatgatggtccgtgcctggatgcggctttggccgtgttcgacgaaaccatcgaggacggcggcggccgccggacggccatgtcctgcgcgatacgcgcctacgatgagcggaatcccggacacccgacattgttcgtcgatctttgcaacgacaggtcgttcgaaagaatggtgagaaagaccgggggaagagcattcaggctggattcgcaggacgaaggccgtgaaatagatcccctgtccttcgcggatcatgacttttcccgtgaggcggcgcgttccggcaatcctctaatcaggattgatccggtcaagggcgggcccatcgccgtctacctccctgatggttcaatcagggtcggggacgaaatggatttcctgctcagggatgaagccgacgcgcgaaccagcacgaataaaccgaatccagggaagccagctcgaaatccggaaggagcagaggtctccccggatctccgacggtgaagccatgatcccgataatatccgcgcattacgggtttgcagctgccggcagcccagcggcattccctcggagccgccgaatccagcagatacaggagcccgccgccgatgttccttccccgacgggattcggatacggccaaggcctccacgaaaagaatcacgttcgcatcgaacctgcgggcggtggtacggatggcggcgcacacgctgccatccgggtcgatggccttgatgccgtgaagcggacgggaatgtccgataccaatgtcgggcagcagccgggagacaagtctttcgtaatcaacgcgatcggcctctcccatgggccagaacgagtatccggacaattccgggttccgtgtgggatcgtctcttctcatggcttagacagtaggacgcatacccagaatcatgcatcgaatgatggaacaggaaaaggaaaaagcaatgagcggaacaaggcatgaaacacaacccgtcgccaccatcatttacgacaacggttcggagctgaccggcacggccgtcacgacatcggacgggagcgtgggcatacgtatcccgaacgagttcttcaagaccgggctcctgcccgatggttccatgccggagggcgtgaaatcggtgagcatccgtccgaaacacccgaagggcgtgctcccgctgaccgacgacatggcgtacatggcggtgaccgccatgctgcgcgatgcggtgggcctgccgttgaacgaggccgccgaccggtacgaatcctggctgaaccgggtgaggcgggacgcgatcgagaagtgggtggattccctgtccatgcgcgaattcacgcgcctgcaccgcaagtatctcgaccgtgacggggccggccatccgaaggaagagggggacgcatgacgctgatcgagcatgaggcgcgcgtcggactgccgcgcatgtgggagcatccgaaacgcacccgcacccgacgtggaggcgtcgtgacgagcatggtcggcgggtatacggcgatactgctggtccgtcagccgaacggcgtggagaacagcatccggaggcaatgcgcgagcctgaacgaggccgaaacatggctggacaaacagataggagaagacgattgacatcctcccccgcatgaatgcgggggattcccgaatctcacggttcgggtttctgttcgccacgacaagacaagaagggaggggacgctaatgcgagaccttggttccggttctgccgtccttgcagacgctgaccgcaagccctgcggcgaggatgttttcggctgcgttcaaatccctgtcatgggttgttccgcagtccgggcacgtccatgccctgaccgtgaggccgggcatgcccttcggcccggtcttcgccccgcagtgggagcagatttgcgtgctcggataatacctgtcgatggttatgagctttcgcccgtaccattcggccttgtattcgagcattcgacggaactccgaccatccggcgtccatgatgctcccgttcagcccgtttttcgcggactggccgttggggagccaatggttcggattgtccgggtcgggtttcggcgcgcatcttctggccatgttcctcacgttgaggtcttcgagtaccaccgtttggttctcgcggattatcctcgtgctcaacttgtggaggaagtcacggcgcatgtccgtgattctggcgtaggtgcgggccaccttgagggcggctttccgacgattgttgccgcctttggttttgcgggacaacgcccgttgctcccgttccaaccgttcggcgagtttcctgtagtggcgtgggttcgctatggtctccccgtcgctggtgacggcgtagctgtccactcccaagtcgattccgacggcgtcccctcgggcggggagaggacggatggcctcctccacgaggatgctgacgtgccatcgtccggcggcgtccaagcttacggtcacggtgctcggctccgtcttgcggggcagtgttctggaccatcgtatcggcaatggtccgcgcatcttggcgagtgtgagttcgttgcgcttggcgtcccatgtgaacgcgcttcgagtgtattcggcgcttccgccgtgggattttgccttgaatctcggatagtcgccggtctgcttgaagaagttggagaacgccgtctgcaagtgcctcaacgcctgttgcaacggcacgcaggacacttcgttcatgtacgagtattcagccgtttgcttccattgggtgagcatggcgctggtctggacgtaggtgatgctcctgcgctccgccgtccatgcggtggagcgggcttccaacgcgaggttgtagacctttcggcagcagccgaccgtgcgcctgagcagttgctcctgctcgggcgtcgggtagaagcggaacctgtacgcccgcttgcacgccagccttctgaccatgtttcacattatatcatatcaatctgtgaaaggaggacggtttgcttcctccccgccctaaaggacgaggtctccgcaaaccaaaaacgatgagcgaccatgggaaaccggataagccgggactgtggcgggatacgaacgagaaaacggtcgtggcctgcatggaatccggcaatctcaggatgcgcgacccggataccggcatggtcctgtccggggagcggctggaacgggccgcgccgttccgtcgaaccgagtgggcgggaatagacctgacccgggccaggttctccgccatgcccgacgcggcgggatgctggtgcgacgcgaacggcagcctctggctcatcacgggcggcgacgggatcgacgggctgaaggaaccaggccgcgaatgggaatgcgcgccgtgttccggcatcaccgtgaggatgctccacgaatggggcccgtgggcgcgctgcgacttcaatccgaaggatgatgaagccgttcgttttgactggtgcaaaccgtggatcgccgatcatggccgggatgcggatatgtccgaatccgcatcgtctctgctggctcatatcgaggagattcggaagagtctgccggaggagcccggtctgtggaggttcgagcatgccgggtccggcgtcgtcttcggggacggcggcgggaagagcctgttcctgttcgattcgggcggaggtttcctggacgggggtttgggtccatgcacacggctccgacccggcattccggtcggttccgcgccgatcccgaacctgccgggcgtatggatggacaagggcgggaacctgttggcagtgtttggggaacgtcgggtgaggatttgggacaaccatgactggatggtggaagagcttgacgacgattccggggaactgtccgcgcacggcccgtacacccggtattcgctccaaaccgtcgaacaggtcccatggaagccgaccgccgacggtacggctccgatccgtgaggggacccgtaccgtgcatctcccggccgtccgatcgttcggccggctggaacgggacaagtggctggccgtcaagaacctcgaagagtcggccgaactcgtggaggcgtgcaaacagtatttgaaggcctgcgatccgaccgatccgagccatatcggcgaccagttcgacgatcatgcggactgtctcgcctgctacggggtgaacgtgggcggcgagcttggcgacgaccgggacaaggcgaaggccggctggcatgaccatgtgcgcgaccagcgtcgccaaaccatgctcggcgagctcgccgacgtgttgcagacggtcggcaacctgatcacggcgttcggcatcacggatgaggaggtcggacgggcgatgtgcgactgtctggaacgcaacaggcggaaaggacggctctgatggagaccacgagaatctgggattcccgcaacagcaggcatgcgacgattgaacacgagacgttgagaccatgcccgttctgcggcggcacgccacgaatcgacgatgatgtggacgatacgacggaacggtacacggtgcgctgcaactgcggcgggagcatgccgggccggtacgttccgttcgacccatcgttccaggcccgtgtcacctgtctgtattcggcggtcgaacgctggaacaggaggggctgatggactacacggacagcggcctcagggccggtttccgacgtggattgcgtgtcgcatgggatgcgatgcggttccgcccgctccggcatgagccgtggccggcgccgcccatgccctccctgcgcgaccatctggaagcgtacggcggcaccagtattggcccggccgatttcgaccggtgcgagacggactggcagcggatgctcgacgaacggcaacacgcgttcgaccgttacctgctgggcatgcgctgcgcgcggtatgcggtgttcggcatgtggattatcgcgttcgcgattgtcggcctgctggtctggacggtggtctcttgaccggttttctcgaccgcatcctgaacggtgatggaccgcgaccgttggacgtggacacggcggccgccatgctcaggaccacgcccggcctgctgcgcgagttcgaacgctcctaccatgcgaacgtactcgaccggaagaatgcgcccacgggaccattgggtccggacgcgaggagtgtcatcgaatcgcgttccggccatgatctgtcggatgccgtgttggcgttggatgcgcggatcgtgcgtgaactgctggcggatacaagcatcatccggtatgacggggagcgtcttacggcggccccctcattggctcccgtcccggaatcgtatgtgacggaagtggacgtggacgtattggagccgggggagcgcccccagttggcgggcgagctaatccaccgtcagatcgatgcggtgaactatccgctcctgctcgacatgtggcggcgcgccacggatctgaaacgttccgcgaggcaacggcgtgaggcgtacggcatgttccgcaccggtctcgacctgttggatctggatccggtcatgtaccggatgctcgacctgaacccggcgggcatgggccattggctgcccgcattggcgaaggcgaacgaaggcaagacgttcttccgtatcccgaagactaccatcgccaaggtgcccatgaccctgctgcaattgtcgcgcgtcgaatacgaatccctgaccgccgccaccttggatgtcgtggaccgttgggcgcaggccgcattcggcctgaacccggacggggagtatttcatcaagactggcacgttcagcagcaaatacgactaccggaacgcgcatgtcaccggcccgcacgaggtcgcgcagatcggcgaatacctgctgtacatccagtcgcaggcggtcggaatggccggcccgttgaacgagcccgccatgtacggggtgtccacgacgaacgagatggtggtccgcgaatacatccccgaccggcttggcctgccgaccatctacatgggattgccgctgcgatgcgaataccggtgtttcatcgactgcgacacgaaggaaccgctgggcatccacccgtactgggatcccaaggtgatgaaccatcgtttccgcgactggccggattccgacaacccgcacatgcggcacgacgcggtcgcctacgcgatgcgcgaaccatcgttgatgcgcgaatacgaggccacgaagagcctggtcgccgcgcatgtcaaggaactgcttcccggtctggatctggcgggccaatggtcgctggatgtcatgcgcgacggcgacgaatactggctcatcgacatggcgcccgccgaacgctccgcctattacgggcagacggtgccgaaagggaagcgccggccgatggtggagaactggatacccgaactggaaggaaaacgttgaccggctggctcatcgacatcaacccccgggaatgcccgcccgacgtgatggacgcgccggaagcgtaccgcgccgcatgggaacggcatgtaggcgaggccgtgccgggcgacggcgatccggaggattggcgcgaacaggcggcgcgcctggaagccgccgtccgtgttctccccgacccccatgtgcgggtggcgggccggccgtacgaggggccggatccgatgacgctcgcccactacggcacggtcatgctccgaccgtatatggatcagctttccctgccgccgtcgaatgcggacaggtatgacctcatgcccgcgctgcgcccgcatctggggcgcgacgcgcgatcggtcgcctgtgacggggacatgatcgacacggcggtgcatggcatgctcgaccggcatcccggttcgggcgtggtcgtcaagttcatgctcagggacaaacggctgccgctcgcgttcatcgacccggacggcacgttcatgcaatcggatgaatacggcgggaggccggagcgcatcccgttcgccgcctggcgttgggcgggctatgacctcgccctgttcgagggcgagccggacgcggtgctcgtccagcaaaagacgcgcatgcgatacgaataccggatacacgtgatcggcggccagccggcgtgcggggcgggctgcgtcgaacggttcacgcccgccgacaacacgggcgaacggtacgatccgcgcatggaggagacccgcaacaatgggcgcatcgaatcgcatcccgacatcgcacggttgtatgaggcgttcgcgcacgaggtcgcgcacgcgatacgcgatgaggtgtccggcccgtacgtcatcgacctgtatctggatgatgccgggcggccccacgtgattgaactgaacggacagtcgaacagcgggctgtacgcgctcgacatggacgcattgctgacggcggtcggggataatccggctcagttcatgcccgacccgaaacggacggcgacgcccggctgcctgggagtcagggaggagaagacgatctgatggtatccgaggtgcaacgcattcagaaccgcagcggacttggctctacgcagatggcccggctgttgggcgtcagcatcaggatgctcgttaggtggaagacgggcgacggtgcctcgaagaccgccgaacgccggctccgtctgctcgaacacgtcgtcgactcatacggcgaccagccacccgagcgtatccggtacctgctgttcgcgccgaaaaacggtgtctgcgactacgaccggatacggctgaaggacagacggaaggccatcaacgggccggtcggatcggcctgcgattatccataaggaggaaaaacggcatgacggggcagaacgcgaatgatgattacacgtaccgcagccaagtgaacgcggccatcgaccagctgcggctcgcgctcgaaaccaaggatacggggagcggatccgcctgctgaacggcgcgttgcagaacacgggcaacgcgatcgggcagctcgccctgttcgaatcggatggttcgcgccgtccggaacggcggtaggatcatggatgtcaaccgcttcgaaacgaagggtcccggacgtgaggggcactggggattctgattccccgaagcttgacggaaacggagcctgattctgatcgatttgtattcgttccagcggtggccggatgtcagagccgctttcgaccggttcggctcgtacacgccctcatggtcggccgcacgccggcaggccatcgccgatgacggggatgaggactggtggaacgcgatttcgcccgcctaccggtggatgatgggcgaaatggaacacaagggcatgccgcgaccggacccggacgcggccccattgtgggcgtgggcccgctgggtcgattcgaaaggcagggcgcatacgcgtcccgaccgacggtatcccggcttccgcaaccagtacgacggattggagctcctgcacctgcgggtcgatgagagccgcgtgctctgcacggatttcgaccagtaccattgcgtcatcagccggtggccgtgcgccccgttggacgccggcacatggccgcccgccgagtacgaccggtggctggacgagcattgggacgatccggccgaaaagaaacggctccagtacagggagaacgcgatcgtggatcctgcgcatctgccggaccggtggatccaggcctgcctatggacgatcacgccgcatgatgtggtcgatatccgaccggcatgcgggaaaccggataccattggggatcatggatgatctgaagagcagggcggccaagttcgccgaaacatgggcgggacgaggcgacgagaaatccgacacccaacagtactggcgtgacctgttggacaaggtgctgctcatcccggacacgagcgacaggcaggtgctctggttcgaacggcgcaccgcattggacgggttcatcgacgcgctcatgatccaggcccgcgtgctcgtcgaacagaagagcctcggcgtggatttggacaggccggagccacgccaggggagcatggtcacgccggtccaacaggcgaaacggtattccgacagcctgccgccatcggaacgcccgaccgtgctcatcacctgcaatttcggaacattccgcctctacgatctggaagccgacccgttggcccgcaccccgcaatcggagttcacgcttgccgacctgccgaaccatatcagcgagatcggccgcctgttcacgcacgagaactcccgcgtcgtacaacaggagcggctgtcggtcaaggccggccgacgggtcgccagactgcatgactctttggcgaaatgcttcgaacatccggacgatccggcggagcatgatgcgctggcgatgctgaccgtacgcctcgtgttctgcctgtacgcggaggacgcgaacctgtttcggccggacgcgctccgcgactatgtggcggcatccacgcccgaacgtctgggcgaagacctctatgacctgttcgaggtgctggacacgccgatcgggaagcggcgccgttacctgccggaatcgttgaaggcgttcccctacgtggacggcggcctgttcgccgaccggatcgacgtgcccccgttgaccggggagctgcgtgacgccctgctggacatcagcgagggcttcgactggagcggcatcagccccgtcatcttcggctccctcatggaggagacgctcagccatgacgaacggcgcaagggcggcatgcactacacgtccgtcaggaacatccaccgtctcatcgacccgttgttcctcgacgggctgaaatcggagctcgaacaggccgaagcgaaaccggtcgccggcggggcccgcaccaacgcgctcaacaagttgcatgacaaaatcgccggcctccggttcctcgaccccgcctgcgggtccggcaacttcctgaccgaaacctatctggaactgcgtcgcatcgagaaccggatcctcgccgatttggacaaggacgggcagctcgccctcgatctgggcgacgacctgaacccggtcagggtcagcatcagccacttccacggcattgaaatcaacgggttcgcctgcgcggtcgcccgcaccgcgttatggatcgcggaacagcaagcattggatgataccgaatcgaccatcagtggcctgccccggctcccgttcaccgatacggcccatattcaacaaggcaacgccctgcgcctcgactggaacgaactattacccggcgaccactgcgactatgtgatgggcaacccgccgttcatcggacacgtcaccaagaccgccggtcagaccgatgatctgaagaccgtgtggggccgccagtatgacggatatctcgactacgcgaccggatggtaccggaaggccgcctcctacctgtctaaaccggatgcggcgttcgcattcgtcaccaccaattcgatcacccaggggcagcccgtgggacccctgttcaaaccgttgcatgcggacggctggcatatccgtttcgcgcaccgcacgttcgcatgggacgcccagtccacggacaacgcgcacgtccatgtcatcatcatcggcctgggcaggaaagcgaagcccgcgcccgtactgttcgaatacgcggacatcaatggggagccgaccgcccgcaccgtggacaacatcaacgggtatctcatagacggccccgacctgtacgtaggcaaacgaagccagaagacgggaccggtctcgcctcttctcgatgtcaccgattccggttccatgcccctggacggaggcaacctgctgctcgccgaccgggaggaatatgccaaggccatggccgatcccatcgccgcacgcttcgtccggccgtttcgcatgggacgcgagctcatcaacggcacggaccgctggtgcctatggctcagggacgcggagccgggggaactgaggaaatcctcgttcctgaagaagcgtgtcgacgcatgcgccgaataccgtcgcaatgctccaatgaagggcgatgcctacaggcatcgtgcgacaccttggctgttccgtgacgaccatcagccgtccatgaactatcttgcgatcccgaaggtgttcagcgaggatcgggaatacatgacctgcgactggtacacgccggacatcatcgccggcgacatggtgtacaccagtcccgaccgggatggcctcgcattcgccgtcatcgaatcacgcatgttcatgacatggcagcagacgattggagggcgactggaatcacgctgccgtttcagcaacacggtgatttggaacaacctgcccctgcccgccctcgacgacgacacccgcatggccctgatcgaggccggcaggaacgtgctggcgacgcgagccaaccatcccggccagtccctggcagacctgtacgatcccgactacatgccgaccgacctacgcgccgcccaccgggaattggacaaggttgcggacgtggcgttcggcgcggatagacggctgggggacgatgacgacgcgcgcctcaagatcctgttcgattcgtacgcgcgcatgacggcggagcggggctgattccgttgcgcccatagtcggaccgcatggacgaactgcatgaatgcttcgaggagcggccccggctcgaggcctgccgtccggatccggacgatcccgtccacgaccccgtctggtccgacatcgcaagggatgatcggggcgtgtacgcgaccgtaatcgccccacgtcccgtcaccctgctggacggacaggggtatgacggggccggcctggacgggttccgcccgcccgtcaccctgcggcccggcgaacggttccgcatccccgtcaccatcggcgcacgcgggcgcgggcggcacccgtacatacggttccgctaccggtatgcggacggtcgacgccccgccagcgtcatctggcgcgtccccgatcagggacgcatacccggggcatggaacgattcgacgatttcatagccaccctggacggaacccagctgctcgccctgttcgagcacggggacggcgtcatggcggatctggccgcgcatgcgagactccgtccaggccagatttccctgctcatcggcttcatggaggagacgagcccgtcatggtcggcggatgtcgcctaccagctgatcgccagccaggattgcacgcccgcccagttggaacggctgatcggctggtgcgatgaccccggtacctgggagatcgcgtgcgggaagcatccgggcggcgagcgcgcgctcgtccgggccgccgacccgtatacggcgctccgatacgcgcatcgtatcggcccggatatcatggccggattcgcgcgcgacatcgacccgacggcgcgcggtgcgcgctacgaggcgggacggctgcgccgccggcacgacttcaccggcgaagccgattcgatcctcacggcgaagggcctgtgatggggacgcatgcgtgaggggacagacggaaaggaagacgaaaatgctcaaccaagaagccaaaacactcgaacacacgccgaccaccggcatggaggtccacgagggcgacatcttcgtcagctcttggggctacagcatgaccctcgttgacttctaccaagtgaccaaggtcagcaagacgggcaagagcgtcagcgtccgcagactcgccagcaaggtcgtgtccgggaacatcgactccccgcaaggcgggtacgtgatcccgatcaaggaccgtttcgagggggaggagctgaggaacaagcgcctcaaggccgattacggcgcgaacccccgccccatgttcaaggtgaacgactgcgccagcgctcgtctggctgacggaatcaacccgaacgggtactacatgaacacttgggactgattcacacaaacacaattcttaaaaaggagccgacatgaccatcaacctgcacgacatcaccggacaggaatcgggaatcatcctcgtggaaatggatgaacgcggacgacgcatgaacatggtcgccaactggggcgacaaggacggactgccgtatctcgtcgaaccgatgctcgaaccgttctcgttcgtcttcctccagtcggaggacgtccacgtcgaaaccgaacgtatccacagcgggacactcaacgacgaaatcgcccacgacggcctcgaagactggaacccgttggatgacgacttggaatcggacgaaccctgcgacgtctacccattgtcgaacggctggattgtcgtcgcgccgaaggaatggaactgacaaaatgaaaacacgcgacattctcagcaccgtcacccgcatactgccggactggcatgtgtacaaggaccaccaatccggatgcatcaccgcattcgaccctcaagcgggatacgaggtcaccgtcaaccttcccgacagcgacaccatccgcatcgtccgcacgcggtacgagcttgtcgaggataacaccgtcctcgatacagccgacatgggcgaggaacgggcattggacgagctggcccgactgctggcttcgcccatgccgcgcaccgaccggctcatgtggctgaaagaccagttcgacaaaggcgccgaatggtgccggagcacgctccacgacgaacaggaggcgaaggacaccgaggatatggccgaacactacatgcgcgtatgcgaatcctgcaacaaataccccgaactcgaccccgcgaccgtgttcgaagggtggctgctgggcgaggagcttggcaacccgtatgaaacgcgccgtcaggccgcatcgcacatgctggccgacgtgcgccgactggacaaggattgaaccatgttgaacatcgagaagacgctgcaatctgtccgcgacctattggaccggttggacaaggaaggcgtggagttcgctctggttgaatcgaaatactgcaactgcgtagcgggcatccaagaccctaaggatgacgtgcgtgtgttcttagattgcacgattggtacggacggtcgcttcagctggcaggattacgacggtcacgaaggactctgcgacttcgacgaattccgtgtactgataatcaatctcacggcggacaggagaagcgcgaacagtgggcagacctgtgtgacaacgtggacacgcccatgccggattctctggccgccgttgtgtccggctgggaaggcaaggcggaccgtctgcgagcattgctggaacccgacgacccgcccctgttggatgagcgggactttgaaatcctgagaagccttctgccgcatcgcttggtcggaccggggaagaaatcaatatgtgttcgcaccagccggggtcctatcctcctccggagtgcggtcgaaccggaggaggaagcaaaacggctacgggagctgggcgtattggaacgccgatacatcatcgaccacccagcgcacggccaagtgttctacgacttcctgaccgacaaaggctggaaggcgttggacttcgcgtggtacgtcggacttgtgtagtgaactaccgcgacgctcgccgtcgcggtagttcaccggattgggaaaggatgaatcatgttgaatctcacagaactcatggacattggttgcgcccataccgtgaccgattcggacggttggatgtacccgtgcggcaaacccattgtggcaatccgccgatggccggagggcgacggggaaagcttcggcggtgtctgccagcggcacgccaaacaggccggtgccgaactcgtgccgttagaaaacgttccgcagtaaggcagaaaggaaaaaggatggcgatgaacgtcaagcagaaggacaaggagcaggtcgaatatctacgcgaactggtgcacgatatcaatgagtcattggaacgctacggcagcgacatcccggaaaacaagaaggactaatcaatggcaaacatcaccaagcccgccgtcgaacggcattcctgtgatatcgccggctgtgcgagcatggccgaaaatccaatgtactggggagtgagcttccccgtcatcgcacaggacaattacgacgacggctcctatttcggcggcacgcgcacccggatcatcaaccggacgctcgacctgtgcgaacaccacgccggcaccctgctcgcattgcacggacagcacaccagcaactacggggaagtatggacggatgatgggcccgaactacaagcccatgacgcccgccgcgaacaggcggaaggatgacggcccatgaccgaggtcgacaaggctgtgaaacagctgaacgattcaggtattcccgccatgcgctcctcggatccggactatctcgtctttgagatcggcgagagcgtgttccgtgcattattgtccgccgatccgacgcatgcggcaagccagctgattcgtgcggccggggcttgcgggggaatcatcgccggctatcggaagacggtcgccggtctcggccggatcgagtccctgcccgcggatgatgtgttctgggacgagctgttctcgaacggggaaccggtcgaaatcgggaccgtcatattccaggtccaggtccaggccggcggggacgaacatcccgtcggcctggacctgctggtcgtgtcggacggcacgtggcggccggacggtttcgaccccgacaaggaaggcgccgccggcgacgtgcgcgactatctgacccaatggattaaggagaatcatgaatgttgaacgcatcaccgtcgagaccaacgacgagaccgggaacaatccggttgaatacgattgggagttcggcccggacggcgtgttccgcatgaccggtgacggggatatgcccgccgccttcgaggagtccgccgccatcgtggaggcgttcaaccatgtcaacatgagcatcgtgaacggggagcggacaccgctgaaggacggcgatcacgcactgctcgcccttcttgccgccgtcctcgccaccctcgtcccgttcgtggaggggaaggacggcgaccaggtgggattcatgatgggcgatacatcgaacggcttcaacgtcaatatcacgtcggcggagttcctggcctgctgccggtccatgtggatcggcgccgacgtgcatcgcggcatgggccgatacctgaacttccgttgggacagggatcgcggggaatgggtcgaggcgggcaccgggctcgcgttccccggggcggacagtcaggtggctttcatgctggagaccggcatgaacaacggcgacggcatccgcttcgaccccatggaaggcaaggaggaaaccgtccggctgttccggctcctgttggagacggcgaaaagcgcgggcatcccggtccggtggggggcgtgatggccggaagaaaatacatcatcggcgtgtatatcacggacggcgaggacgccgatacgatggcgacgctcgacatcagtagcagaccatggcatgcggccatcaacgcccgcgacttcaagccgggagcccggcatgcgctgtccttcggcctgcggctcctggccgacaggctcgacgaatacaaggaggagtgatgaccgattactcgcaatggctggaaacggtgtccgaggcggtgcggccggcgaaaggacgccatcatcctcgccgtgctgtccgtgttctgcttcgccggcatggtcatcgcattcgtgggcggcatcgccttcataggccgtccgaagaattcgtgaaggccaacgtccggatcacggccgtgatggccctgggatgcgtcgcgtccgtcatcgcgttgctgttcgcgacggcatccggacccaatggcgtggaaccgttcgcaacgcataccgagaacatgtacggtatcgaacatctgcgctgcgatggagcggattgcccggcatacgacctgcccgcggacaacacccccgcaggctggctgaaggacggccggctcgaacagggccgcttcatcgtggatggtcacagggtcgggttggccggccctgacggggaactattgaagccggtgaaacggtgagcgggttctggatcggctatctcgccggcctcgccacactgcctgccgtcgcggtgctcgtgttccttgggctcgtggtgtccgcactgtttccggcgtcgtacggatgggagtgctattgctgcggtgagaccatcatcacggaacgggacagccatccggtgccgggtctcaccgcatgggcgagattccaggcgcaccggctgaccaaacggcatcgcatcaaccaccgggcatggatgaaggctggcaaaccgtacgcagactggaagccggtggcttgatggaacgtttcggttcagaccagttgcagggtgcggccgtcaggcatgaccgcattgacctgcagcttgcctccaatcgcgtcgaggtatctgcgcaaagtgcggatttcggttttgtcgacgtcgccggattcgaggctgctgacccgcttctggctgacgcccatgcgttcggcgagctgcttctgagtcacgtcctgccgcttgcgggcctccttcagctcgtacaggcgaacctcttcgagaaggcgattcttcgccgcatcgatttcctcgcggctgattccgctgtcggccgcgaactgttccggagtgtagctcatgtcgattcctttcatttgttgttctgtttaagccacgcctcataccggtcttccgcttccggtatggccgttttgtaccatttcgaccatttgttttgcttgtctccgccgacgagcattatcgcctgccggttcgggtcgaacacgaacagtattcgtatttcgcttttgcctgcggagccgggtcggagttccttcatcgatttgattttggagccttcgattttgcctaccagtggtcgtctgaggttgggtccttgttctttcaggacttcgacggcggcgaggatctgcagtttggattctcggtcgaggccggtcagccagtctttgatgggttccatctctatcttccacataatcacaaatataccatataaggtatacaaagtaaagcgaggaaagatatgcggttcaagccaaggaacatgctgccgtccggtctggagcagtccgagttcagtgaaccgtatgatccccttctcatccgcaaggcgttggagccggaacgtctgacggccggatgcggcgcagtggtgttttcggatgccggtctggccgattgcggtacgccgatggaagagcgaggaggttgatcgtccgctcgacgacgcgaccgattccacgtgcgacctgtactccccggtatgcaagctgcacgccagacgtgacgtgataccgatgacggagatcctgaaggcgttgcgaggccaggtcggccatcatcgtgcgtccgacggcgatgatctggaatcccgcctgcacgaggcgatgttcgactggatgcttgacgtgggcgtctggacgcccggggatgtgatccccgttgaggtgacaggctgggaggagacgccggacacggtcaggatactcgcgctttccgtcgacgggatgtcatgcgaggccgtgtacaagggccggctggacggttttcttcgcgaacgcatatcagggatgggaaaggagccggaatcatgagcaagatcagtgaatcattgccgtatgatctgaatattatcgccgcccaatgcgacccgttgaccctgcggctcggcacggccggcgtatcccgcaacgggaaccatgaactttgcggcaggcccgtggtcgctatccgtcgttggatgcgctcggacggccccgactgcgaggatatgcccgaaaccggatggtacggtcccgtatgcaaaacccacgccagccgcgatatggtgccgctgtccgtcgtattggacgtgatgatgggagccgggcgatgatgagcgcatacgactggttcatcgcccgatgcaaggcggtcgtcaaccatcccaggccgcccgaacctccgatgcgcctccgcctgcacgaggcgggtcatgcggtagtcggccatcggttcggatacacgcaacaaggcatcatgctgcgggaggatgataccggccagaccagccagcagtacgccaccggtccggacgatgatatgtccgtccgattgcagacggagatgatcatctccatgaccggtttcgccgtgaccatggaatatccggaataccggaccgacgcgctccgcatcggcggcgacgtgcaggcggagctggtggacgcggcgatcatccaccggatcgacccgtcgatgggctccaccgaggagatcatcgactcattgtgggtcagggcgcgcctcgtcgcaaggaacaacagcccctgatccggacggtcgccggcaggctgaatcgttacggctcctacacgggcgaggaaatccagcggattctcgacgaaagtatgaaggagcttgaccggtgaacgcattggaatggcccgccgacctgaccgacttccggctccccgtcaaatgggatgggcagccggttgattggcatggctggcatccacccatcgaagtccgcgacctgttcctctgctcgaacaatggactgttgcgcgacccgcaaccctgttccggctgcggacacccgttccaaccctggtgggcgcagggattgacggccgacgggcgcacctccatcaccatcgaacgctgcgggttctgcaacacgaccatcgcactcgagaccgggccggatggaacaagcgaatggacgttggatgatagcgactacggaccggaaggcagttccgacaatcaggaaggaaaccgatgatgttcggattattcgggaaagaaggaaaggcgacagaaggaggaatcatgagtctggaaaccgtgcgttgtctcgcgtggacggcgatcatcctgttcatcatggcattggtgttcgcgttcaaccatgggccgatactcgcctggctggccgcgaaccatacgccgctgttcgccggaatcatccagtcgccgttgtgggctgtcgcattctggctcatcatcctgatgctcctgtgcgtgatcggcatcatggacgacgacgagacgccattcgcgatcggcatgcacgcgctcggcatcatgctgtgcatcggctactgggccggcggcttcatgctggcatcccgccagccggccgacgcgaactgctacgggctgctgggcggcggcatccttttcggcctgatatggatcatggcccaacggcaagaggcagacaaggagatgtttccgagactgcgcgaccagatagccgacttcgcggtcgaccatatcgcgtcggaggaatatcggcggaccggcggaaagaaggattccgaccgtgatcagatccgaactatcgtgataggcgagccccggaccatagaaggttcggggcttttgcgtttgccggcccgcaaaccatgaacgacacgcccgcctgaaaagggcgtacagggggacgtccgggctgaatcggcattaaaaaacgggttcggaattgcatatgggacaggaattgcatgggccctccggatttgcatggggtcgggtgacgcataccggttcccatggctgtttcgagacgtgatatgggggagaggctgttggaaaggcttctcctgtcgggaggctacgggccaagcagcatgccggtcagggtggtcggctgggatgatgcgagcctgaacggccggccggtgacggtcgtctattacgagacccgggatgggggaggcaacgtgcgtacctatccgggcgacagccgtcggctcgcctacgtggatgcgcgtccccgcgcgctcatgcccggcgcgcgcctgcatggcgggaacgcatacgtggagccatgagtcttacgcaatgggatgacggccgcatccgtctgatgccgggggattgccgcgacctcatcgccatgctgccggacaacagcgtggattccgtcattaccgacccgccgtacgagatcggtttcatgaacctgggcttcgattcgacgggcgtcgcgttcgacgtggatctgtggcgggatatcctgcgcgtcctgaagccgggagggcacgtggccgcgttcgccgccagccgcacatatcatcggctcgcctgcgcgatcgaggacgcgggcttcgaaatccgcgaccagatcgactgggtgtacgcaagcggcatgccacacggttcggatgcgaggctgctcgtggacagggagcctggcgcgacacgaaccgggcaggcggagcaatgggccggctggtacagccagctgaagcccgcgcatgagcccatctgcctcgccagaaaaccgttggacggcaatctcgcccacaatctgctcgaacacgggaccggcgcgctgcacatcgactcatgccgcgtcccgttccgcaacccggcggatgagaccgaggcgaagaacaagaaccggcatggacggttcggttccggaccgcgggacaaccatgtatacggcgcggataatgcgaaccgcaccgactataaggcggacgcccggttcgcgccgaacatgctgttcgaccggaccatggccggagagcttgaccggcagtccggggtgacggtcagccggaaaggcaaaccacgcgcgagcgcgagaccggacgccggctggggcatgacccggacgggcgcggaatacgatgatgccggcggcgcgtcccgcttctacccggtgttcaggtattgtccgaaggcgggaccgggggagaggccgaccgtggacggcatcctccatccgacggtgaaaccgttggaactgatgcgctggctggtgcgtctggtcacgccgccggacgggctcgtgttggagccgttcgccggcagcggcgccacgttggaggcgtgccggatcgaggacgtgcgttgcgtggcggcggagatggattcggattacgtgcggctcatagcccgccggatggcgaggccgacgaacccggtgctgttctgacatcgccggggacgcatgcatgccggcgtcgatgatatcgggacgatacgaggagtgtgcatcatgtttaaaactcgctattattacgctttttattggacttacggtatcggcacgacatggaatgacgggtcatggccgggcaatctctacgtgtttgactcgatggcggaacgtgacgcttgggttgccgacgacgtttttgacggtaattggcatcgcgaggccattacggcaaaggaagcgcgtcatatcatggcagacactgttatctcttttgacaatgatatggccggacggtacgacggtagccggtcggccatcgaacggtacgcgcctaccgtcgaactggtcaaagcatggcggcgtattgacatgcaaaacaatccggccgcgtattacgcggaatgattgccgtaatcgaccactgggggcgcggctacatggtgcgagcccatcgttaaatcaatcgtttcggggcatggcatgggagtcatgccccactttgtaagggagctaaacaatgattaccgctaaggatattgcggatatggtggaacgtgtcgatgcgaagggcgcggccgtgtccacgggcgacgggctcgtcgatctcgcggtgatcgactgactatccttcgatgaggcgttccacgccgtcgatggcgccggcgagcatgtcggcgtccacgtgcgtgtagatggcgttcgtggtgccgatgtcggcgtggccgatgatggcacggcgggcgaggtcggagacgccgatgcgcgccatggcggtggccgccgtgtggcgtgcggagtggacgcgcacgcggggcagtcccacccgttccaacgcttttcgccatgcgttctggagtgtttccttgcggatggggttgcctcggccggagcggaacaatggggtgtccgggtcgatgtcgggatggtcggccgtataggcggcgaggtcggcggcgaggtcggcgggcagggggatgagccggcgtccggatctggtcttgggtctggtgagccatgtgcggccgtcgagccggcgggcctcgaagccggcgggcatgtccgtgatgccgtcgaattccttgagctgccattcgacgagcaggcagggcagtccgtcggagcggacgatctcgttgcgcgtgacgcccagggcttcgccttcgcgcagtgcggtgatgaacaggagccgccagatgatgctccatcgcgggtcggtttcggcgtggatgagcatggcggcctgtccgggggtgagggtggcgattggggcgggcggcacccggttcttctcgaccgcgtccacggggttgctgcggatgatgccttcggcgacggcggccttgcatgcctcggacaggacggtgtgggtcagggcggccgtggcgggggatttgccctggatgcctttcgcggggtttccttcgaggcagtggcgttcgacgaggcgtatgtgggcgggtttgagcctgtccatgcgtacggcgccgatgacgggggtaatgtcgtgttcgatgcggaaccggtatgaccgggtcgtgttgggtgcgcgtctgggggtcacgatctcgtcgatccagcgtcgcatccattcgttcacggtgggcggttcgtccaccagggtgatgtcctcctcgatgcggcgggctttggcgcgggcgttgttcagggcttcggtccgggtgtggccggtggcgctggtgcgtcgtctggagccgtcggccgggttgggggagagttcgacgaacgcccggtatctgccgttgccgagtttcgtgatcgcgccggctcccttgtctcgtcttgtcgtgtgtccgcctgtgtctgccatgtcgtcgccttccgggttcgtcgtgtgatgacaacccccggtatgcgtatcggcccggtccggtcggcgtggcgcgtgtgccgagcgtgtgcctatcgtgtgcctattccagccgaaaatagccggatatagccgtaaacgggagtgccgtccttccatgacgcgcgcacgaagaacggcgttgtcccgccgttttccgctgattttggccacttcccggtttcttccgaaaacctaatctgacataacgtacattatcggatgatggatataggggatggatggcaaaatccttggaatcattgggaaacggctttattccaacggttcccggcttccaccatccgaactgccatcgcaccagatgcggccatattcggctattttcggctgaaataggcacacgattggcacctatcccggtcggaaacgcataccggggcccgaaggaacgggaacaccgaaggacccatggaaaggtgacatgacgacgaccgcagacagacgcgagaaaggctcgggcggaatcaccagactcgccaacgggaaatacagggccttcgtcgaaacgacccccgaccccggcgacgggtcgagacgacgcgtgagcgccacgggccggaccaaaagcgaggcgctgcgcaaggccagggacaaggccctgcgaccggacatgggcatgacccccggcgggaacgccaccgtcgccgaatggatggaccactgggtggacgaggtcatcgaaccccgacgcgccccgaacaccacgaaaagctaccgcacccgcatccgcatggacatcacgcccgtcatcggcgccgtcccgctcgaccggctgcgccccagccacgtccgcatggtcgagaaccgcatcctgcgcggcgacggacgcaccgggaccgacccccgttcggccgcgaccgcacgcctgacccacagcatcctcaaaaccgccctgggcgacgccatggccgaagggctcatcgaccggaaccccgccgccctcaccgaagtcccggaaaccgaacccgtcgaaatcgccatcctcaccaccggacaggcggcacggctcatcgctctggaacccgacacgaaatggcggctcatctggcggctcctgttcatcaccggcatgagactcggcgaaacgctcggcatcacccgacaggaactcatccgatcggacggactgccctgcctgctcgtcgaatggcagctcaaggaattcgagaaggacaccgtcatccccgccggataccgggccagacacctcggaggccgcatgtggctcacccgccccaagacccgcaaaggccaacggctcatccccctgcccgccgaccttgccgccgacctcgaatcatacatggactcggccggcatccccgacgaccagccggtcttccgatccggacgcggcaacccgatctgcaaggacacgctgcaccacgcatggcgccgggccctggaccgggccggtctgccgcacgtaatccgaatccatctccgccgccacgcaacgcacgtcctcgatccggcacgcctccaacgtggcgccgctgccggcgaacggctccaacacgagcccgtccggcggcgtgaccagacgcaccagccagcgcatcagttccaacggtttcaccgtcggatggaggatcccgtccacggtcagcctctccccggtcccgccttcggacaataccggaacacgggatagaagcgggatgcgccgccggcatcatcgtattccgcacccgtatgggtcatgctccagccgtcaccgggtttcgtgcttgcgcgtggtttgccttttcgactgacggtgacgccggactgtcggtcgagttccttggccgtggattggtcgaacagcatgttcggcgtgaaacgggcttcggccgtgtagtcggtgcgatccgctttgtccgcgccgtagatgtggttgtcgcgcgggccggagttgaagtcggcatgccggttcttgttcttcgactccttctcatctgccgtgttgcggaatgggatgcggcatgcgtcgatatgcagtgcgcccgtcccgtgtccgagcagattgtggtcgagtgtcccgtccaacggcttgcgtgcgaggcagatgggttcgtgcgcgggcttcagctggctgtaccagccggaccattgttcgccctgttcggtggcgagcgcatcccattcggatttcgtcttgccgccgttcgcggtgctggaacctccgaagccgttggtgtccgaatatcctgcgccagcatgacctttaccggccacatgggtgcgttccgcacccaattccctgtccacgagcagtctcgcatccgaaccgtgtggcatgccgcttgcgtacacccagtcgatctggtcgcggatttcgaagcccgcgtcctcgatcgcgcaggcgagccgatgatatgtgcggctggcggcaaacgcggccacgtgccctcccggcttcaggacgcgcagaatgtccttccacaggattacgtcgaatgcgatgcccgtcgaatcgaagcccaggttcatgaaaccgatctcgtacggcgggtcggtgaccggtttggcggcgcaagccccgtcttttaaggctggggtgagccgccacttctttgattaatcactgtttccgtggcaaggtttatagcatgagccagaaggtacgaatcatcaaagtcaggcatgcgggcgcatccgtgtaccttggcgacgattcatgccgcaaccattgctggacgcgcaatcccgaacgtatcatggactggctgtgcgatggttggcgcacccgtttcaaccagcatcgggagcatcggacaatccgccgctacatggaggacgtggaatcccgtgagcgcatgtgggtggacgttcccttgggtggggcgaccgtcggggagccgttcaaggacagcgaggctcgaatccggtgttcttggctcgcatgcattccctccgccgttctcgccagtcccatgcgcgtggagaattcggaatggtatgccgcgttgaagcgcaagaagattaatggcggtcgtgttccggggttcaaatcccgcaaacgcgcccccagtatttcgtatgttggcgcaaccagaacaagaccggcaacgccgtctaccatcaggtgtcacgcaagcgtggcgtggtcgtaatcaccggaagcgtgaaaaaggaattccgcaagccgggcgaaacgggatgccgttggatgctctccatccacgtgcgcgtcagccaacccgtcagggattacacgagcgtggcggtgaattggacggaacgcactctggcgttcaccaacgaaccgtcgcccatccgacggaatgccgccggcaagcagaccggtatcgaccgtggctgcgtccacacattggccttgtcgaatggaaccatgctggacatgccgcaaccgtccgaacgggagaagcgagagtatctgcgcctgcaacgcaagctcgcccgacaagacatgaccaacagccgacgtggcgggaaaaccgcgaaattccagtcgaaacgacgcaaactcacattgaagcgcatgagttcgatacgccgccgcatcaacaaccgcaaggacgattgggtcgcgaagaccacgacccgactggtcgaagactacgacctcatcgccttggaagcgttgaacacccggcagatgacccgcaagccgaaaccgaaacaggaccccgaccataagggacgctacctgcgcaacggttcggcggccaaagcgggattgaaccgcagtatcctcggcaaccgttggacggacatccaggacaaactcgaatacaagacccgtctcgccgggacccggctcatactggtcaacccggcgtacacgtcccagacctgcaaccgttgcggccatgtcgcaaaggagaaccgtgagagccaagcggtcttccactgcgtcacctgcggcaacaaggacaatgcggacatcaacgcggccaagaacatcctcgaccgcgcgatacacacaaccggcatggacgatgccgagggcgtggagggacacgcttcccgtgaaacctgtgtttcacgggaaggttccgttgaaacgccaacccctgccacgcgtacgggaagacccctccaatgagtgaggaacgtgtctcacatgcgacaggaatcccccggcttcagccgaggggaggaagtcaagtgatatccacgctcaaccccgattcgaccgaaccggacacgaacgggatgctagccgccagcatagcggccaacggtctcaaccatttcgcatcaccgccggacgcgatacgctccccatccacgatggattcggcgatatgtccgaacgtctccacgatggccgtggaatcgtcggcgccggagggaatgtccccttcgccggtcatgtgggacacgccgtccgggtcgaactcccaatcgtattcgactggattgttgcaggtctcgtcattggtctccacgatgatgcgttcaacattcatgattgctcctccacccattgggccagatagtcgcgcacgtcgccggcagtgcctttcacgtcggaatcgaaaccgtccggccgccacgtgccgtccgacatgaccagcaggtccaggccggcggagtgttcgtccccgcgctcgaacagggcgagcagctgggggccgtccagggtggctatggaatcgtcgaatcgttccatgccccgggtatgcgtccccctaatcagggaaacggggtcagcggctgcgccagtatccactgacctcatatccgcttcggatatgagggctcacccagacgccgcccccgctgaaggatgccgtattcgcctttggcttcgacatccttctgtgcagtggctggatgttctcgtttgccttcgaaaccgccttacgcatggattccctcagcgaatcgggcaaaccggccgatgcctcatccagatggtcgagaacggctcccgccatggtccgggcgatatgcgccacacgttccccgtccaaaccggcctcctccgcgaaggcctcccagtcgaatggggtgagcagttccgcgaattcgactccgttgatcggcatcgccatctcctgatccacatgaggccatattctggtgactgtcatgtcgtacattggcgcgaaacggaacccgttttcggcaagaacaatcgaatagttcttgccgtgggagtccgaatcacccgacgagacgttgaaggcgagccggcgaacccattcatatccggtttcatcgcttgggtcgaaatggtgcaggaaacggacgcagcttgcggcgccgatttcatacttggattcggggtccatgcccatggcctgcgctagatcctcgcaatggattcgtctcacgttgtttccatccacgatgcgatcgaaacgtcgggtgatgaaagcctccgccccattcgcggtgagaatgccatgctcggataccggcaatccgcaaagagtcccgagcgtcagggcggcatcctccaccctgtggctgccgggacaatccctcatttcaggtttgatgatatgggtggaggggatggatgcgttgggccagagccagacaccagcacgtcgggcgagcgtgaacttgggctggcctccggcgatggagaaacggcatttcggcgtatcccgctcatagaactcatcctcatcatcccgtgcgaaccagttgtatccgttcgcacgcacgtatcctatctgattgccgatttcctcctcgtcgaggggtttcgcctcgatgggatggtgcgggagttcgggcttgtccgagaatacgagtccgcctaccgtatccgcatccgcaagaagtttgaacgtgtccgtcgaatccagatggagtcgcgacgccatcctacgacgggcgttctcatcgtcgggaagcaggttttcgagaaaggccgacgccgcttttccggaggatttcccggttcggggcagactgaggcttatcggcgcgccttccttggaatcatagtggaatgaaacatgtccgccggaggttcgcatgaattcccccacatggtccccgtcggtccagacatgcagtcgttctcctcgcatcatgcctccagatattcgggcggaaccctatcgggtttgacgccgagtgtggcgaacacgcgcagggccgcttccagcggtacgatcccgcattccgccatatcggtcacgatgctttcggagacgccgcttctgtccgcgatttctgacggggttcggccgatttccgtgattcgtgcggaaataatctcgcccgccttttccaatgagggcatgtcgcgaatgccgtcatgcgatggttcttcgctgatggagatctcatcggttttcgacggcagggcgtcgaattcgctgtaatccatttctcttccgctcctttccgggaaaagcatgcgtcccgaaaaccagaggattgcgaatcaggctgctcgaaccatcataacgtcgaatgccttattccggcacgcgccagatgacggcgacgatgcgcgtcccgtccgcataccggtagacgaaccgcatgtacgggtgttcatgccgtccgtgcgcgcccacggtgacggggatgcggaacacgtcacccgggttcagggtgacgggcgggcgcagcccgtcgaggcgtgcgcccgaatatccctgtccctccgatatattgacatcctcccctttcttacgaaaggggattcccgtcgtccgtcggactctctgccccgaccacccgatgtctatttagaggtgcaacacccctgttggtcctgcaattccagcagttcgtcggcgaatgcctcggcgggcgtccggtagtccggcacgcgcatgggacggttgtcggcctcgtcgacaatctcccgcagttccccggccatgtccatccggatctcgctgcgttcgggcggataccggcggatcatgccgttcccgttctcgttgcttccccgccgccggctggagtacgggtcggcgaagcacgtgtccatgcccggcccgtcgcgcaggcgcgtgtggcgggcgaacccggtgccgttgtcgtgcgtgacgccgccgcgcgcgccggccggcagcggcgagaacatcgccagccgcgccccgacgctttccccggcggtcctgccgggcacgatcccggccatgaggaacctggtcttcctctcgacctcggtgtgcgggttgcatccggcgccgatcacgccgtcggcctcccaatggccgaaaccgctgcggtctccggcctccggcgggcgtccggagatgggagcccgtccgggaatcgggaaacgcgacgtcctcccgccgccacgcccgcgccgcctcctgctgccgcgtggaaggcggcgcgcccggcgctcacggtgatggcggtcgacgtagatccaacggcagacgctctccgggcgcacgcacatggtggggtcgtcggggaacaggacgcgcggcctgccgccgacgggcggcggcgaccagccgcgacgcagccattcggccacccgcgcccacaggcgttcgcatgacaggcggtggcgcctgcgcgatctggcgcgcctgcggccggccctgcgccgcgcggggccggcgatgtagcatccgcccgtccacgggcccgtcttcagccgtttcggccggcacggccggcaggacccgttctcgtcggacgggaaccacgtgtcgcgttcgatctccctgccgaccgtcgaggcgttgcggccgagcatcagaccgatcctgcggatgctggtgccgttgccgatctcgatccggatgacctggcgttcctcttccgacaggcgcgaacatgcttctcccataggtgcaacatcccttcggactggttatctggacaatctccaatctaacgggtgttgcactttcaattagacaacgggtgatgccgctgcgttgttgtgttgtagtaatatcggatgatgtaaacaccgtccagtggttccgacaatcgtaatcgttcgtattggctgaacgcattttattaaggtacagcaaaggagcataccatgaagcgttccagatctttagcggcgctcactcggaccaagcgtagactgatcgtcaccgttgcgactgctgccgtgctccttatatcgagctgtgcggcagtcgcaatggtgcaattttaccaagcggattaccaagctttggagcaacgtggggcaacgcgcaagacccttgattcttttcgtgccctcagtactgcggatgggcttttcgatatgcccgagttagacactcgaaacactgaggaatcacgaatcaacgccacctacatggtgtctcagatggtgggcgagaatcatgacaaggtatctactcaacgcactctggattccctatacgcttatgccaaggatgaacggaatccgcttgccatgagactaaaggcctattctgactggcaccgagcaaagttcctgcatatcccgtccggtgatcaagaaactcttcggttgcaagaactcgactcaaatgatcgcgatagatggttcacggactggcgtgtgcagcctgacactcacctattacgcctatagatcgggggcagcgccattatgatgcggggcatcgaaagcagcgttctcgtcttcgaccacgtgtcgaaacgttatgcaagggacaaaaaccgccggttcgttctcggaccgatatccttttcgctggagtgtggggaagttcttagaattcaaggcgattccggttccggaaagacaacggttctcagaatcgcgggtcttcttacggtgccggatcgcggcggcgtacatgtgtgcggagaaaaggcgaccactgagaaatcccgcaatcggcttcgcgccgcctgcatcggaatcgtttttcaggatgcgaacttgtttggtcatctgacggtgttacagaaccttcttgttgcggatcaagggaaagggaacagcgcagaatgccttgagttgctttcccggtttggaattcggcggctggcgaatgtgaaggcgggcaggatttccggcggcgaacttcaacgtgccggaatatgccgtgcgctgattaacaggcctcggctgcttttgctggatgagcccacggcatcgctcgatgacgcggccgccgatgaggtggcatcggccattcgcatgctgagggaaaggggtgtggcgattttgctggccagccacgatcctcgtctggatgggttggagtcccaatcgctgcgtcttgaggccgggaaggtggttgtgagctgatgagaaaggttctacgactcgcgtggtttgagcgaacgcatacgttcagaacatcgcgggcgttggttgtcatgctggcgatcgttgtcgccgtatgctattgccttcagggttttgtggtcagtgcggttcggtcccatgcaagcaatgtcgagaagcactccaacgtatccgtcatcgagctcagcacgattcgtccggacgcacgcgtcttggacggggaatcactttccgaagtatccggactggggcatgtcgtttccgtggttccatggatgcagcacgatctggatttggccgacgaaggcgactggccatctccaacggtcagccccggatcgctgtgggccaccacgtatttcgaaccgaggcttccgaaaatgatcaagggagacaggcccgtctccctgcaggacgacgagattctcctacccgattccgttcccggaggcagcctcaggcatctgtacggcaagaccgtcatgttcgggtacacgcatatcaacggtaaatatcaaggatcgtatagaaccattccactcaaggtggtgggaatctacgacaactccgtacccgacaaggatggcgagaatccgtcctatgtctccgaaaacacaatggatgccctgttcgacgggaatgtccaggaatcatacacattcgcatacgttcaagtcgattcgggcgataatgtccccttggtccagaagaaactcgccgccatgggattcggggtggccggtgccgcggggcagcaggatgtcacgggcattcttgccgcacttatgagcataggcaggttcatgttccccattgtgcttgtgtgctccctggtgttcggcttatttctgagcgtgatatggatgaagcagcgcaaacgttcgttggcgctgctccgatgccttggatacacggccgggcaactgagcgcccttgcactcgtccaagtcgtccaacttgtcgtcgcagcgggcatcgcgggcatcatcttgggggcgggtttcagtttgctgctggcgcattccgttgattccggcgatctgttgaatctcacgaatctggattcggtggttttcgatccggtactggcgcttgaaatgctcgccatcaccgtcgctggtgcagtcatcggggcccttcccctgagcgtaaggattgcacacacccagccggatgagctgatgcgcgggtagttcagtactcggcttttatggcggtgatggtgagcttgtctgattaattccaatactatgaggcatagttaaatgacgataccgatatatgtcatggtctcccttcacccaacccggacgacggttgcatgtccctcccccgcatcagccatccaatcagtcttcgcccggtttgtccatgtctccctcattcccgctcctcgctctatcgggcacgattccggcatcgtcatcatcccggcggtcggcgacgcccagacggccgtccatcgcggattccgaagcgttgcgcgcctgcagatacatggcgacaagttccaacagcaccagcgcgaatacgatgattgcaccgggcaattgcgcacgatcatagaacgcgagtatatccgcatccatcaaatccgctgtaaacgtcaacacgggaaacggaatcagcgccgccgcaaacgacatgaaatgcgttttcaccatcgaccagtcgaccggatcgaccggcggtcgccggcgtttcggcgtgaacagatggcctcggctgaccgttatagtgatgatggacacagcaaagatgacggcgaccatccacagaacgcccggcaacaatccgacaacaatcccgttcacccggtcctccaatcagtcataataatcaccgcaacatataaaaaacataagatggcaggcaacaaaagcaacacatacaacaaagcgacctgccgaccaaagccggcaagtcgccaacaaccatacatgtatcaggcggttgcgcgttgcaagcgctgtgcctcgagcttcttgcgcatcctcatggcggtcagttcatcaatcggacggcccgtggcaatcgtcagcggcttggcctcaagatcaacatattcttcctgttccaaggccgtctcaatctggtgccacaacgaacccaccgacacggcgaacactgccttaccgctttgcaacagttcgagcatctgttcgctggttgtgcattcatgtacgttttgaccatcgcacataatggtcacattggccagctgatcggtgctgcgttgagtcaagaatccgatggccgccgtcacgttctgcagattcacaccggcatcaagcaacttcttggatacagcgagaatcaccacatccttaaacgagtatagtcgtcgtgaaccggagccatgagacggcgtgatggacggctcaacaatctgcttgcgtgcccaataatcgagctgtcggtacgtgatgccggccaccttggaggccacagtgccacggtagccgcgcttgatctcctcagtatcgacgttggagaacaactccccctgaatcgcgtcagcgttcagattctgacggtcctcaagcgaaacatgaagatgcagcccggtctgtcccatggcacccccctaactcatgcgtgtctcgcatatgactcacactggtgtaatcacatgattgcaatttctgcaatcagtctaaccccatgctaggtgtggactattgggaaataatggcagatttcgtgaagaacacgaggcggaatttaccgatcatgatttcgtcgccgttcttcaacgtcgcctgatcaacacgctgacggttcacgtaggtgccgttcagacttcctgcgtcaaccacaaagaactgaccgttgaccctgcggaacacggcatgctgacgggatacggtggagtcgtcgagcagaatatcagctcgcggatcacgaccgacggtgatttcatcctcgtcaagcaagtaacgagaacctgagaccgctcccctggcggaaatcagcaatgccgttccctcggacaatctggtgatggtgtccagatcctcttgagtcagcggtcgatcgccggtggtggtaatgggcagtacattaatcgcgggcaggccgataatggtggtttcgcctgcgctaggaatcgggttggtcataatctcctattctaccgtctttgcatactggttttgcgtagcttcgcgtacttcgtcgataatgatgctgtcagaaggctgtacgttgacgttggacccgtatttcacctggagctgagcgcccacaccgccggcgatatcgactgcgttggacagttcctgcggattgccaatggccttcactgtgtatgtgggcttgatggtggtgccatccacaatcaaaccttcctcggcgtcctgaatgtaggtggaggtgatgacgcgcacgttattgatggcgattacctcggcaccggcattgcgaagttcctcgataaggttgaacatgattgaggcgtccactttagtcgtcgagcctcgtccgattcggatggtcacgccttgaccctttgccgggagtctgccggaaatcaagccgctggtctcctcgttttgcttggcgatcttacgcgcctgctcctgctcgttagccgccgatttcagcgagttgagctggctgttcaactgggttttacgctgctcgagattggagatttgcgtattcgactcgttcagcagccttaccagttcactctcgtccatcgtttcgtacgtggatttcgtgttattgatctggctcatgtaggcgaaacccaacaacgcgcacatcagagcgatgagaatcgaggatagtaaccgtgatttgttgctggcacggttgagatccttccggggcttcttacgcaccgtgggaaacgacccggtttccatccggtcgttgaccttgtcttgtacatgctggtcgcgcattttctccagcatgttgtctgattgtgctttacgtgccatacgtcagtacccttgtcagcctcggaagatgaagcgtctgatcgcggacacgttggagaagatgcggatgccgagtacgacgatgacggctgtctgcagctgcgaaccgacgccgagctggttgccgaggaacacgagcagtgttgccgtcaccacgttggcgaggaaggagatcacaaacacacggtcggagaagctgcgctcgaaataggctcgcgcggcacccagcagggcgtcaagagcagcgaccaccataatcggcagataaggctgcacgatgatcggaatatccggcttgacgaacacgccgatgacgacgccgatgatcagtcccagaacggctgccattattcattcctttccgcgtacttcacttcgccagtgactgctgcctcaagtgtaatcgaattggatttgctcacctgcgggtagataccggcttccttgaaggaatcgtaaagacttgcaagtttcttcttccccatcgcttcggccaaggcgctcttatcgcctatggcttcaatggtataggggctttgtatcgcggtcatgccgatgagaatatgcccgccggccttgcgtatcgaggtttgcgcgccgagcctattaccgttgatggcaatggcttcggctccgttttggaacatcagggagaccagttgctgcagatccagatcggtgatgactcggatgttcgtggaggtgccgactctgttcgatgagctctgatccgactggcttgccgcgattggatcggccagcgtcatggtgattccttcgccttcgaccaccgtggcaccattgaccatttcgtcttggataagcgtatcgcttttcacgctgccggagattttcttggactgttcgtcaacttgggagcgcaaattattgacgtccttggtgagttcgtctatttgcgagttgcgattctccaattgcgtggccaaagtctgccgtacctgcttacgcggatcggattgcaactgttgcacgaataggctgcaggcaaagccaacgccgacgcagatgatgaatacgacgatgcgattaaaccagatggagaaggtcgaacgatgctcatggaccagtcgtgagtcggagaacatcggatccatcggacgattgacaagatcatcgatgagctgaagcgaatcgtcgttggttttacggcggcgtggggtgcggatggcggcggcgtcatccggggaaagcgcatgatgtgattccgcgcctcggactgagtgggagaacacggcgcggcgtcgtaccggctcagtctccttaggtacggggaatgagaccggggccgtggcctcaagcgccatacttctcccccagttccttgcgtagcaatccgacgccctgcttggtatagatatatccggcgagccaatacatggcgatgccccagatgccggcggccagcgcggcgatgtagagcaagtggaagaacgtactggtgcccaaatcggcgaaaatcagaccgacgatggaaatcatcagcagcgcggtaccggccttgcccacgaaatgcacgggcagcgggccataaccgtactgggcaagccatagcacctgaatcgccatccacagatccctcagtcccacgataatcagcatccaccatgggatgatgccggcgacgctgagagccagaatcgagcagaaaatgagcagtcggtcggcgatcggatcaagaatctgaccgatcttgctcacttggttgaatctgcgcgcgatgatgccgtcaagtccgtctgaagccgaggaaatggcgatcagggctaacgccgcaatcatctcgtgcttggagatcagcacgctgatgaaaggaatcgagatgattcgcagcgcgctgatcaaattgggcacagtgaaatagatgtcacgtgcttccggactgtatctggcgttgactttctggttggtcatatcgactaacagtctacatgcgggaggcttgcagagcggtaacgatgatgccgcgtgcgccgacttcgtacaaatcatccatcagctggttgaccttggccttggggaccatgactcgcacggcgttccactgtttgtcgtgcagcggggagatcgtcgggctttcaaagccaggggtcacggccacggcggcggcgaccttgctgatcggaatgtcatagtccatcagcacatactgatgcgcagtgagcacgccttgcaaacggcgggtcagcacggccagacgtgggtcctgctcgttcagacgcggcgaacgaatcaggcaagcttcggagtgcatgagcggttcggcaaacacgcgcaggccggcgttgcgcagggtggtaccggtggagaccacgtcggcgatgaggtcggccacgcccagctgcacggaggattcgaccgcaccgtccagatggatggtctcggcctggatgccgtgctcgaccagatagtcgtgtacgagcttatcgaatgtggtggccacgcgcttgccctgaacatcctccagggtggtgatcggggattcgttcggtgcggcgaaacggaaggtcgaggcaccaaagccgagcggcatgtgctcgagcgcggcggtaccggagttcttgagtagatcctggccggtgatgccgacgtcgatggcgccgcggcccacgtatacggcgatatcgagcggacgcaggtagaacaactcgatgccattgtcgggatcttgcacgaccagctggcgagggttgatgcgcagacggtagccggcctcggccagcatgttccacgcgggctcggatagcatgcccttgttgggcactgcgattctcagcatttgcgttcctctcacaggtgcttgtagacgtcctcaagcgtcaggccgtgcttgatcatcatgacctggacgtggtagagcagctggctcatttcctcggcggtgcggtccgcaccctcgtattcggcggccatccaggtctcgccggcctcttcgatgatcttcttgccgatgaagtgggtgcccttgtcgagctcgtcgacggtcagggagccttcggggcgggtctgggccttctcggacagttcggcgaacagggattcaaacgtcttcatgtgattcagattcttctcttgtggttatggatgaaaggtggattgcggttcaggcttggagctcaggccttgaacgcggcctcggccttggcgcggatgtcgtcaatggcttgggcgggatcctcggcgccgtacacggcggaaccggcgaccagcacgtccgcgccggcctcggccacgatgtgcgcggtcttggggctcacgccgccatcgacctggatgcgggtcttcaagccacggcgggtgatctcatcgcgcaggcggcggaccttggccatctggttgtcgaggaacttctggccgccgaagccgggctcaacggtcatgatgaggaccatgtcgaactcgtcgaggatatcgaagatcggctcgaccggttcggccggacgcacggcgaagcaggccttgcagcccatctcgcgcagctggcgggccagacgcacgggcgcgtgagtggcacccatgtggaaggagacggaggcggcgccgagcttggcgtattcgggggcccaacggtctgggtcctcgatcatgaggtgcacgtcgaccggcagatcggtgacctggcagatgcggccgacgatcggctcgcccagggtcaggttcggcacgaaatgatggtccatgacatcgacgtggaccaggtcggcgttggcgatggccttgagatcacgttcgaggttgcagaagtcagcggacaggatgctgggtgcgattgcgatattgctcatggtttcctaccttatctgtgcaatgggacttggggtcccgtgtttcgcgctgtttcggcgctgtttatcgtggtgtcacttagtgcgcttggcttgctttttctggcgaagccgttcctcttcgatgctctggcgttcgagctcgtcggcggtgaccgccgcaagcccgcgcgcctgcgccttggggtccggcccgtactggtagagcacgacgaacaggatgcagccgagcacgaagacgatgatcgcggtccacatgttggtcctcaggcccagaatcaccgtggagtagttgatgcgcacgttttcgatccaggtgcggcccaagccgtaccacatcaggtacatggcgaactgctggccggccttgagccggtcggcgagcttgtggccgaggtagatgatgagcgcggcgccgatgaggttccagatcatctcgtacaggaacgtggggtggaacagcgtggtcctgtagtccgggcattgcgcgccggaatagcagatttcggatttgccgatggcgtccgcgtcgttgagcttcaggccccacggcaacgtggtgggccagccgtagagttcctggttgaaccagttgccgagtcggccgatggcctgggccacgggcagcgcgggggcgatggcatcggcgaagatcgcgaacggatagtgcttgtggcggcaccacaggaacgccaccaaggtgccgacggagatgccgccgaagatggccatgccgccttcccacaccttgaggatgttgaccaagttaccggtgggcgggaagtagtcagccggcgtggtgatgcagtggtagaggcgcgcgcccaccagtgcgcagggcacggtgacgagcgtggtgtcgagaatctggtcgaaggtgccgccgtaccgcttccaacgtgtggtgaggatccatacggccacgcagatgccgatcaggatgcagatcgcatacatgtggatagtgaatgggccgatctcgaacttggagaaggtcggcgagggaatataagccagattcatcgtgcctctacttgctggtgctcatggtgtgtccgcgcgcgggttgtgcttgatgctctgtgactaccctaccgtgtcacggcacaatccgcgtgaggcgcaccgggtgtttaccgggcgttgtggatgccttcggccagttcctcgctcttggcggcgagcagcttcaagccttccttcgggtcgcgtgcggtcttgtcgtcgtccgcgagcatggtgtgcacgagcgcggaaccgacgatgacgccatctgcgtaggcgccgacccgggcgccctgttccgcggtggatacgccgatgcccacgcacacgttctcagcgcccgcgcgacgggtgcgcaccacaagctcttcgggtgaggcgtcgatggtggcgcgttccccggtgacgcccatgcgggcggccgcgtacacgaagccacgcgcgttgcgggccacggtttcgaggcgctcggtggacgagtccggggagaccaggaagatgcggtcgagtccgtgacggtcggaggcttcaatccactcccccgcctcgtccgggataaggtccggggtgatgaggccggcgccgccggcgttctcgaagtcacgggcgaaacgctcgacgccgtagtggtatacgaggttccagtagctcatgatgagcggcacgccgccggcgttggccacggtttcgacggcctcgaacacgcgcttgatggtctcgccgttgttcagggcgatggaggcggcagcctggatgaccgggccgtccatgaccgggtcggagtacggcaggccgatctccacggcatcgacgccgtgctcgaccatcgttttgaaggcgtcaagcgagacgtctgggttggggaagccatagggcaggtagccgatgaaggcgggcttgttctcggccttgaacttggtgaacatagcgcccgacttgctgggcttgtggctgatgcccagcggctggccggacggcgtattcgcttcgttggtcataatcaacaatctcctcttcttgttcaggcaacggtgttgccgttgacaccggtcacatcaagcgcggcggcctgatcgtcggtcaggtagccaaaccacttgccggcggtggccatgtccttgtcgcctcggccggagatgttcacgatcatcacggccttgtcatagcccttggccttcagatccgcggcggccttgtacgcgccggccacggcgtgcgagctttcgatggcggggatgatgccctcgctctggctcaggtcgcggaaggcgttcatggcctcctcatcggtggcccagctgtagttcacgcggccgatgtccttgagccatgcgtgctctggccccacggaagcgtagtcaaggcctgcagagatcgagtaggtgtcgagcgtctggccttcgtcggtttccagcagatagctcttggcaccctggaacatgccgagctggccggtgccgggggcgaagcggatggcgtgcttgccggattcggggccgttgccgccggcttcgtagccgtagaggttcacgcgctcatcgtccaggaaggcgttcatcacgccgatggcgttggagccgccgcccacgcaggcgcagatcgcgtccggatggtcgatgccgtaccagtcctggagctgctgcttggcttcctcgccgatgatcttctggaagtcgcgcaccatagccgggaacgggtgcgggcctgcgacggtgccgagcaggtagtgcgtgtccttgacgttggtaacccagtcacgcagggcctcgttgatggcgtccttcagaatcttgtcgccgagggtcacctcgaccacttcggcgccgagcatacgcatgcgggccacgttcagggcctggcggcgggcgtcgatctggcccatgtagatgcggcacttgaggccaagcatggcgcacacggtggcggtggccacgccgtgctggccggcgccggtctccgcgatcatgcgggtcttgcccatgcgcttgacgagcagggcctgtccgagcgcgttgttgatcttgtgcgcgccggtgtggttcaagtcctcgcgcttgaggaagatacgggcgtcgagatcggtcttctccttgacgagtgcggcgaagcgcggggcttcggtcagcgggctcgggcggcccacgtaacgctgctggagcgtcatgaattccttgtggaattcggggtcggccttggcttgcgtgtacacgcgctccagctcgtcgagggcggtgatgagggcctcgggcacatagcggccgccgaactgtccccaaaacggtccctgatgttcgctgagcggggttgtttcggatgctttcacttgtgctcctgcctttactagtcgttccactgcaagttcatgatcatcagcggtggccacgccttcaccgaccagtaccgcgtccgctcccgcgcgggcgtagtcttcgacctcgaccgccccgaatacgccggattccgccaccttgatgacgtcatcgggcagatcggccgcgagttcgttgtatttgttcacgtccaccttgaggttcttcaggttgcgcgcgttgatgcctatcaccttggcaccggccttgcgggcgcgttcgatttcctcgcgggtgtgcgtttcgaccagcacggtcaggctcaactcgtgcgccagatccagcaggtgcttgagctgggcgtcgtccaatgcggcgacgatgagcagcaccaggtcggcgccgtgggcgcgggcttcgaagatctggtagtcggtgacgatgaagtccttgcgcagcaccggaatgtgcacggcggcgcggaccttgtcgaaatcgtcaaggctgccgaggaatttgcggccttcggtgagcacggagatggcgcttgcgccgcccttctcgtattcgcgggccagtacggccgggtccgggatgtcggagaggtggcccttggacggagacgcgcgcttgatctcggcgatcacggggatgccgtcggcgcgcttaagccatcgtgtcgcgtcaatcggagccggggccgccagcgcggccttcttcacgtcctcaagcgatacggtgagctcacgggtgcgctgatcctccagcgctcccgccaccagttcgtccaaaaccgacatggtcctccctttgttggtgttcggtcatgcgccactctaggtcacgccccgtcccgattgccgaacccgtcctacattctgggctattcctcgttggttcgtatcgctacggaaccagagcggccaacaaaaaggaaaatcgccatgaatatcggtcatacggcctgggattgattccattgatggcatagactgggcgcatgtgcaggagattcgcgcttgatttggattgggatgccgtggcctcacagttcgcggtagacgaggatgacgtgcgcgttgacactctgccacagccttcctacaacatcgcacccacgcagaacattggcgtggtggcacagggcaaggatggccgccgtcatctgaccggtgcctattggtcgctggtgccgcgatggagcgccagcaaagtgctgagctaccccacatataatgcgcgtgtggagtctgcgcatgtcaagccggcgttcgccgaatccacaaaatccatgcgagccatcatccccgcttccggctactacgaatggaaaggtcgcaggccgttctattttcacgcaccacatgatgaactattgtctttggccggcctgtactcatggtggaggccgtctcccgcatcgccatggcagctgaccgcaaccatcatcacctgccctgccgcggacgagttcgtcaaggtgcatgatcgcatgcccctgctggcgcctcggaatatggttgcctcatggctggaccgctccgttgacggagccgcactgttagattccatgcgggaagcgggtaccctgctttcccggcgtctgcaatttcacgaagtcgcgccactgaacagcgacggcaaacgtcttattcagccattggattccaccgaacccatgcgtctgttttgagctcttgcagctggaaccggctatgcagctgtatatgaagacggatcaatcaatgccccgctgatagctaacctcgtatggccctcagtcaaaaacaggtctcttctgctcgacattggtcgactacgactacttttgcaccaatccgcgcagcaactcgatctcgtcgcgatgcgtggcgggcgtctgctccttggtttcgaggatcatcgggagcttggccatgatcgggtcgttgaccagtcgcgtgaaaaacgggatgccgagctggccctgcccgatgttggcgtgacgatccttatgcgagtcgaggccaaactgcgaatcgttcacgtgaatcgccttgaccttggccaagccgatcgcctcatccaactggcgcatcacaccgtcgtagtcgttcaccaaatcgtagccggcatccagcacatggcaggtgtcgaacgtgacgccgacgttcgccttgttcttcacgccgttcatgatcgtggcgagctcctcaaagttgcgcccgcattccgtgcctttgccggccatggtctccagaagcaccatgacgccggtcgtacgctcgaacacctgattcagtccctcgctgatcagctggcagccggtcttggtgccttggcccacatgtgcgccgggatgaatattgatatacacctcctggccggcctcgcggatggcggtcagcagctcgatgtcctcggccaacgcctcgatcgcgaatgcgcgcttggcctcatccttgcctgccagattgtagacgtacggcgcgtggacgaccaacggcccatagtcctcagccttcagacgtgcgccgaacgttgccgcgtcggccgggtcgagcgccttcgaacgcttgccgtacggggagcgcgggaagaacgcgaacgcggttccgccctcctcatgggagcgttccagcagtgcattccatccgccggccgtcgacagatgcgatccgatatacagttccgtcattccaaactcctcatgttccgctcgctgttcgtgttaccgctatcatatggtaggcggtatcgcgcgccgcccgcacaaccgacacgagacacaactgttcacccgaccaaaggagacccgagcatggcggcagccggcacacccaaggacgataccggccttgaacgaaagatggagtcgcgccacctgacgatgatctccctgggcggcgtgatcggcaccggtctgttcgtcagctccggctacacgattcatcaggcggggccgttgggcgcgatcctcgcttacgcggccggctctctgctcgtatactgtgtgatggtgtcgctgggcgagctgtccgtggccatgccgtacgccggcagtttccacatgtatgcgaagcggttcatcggccccggcaccgcgttcaccatcgccatcctgtattggctgaactgggcggtggcgctcgcctccggatttacggccgcggggttgttgatgcagcgatggttcccgcattcgccgtcctgggtgtggtcggccgtgttcattgtggtggtgttcgcgctcaatatcatgtccgtgcggctgtacggcgaggcggaattctggtttgcgtcgatcaaggtgttcgccatcgtcgcgttcattgtgatcggcctgctggcgatcttcggcgccataccgattgccggccatgattccgcgccattgttcaccaacttcgtggccggcggctggttcccgagcggcatcgcgccgattttctcgactttgctgaccgtggtgttcgcgttctccggcaccgaagtggtgggcgtggcggccggcgaaaccaaggatccctcgcgtgcgatccccaaggccgtgcacaccacggtgctgcgcctggtaattttcttcatcggctcgattctggtgatggcggccttgatcccctggcatcaggccggcgtggatacgagcccgttcgtgctggtgttccagtcaatcggtatgccgttcgccggcgacatcatgaacttcgtggtgctcacggctgtgctttccgccgcgaactccggcctgtacgtgtgttcgcgcatggtgtggtcgctggccaaggagcggctgattcccgaacgttttgctaagacgaatttccgtggtgtgccggtgtgggccgtgctgttcagcatggcgggctcgctgctggcgttgctgtcttccgtgatcgccgcttcgaccgtgtatctggtgttggtcgccgtatccggcttggcgacgctggtggtgtggttctccgtgtgcgtgtgccatatccggtttaggcgtgaatggacgcgggatggtcatagtgccgacgaactcggctatcgcgctcccggctttccggtgttgccgtggctggccatcgtgatgtgcatcggcgcgctgctgctcgtggtgctcgatgagacgcaacgttcgaccctgtattgcatgattccgttcgtcgtctgctgctacgcggcctattacgccctcgaacgccaacgcaaacgcgaaaagaatacctaactcggtttcgaggggctgattcggcgttcgccggaggtctacttgcgtttcaaggggctgatgcccaagtaggcaaggctccgaaatggcgtcatgtcgttgccacaaagccgtttatactcgcggtttggcgtttgagcagcccctcgaaagccaagtagatgtccccaccggacgaaatcagcccctcgaagccgagaaaccattgatggccgattatgttgagtccagtgacgtgcctggtcccgtgctcgaactggtacaacaattggagtttggtttttgcaaaggggcattgttatgtacaaggtgttggtgtcgttcgcagacagctaatgcgcgttgactcgtcgcgctaagccgtggtcgccgtttgggccctgaccaagcgcgtcttcctatccgcgatcatactcggtgcaatggtgaacatcgcctgcgtggccagtatcaccggcgcgcagatcatgttggccgcccgtggcaccagcgcggtcatgatcggactgctcggcacggcaatgggcgtgagcacgttggtcggctcgctgttggccaataaactggttgatatggttcccactgggagactgattgcgggcgcacttgcgttattcgcggtcagccagatgccactgctattcctgcacagctacgcggccattctgatctgccagattctgaccggcctgccgttccccgcgctgaacgccggtctgctcggctttctctacggcaagacgcccgacaatattcagggtcgggcttctgccgtatttgaaaccacggtcggcatactgggcgcggcatgcccggcgatggtcggctggctgttgcaacagccagatctcggtttcacggcggtgatgggcgtggccgtggcctgttccgtagcgggattggccatatcgttggccggcccgctgcgcagcattccgactcccgaacgatggtcggaggttgccctgtaacgccaaacggcggagcgccggtcttatatgaggtcgtacggcatctgatgcttgaccagccagaagatgccgaggccgatgaacaccagcagattgaatccgccgctatgccatggcagcacgatgactagcgtcgccatacgcgccacatagaacgccgcacgccgccagccttctcgcggccgggtttccactgtcatgtgcgtgaaactgccgccgaacgtgcagccgccgcgcaaccatggcaccacgccctcgaagaggatgagcgccgccaggaagaggatcgaaccggtccagtcgaacggttccatcgactgccatgagccattggagcccgagggcaggttcgagcggacgatcatgacgaacagatgcgtcggcatcacggcgaacgcgatcagcgtcatgtcgatgatgaacgtgatcagccgcctcatgaagcctggtgtggtggtcggcgtcatatcggcgacccgcgccggaatcaggcgcagcgaaagcatggccagcgcgaatccgatcagcgcgccggtcgtgttccacaggagatcgtccacgtcgaacagacggtaagcgcacgggaacacgcccatgaggccggtcagctgcatcgtctccagaaatagcgacgtggcgaacgacagtactgcggtaaccggcagcggccaacgccatatgcggcccatgatgaagcccaacggcaggaagaacacgatattaaacgcgatttgcagtacggcggtgagaccatcggtacggatgtcaccgatgaactgcagtgggttgagctgcggtgtcagatggtgcgcggcgcaataggccgccgcatcggccggcatcggatacagtgtgaagcacagcaggccgagcaagtacagcaccgtgccatacgccactatggccgacgacagtaggatgcgattgtcgcggtgatacagcagcgccagcaccggcacggtcagcagcatggacacaaacggccacagcgccatcgcgaacgcaaacggttcggaaaagttcttaagaaatcccatcttcaatgctccctgcttcggcccgctccgttcggtttcggaccttgactctcgacttctgattccaaggtacggaacatgacggcatgcgggtatcggccacgagagcgaaatcattgggatgaaagacgattcgtatcattcgcatggatgagggagatgcgccagttaccattgacgccgacgaggatggcgtggtcgacgccgtgaccgcgcagatgagcgagcgtacgtcgttcatcgtgttggaccagatcacttccgccaccgctatgctgtttccggcccagcgcatcgccgccgaagcccatcgccgcggcatccgcattttggttggtggcgcgcacgctcccgcccaactggccgatccggtcggcggactgcagtccgattggtggggcggcaattttcataagttcccgtgtgcgccgcgtggcacggcattgctggtgattccgcccgaaggcggtcaggatggtcaggatttgtggccactgatcgactcgtggggtttcgccgacccgttcccggagcgattcgatgagcaaggcacccaggatttatgcggtccgattgccgcgcccgagtccctgcgcgagatcgagcgactgtggggctgggatgtcgtgcgccggtacatgtccgatcttgccgattacgcggagcgtcgggtatccgaggcggccagcgaggtcggcggcgaactgtacctgcgcctcaccgcccacgcctacgtcaccaccgacgccatagaccgcttcgccgaacaatctatcccaaccatcgtcggatggctgcgtgggtaagcgaatcgtatgttgcgtggtgccttaactatggatgattaaggcgccaatgcaacagtattagagttttgcgggttgtagagctgcttacagaaaatttgcggttgaacggcagccccaatcttccgtcacagtggcttgacgaaatcttcgccattgaagtagccggcgatggcgttgtgctcgatgatgagctgcgggtcgatggcaagcgtgtgatgtgggtcttcagtgccgctgattccccctaatggtcgattatctcttcctcgataatcaatatgctgtcatgtgatcgcatgacagcatattgacattccccgaacaaagtgttctactatgaacggtatgacgattcgtattgttccgattgagccgcaatggtttgaggaaaaggcccaagttcagtcgtacacgtggcgcgaactcaatcaggggcatattccgcaggaaatcgtggatgcgatcactcccgaattcgcgctcaaactgacgcgcagccacgccaaagaacccaatcaggtcgtattggtcgctttggagaacaaccacgtgattggttttgctgagcttctgcaaacgccgcgctcgccaatcaaacggtccgaggctgcggaactggcttcgctatatgtgttggaatcttgccatcgtcatggcgttggccgtgctttggttgaggcgggccaacgcgccatcggcaacgatcggctcgccttgtgggtcgccggattcaacaccaacgcccaaagtttctaccgtcacatcggcttccatgagaccggcctgactcaaaccgaagacatgggcccggaactcgaaatgatcaactactctgacggcgtattccagtgagcagcgcgcggcgactatccgcgaatttcaggagaacatgagccggctgggtctgaccgccgaacggatcggcaaggattttggcgtcagcggcagcagagtggagcaaatcatcaccctcaagtcgggcgcgctggagtatccgtggattatccgcgcctatctgctgagcaaagccgcggcgcagggcgtggaactgacgccgctcacggcgctacgcggaaatccacacgattattggttcctcgacggcgactttatcgaccgaggcgaaatcgattaaaaccgattgataatcggccatttatacgcgagaggcgccgtcaatcgcctcgcgcatagaggccatcgctctccgtgcaggtggcgatgcgtgtgtagtattccgtcttgtcctcatggtcgatacgtgcgccgcaatgctgctgcaccgcaagacttgccggattggttttgtggacactcaggtaagcctctttgatgccgagctcgcgggccttggcaagcgtgagcttgagcccggcggtcgcgtagccgtggccgcggtattcgcgggcgacaccgtagccgatgtggcccggaccgttgcgcaggaagtcggtgagccggtgacgcaggttgaagatgcccacatagtcgccctcatcgttgacgagaatgtatgtggtggctggcacccagccgtccggcaggccgacgccaagcgactcatcacgcaaccctcgcacatatgcggcgaaccgttcacgattcatgccggccgctgggttctcgaatcccatctcctccgccgggaatttcgcgaacaagtcaaacgcgcgttcctggtccgccagccatgtctcgatcagccgcattggtcacactcctcctgtttgacatagcaaaccacactactactgctcggccaacggccgcaagccttatctagggtgtgtttgctctagttggttttgctggtgtttttgagttggatggtgatgaggatgagttggaggttggcgaggaaggtggcgtcgagcctgtcgtagcgggtggcggccttgcggtggtgcttcatgcggttgaagacgcgttcgaccatgttccgtcccttgtgcgcctgcctgtcgtagtcccatgggtccgtgcggttcctcttgggcggcacgaccggcgtcaggccgaacgactcggccagcaggctcatggaccccctcgtgcgcgcggtccatgagcaggcgcgcgcccatgaacgcgccgggcgcggccatggagcggctcccgtggcgtgctggtggaccttcacgctcgtggagtccatggcgggcacccgaacctcgacggcgatgatccgctcctcctgcaatgccgtgaacaggcgttccatcgcgccgttcccggaccagcggttgaaccgccggcagacggtgatccacttgccatagcactccggcaaatccctccacggagccccgtcctgcacatccacagcagggcgttgacgaacctgtagttgtcgaccgccacgttgcccctctgtcgcggcaacaggtgcgcgaccctcatgaaccggtcaagcgtgatgccataccccggcgtacgcatacgccaatcatcacacaaaacctaaataatgtaaacacaccctaactattctgttcgatgttcatttgatacgtatcgacggccatactcggtttgtgtgtttttgacggtttttgtgaggttgtaatcgctttccaaaatggtgaatacgcttcagcgggagaggctcaatgttcaaatgacactgtgccggtctcacgaaatgcaagcaagatatgcgcgattgaggcaaatcgtttcagaagcatccggcaaagccgtgtatcgcctccttgaaattttttgtatttgggactaatttgagcacttggcaacgcaatcagtgacatttgctgtctgattgcttacacccacgcaaaatatattcaaggaagaaagagggagcggcatgattgatcttgctgctggagaatccgcgattcgcctgtcgctgagttgggtggattggctgattctcatcatctatttcgccatgatcgtgtggattggttactccatccacaagcagcagaagtccagtgaagactttctgctcgccggccgttccatgccggcgtggattgcaggcttggcattctgtgccgccaacctaggcgccaccgagattctgggtatggccgctaacggtgcccagatcggtatgccgaccatccactactacctgatcggtgccgtgccgggcatggtgttcctcggcatcttcatgatgccgttctactacggctccggcgtgcgctcggtgcctgagttcatgtaccagcgcttcggcaagggcgcgcacatcatcgtatcgctgtgcttcgccgtctccacgattctgcaggccggcatcaacctgtacgccatggccctgattcttcaggccatgctgggttggacccaatggaccgccatcatcgtgtccgccgtgttcgtgctcgcctacatcacgctgggtggtctgacctccgcaatctacaacgaggtcatgcagttcttcgtcatcgtcgcggccctcatcccggtcactgtcatcggtctgtcccacgtgggcggctggtccggcctgaccgccaagctcgacagcatgcaggactggagcggttccatccacgcttgggccggcaccggcctcggcaacgtgaccaacccggtcggtggcgactggttctccatccttatgggcctcggcttcgtgctcggcttcggctactggaccacgaacttcaccgaggtgcagcgcgccttcgccgcgaagagcatgaccgcagcccgtatgacgcctatcctgggcgccatcccgaagatgctcatctggattatcatcatcatccctggcctgatcgccgccgctaccgtgggcaacctgttcgctggtgaccacccggtgctgcagtacaacgaagccattccgtacctgttcaagatgtacctgccgaacggcgtgctcggcgtggcaatcaccggtatgatggcctccttcatggccggcatggccgcgaacgtctcctcgttcaacactgtgttcacctacgatctgtggcaggactacgtcaagcccggcaaggacgacaagtactacctgaacatgggccgctggatcaccgtcatcggcgtgttcatctccgtgttcaccgcttggatcgcctcgcagttcggcaacatcatgacatacctgcaaacgctgttcagcttcttcaacgccccgctgttcgccgtgttcatcctcggcttggtgtggaagcgcgtctccaacgtcgccggcaccgtcggctacgtgtgcggcattctcgccccgctcgtcacctacatcctgtacttgcagtccgtcgcggccggcaacccgattttcggttccgccaccgccgagacttggtacggcgccatcatctcctgcctcgcgacctggatcgcggcggctgtgcttacgccgttcaccaagtccaagaccgatgaggagctcgagggcctgaccttcggcaccaacggcatcaagtacttcaaggaggcctccgccgaggaacttgaggacgccaagcacgccgccaaggaagccggaaaggatgtctctacagtgaaggttccgtggtacaagaagccgctcattctcggctccgtgatcttcaccctcggtctcgtgttctacatcccgttcttctaaaccgcaggtggaaagatttaaggagtgtatgaaatgactgatgaaacgcaagaaaccaagagcctgctgacccaggccgaaaaggatcaggccgttaaggcggcccgcaccaacgacctgcgtcgtctgatcgcgatcctgttcgtcatctacggtgtgatcgtgacgatcgttggcatcgtggcaccgaacatgaacggtgccgacaccaacggcattgcgatcaacctgtggaccggcatcatcatgctggtcatcggaatcctcttcgaggtgtggtgccgcgtcaagccgctgtcggccgacgacatcatcgcctccgccgaggagtcggcgcgtaaggcgcaggttaagcacgaaggcgacaagaagtgattctcgcctgaccttcgtcggtcgaaacgggtccgtgatcggacgtggttcataaccgacgcaaaagggaccatcggagcaatccgacggtcccttttcgtgttcgttgtgtgcatacaatgccgaaatatcccatcagtcgcactagggtgtgtttacattatttttccaataagaaactggaatatgaaacgcgctcggtaaaatcgttgaaggatgagcagcgccggatatgctcatttatccgtttttttgaagattttttttcataccttattttgaatcaatacttgaatgacgagatggcaactcttcttcaaagaatcgctgatctgtttaggcagaggcttcagaacatcaatatcatggtcatccaagcaaatcgattcaaaataattaacaaggatgagtactacgaacttctttcactattgactaaaatgaaagaaattgtaggaaagcaaatacgtttgctttcaagcaatggatacctatttgaccaatttgaggcattcgtacgcagcaataacatagggtatccagtcaaaattcctacagaacggtgcggcagttgctgttcaaaaacagatttctttgatttttcaaaacgcattcttaccaactatgcatgaggacatgtcccatctgcggaatctattccatccaagtgggcagcgaaaagttcattcagcattattctgtgactaatgaagcagggaatacagcattctcgatagccactacagggtatgaattttactatttccgactgtatgataaaactcatgacactcttgcatatgagcaattcggagagtgtggtgagaacatcagaatgcacacggacagtctgtctcccgatgtacactcttataaggtttggtagggatggggtcgcgtattcacatggaaaatttatcaaggagggggaataactgggtttatctgctttccgttgtaagcgataatctcggcagttcgttgatgactttcgtgttgccgcttatcgtgctcgaccttaccggttccggtattcatctttcgatcatctcttcgttcgagacgctgccgttcttgctgctgggtctgcctttcggcgctattgtggacaggtgcgacgtcaggaaggtgctcatccgttccgatgccatcagattcggaggatacgcgttgctcgcggcggttctttcggctcggagcaacgcgaccatgacgctgatagccatctatctcgtcaccttggtcatagggtgcaccaatgtgttcagctccgtttccgagatgacgttcatctcgtatttcgtgtcgaaatcggattattcgaagatgaacagcatcgtgtacggcatccagtacacggccgggctgctcatcccgcttgccggcggggcgctctactccgtggtgccgatggggctgctggccctgatctgcgccgcgtgttttcttctcagtgcgggtgccattctcctgatgagggtcggttcctcgaagggcgccggcgggttgaggggccccgtgccggccgcggtgcgaacggtcatcggcgacacccggcaggggctttcctatctgaagaccaggcgtgtggttctctacccgcttgtgctggccgcgttgttcaacgtgctgaccgggaatttccagaacgacagcctcgtcatcatgcgcaagagtctgagcttcacgtcgggccaggtcggcttggtcatgtcggttacggccatgggcgcgttggcggggaccttcatcgtcaacctgctgaacagaagcttcaagttcgaaacggtcctgatcgcgaacttcctcgtccagatgtgcttccgtctcctgtttgtggcgttcggcaacatcttcgcggtggcggcgacgctgttcgtggtggacctgtgccagtccgtgctgaacatcatcattatcacgaaccggcagaatctggtcgaaacccgttacctcgggagggtgacgagcatatacaaggcggttctgatcggggtcaattcgctcggtttcatatacggaggcaccctgtcgaacaccttcggccagaggaacgccgtcctatggtcaggcgtcgaaatcctgatactgaccatgattggtatcggagcctacgctcatctcaacaaagaaagaaccaccgatgagtaatgtcaaaatcaaagaaattcctgaagatttcatagtacatgaaatctcaattccgacttccgacggagtatacactcattcaagatatcgtctagcaaaaaggatatagcccatttgaagcaatcgagtgcatgtcaagtttcttcgcactctcttcttcgcagataacctattgcggtctaaaagacgaagagggaattaccacccaagaggtgtccatcaaagtccatattcctgatgaagctttagagcgattcaatgcaacgatgtatgccagttcagcatatattgaactaacttatattggacaatcaaattcacaggaaataggaaaattgctcgggaacgcattcactgtcacattacgaaatttaagtggtgacgatgcagaggccttttcagaaattcataaaagagactatgcattcctgaattattatgactatcaacgttttggcattcccggataccctcaagtcacgcatcttttagggaaggctttactggatcaagactatcagcgcgcattcaagttatatagacttagcggaaacacaaaaattgattcagtaaaggacccggagaagttcttcacaagtgacgttgatgctcgaaagttatcatttttcaaaaatgcctattcttcaagcatttggaacaacgaactcatgtaccttgtacaacgcaacgtaccgaacaccgtaattgatgattcaacgggaataacctacagattctgcaaaaatctgaaagatgtacttttgctcttgcgacagggggataatttaccgtatctgaaatatgacgtgcaaggttctcatcaatccgaaaggtctctcataactcatacgagggttgaatgtctaaatacatctgacgacgaaaggcacgctaactgcaaaaacgcaacagttaccttcattttgccgtctggctgctacgcaacaacttttatacgtcagctttgcacatgtctcatgcatcaaggaacgtaccccttcgtctgctgcacacggaagctaccagatgaactcacaaactgcaacctatcctgtagtttccattcaatccaagctatcaacggtagtattattgcaatagttccctcatggataaaaggcaaatgttttcgcttaccagaaagtctcttagtcttaggttttgtgtgatgattggcgtgtgtgtacgccggggtatggcatcacgcttgaccggttcatgagggtcgcgcacctgttgccgcgacagaggggcaacgtggcggtcgacaactacaggttcgtcaacgccctgctgtggatgtgcaggacgggagccccgtggagggacctgccggagtgctatggcaagtggatcaccgtctgccggcggttcaaccgctggtccgggaacggcgcgatggaacgcctgttcacggcattgcaggaggagcggatcatcgccgtcgaggtttgggtgctcgccatggactccacgagcgtgaaggtccaccagcacgcggtcgtgccgcccaagaggaaccgcacgggcccatgggactacgacaggcaggcgtacaaggggcggaacatggtcgaacgcgtctttcaaccgcatgaagcaccaccgcaaggccgccacccgctacgacaggctcgacgccaccttcctcgccaacctccagctcatcctcatcgccatccaactcaaaaacgccagcaaaaccaactagcgtaaacacaccataggttactttccccgatacacggcagcgacgccgaatatgatgaacagtcccagcaggaagatcagagctcccggccggtacgtgcggtagaagtcgaccatatccggctgcgccaaaggtactgccatgatatacaccagcgcagcgaacacggcgccgagcgcggaaacaaccaagaacgcgcctacggcaaaacgcagcaggccacgatccgaggtcctccggcgcagaccacggcatcccacgaagacgaataccgagatcagcaggtagaacagcagcccgtacgtgggcagcatgtcgataatcagcagatcgttcatggcatatcctttcgtggcgcaatcccattcaacctgcgcatggccgcaagcgcaacatcgtgtcaagtaatcgcatgacagcaggtttcgtccggctgcgaccgtggccacgatgagcggcatgggacatgataacatgaccggggctgcggcgcggtcgatccgtatcgcccgtattggacaatgatccgttcgccctggatgcgatgtgcgcgatgatctcggccgtttccaaggacttccatgtcatgtggggcacgggttcgcccgcggtggcgatcgagcattgccataacccgcataccaggccggacgtgccggtgtcggatcctaaggaatctgttggtgtcgctgcagctcattgccattcccactgaagagatgattggcgaaaacgatactcactacctattcattaggcttcagctcgtgttcgagcacaagtttcatcttgctgttatccatcaaccatgcgtgtaggtctcggtccaggatcatcgccagagcgaagcacgcctgcgtcgcattctccaatgcaatccgtcgattctcacccggcagaggtatgccgttgacaagcggctcatggtgagcgacccgattacgcagggcatgcactgtttttacgatatccagcgcgtactttctcgtccagcgttcttccactgcacgggcatactggcgcccattggagaatgtcttatcgagtcctttgcgccataaatcgttctcataatctgcacggcgctggtctggccacttcgtgtggattgttccgccgtcttccaagagattgcgccaaaatccgaatgtcaatgacgctatgagatggccatgcgtatgattttttcgctggtgcggggtgagatggttccacgcttcacgaatctggtactgggttcggtcatcgaattgtagccctgccatataccagtcttcagtgccattctgctccagagcgaggagggagagttgccggtccatgcggttgcgcagagcgacctcgaggatggcgatgtcgcccatacaggcgctggccatgtcgtgatcccacaggtacagctctagcgctgggcatgaacgtctttgagcctcataattgtaggtggcaagccgttcatcggtaatgcacgcgcgcagcgccttctcccgcggacttcctttccttggagtccgtgagaggaaatcagttgttgaatttgactgtcggctcatggctcattatgatatatcaagaattcccccaaagggcctctccggacggtcttcgactcagccgtgatgcactgggggtttctttttatctggataatcggggcttggttggtctgggctcttcttcaggacaatcgcatatgtttcgggagtgctcagctttcagacgaggcattcgaagaaatgccattccgaggaatcggcatcatggatgatgatcagcgtgccgccctcattggttatctccttatgaggccggtcgtagagcgcatcgagctgtgttcccaggttcaatcgcagggtcgcatccgcttccttgattatgcggatgttctcctggggcagttggccactggagtaatccctgccgtccagaatggtgccgtcgacttgttctgggtcagcggcgaccttcacgtaccggtatccgtccccatgaaagctttcctcgtccttgctgacgattgcccgcgcatcctcggaaaatgagatcgagaacgtctgcgacagattcgaaaccggactatagccctagtatcgagtccatccgaaccatactcccgccactaccaacgccgcgatgcccaaagcgatgatcgttccggcccggccaccggcggaaggctcacctttccatacgcggtttcccatcgtcggcctcctagccttagccgtagggtctgctagatcaaagtgtgtattactgattagcgtgaggtcgccgccactacgtgagcggtcgaaaacctcatgccacccggcaaatccgagaagcggtcggagaactattcgaagccgtcagctaatccagtgttgaacgtacgcgacgacacccagaaacgctcctatacccgctccgaggaagacgaatccccatcccaaccagtcagcaaatcgattgaccggggatttcgcaaagccctccatcaccgaattcgttccagtcgagccctcccctgattcatggttgtcctcctcggcatccctacataaaacccgttagtccaattcaatccgttcgcgcccgcaagcgcaacatcgtgtcaagtaatcgcatgacagcaggttttgtccggctgcgaccgtggccacgatgagcggcatgggacatgataacatgaccggggctgcggcgcggtcgatccgtatcgcccgtattggacaatgatccgttcgccctggatgcgatgtgcgcgatgatctcggccgtttccaaggacttccatgtcatgtggggcacgggttcgcccgcggtggcgatcgagcattgccataacccgcataccaggccggatgcgctggtgttggatatggcgtggggggaaaaatcacgggcgctgacgtgtgccggcgcatccgtcgcaggagcggcgggacgggcagcgtgttcacgtacgtgcaccgcgtggccgacaagctgggagtcgccagccgcaaggaggtgctggacgcatgcgccagatacgatctgctctgccccggctttccgagcggcttggcctgcggcatgccgggcatccggtgatcgcggcgtcctgcgccgtattgtccgtggcggtgctcgcggagtacgtgttctcgatggcggcacgggtccccggcaccgcgaccgtgcgcgatatcatgttggctctggctgtgcttgccggcctggtcggcggcatgttccgcccggaccggttcctgtggccggcgcttgtcacgggcgtaatcctcatgctggatgtcccgatggtcacgccgggaccgacggcatgcccgccgacgaacacgaataccagcaacagctcgacgaattgcgcgacgccgccagccgggccatgggccacacgcacgaggtcatcgactcgctcgaagaacacacaccagcgcaagccagccggacaccgaacaagcccactggcagctggaggccgtcattccctttaccggcgtgttacagacaatggaatggtgatgttcgcgttccagttgtcggaatcatcggtgatgtcgaacgtcccggacatggattcgataacggttcggtatctcttgaggccgctgccgagtccgagccgtaccgcttcgtcctttagtacgtcgcttgccgaaatgatgacgtgccgccggtcgaaggagatcgtgacggcgtaccattcgtgcggggcggcgtgcttggcgatgttcgcgtacagttcgttgagcagtccttcgagaaggtcgaggatgtcgtccgccagtggatggtcgaacgtcccgaggatgtcgtcaccttggaatccgaggccgccaaggcgacgtcgttgcgattgaatgatgccgtcaagccgttcacgctgctgttcgattttcctgtcggttttgtcgtcgttatttgttttgacgatgcggctgcgatcgtctggtttgtcggtgcgttcaagttgtcgtatcacctggtgggtgtggtcgagcgccgtttcggcgatggcgcgcagatcggtgagttggcgctgatattgctcccgatcggcggggcaatcactgcggcttgcctggtcgatgcgcaggatcatgtaggcgaggtcgttgctgatggtgtcgtgcaggtgacgcgccgtgtgttcgcggtcgagttgttgcctgagtgtcgcggtcgcctgccgttgggcgaacagcaggttgagactgaaccccagcgacaatgggcataggcacatgatgatcatgcctacgatgttcgacgaggtgaggttgttctgcatgttgttcgcggcgagggcggcgagggccgccagtgcggaagcggctccaaggcggggtttgacgaacgagaggaccgctatggaggtcagtgcggcgatcatgatggtcgtcaacggcgagaacagccacagcaacgcgtatcctgagaccgcgaacagcagacaggcggcccataccggtgccgctccgagcatggcgcacaggacggcgacgagccagcgatatgcgtatggtcgaccatgacagcaggttctgggatgagtacacgcccatctctacggggatcgccactgcgaggaccaaccccgcggccagtatggctgggtggtgtatacggttcagagcagatcgtatcgggcgcatatggcgagggcctccttgcggtcggcggcatggagcttgcggcatgccctgttgacgtaggtgaagacgctgcccttgctgacattcaggagcgcggctatctcgtcggtggatgatccatgcgcgtagaggcgcagtacgtcccgttccctggaggacagcgatggcttgtcgttttccggcagccggccctcggtcgcgtgtccttcgttgagtttgcgattggcttcccgtgcggtggggaatccggtgccggggacgggctcccctgtgccgcgcatcgtatggcctgcgggagctctttgacgatgtcatctttggctatcaggcattgtgcgcccgcctcgaccgcgtcttgccgatatggatcaaggtcataggaggtgacgcacaccaagccgatcgtcggagtgcgccgacggattctggcgcatatgtccgcgccggtgatgcctcccaaggccatgtcgacgaccagcacgtcgggtcgcgcgccgtgggtcatacagcgctgcaatgccatcgccggggacgtggtgctccagatgatgtggaaccgcggggagagacggctcgtcatcacggctatggcgttgagggcgagcgaatcgttgtccagcaccccgatggagatggtatgcgagtccgataggtctgtcatgccacccatcgtatgcgcatcccatgctcctcgacgtatcgttgtcatgcgcgcgcatgacagtcttttgctcccggatcgccgtctgtgggctaatggttggcgacagttgtgcaatcgtccgaaggagcatgatgatgaaatcgggaacacgacgcagggccgccattctgaccgcagtgatgctgctgtccggttgcgggacgactccgaacggcggcacctcgggaagtggcggcatgctgacctggcagcaggcgaacgaggaatacaaggcgaccgtcgaggatttcccctttgaactgatgaacggcgatgcgtttccagcgaatatacccaaggcgcaggccgcgtcctcgctgtatgccaagggaagtggggaaggacaggcgtatgtctactggcagtgctcggtggaacgcgacattctcgacaacagccagaccaacgcggaagcagcccgaggcgccctccagcagctgcgcaagctgctggataccgactggttcaagaactactacgaggacaaggatggcatatacgagaacgatgtgatcggcaaatccgaactcggcgactattcgaccatgcgggacttctacaccacggactgcacatggtaccggcatgagaacggactgacgaaatgaatgcgatcgcaccgttcaaatgcctgttggcgtgcgtgacggccacgacgatgtgcgcgatgatgacggcttgctcgccgtcgcggacgccatcgtccgacgcctcctccacggcgaagcggccagcatccacggtcgaggtgcgtaggggcggcatcacgccgttgtcctcttcctccaccggcgtgcaggtggctcctgtgttctcgcttacgactccggcgaaaggctggttccactccacgactgatcaaggagcatacgtgcatgcgggcgacgtgttgggtaccgtcggcgatcagcaggtcacggctccggtcgacggcgtgatcgaaacggtcgcgcaggccaacgacatggccgcggactatccgctgttctcgatacggtatggcggcatgagcgccagcgtggacgcgaccgcgctgctggcgaccatagacccggaccagccgttgacgggccgattccaaatcaccgacgcgcaggggcccacggactgtgccgcggtagtgaatgacggcgtcgccactccgccctcatcagcggaagatacggccggatcggcgacgactgcgcatgggacggaatcgactcgcacactgcaatgcctgttcccaaaggacgtgcaggcgcgtcccgggcagaacgccaccgtggtactgaccgcgacggcggtcgaggacgccttgatcctgcctgtcaccgcagtcgccggcaggctcgcctccggccaggtcagcaggcgtgacggagattcgttcgccaccgtgaacgtgaagttgggggcatcggacggcacgtcgatcatcatcctcgacggtctcgaggaaggtgacatggtgtctgcgacagctccgaatctcacaccgggagcgcaatcatgagcacactcatccggttggaacatctgagcgccgaagtccggctgcccgacggcgaacgcctgacgacggtggacgatgtcagcgcatcgttcgagaggggaacgtccaccgccatcatcgggaaatcaggatccggcaaaaccagtctcgcctccatcgtcgggctgctcaacaacgactatgacggaacgctctcctatgacgggcgggactgcgccgcgtggaacgacgccgaccgggcgcgcttccgctgccggcatgtcggcttcgtgttccagaactactccctcataccgcatctgagcgcatgggagaacgtggcactcccattgcaataccggggaggtatccccctgcgggtcatcagaagacgagcctcgcgcatgctgcacaccgtcgggctcgggagccggacggtgtgcagcatgccgtcgcgcctgtcgggaggcgaacagcagcgcgtggccatcgcccgagcgctggtgggcgatcccgatctgctgatctgcgacgagccaaccggcgcgctcgacaccgaaaccggcgacatggtcgccgacatactgttccgacatgttcgtgaactcggggtcacactcatcctcgtcacgcacgacccgcagctcgccgcccgatgcgaacgccgactgacgatcgacagggggcgactgtcgtgatccgcatgatcgccaaggatctgcgcatcaacccgttgcgtaccagcctcaccgccctgtcgatgttcatcggcatcatcgccctcatcgccggcgttctcgacggcacgctcggacgcgactatctggaagcggtcaacgcgcgactgggaggcaagtcacccacctatagcgccatcgtcgacgtgccatcatcggtgaacatacaagtcgtcacggctttgcaggaacgcctcgcgcatttccgtccgggaatcgcatcggcgcaatatcacctcaacgacctcgccatatgggcgtcgtccggtgacggcaacacggagatacgccgcgtcaccatcatcatcaccgacgccgaacggacaagaatcatgcccgcccccatcatcgagggtacatggctgaccggagcggacgaacccgccacgctggaaaccgcagtcaacgaaagcgcccgccaatacgtgcatgatggcaccgtggcactcgcccggacaggaaatccgcaacaggtgccggcacgggtgaacggtgtcatcgccgacgggacggacacacccaccatctacgtcaacgcgaccacactgcaacgctactggccgcaagcctgggaactggatgggctgaccatcctcgtccatcccaatgaaggcgtggacgatcaacacgccaaaaccgtgttggacgatctgttgtccgacgtcgggaccggcagcatatcgtcatggaaccgttccgacaacgccgatgattacgagcaggtcatcggttttctccaactcggcgtcaccgtcaccgcgatattactgttgtcggtatccgccatcggcatgatcaacatcggattggccggcatcgagcaacgctcgcacgagctgctcatccgccgcgcactgggcgcgaccagagccggcatagccatacaggtcatcggctcgtccgtgctgctcggcctcatcatcgccttcgccgcggtgctcatctccgcggtgctggtctgggcaattccgtggatgatgcccgccgactcgccgctggaaccgcccgcatacccatatacggcggcgatgattgcggcctgtgcgtccatcgtcacctcgcttgtcggctctcttgccccggccatcaaagccatacggctgcaacccgcgctggcgttgcgatgaaccagaagccattctggacaagcccgccgacagctggatggtcggcattccgatcatcgattgcatccggtaaacgatccgcttgcgggatgtgtaccatggtcgagatgccgcaaccgcagaatgttgactattagcatacaaatacatactattgtcttacgtaatgatgttggaggttaatgtgagcatggcatccgtcacagtccgcgtggatgcggacaccaagcagaaagccgcaaacattgccgaggatctcggtctggacttgtcttcggtcacccgcgccttctacaagcagattgtccgggagaggcgcattcccctaaacctttcctatacgaccgtgccgcctgaaaccatggaggcccttgacgaggcgaagaacaggctcgccgacggcaaacctcgtttcaacagtgccgatgagatgttcgattcgttggtaatctgatcaatgctcaaaccggattacacagcggcattccagcgagatatcaagaaactcaaacgcaagcacactgatttacgcccgctgaaagaagtcattcgtctggttcttgaggacacggcggactccaaggaagtattgaggcgtaggcatcgcgcccacacacttaccggtgatttaaacggcgtattggaatgccacatcggcaatgccggcgactggctgcttctatggattcgcgatgatggtaccgccatgttcatgcgaaccggcagccatgacgaactgttgggcaaatagcgggtttacatcctgctttgaaccggccgatggcgatttgagtgcggcagtcggcccgtgcccgcagaagccggcatcgcctcgcagcgtgccggtctgcaatcgctgatcgacgaggaggagtccaggctcgaagccccgggattcaccggcgacaacctgctcgccgaaccacaccggccgctcacgccggagaccatgcgactgctgtcgggcttgccggcggaactgtacgcgaacatcgccgaacacgccgaccggggcgaatggtacgccatctgcgtcaccttcgacacggacgccatccacgtctccgccagcgacaccaccacacccgccgacatgggactcggcctggggcagcggcctcgaccgctaccggaccatcatcgaaacacacggcggcaccttccaaacccacaccgaacaagcccactggcagctggatgtcagcattcctgccaagaactagccaggcttgggactcggtaatgcacgcgcgcaacgatttcttctgtgagtttctgttcttctacacaacttaatccgatatgccttccgggcgtgtcgttgctcgtgtcgtgaaccgtcggttcgtttctagctacatacatcaatgaacgtttgtttacgatgtgccgtggaaggagccgcatacgcaggatgacatgacctcgcccggtggggcggtgatgcgcgacgaggatctgctcgcgcgggtcgcctccggggacgaacgcgccttcgagaccctgtatgggcgtcacgctgcggcggtgcgggcgctcgtgcgcgtgcgcgtgccggatgccggcacggccgaggaggtgtgcgccgacgtctggctgggctgctggcggtcggcgagggcgttccgtggtgatgcgaaggtgctgtcctggctgctgggcatcgcgaaacggcagatctacatgcgcgtgcggcgcgtacgcccgaatgtgaccgcgttggacgatgcgcccgaaccgcgtgacgatggaccgagtccggagacggccgtgctgtccgaagcgggcgtggatgatctgatggcgttgttgcgccggctgcccgtcgaactggtggagacggccacgttggcgtggctgcacggcctgtcgtaccggcagatcgccgatttgtcggacgtgccggaaggcacggtcaaatcccgtatctcgcgtgcgcgccgtctgctgcgcgcgcaactcgaccgctaaaacgatgcggatggaaaggaacggtgaatcctgatgaccgatcatcttgacgaaacgatcgaccgtttgacggacgagacgcccgacgggcgtctgcttgcggcattggacgccgtggaacgatcccgttcgggagacgcgcctcccgctgcggcggtgatggcgcgcatccgcgcgtcgcggtcccagttggacggaccggcatggtcgtgggcgcgcagtctgcggttgttcatgctgctgctgggccggcagtcgcgggtggtgccgtggcaggtggtgccggccacactggcgttgatggcgttcgccggattgggggcgcggttcttcgcggtcggctggagtgcgacgatcgtgtcccatgcgttctgctcgatggtgctggccggcgtgctgctgagcgtgacgatggcgttcggggattcccgcgcggacatgatctcgtcggccaccccgttgggtacgggggcggtcacgctggtccggctggtgttcatactcgcctgcgacgtcgtgttcggcctgatggtgaccaccgtgatgggcgcgcaggggtatgggacgttcggcgtactgctggtcggatggctgtcgcccctgctgctggtcgccggcgtgggcgcgatgctcgcgatccgtttctcctcgggcgtcggcttcggcgtcggcctgctgttgattatcgcaatccggctgaatccgttcgggttcgcgggtctggcggacgcaagccggtccggtgcagcacaatcctccggacagctaggtctggccgtcgcggggctgatggcctgtgtgggggcggtggcgctggccggacgattgtccggggcgcgcatggcggccgcgaccgtctgaccgactcgaagccgataactcatctggtcgttcggcatgtcgcgtgaacttcaggacaggcggccgctacctacttggtgacgaacaaaaagaatgaccgtcaacttcatcggacttcaaggagggtcggcatgacgggaatgattcgcgctcaggcaaggcgcatcggcatgggattgctggcaatgcccgtggcctgtgggattgcggtggcggcagccggcgtcatggtatccggcgtgtggtcgcgtacgcaaacattgatggtggtgaactggctcgcccagctgatggtgatcggctcgggcgtgtgcgtggcggtcgcattgaccggtgacccgctggtcgaggcgagcgagtccacgcccgtgggttggaggcgcgtgcaaaccacacggttcgcgctcacggctgtatccactcttgtgggtgccgtgcttatgttcgcgccgttgcatgtattgggcctatggccgcaggatatgggatggataagtctgatcgcgccggccggcgcgatactggtcgtgggcctggccgggttcgcggccgccgcatggtccgcgtccgcacaggccacggtcatggcggtggtcgccgtatggatgttcctcgccctgctgtgggacccgtacgtgctcgatccggtcacgcaacgcggcatcccaatcgccgtctccatgatcgccgtagtgttcgcgtggcgtctgctgggcgacgaggaacgcaacgtgacgctcgcaaggagaagcatatgagtccttgcaccggtttccggcatctgacccgcgtccacatgatcatcgtgtggcggcaacgttcattatgggtcgcggttgtcccgctggccttgctcgcggttctgctgggcgtgatctccccggcaggaccgcatgaccacggtgcgggcgatttggcgttcatggccaaggcgatggccatgttcatgccgatcgcctacatggccgcgttcaccgacttccacacgcggcactcccgacttggcattggtcaattggaggattccacgcccatccccgcgcccatgctggccgcggctcgcacgctcggcgcgtttctgatcctcatcaccccgtcgctcctgctgctggagtgcgccggcgtcgtccagaccctgcacggctcgtggcgggccataccacaggcattggccgccggactcgcgatcaccgggccggccgtgctgaccgcgatgagcctgtcctcgctgctcggcgcgatcctgcccatgatcgtcgcgcgcatcaccggcgtgctcgcatggttcgcgctcgtgttctcctcgccgatgctgcccgtgccgaccgtcaacggcaccatcctcaacgtgatcggcgacgccgtcggcgccggatggttcgggctcggccccgtctacccggccacgggaggcatcctcgcggtcaccggcacgcccgccaacgcggccatatccctgatcgcgcagctcgccgtcgccatgctgctcatggcgttgggtggatggtgctcggcacacccgcgcacaacgcgctgaacggcaccggcggaacccccaccgaaaaaacatcacacggaaagaagacgtcatgttcatctccatcaaccacctgaccaaggacttcctgaggaagccccgcgcgctggacgacgtgacctgcgacctgccgcacggcatggtcggtctgatcgggccgaacggcgcaggcaagaccacgctcatgcgcatcctcgccggcatcatccgccccacatcgggccaggtactcatggacggccacgatctgaaggacgagaggacccgccgtgcgctcaaacgcacgctcggctacctgccgcaggacatcgaaccctacccgcagctcaccccgctcgaattcctcgactacgtgggcgtcctcaaaggcatcgacgacacgcgaaagcgcatgcgccaggcgcacgagctcatcgaacgggtcgggctcacggacgtggccgaccggcgcatcggcggcttctccggaggcatgcgccgccgcgtcggcatcgcccaggccctcatggcggatccccggctcatcatcgtggacgaacccaccgccggactcgaccccgaggaacgcatgcgtttccgcacgctgctcgccggcctcggcggcgaccgcaccgtgatcctgtccacccacatcctcgacgacatcgcccagacctgcccatacgtgttcgtcctgcgccaaggccgcatccgctacgacgggccgaccgaacacctcaccgaacacgccacgggccgtgtctggctcacccagccatccaacaccccgccaccggccggcatgatcgtcgccaacgccgtcaccaccgcacgcggcgtacgctaccgcgtcatcaccgacaccccgcccgccgacgcgcatcccatggaccccacattggaggacggctacatggtcctcatcgaggaacaccccgaccagcattgacggcagacgaacaagcaccccgaccaccaccgaacacgacaaaggaaaccagcatgaccaacacgacacacgccatccaaaccatcaccgccaccggcctcgccgccatcatggccctgggactgaccgcctgcatggacggcatcgaacaccccgaaaactaccctaccaacggcagcaagaaaatcaccgcgaccagcaacccacaggacatcagcgccgaccaactcggccacacatggcccctcaccgtcgaccacggcaccgtcagctgcacgcacaacagcaaaggcgatcccgtcatgcgcttcaccgcgcccgacggcacccaatacgccctcaaccagaccagcgacaacaaggacctgcccgacatcaatcagctcctcgccgacggcaaatccaccggcaccctcaccagcttcgccttcaccgtctgcgacgtgaaataatcatgcgcccgctgccggcggccgtgtcgatgtcgaccaccgtgcgcataccgcgagaatcctgtgacgctgacggttcatcatcgtcttgcagtcaggaccggcgcggttccgccgccgttttctccgtaacaatcgcgtatagcaccagtgcgaccagcacgacgagccgggtccaatcgaaattacggatgagcagcccgacgagaatcaggacgtcgtagaacagcgtgcgcgcccaccgccacgggtattccttacggacgcgcatcgtctccgccaatccccagatcagggcgcagacggcgatgataccgttgaaccacagcactatgggcctgccctgcggatcggtgtccggcatagcgagattgctgaagaacatcaccagagcacccgtatatacggcctcgggcgcgaccgacaatcttccgccttcaacgcgaggatctgacatgattacctccttattggggatccgtcaacgctaacgaatcatgcgaaaaaccattatatttgaatggtatgagcggggctcaagcattcacaacatgctgtcaagcaatcgtatgacaagaatcatccgtttacggcatcgccgccggatgaccacaccagcagggcacccgcgagggagacgacgatgacgccgatcacggccaccgcggtgatggtctgtcgcaatatcagcgcggcgataatcacgctcatggcggggtcgatggagaacagcgtgccgaccacgcgcgccgacgtgatacgcccggacaacgtgtccatcgtgtagggaatcgcaactcccagcaccgccgaggctgcgatgacgccccactgggcggccgacacatgcggcgcgcgagtgatggataccggcgaagtggccagcgccgcaaccgtgaccgacagggcgagcccgtcgagcccggtgcctgccttgccgacccggtcggcgaagagcgtgtacaggccgaagcacacggccgagcccagcgcgaacaggtagccggccggattgaagtagccgcccggcgtaaacgagatcaagcccacacccaccagcgcgaccaccgcgcacaggccctcgcgccagtgatgcgaaccggccagggcgaccacgcagggtccgaggaattccagggtgacggccacgcccatcggaatgcggtcgatggccgagtacaggcagacgttcatcgccgccatcgcaagcccgtagattacgatgcccagccattcgcctttcgaccggccagccagtttcgggcgggtgagtgcgagaatgacgatcgcggcgaccagcatgcgcatcgaactgaccggaattggtcccaacgcgccgaacaacgacgccgacagggacgacgacgtctggatacccaacgaccccaccatcaccatgccggccgccgccatcacacggccacgcgccgaacgcggcgcccgaagcttgcccaatacccctcccctgtcacggccattcccacacgacctctgcgccaccaatgatagtgttcggcgaagactcgcgacgtgcggagtcgactttgtatggcgggatcagcggaaagcggcaggctcactcccgcaacggaatacggtgagaaagctggctgccggacgattacgatccgaaacagtgcacccgtatacggcttcggtcagacacgtttcaccgccttgaacagcagacatgcgcttatcgcggcgatggcgacgccgaccggaatcacgtaaccggcgaatttcaccccgttcaacacccatgtggttggtatgacggcgtacagcatcggcgcgtcctcgaacatgccggaactcaccgtaagtccggcgacgatgaagaaggcgacgacgttccaggcgacgagaggactgacccagagccgcagaacgaagcatgccagggaaagaacgacggcggtgaacgcaagcatcagaatggtacgcgacgaaagcgtttcgttgacgacgagcccgacggcaagcccgtacagcaaagtcaggcagacgttgatcacgacgccgagcgacagcgacttcacgctgaagcgaagcaggagccggtcgtggatgctgaaggaacggtacgaggagggcaccctcgcatgggagaagacgagaccggcagcggttacgggaagcgccatcaccatcgccgactgcaccaccgcacccgtgttcccgtaacgcaaaaagaacaacggaaacagcagcacagccacgaaggcgagcgtcggccagcggatcaccgccacacgctcaatacgcaatagggacttcatttcctctccactccttcgcgacggaaccggctcaacagcacataggcaaccaaaagcaccacgatcgggacgacgaccatcacggggccgacggacgctcgactcgccgcttccgccggcgacatcacggtgccgttcaggttcagcccgacggtccgtagggcgttcgcgacgtagggcgtcgcatagtcgggaaggtcgcccggcaggagaatccatgcatagcaaaggatggccgagacgattccggcggttctgggatcggcggcgatctcgacgatcgagtagatcagggaggtcgcaaggctctgcagcacgacgaagcacaggacagctgccagatgcgggtgcattccggtacccgtcaggaccatgatggcgtcgaagcacagtacgccaatcaggttcacggaggtcaggatcagggcccggaacacggccctgagcgagcatggcgtccacgcggaatacacgtggcgcggcaggccaccgtagtgcgccttcgcgaccctggcatcgcatgcgaagagcagcgaaagacagatcaacggctgggtggcggtgaaatagacgcaataccctccggttatcggggttccgttcgccgcgcttgagatccacgcacccagcagaagggacgagacggccccaaacaccgcggcgaggaaataccacgtgttccagtagtaggcgaccaacgcgcgaacaggggaaacggcgttcaagaccctacctcccctgatacagatccgcgaggttcaccccggtcagatccgtgacctgcacggcccggccgtgacgaatcatgatgcactcgtccgggacgccctggatctcatgaagcagatgcgtggagatgacgacgcagttccccttgtcccggtaggcgcgaagcgtttcggacaaggaggctatgccatcggggtccagaccgttctgcggctcgtcgaggaacaggaacctcggatgcggcacaagggcgaggcacagctccagacgctctttcatgcccgtcgagtagtccttcgccttccgcccatacaccgcgcgattgatgcccacaccgtccaacgccgcctccgggtccacatccagaccccagaacgcggagaccacctcgacgttctctctaccactcaggtaaggaaagaaactgggatggtctatcgccgcggacatctcattgatattcgtccctgtgtacgtgacctctccgctcacgggctttatccgtccgagtagcgtcttcatcaacgtggttttgcccgcgccgtttgccccaagcagacagatgatcctacccgtgctcaaccgcaggttaatgttgctgacgattggggaacccttgtacccgatcgagagattcgtagccgatataactggcataatcacccttcacgaaaggcgggcctgaaggcaaaggcaggatgccttgcccagacccgcgcgttgcaatgtcgccgccattttacccttcagcggccgcaaacgtaacatcatgtcaggcaatcgcatgacggttgctccatgctccctcgatttgccgaaactatccatcggccaaaggaatgaacctgcgcatcatccgcaaggacgatgcatccgactcccatcgcacacttgccgccaccggtctccccattaccatgtttggtaggccccgatggtcggggccgggtcgccggttccggtatgactttcctgccctgtcgtcgatgatccgggggtgttgtcgccgggaacggggacgcccgatgaccgctgataggaaccaggccggctacacggacgcttcaggggcgcatggcgcaggtctcgtcgtaatgtgggtgcggcgcgggcgtccggactcctccgagcccgcggcgaccggaaaaccttcatgacgggaggaacgatgatgaccccggacgacatcgacgtgtgggtcggcctggacgtgggcaagagcgcgcaccacgcgcacgccctcgaccatgacgggaacaccctgtacgacaagccgttgaaacaggacgagaaggccatccgcacgatgctgggcaagctctccaagcatggccgtgtgctgctggtcgtggaccagcccaacaccatcggctccctgcccctgacggtggcgcggaacatggggatcgcggttgcctaccttcccggcacggccatgcgcaggaccgcgcagctgctgcccggggacgcgaagaccgaccgcagggacgcgcatgtgatcgcgtgggccgcgctcaagctgcccgagacgctcagggacgcgggcccggatgacgagaccctcgccgccctgaagctgctcgccggccacgacgaggacctcgcccacgaatccacccgccacgtcaaccgcctgcggagcctgctgctgcagacccaccccgcgttcgaacgcgcgctcaagggcgagagaatcacgcgcgacgcgacgctcgcgctgctcgaacgatacggcgggcccatgggcgtgaaacgggccgggatcgaggacgtgaaggactgggccaagtccaacgggcttcgcgccggccgcatcatcgacgacatgttcaaggcgatcggcgagcagaccgtcaccgtgcccggcaccctcatggccgagaccatcatcccctccatcgcccacgacatcaagacgatcagggaccggcggcgcgaggtcggccgccaggtcgagaagctcctggaggaccaccctcttctcacggtcctgacgtcgatgcccgggataggcgtcaggaccgcaagcaacatcctgctcggcatcggcggcgacatcgccaacttcaaatcgtccgcccatctggccgcctacgcgggcatatcgcccgtcaccggccaatccggcaccagcatcaaaggcgaacggccctccaggcggggcaacaaacgcctcaagaacgcgctgtggcagaccgcgttcgtcgcatccaccaaacacccgccctccgtggcctattacaagcgcaaacgcgaacagggcaaacaccacaacgccgccatcatctgcctcgcgcgtcggcgctgcgacgtgatctacagcatgctcaaaaacggaaccctctaccaggaaccagccctcgtagcctgaaccgggccacacgggaaaggacgccggacgccaccggcagggcgaagcgcgcccacgacagccaaccggaatcccgacacgtcaactccccaaggagttgacaaaaacataggaacaccccccaaaaaaaaatggcgaagggcgggttccagtgatcgtcgcaacgcctggctgactgatgggagggccaggtggacaggtgggtgttcgagggtgtggagtacgcgacgcgtggtgagatgtgcgcggcgaggcggcgccgctacgtcgagctgctgggggcgggcatgaacttcacgcaggccgcgcgggcggtgggcgtgtccaaacgcaccggcaaggtgtggcgcaacggaaggacacgatcgaacggcaggaacgagaagccgtcggtggactggtatcgttccaccgtggacgttccccagaagatcagttcgaggtatctggaccaggacgagcgcatcagcatcgccgactggcggaaggccggcatgggcgtgcgcgggatcgcgcgcaggctcaatcgtctcgcgtcgaccgtcagccgcgagctggcgcgcaacgcgaatcccgcgaccggcatgtacgagccgtaccggccccagcagatgagcgcggacggctcagacgacccaagcccgcgaagatccatacggtgcccggcctgctcgcatacattcgcgcaggattgcgggcgcattggagtcccgagcagatcgcggggcgcctgcgcgccgatttcccggataatgatgctatgcatgtgtgcgcggagacgatctaccaggccatctacgtccaggccaaaggcgaactgaaaaaggacgtcatcaaggccctggggagcgggcgcgcccaacgccggccgcacgggcaggcgggttcgcgcaggcccgtttccgcgagcccatgatcatgatcggcgagcggcccgccgaagtcgaggaccgggcgatacccggtcattgggaaggcgacctgatctgcagcgcggccaacaaaagcgcgatcggcacgctcgtggaacgctcgacacggttcacgatcctcctgcacctgcccgacgggcacgacgccaaacacgtccggcaggccgtcatccggaaaatgcaatacctgcccaagctcctgaggaactcgctgacctgggaccagggaagcgagctcaccctgcacaaacgcatctcgaccacgctggacatgcaggtgtatttctgcgacccgcattcaccctggcagcgcggcaccaacgaggacaccaacgggctcctgcgccaatgcttccccaggggcaccgacctgagcgcataccccgaggactacctcgacgcggtcgccgaggaactcaacgaccggccccgcaaaacactcggctacaggaaaccatccgagaaaatactcgaactcatcaacacagcatgatgcaatcgcaccaatccaagaccgccatcaagagcggcaaaacacacaggtgttgcaaccaccactaaaatccgccaagcccaccttgccgaatggggtgtcgaacatggaatccgtcttgggggcgtgcggtagtcgcattcgtaacaacaatccgcttgaatgagctgctgagcaaatagcaggtctacatgcctgctttgaaccagccgatggcgatttgagtgcgattgcgcaggcccaaagttgcgaggatacgggtcacggcacgtttgacggaggcaggttcgacggtgagttgattggcgatttcctcgttgatgagcccttcggagatgagtgcgcagatttcacgctggcgaggggtgagtgcgtcgaaagctttgcgcatttcttgctggcgctggctgctggtgggatgcggaacgcctcgttcaagcacttgtctggtgattcgtggggtgagtattgcgtcaccgttggcgatggcgtgaaccgcgtcgatgaggttgtgcttggtgacgtccttgagcaggaagccgctggctccggcgtcgagaccgccaaaggcgtaatcgtcctcgtcgtacgtggtaaggatgagaatgctgatggtgggccagcgtctggtgatgcggcgagtggcttcgatgccgtccataccgggcatccgcacatccatgaggattacattcggcaatggacgatgctgaacggcgagctgttcgagcgtctcgatggcggatcggccgtcagcggactgggcagtgacgacgatgtcggaagcatcgtcaagcatgagttggaagccaagtcgcgcgaaacgctggtcgtctacgagcattatacgaatcatgcggtgtggtccttttcgttcactccgttggacgggatggtcgcctcgacgacccattcgccgtcttcgtttggaccgtattcgaagatgccgcttgccgattcgacgcggtggaatagacggacgagcccagtaccgtcatccttgcgcgcgtccttgcgcgcgggactgccgtcattgcggataatcacggcgacggtgccgttctcgctgtggttccaggcgatgctgatatgcaccacgttctgtccgtgacgtatggcgttggtgatggcttcgcgagtcacatcgaaacacaaatcagcctgagcttcgtcatcggcgcgcgtaccagtctcggtgaacaccgtgacgatgcccagccggcgtgcgtgcgcgagaatcggccgaatgtcatcccatgaatgctggtctgattcttgggtgtgcgtatcgtcaccgttcgccgctccatcgaactcggtcagtgcgcggacggctttgcgcgtgtcgcccagactctctcgtgcgatttcgttgatgccgtgcagcgcatcctccacgcgtgggtcatcggttttgccggccagaccctcagacagtgcgatgattacggtcagatcctggcccacactgtcgtgcagttgaccggctatgcgcgaacggcgtattgcggcatcgcgttggaaggccagctcggctgcccgccggcattcctcggcagctttgtgttcggcttccttggcctgttgcctgccacgtactgcaagcgcgccgcctcccacggctgccaacgttaccactcgactcacccattcggtcgcgagaacgtccggatgcaccatgatggccgacgcggtcatcgacagcatcatgccgatgcctccaacgcacagcccgcgccccctcgctgtccgggcgaacgcatagcaggcgacgagcgtctgaatcatcacgattgagtccaaccgccagtacgaggcaactattaacaataccgcttcaagcgccaaggcaacggctggcagccagtaacggacaagcagtatcgcactgctggctatggtcatcgccagcagcagagccaatcccagcggatctttggcaaacgtatacatggtgtcggccggcgctccgatcgcatgctcccacagcatcgctgcacattcgaccacggcgatgaccagtggcacggccaggaccgtgaccttattggcctgcgcggattgcggtttcatggctcccattgtggctctttttgtatgatgttgcgtgcatgtcagcatgtgcgtatcgtgtcggccacgctgcggtgtagcgcggggcgaatctgcgtgaactggatgaggaacaatgccagccagcaggccgtgcccatgccgattacgcccggccatgggatttcggccacggggatgccgacgagcgccgcggatcttgcggcgaaaacgcttgcgctgacggcgaccgggatgagcgagagaatgaccgcgccggcggccagctgcaggctctgccagagatacatgcggatcacacgacgtggggacaggccgatgctgcgcagcaatgcctggtcggcgaccatgctgcggttcgacagggcgatgaccgccatgctggtggccagggacacgatgcacagcatcgttatgagcagcagcgagtccgcgtagttcaggctcttcggatggccgcccaaggcgagtatccggccataggatcgcgcgcaggtcagcagggtgaccgacagtcccatggcaagggcgagcggggcaatcgtgttcgtgttgctggcggccttcgcctcggcggaacgggcggcgagcacgccggtcgcggacccgcacaggcgacacacgacacgtccgatgcccaacagaatcggaatcagcatgctgacaaggatgtacatgccgaacgaggcgatgatgccggcccacagcgcgctgttgaatgtctgccccgcctcctggccgaacgcgagcgcccgtggcgtgcccatgccggagaacgccaatgccagcgccgccgccatgacaatcaaaccaagtgcccagtgcgcccaagaccgccaaccgtgccgtatcccgatggctcccgtgccgcgaatcacctcgatgggacggatcttcgctgcgcgcagcgaggggatggacgcgcccaacatgcacgtggccacacccaacagcagggatccgagccacgcggccatcgacggcgtgaacgcaggaggtgcgaacgagccgaatccatcggcgaagctttccgcagccatggcgttgaactcgggaaccgccagcaggctggccggcactgcagccagagagccgatcagggaaccgaacaggctcgccacacccacgagcatccacatgctggcaagcacctgactcgggctggcgcccataagccgccattgcgcgaacgtgctgtgaatacggttgaccgtggccgagccgaccaccgtcaacgagaagaacgcgagaaatgacaccaccacatagatcgtgaccgacaccatgccgaactcggccggatcaagacccgcctgccgcgcggccaatgtgaacgacggagacgaggtccacacgaattggttcatgcatatgcccaccagcgtggtcaccactgcgaccaccagaatcgtgggtacccatcccgtgacattgtcgcggaacacacgcagcacatacctagccacgatgagcctccttccgctgctgcggatacgccacgcgctggaccggtcggcccggttggacggattggataggctgggcgttcaccatcatcgggccgacagaccgcgccgccgcaaccaacggcggcgacccggccggtacgaaagtgcggcgtatgccatcggcaatctgctcggcggtgagtctgccagcgatgtgggtgacctgaccgtcgcgcaggaagatcacgtggtcggccaaagcggcggcatccgtgtcatgcgtgaccatgaccacgctggagcccgcatccgccagctcgcgcagcacctgcagcacaagctcgctgttcgcggtgtcgagcgcgccggtcggctcgtcggcgaacaccaccgccggacgcatgagcagcgcacggcacagggcgacgcgctgctgttcgccaccggacagggcgcttaccgtcgtcttcgccctctggcgaagaccgaaccgggacagcagctgcgtgacctgcacgtagtcggccttgcgatgggcgagcgagagcggcaacatcacgttctcctcgaccgtcagatacggcacgagattgtattgctggaacacgaaaccgatatgcccgcgaatgaaccgcgaacgccgttcctcattcagtgcgtagacgtcggtaccgccgatggtcacccgcccggaatcgggcctgtccaatccggacagcacatacagcagcgaggtcttgcctgcgccggacggaccgacgatcgccgtcaagcccgctccatcgatatccaacgaaacattattgagaacagtctgcgtgtttgcgggtcgggaggcggttcgagcatcgaaccctgtccgtttcaccagtccgagcgcctgaatcggtgtgccggcattttgccaagtcatgaggtagccccctgtcgtgaaagttgacgccgtttttctcaaccttcgcaccaggggcatggcaggtcgaggtaaacacggaaagtgacaccctagggtgacagattccagtagcgttccatgaccggcacccaatatgccctcaaccagaccagcgacaacgaggacctgcccggcatcgtccaactgcccgcctatgccaagtatgatggacggctgctcgtcatacttggttcctccgggaagcgaatatccttctgtcgtttgcggaaacaagccctgccgatgcccaagaccgccagataaagcaggaacatcacgggcacgacccatgtcacgtaccgccacgggtcaatctggaacgtatcgaagacgatgaacatgacgccccacacgttgatggcgacgatcgccagaatctgggcggccgccgaatcgaacctggattcggccgggctggtatcgttcgcgtcggccggaacgtcaggcgtccgcccggcgcgacgcatgaagccgagcgccgcccacacgatggccgccaccaacgccacggccgccggcaccaccagcttccagaactccccgtcattccagccgtaccggatgacggcgcacgtgatggccgtgacggcggccacgcccaatgtggcggaagcgccgaaaaaccacagcagaccttgattccgacgcccaccatgggaggcccgcacctcatcgtccgcaaccatatcgtccccgcattccataaagtccgacgcgtacgcatgccatctcaattatggcactcaaagagtcaatcagacaacatgctgtcaagcgatcgcatgacaggaatcggctatccgtcaatgccttagggtgctgtcgatgcatatccgattgaccgatgcttctacatgcgtgccgacatgtgccggtccttcgcgtccgcgtacgcattcttacatcacgacctcaaactaatctacgaaaaactttaaacagatatctatttgattttaatattatttatggtatacttaattttattaaacccgccgtgaattgaaggaggcaggtatggatacgacgatgatcccgccgtggatgtcgaacctcgatgacgaggatatgacgttcatcaaacggtttctgctcgcatcaggctccatgaaggaggtcgccgcgcagtacgacgtctcctaccccaccgttcggcttcggctcgaccggctcatccagaaaatcaagttgggcgagcagatcgagaacgagccgtatatcgcgctcatcaaacggctcgcggtcgacgacaagctcgacttcgacaccgccaaaatcctcatcagcgaatatcgcaagcagctcaagcaaggagagtaatcatgattggcgccacaatatttgccgtagtgtttttcgtgtttctcatcgccatctgcatcggcttcatcatattgcagatcaggctttcgaagatggacagcaagtggcccggtctggtattgcccgccatcacattgctgctgtcgcttgtggcggcgattaccgtcttcgccagggcggacatcggtgcgtatggcaacatgtggaacgtcgtgctttccgcattcatcgcgttcctgtccaacaacgtatccaccatcgtgctggccggcatctacttgtatcagcgtgacaagatcaatcgtcgcgccgagctggcccgtatgaacgttcaggacctgtaactcactgtgcaaaacacgcagactgaaccctacgccgcttatgccgactcatcatcttttgcgccgcttcgcgcagcttggatgattaagccggtgacgtggtcgcagggttcgtcgcgcaatcggagccggacgccctgtcatttcggctgattccgtacatcctgttccgccgcgaaccgttcggcgatttgccgtgcgtggatgttcttggcttcgttgacgaagtcggcgcatgccttgctgccgtagagcgcctcaccacacgggtcggcgaaacgcggatcgccgaccagcgcggagcgaatggccccgaacgagccggacagcggcatggcgttcatcacggtcgcggtttgattctgtgccgcccgggtgcgggcggtcttgaccagaccggtctcgtcgcagtagcgcaacgtgcgcgtcgtcacgccgctgatcaatgccgcctgatcaatgggccacaaccggcccgtatccagcggattgccctccacatcgaacgcgccggaaccgttgacggcgttcgccgtgttgtcgttctcgttcatgatcgatcatcccccttgaagccgattatcctctacccgccgtgcgtgtttcgcggcgttgccgtcaggatagacgtttacgcaacgtcaaccgcaagcgataatgggatgtatcgttcaagccaggcaatatgccgtcaagcaatcgcatgacagcaccatgttcggcacataccagatggaagaattggcaaaccttaaaaaataccgcggttattgctgtgccgagaacgccaatatgaccatagacgtgctttcccgctacacgttattcacctgtcatgcgccgatatcaatcaaaagacacttgcataaccaccgctacgcatcgccaataacataccgatgagccagaatgaggcccaggccacgatgctaatccgtaaataatactggtcagagtggcaggtacattggtcctatggctaagcgcaaacatatcggcactgttgttattgcaatactggtcgctattctgctgacggtgggcgtttccggctggctattctggcagtcggtacaacgggtgatcggcgaggcgcagcaggcgggcgaatatgcggctgaagcacagcaatccgtcgggcagggcgacttcaagcaggcgcttgagcagatggacagcgctggcagtcacatcgtcgcggcgcgagacgaaacccagggcatgctatggcaggccgccgaatacgtgctgtattacggttcggacgtgaaggcggtgcgcggcatgctggatgcggccgccgacgccgcgaccaacgccctgcctaaaatcgacagtgccgcgcagggcacgctggtggacttcaatatcgaagagctgctgtccggcatgaacttctccgacggcacgctttccattcccaaaatcgcttccatcaagcaggacctgtccgacgccggtgcggtcttgaagcgcgtcaagacgtcgatttatgcgctgccgcaaccccgcacggaacagatcaccgaaatggtcaaccagggcaagcaggtagtggaccaaatcgatgagactttcgacaccttgaacaccatcgtcgaaaagattccgggctgacgtcggtttgttcttgtcaggcgtaccattcgggtcgtcgcagttccaggaatggccgctgtttgcgcgctgctgcggtctgtgtgagatcgatgtcggcgataatcaactgttcttggtcgtcggccttgctgacgacgttgccgtacgggtccaccaccaccgattggccggcgaacgtcacatcgccttccttgccgacccggttgcacatgacgatggccacctggttctgcatggcctggacacggattttccacaggaacggcttcgacggttcggcgtcaatgttcggaaccgatgctcgccgtcggcacgatgaccaggcggcgccgcgcaacgcgcatgtgcggatgccttcacggggttcactcaaatagcgtcatccagtcgggatcgcggtgggccgcaaaacacatggcgatttgttccgcggtgtttcttgtttccgaaagccgcggcaaccggtcttcctcgaagtagcggatttccgtcgtttcgatgttggccgagaaccaaccgccggcgcggctgcacaatacgaagaacttgagcaccccgtacggataggtcagcgcgttgtgattggcgcagtcctgcaccgcgatgagtcgctcgcccctcacatcgagcccagtctcctccttgacctccttgacggcgttggaccgaatggactggttctcgtcgacccagcctccgggcagtgaccattccccgctgttctcatgcgtcatgaggatcctgccttcctcatcgaagatggccgcacgagtgtcgagtttcggcgtcggatatccggcgctgagcagtcgactcacctgtccggccggcgcatcaacctgcgtggagagcatgtcgaccgccatcgcgcggatacgctcgtagcgctcccggtcgaagggatccttgcagtacatcagtccggtctgggccagcgcctgcaattctcgggcctgttccagtaacgtgcggttcgtggccatcatcgttcatcctgtcatcgtaaggtcttggatccgtttgcgctcaggcatcgcagcgtagtgcaagcagtatagcacttcgaaccgttccggggacgagggtctcagcgcatcccccgtaacctctcccatgtgccatcaacgcttggcgagctgcacgttcttgcgctgtctgcgattgcggctggcgaccgacttttcacgctcgcggcgcacgtgggcctcctcacgcgcggccgccgcgcgctcttcttccaaagacggcaatccggaggcggcgcggcgccggttctcccgctcatggtcgcgttcggccttgcgctcccccgcctcggatccgggcgccggaaaccatcgcagttggcagagcgtctggccgaagttccacaggttattggtcagccagtacagcagcacgccgaacggcaaggtgccgcccgacaccacgtagatggccgggaacacaaacgcggtcagcttctgcgtgcggaactgcggtgaatccatggcgtccttcggcgtattgcgatggatgagcagccactgcatcgcgaacaacatcagacacatcaacgccacggccacgccgatgacgacgtgcgactgcggcgagacgaccgtgccgaacgagtcggcgatgcgcacgccgaatatggacgatgattcgatgtcgcccgccatgacgcggtcgatgccgctcaacggttccgcattcccggcggcgcttgcgggcagggattgcagcgtgtagaacagcgagcacagaatcggcgcctgaatcagcgaaagcaggcatgaaccgagcggattggcgttatgccgctgctgcaaagccataatttcacgttgcatggcttctttggaacgcggatccttacgcgcggcgtacttgcgttggatacgttggatttgcggttggagcacctgcatacgctgcgtcgcgcgcatttgggagaagaagagaggcaatagacagatacggatgatgagcacgaggcacataatcgcgatgcctaagctgtgcggcaccgcctcctccttctacggcggcggcatggtcgtcggccagcccatcggcaccatgatcggctctcgcatgatcaacaatgcgtaagccggcttcatcatcggcgccgtgatcatgctggcttccggattcgtagcgcttgccatctggccgcgcgaggaatcctcaaaggacatggaacgcaccaagatgacgctcaaggatctcgctgtctccttccacttcccgaagttctccacctcgcgcgacttctacaaggcgttcggctgccgagtgtgcatgttgctcagctaccagatgatctccgtgtaccaactctacatcgtcgaggattacgtgcaccagaccaagaccgaggctgccggcaccatcgccaccatgtccatcaccaccatggtcgtttccctgaccgcttcgctgatctccggcccgatctccgacaagatgcacacgcgcaaggtaccagtcatcatcgcctcgctgctgttcgcgattggcaccgcgatgccgtggatcatgccgagcgtcacgggcatgtacctgtatgcgggcatcgccggcttcggctacggcgtgtactcagccatcgaccaagcgctcaacgtcgacgtgctgccgaacaaggaagaggccggtaaggacctcggcatcctcaacctggccaccacgctcggccaggcggtgggccccaccatcacctcgacggtaaagaccgcgaccggagctttacgcctgcattcgccatctccatcatcatggccgtgtgcgccgccgtgttcgtgctgcgcattcagaaggtgaagtagacgctgcaaagtgcccatctccgtttcgaggggctgatgccaaagtagctactggtcaaaaacaacggaatgacattggagtaatgccatttctatccgtaatctggcagttgaccagccccttgaaacgggagtagacctccgacaagcacgaaatcagcccctcgaaactgaatttggctcaatgcatcgcccggcgcaactatatccccggtgcgggtatactatttcgggccgtcacgatgacgtccacggaacgcacgcatggcaaagagagaagcatgagtcagcccgataccgacatggcaaagcagtcgccgtcctcgcaacaggaaacgcagattaggatggatgccccgcagcataagccaaatcaggcagacgaatcgagcgcattaggcgagcagtcaactgagccgactagccagcacaataaacacgctctgcacacgaacctgaagcgcggcatggaatcccgccacctgcaaatgatctcgttgggcggcgtgatcggcaccggtctgttcctgagctccggatataccattcagcaggcaggcccgatcggtacgattctggcgtacagcattggtgcgctcatcgtctatctggtcatgctcacgctcggcgagctctccgtggccatgccggtgaccggttccttccatgtgtatgccgaaaagttcatcggccccggcaccggtttcgtgatcgcgatccaatattggctcacttggacggtggctctcggctccgaattcaccgccgccggtctgctcatgcaacgatggcttccggacagccccacatgggtatggagcgcggcgtgcatcatcctcatctttaccttgaatgccctgtccgtccgattcttcgccgaggcggaattctggttcgcttcaattaaggtgttcgccatctgcgcgttcatcatcatcggtctactcgccatcttcggcattattcctatcgccggatatcagcatgcgccgatgttcggcaatctcatcaaggacggcgtcttccccaacggcttcatgccggtgttcgccacgattctgaccgtcaacttcgcgttctccggcaccgaactcatcggcgtgaccgccggtgagacgcgcgacccgcaaaccgccgtgccgaaagccatccacaccacgctgtggcgtctggtgctgttcttcatcggctcaatcaccgtgatgtgcgcgctgattccgtggcgccaggccggcgtgagcgaaagcccgttcgtgctcgtgttcaacagcatcggcatcccctatgcgggcgacatcatgaatttcgtggtgctcacggccgtgctctccgcctcgaattcaggcttgtacgcctccacgcgcatggtatggtcgatgggcaacgagggcatgattccgcgctggttcgccaagacgaaccgccgaggcgtgccgatgctcgcattgtgcgccgcgatggcgggaggccttctggcgctgctctcgtccgtggtggccgcctcgaccgtctatctggtgctggtggccctttccggcctgtccgccgtggtggtatggatcgccatcgcctactgccagatcgtgttccgccgccgttggctggcggccggccatggcgtggacgagctcaaataccgtacgcccggctacccgtatgtgtcctgggcggcgttcatcctgtgcaccgcatcgttcgtgctggtggttttcgatgccgagcagcggttcgcgctcgtggccgagcttgtgttcatcgtggcctgttacggcatttacttcctgcaacaatggtggcggaaacgcggaaaagcgtctgacagcgaagacgatctatccatgccgtgggccaatcaacactgattgaacgattgcattttgttccgggttccagctccggttctttgccttgcggattgcgtatatccgaacaatagatacaacacaataaaaagccatatttgattggaatgccgtccatccccattcataggtcaatagaaggccggcaaacagataataaaccgcgaggggcggtgatgttcggatgatgataaccgaacgccaccgcccctcgcactcattgcgggatcaaagccacgaatcagctctccgcattctcgcggagagcctccttggcgtcgttcttgacctcggtggccttcttggcggcctcggctttggcgacatccgccttggctttggcctcgtcgagcgcatccccggccttgtccaccaggtcagaggccttgtcggtagccttgtctttgatatcgcgggccgtatcggcaactttgctgccggcctgtttggcaagatccttcgcatcatcgatcaaactcatggttgctccttagtacatgtgtgcatggaactactgaaattgctgacaatactgttcgattattcttgagttgtggtgagccttacttgcgacgttcccgcgcaaatatccagctcacgaataattatacatagcgtgagtgaatggaatccgtcaactcggcaaccgtcaaatgaatttcaacggctcatgcagactgcaatctcaatggttctccacattcccgcagcaacggattgctccttgccgtgcgccgcctcttgactttttatgagcacgcgccaatcatggaatatatggggattgcaatcaagcgcatatatgaggagccggcggcatcggacgggttccgcgtgctggtggaccgcctgtggccgcgcggcatgacaaaggagcgcgcggccctggacctgtggctgaaggccgtctccccttctccctcgctacgcaaatggttcggccatgaccccgcgaaattcgcggaattccaagcccggtacgttgccgaacttgacgccaataccgccgtcgaagacctgcgctgtatctgcgcggagtatcccgacgtgacgctgctgtatgcggccaaagacccgcaagtcaatcatgccttggtactgcgcgactatctcaatgagtcacttcaataatcggcagcacaagcaaatgttcaaaaacgacattcgcttctcgcggcgatttcgaattccaaagttcacaccaacggcttgcgtacatccagttcgcaagtgatgccagtctccttgcgagcccattccgccgcctgcaatgcggcgatgttccagagcgcgtgcggcacaccgccgagatctggatgggaaccccagaacgtgatgtcatcggagtatgcggtgatgaccgaatcctccgtaaccggcataatcgtgcggtaaagtcgatcggccagcgtggacacgaattcattggccgcggcaaacgtgtcgatgagatgctgctcggcagtcaccggcggccaaccagctcccaggattcgacatccgtagcgctccattgcgcggcctcgccgtccacctcgcgctgcagtgaaacgaacagcctagcgaactcgtccgaggtcagacctgtaactcgacgacgggtcgagagttcaatcggagtcatcaacttctcctttccatgtatttatgcatcatatgctcttaagggtcaaattcgattcatgcggacgaacgaatccatctagtaaacgaaaagcatggctgcaatgcattacagaattgactcaagatccccagatgaatgctttttcttgtaaatcggatatactggcgcgagaacagtgcgagaaagaggcgaggatgaccgagaaacaatcgcggaagcaaacggcaacatacgtcaacctgcagaatgaccagtccggtcagccacagcaaggcaagccgcgcaagccgtcgctgcatgcacgctggaaaaccatgggccaggccatgcgcatggagatccgcgagcataaaagctcgttcgcggtctacgccgtgctgcgcatactggtgctcgtcatggccgtgctccagttcttcaacgggaactatgagaacgtgttcctgtgcatcctgacgttgctgctgctgttggcgccggcgttcatccaagtgcggttccgcatcgagctgccttcggtgcttgaggtcatcgtgctggtgttcgtgttctcgtccgagattcttggcgagatcagttcgttctatgagatcttcccgttctgggacacggtgttgcatacgatgaacggcttcctcgccgcggcgatcggcttctcgctggtcgacctgctcaaccggtccagtcgggtgaagttcgagctttcgcccctgtatctggcaatcgtctccttctgcttctccatgaccatcggcgtgatctgggagttcttcgaattcggcatggaccagatgttcggggtcgacatgcagaaggacgccatcgtacactccatcagctcggtgatgctcgaccccacgcacaccaatcacgtgatccacctcaacaacatcacgcaggccgcggtcaacggccacgacctaggtcttggcgggtatctcgacatcggtctgatcgacacgatggaggatctcatcgtcaacttcatcggcgcggtcgtgttctccgtgttcggcttcctgtatgtgaaaaaccgcggcaagaaggactccatcatcagtcgtttcgtgccgcaacgcaagtccgccgaccgcgactatctgcgactggtgatcgatggcgggagcgcggctgatgccaaggccaaagccggcggtgtcagcgctgacgatagtgctaacgccagtgcggccggcaccgattcagctgatgcagctggagccaaagccggcaatgccgacgccgccccgaccgtcaccgccaagccttgagcacgttctgcggcactttcgaagcgtcgagacggtagtgcccggtgaccgtcacgtgcttcttgaaggcgaagtagtcgttttcccgctgctgctgcgccatgttgtgaatcacatacggtgcacgccccgcggtcagccgtgacacactcgccgataactgcgactgcagcacgccgcccagatggcgtaccaccaacgcgccgcccaccgtcaacgccatgatcagcacgatggcgacgattcgccctgttcgccgcccggcccgtcggcccgtctcatatcccgtttccgtcagatgccgcgccatccccgatttcgcctcgccgtgtgattcgatgattcatgaacgtattcgggtcacactgtgatcgtccgacccgccgcccgcacctcccaatccgcccggtgcttgaacttgtggggctttggcggtatcgcgaccgcagcatcgccatgctcatctccagccatcagctcaacgaattgcaggagttgtgcgggtgattcctgttcatcaaaggcggccggcttgcggacgaattcgccggcgaacagaagcggatcacggttatcgagcttggccggccgctcggtgtcgcgaaacgtgcggcggtcgcggctttggatccggccgccgtcattcatactgattctgccggccgtgaacctgttcaactccgatttcatgaaagtcagcggaaagaccggttcggtgagtgtgctggatttcctcgctggcgagttcgtcgtacagaacatgctgatgctgccacccggttctcgaccggcagtacgagagcgcggaccacaccgtgcacctcgatgtgaaggtggacgaggacacggtgtggcttaacagacagcaattggcattgctgtttggccgcgatatcaaaacaatcggcaagcatataggcaatgcattgagggaagagctcaatggattttcagttgtcgcagaatttgcgacaactgcatctgacggtaagacataccaagtcgagcattacaacttggatatgatcctgtcggtcggataccgcgtcaagtccaaggaaggcatctatttccggcgatgggccaactcagttctgaagcagcatctcgttgatggttatatatcatcactcgcaagcagcttgacgcacttcacgccgtcgtcaaggtgctatcgagatccaccgaaccggagattgctggcaccgccgagatcctggaacgatatttgccgagtcttgtgctgcttaacgactatggcacaggcaatgtccctatacccaagggcgacgagtcccaatgggtcttgacctatgaggacgcgatgctgttcatccggtcgatgccgttctacacgcaatccgatctgttcgggagggaacgcaacggttcgtcccagggaatcgtcgcaggactctaccagacgttcggaggcgaagaactgtaccgttccacccaggagaaagccgctaacctgctgtatcaagttgtcaaggatcacccgttctccgacagcaataaacgttgtgccgccgcactgttcgtgtatttcctgaacggcaacggtacactgtgcgacgatgactccctgcttgtggagagcaacgccctggcggcgatgacgctgatgattgcactgtccgcacctgcagagaaggacacgatgatcgcactagtcgagaacttcctcatacggcacgaatcacaggagatcaattgagagaccgtcaatgaagggtgtgcatcaatcacgttcttgcattgcgcgactatctgtacgagtcgtctgaacgacctgctgggagtgcccttcgcggaaaaccaacagcagaccggaggccgcatccactatgtgttgttcaacccttggaccgtgcgcagcaatggggcattgaacagttgcgattcgccactgatgaagctgctggtgcgtgccatttacgccattgtgggcgtcagcgtcgaggaagcgatcgtttccatcgcccatctgatcgacaacccgccgcacgcggcgctgtcggcgttcatcaagaccaaacccgtcgatctcactatgaacaccttcaacaggggcacggcggttcggttggacgatatcaccaaaaagctgctgaatcgctagctgtcatagcacaaggccttaggcagaacacccggaaatcgaatgggtagatggatcgtgtctccccttgacttccggcaagcgcacgccaatcatgggtcgtatggggattgcaatcaaacacatatatgaagaaccgactgcgtcggacgggtatcgggtgctggtggatcgcctgtggccgcgcggcatgacgaaggaacgcgcgacgctggacctgtggatgaaggacgtcgctccctctcccctcctgcgcaaatggttcggccacgatcccacaagattcgccgaattccgcacgcgttacatcgcagagctcgatgccaatgccacagtggacagtctgcgccgcatctgcgcgcaacatcccgacgtgaccctgctctacgccgccaaagacccgcatatcaatcacgccctcgtgctgcgcgattatcttgattgaatattgaatcaagacaatcgtcgtttcagtccatctgcgagattttcgccgattttcgtatccttgaatcgaagcgcacagtcgtcactccttggattgccaagcaaagggatgccccaaaccaaatcaacccgtcatcgattatggcgaaatcggaacacgattcggcggtccggacaatgcacccaatagcacgcagccgattgatattccgctctattcgtgttctggttgccgccgcagcagtcgccggcaaacgaacataaacttcgatgagcgctttcctgtcggccagtcggagcaattcatcgtcaattgcgctgagtccctgttgcgacacatattcagccgagataatcagggaacgtgcgcaaccggcaatatccttgcgaagtatctctgcataattcgtggccgtaacgatgctgccttcgaataatccgtcagaccgtgtgtcgagcaacgcatccgcagcatcttcgccctgcgtcgcagccgtcatgcgagcgcgcaacgcttccgcctttgcactgagcatgtccattttctcagcatggtcaggatttaccgaatatccttgatttgcgtatgccttcagccgttttcgatacgtgacagcagataacggcaccgtcacatcgatgtaatcatagacacgaacctcggtcttgccatcattctcgcgatgaagtcgccccacatattgcgagagagtaccctcaaacgagaccggagcggcaagcagaagtgtgtcaaaacgcttctggtcgaatccttctccgatatagctgcccgtagccattacagtcaggctctcattattcggcacccaggataaatcatgcaatttctgttgacgatctttccttgaaccgccaccatgcagcaacatcacatgggtgcaaccgctcttttccaaagcttgcgacaatacttttgcggttattcgctgtttgcggtggggcgggcataggttagtgtttcgggttcgattccctgtcagaaaaataatcgagtgcgggattacggccggtaaagctcctgctgtggatgcggatgcgcgtcagccttacggtggtgctttcccaaaacgcggattgtacgaggtgtgggacggcacgcggattcggccgttttctccccgccgtcccacagcgctcgcaatgaacggttgtggctaatcatggagctgcagcgggaatcggcgttattccgcggtttcaacagtcgccggtgtgggacgctacggacgttaaacggttgacttgtctgccatcccgcgttcttgagggacggcacggacgacaaacgattgacttgtctgccgtcccacagatattgggatgcgcgcggccgcctgctgcccatagcgggtgtcggtcacccccaccggtcaccccctgcttccgaaatacgcgactcgactttctgtaggcatcatgacggcatgacgacggcggacagtcgaaaagaccccatgatgcctcaacagccatcaaccgcaaatatcaagaggccgaaaatctatgagacaagcagcctcggaaagtgacctcggaaaacctcagaccctacaaatggctttattgcaagggtatatgccggttcaaactccactaatagaactaatagaacaaatagaacagccggcttaggcacggcgcggcaaatggcgcaaaccggccgcgatagtagtagcgtggtgcataccagtacaaccatgcgaggagaacagccatgatcaatgaggaatacaaggccatgcttggcggcaagtccgtgattcgcgaactgagcgagtacgccacgagccgcggtgctgaaatcggctaccagaacatgttcgattacagccttggcaatccctcagtgccggctccgaaatccttcaccgacgccatggtcgacctctacgaaaacggcgatcctgcggccatccacggctactccccctcgctcggcatcccgtccgtcaaggacgcgatcgccgaaaacctcaacgaacgtttcggcatggcatacaccggcaaccatatcttcccgaccacgggcgcggcgggcgcgctgtcccacgcgatgcgcgcggtgaccaagccgggcgacgagatcatcaccttcgcccctacttccccgaataccagccgtacgtcaagggcatcggcgccaagctgaccatcgtgccggccgacaccgagaacttccagatcaacttcgaggcgttcgaggccgcgctcaacccgaacgtgcaggccgcgctcatcaacaccccgaacaacccgtccggcgcggtgtattcggcggacacgctcaagcgtctggccgcgatcctgaccgccaagcaggccgagtacggccacgacatcttcctgatcagcgacgaaccgtaccgcgaaatcgtgttcgacggcgccacccagccctacccggccagcttctacgcgaacaccctgacctgctactcgtggtcgaaatcgctgagcctgccgggcgaacgcatcggctatgtcgcggtgaaccccacagccaccgacgccgacctgctcgtgcccatgatgggccagatctcgcgcggcatcggccacaactgcccgccgagctcgattcagctgggcgtggccaaggtcatcgaccaaaccgccgatctcaacgtctacgagacgaacatgaacctgctctacgatgcgctgaccggtatcggcttcgacgtggtgcgccctggcggcacgttctacatcttccccaaggcgttggaggacgacgccgtggcgttctgcatgaaggccaaggaatacgacctgatcctcgtgccgtccgacagtttcggcgtgcccggatacttccgcatggcctactgcatcgacacggagaaggtcaagcgctcgatccccgtgctcgaaaagttcgcccacgaggtgtacggcctgtaaacacggaccgcaagtaacaaacacaggaaaggggttgccatggaatacaccgaagacgccgatcgtcgcgaactgctactgcacagcgcctatgactccgatacggtccgagccatggagcgacccctgctggacaaaggcgtgccgctgatgcgcatggccgcccaggccgcggcccacatggcggccggtatgctggacgacgaggatctggcgctggaggacacgtcgatcgtgctgctggccggggccggagacaatggtggcgatggtctgttcgcggccgccgcgctggcccaggagggcgcgaacgtcaccgccatcgccgtgggccggtcgttgcatgaggccggactcgcctcgttcgtgcgcgccggaggcaaggtgctggtgcttgatcccgcggctgatattcccggttgcgcgtccgggttttccgccggtgaggccggcgagcgactgcagaccgccatcgtcgtggccaggaaatcacatctgatcatcgacgcgatgaccggcatcggcatccaaggctcgctacgcggcattcccgccgcactcgcctccgcccttggtctcgacggcgaggctcccgatgagcccgccttgccgaaccgtgagtcgtcaggcgattttccgctggtacttgctgtggatacgccatccggcgtcggtgtgaacgatggttctctgcccggcccgtacattccggccacggtcacggtcacgttcggcgcgatgaagccgtgcgcggtgctgccgcccgccacgttcgcctgcggccgtatcgagttgttcgatttcggattcgatatcgacgacaaggatccggacgtcgaggtggtggataattcgttcgcgtccgacgcggtccgtctcccccggttcgaggattccaaatactcccggggcgtggttggtctggtgaccggctcgcagcgctaccccggtgccgccgtgctcaccaccagcgccgccgcccgcgcgaacaccggcatggtccggtatctgggcccggagcgcgcgcagaacatggtgctcaccgcactgccggaagccgtgatcggcaagggacatgtgcagtcctgggtcgtggggtccggcgtgcccgaggctagcgtcgaggacgccgacggcgatatgcagcgggacaccatcgccgcattgctcaagcattacacgctcggcagcgaggatgagaacaaggacgcctacgacatgccgccaatcgtggtggatgccggcgcacttgacctgctgccggagcgtgtgcccggccaggtggtgatcacgccacatgccggcgagatggcgaaactgctcaaccggttcgaaatcgccgccagcaccgcggagcatgccgattcgcacgagccatacaccgccgacgacgtgcggttgaacccgttggccagcgcgaagcgcgcccacgagctcaccggcgccaccgtattgctgaagggcgcggtgaccatcgtggtggatgaggaccacgtctatgcgtcgggcagcgcgccggcctggctgggcaccgccggcgcgggcgacgtgctggccggtctgaccggcgccctgctcgcccagcaggatgacatggccaccacggccgagaccgtggcctcggccgcatacctgcatggcctggcggcggcgatcgcctccgaatccgagcagcagggctggcaggagccggaactgatcggccgcgagcatcgccagcgcttcatgacgctcggccacccgatcgtggccggcgacgtggcccacgccattcccgaagccatcgccgacgtcatctcataaccttgttgacctccctctgacgagggaggtgtctcggcaaaaccaagacggagggagagaaacataagcctcaaactccacataccccaacctatacacaaactccgtacactaaatcgcagacctcacccaacgacccaaacacacaaggaaccatcatggccaactcccccatcaccgacgtgattttcgacttctgcggcgtgctgctggactggaacacccgcgcatgcctggaaggccgattccccgatgagatcgtggaacgcatctgcgccgacgacgacccctgcggcttcttccactacgaggaccgtatggacgccggcgaggatttcgcggacatctacccggatgtggtacgcgaacaaggccaggaactcgccgacatcttcaagttctacatcggccactacgcggacgcgctgcctcgcacgctgccgggcatggtcgaactgctggcggatttgaaggcccacggctacggcgtatgggggctgaccaactggtcgcatgagaccttccacctggccttcgagaagtacccgcgccttgaacagctgttgcagggcaccgtggtctccggcgtggagaagatgcacaagccgaacgccgacatctacgagctggccctgacccgtttcgacctcacggccgagcgctgcgtgttcttcgacgacaccgccaagaacatcgtcggcgccaacgaggtcggcatccacggcatcctcttcgagaacgcgttgcaggcacgcgaatcgctcgccgaactcggcgtacgtctgtaagtcgccagacgttgcatcgcggcatcggacggcgagccgattattgacgacgatccaacccaatgccgcgccgaatacagcaaccggcttattccgccgagtccgcgcccttcagcccggtatacagcgtgtagtaccgcccgtgcgatggcgagcagctggcgctggcctcggctcagcgccgcgcttgcgggcggtcgggtcgttttcggacggcttgacttccggatagctgaagtcaacgtcgttgaagcctatggacccatccttgacgacggtgaccggcgtttggcggccggcatgtcacactgttcggtgagcacttcgacgacgcggcgcgcggaggccgacgacatcgtgatcatcacaatcgtcatagacagcatcaccagactcatcagaatgtttatgcagtacatgagcagactggtcagatcgccggcgttcaggtcgcccgcaacgatgaggctggcgcccagataaatcagcgccatgcgccccgagaccacgaacaccatgcacatggccaccagcagcggggtgatgatcgcatcccgtttgaattcgccgatgtgttgcatcagcactttgacaaccctcacgcttggcctttcccgctcgtgtcgatgtcattaggttaccaatgtggcgcatatcccgttacacagcgtccgcgatatgcgaggcgtctcatattgtgtcgccatagtggattgatgaggttataaacccgtgtggcgaccatccctagcgatataaatagactttatgacactgctgcagctgaaatacatcgtcaagatcgtcgagtgcggctcgatgaacgaggcctcccatgccctgtacgtctcccagccggccctgagctcgtcggtcaaggaattggagaacgagctgggcatcgagatcttcacccgctcctcgcagggcatcgccctgaccgtggacggcgcggaattcctgacctacgcccgccaggtgctcgaccaggccgacctgctcgaagagcgctacaagcacgccaaaccgcgcaagcagctgtgccaggtctccacccagcactacatgttcgccgtcgagacgttcgtggagatgatcagctccatcaagtccgacgaatacgagttcaccatccgcgagacccgcacgcgcgacatcatcaaccaagtcgccaacatgcagtccgaaatcggcatcatctacctgtccgatttcaacaaggacgtgatcggcaaactcctgcgcgagaagcacctcgaattccacccgctcttccgcgcgccgctgcacgtgttcatctcgcgcaacaacccgctggccgccaagaaggtcatcaccatggaggacctgaaaccttacccgttcatccagtacgagcagggcgaggaaggctcgttctacttttatgaggaagcggtctggccggagtactcccccaagcagatcaacgtgaccgaccgcgccacgatcctgaacttcatcatcggcctcaacggctacacggtgtgcaccggcatcgacaacggcgacctcaacaacgagaagatcgtcaccgtgccgctcgacaccgacgaaacgatgttggtcggctggatcacgaacgagcgttccaagctctccaaggccgccgaaacctacctcaccaagctcaagtccgtagtcgccgatcacggctacaagctcattgattaggagtaaataaaacaggcatggtcagcagtgagatatactgcgattaagccaaccccgctggggaaatggaagtaagagccggcccctgagtatctcaggggccggctcttgcgctattgagactgactggcacaaccagtttgatggcctccgactacttggccgagattaccgacgtagcggctgtcgcggcaaatcccttaagcacctcaatcatcacgtcacggtcttcaacatcaatgctgcgggccgcggcgagcataatcggcagtgactgtgtcaaatgcgaagtgaggtcgccgaatgtgtcgtatccgccagcctcgaagatggcaaacaggttttcgatgaacctgcggcgatgctcatcatcgtatttcgccatccatccgttgatcgtgcgcgccaggtatcgcgcgctacttgtcagtccatcagcctgtacgaattggccatgatctacttgccagtgcaatgcgaaatgctgcatgatgctggcaccgtcgctgctgaccaccgtatagccgtcttccacatgctcacgagtctcaaacagcatgccgatgatcgacgatcccggtaccgatttatggattttcggcgcaatgcgcgcgtacccatcctcatcgaagaacgcctcatcgaagcctggaccatcgtgcgaatacacggccgtgatacgtccctgaatttcgccgggcacattggccgccgcgtataccgccagattgccgcctttggaatggccgccgaccataatcggcccggcccaatggccagccagctcggtcagataacgcgcggcggcctcctgcgaggcgaccgcgcggcggaacgccatcatgaagtcctctttccacccgacgattgagctgtcggtaccgcgaaaagccacatagagcgtgccgttacccagttcgaacacgcaggccgagaattgcttggtggtttcggcatcgaattcgtccacgtaggcgcccacgcgtaggttcctccaacgtgggctctcgctcatcgcacgtaacagatcgacattcatcgaaggcgaccacaccttgccgaacatgtcgtcatagcattcggcgcgtagcaggtcgcggatggagaccgcgggaatcatgccgctggcgtccgccgaatcctcgtgatagcgcggcacgttatccggcatgcgcgcgtaggccagctgggacagggcgagactgtccgcctcggtgaacggcagtgcggcgaaagtgtcgaaatgttgccgaatatcgtcggtgatgttccccatagcggccttccttgttcgaatgcaacgaacctacggtaattctacgccgagcgggttttcatcacaggcgagccggtcccagagtttagaaccctatctcgccttcaaggggctgatttggccttctggagacatttatctccgtttcaaggggctgttcatccgtcatatcccgagtatgagcggcatcaccccaacgtcattccgccattttcatgctgcttctacttgggcatcagcccctcgaaacggaagtagatctctggaaaccacgacatcagcccctcgaaacggagatagcatcaatttaggcccagattgcccgttacagcatcgggtaatacttaccgtgatcgattttggcggcgatatcacgtaattcggcagcatctcggcggtcctcttcattacctcgcgacaacttattcgctttaccttccagatgacgctcaatgccctgaaaactgcatatctccacgagcgcaaacagccctataccaactaaccagttcatagcacgctccttgccaaagcttctgccttaatatggtactgctgttcatggatcgtaataaaaaaagcgggctcgcaagcccgcttttggttttaggttgaagacgatcaggcgccgtattcctcaaggtaggcggcggcgcgctgctggatatcgtggctgagcaatggggtgccgtcggagttcttcatcttggcggcggcgtcgaagatctcgcgcacgttggcgatggagagcaccgggaagccgaattcggcttccacggccttcacggcggacaggtcggagtccttggtcttctccatgcggtccacggagagcacgagacccacgacctcgacgttcgcctcggccttgagcttggggatgacttcgcgcacggcggtgccggcggtcatcacgtcgtccacgagcagcaccttcatgccgtcggtcagcggggtgccgaccatccagccgccgtcgccgtggtccttcttctccttgcggtcgaaggtgtatccaacggtcatgttgtggccggcgttcagcgcgatcgcggtggacacggccagcggaatgcccttgtaggcggggccgaacacggtgtcgatgttgcggggaatcgtgttgtgcacgatggcctggctaatcttttcggcgtagaacgcgccgagcgcggcgatcttcttgccgtcgtcgaaggcgccggcgttgatgaagtacgggctcttgcggccggacttcagcgtgaagtcgccgaacttcagcgcgttggattccaacaggaattcagtgaagcgatgtgcgagtgtttctgccatgatgttccttacctccaagtctgtcctgcggccagtttagcagcgagttcgggacggctgtccagcaggtagtcgagttcgcgggcgacgcgcagcggggccaccgggtcgaagagcgcggccgcacccacttcgacggcgttcgcgccggcgtacaggtattcgagcgccttctcgccgctgtcgatgccgccgaggccgatgatcggaatctccggcagtgcggtgcgcacccggtagacggctgccaggccgaccggcagcacggccgggccggatatgccgccggtgacgttggcgatgatcggctggcctgtgcgaatgttgatgcgcatacctttgagcgtgttgatcatgctcaacgcatcggcgccgtgttccacggccgcgcgcgccggcacggtgatgtcggtgacgttcggcgtgagtttgacgatcatcggcttgtcggtcatcgggcgcagccggtccataagattggcgagggccaccgggtcggtgcccacgctcatgccgccggcggaaacgttcgggcagctgacgttgatttccagcatgtccgcgtcggagtcggcgagcttttccacgaccgccgcgtaatcgtcatcgcaatgtccggcgacattggagatgacgaacgcgcccgcggccttgagcttgggcaggtcttcggccaagtaatggtcgatgccggggttctgcaggcccacagcgttgatgttcgcggccggcgattcggcggtgcgcggcgaaggattgccctcccacggcacgggcgaggcgcccttggtgcatacggcgccgagctggctgacgtcgtagaaccagcggacagcggcgtactggaaggtgccggaggcggtgccgaccggattcttccattccagaccggccaccttggtgtggtgcttccacacgtggggctcgtacaggttgatgtggttgtcgctgccctgcgcggactggttgtttgcggtcatcgtcactccccccatccgagctgttcgcgggtgaacacgggtccgtcggagcagaccttgaggcggccgtccatggtgtcgatggtgcacagcacgcaggtgccgtagccgcagcccatgcgctgttccatgctcagttgcgcggggatgccacgttcggcggcccaggcggccacggccttcatcataggcagcggcccgcaggacagaatgatcggcttgcgatcgtaggccttcaggtcgtcgccttgttccagtttgttgagcaggtcgaccacgttgccttcggcgtcgtcgatgctccacgaccagtccgcgtaccgggagacgtattcctcggcgaagtggtcgttgcggtagccgaatacggcggtggcaaaggaggcgtcgtgttcggcgagcttttgcgcggcgtagattagcgggggcacgccgagtccgccgccgacgagaatgtagttagcgtctttcttgaggttgaagccgcggccgagcgggccgagcacgtcgacggtgtcgccgtcttgcagtcctgccaactgttcggtgccgtggcccacgacggcgaagatcacgctgacttcgtcgccgtcgacttcgctgacgccgaacggacgcggcatgagcatgaagtcgtcgtgcgtgaacaggttgacgaactgggcgggcttagcgtgggaggcgatgaacgggtcgtggaacgtcagtcgcatcacgcggtcggtcagttccgtaacctgcgtgatttcgacgttgtggcgcggcgggaagaatccggccgcagtcgcctccgcaaccacatcatgggtgggggtgaaagttgtcatttcattcctattcagcacatcaagctccccttatcagggaagctgtcaaccgcaggttgactgagggggagttaaacacactcggctccggtttccagcccacactcacgtatagcccacagccggacaatctacctacctatatacggcaacccgcagattatcgcgcatgccgagcgccgcctggcgcgcgctgctcgccacaaggtccagcgcctcgtcggcggtcatggattcggagtacttgccgctcttcttccatgcgccgatgatgccgcgcgacgagttgacgatggcgccgctgccctgcttgtcgaacatgcctgccacgtccgcggccgtgccgccctgcgcgccgtagcccggcacgaggaagaacgtgtgcggcatgcgttcgcgcagcgccttgccttcctcggggtgggtggcgccgaccaccgcgcccacgcgggagtagccatggctgccgatggtctcggcaccccatccttccacgagatcggccacgtgctcgtagaccttcgtgccgtcggccaggtcgagcatctgcagttcgctggaggacgggttggaggtgcgcacgagcacgaagatgtccttgtcggcttcggcggcggccttgacgaacggggtgatgccgtcggtgccgaggtacgggttgacggtcaccgcatcctcatgccacgggtcgaagtcgcctacgccgttcaggtggtgggcgtaggcggctgcagtggagccgatgtcgccgcgtttgatgtcgccgagcacgtagaggccttgctgggccgcgtattcgcaggtcatcgtgtagatgtccacgccggcggggccgagcgcctcgtacatggcgatctgcggtttgacggcgggcacgatgtcggcgatggcgtcgatgatcgtgcggttgtattcgaagtaggcgacggccagctgcgcggattcgatttcctccggggattcgaccgagtcacgcacctcgtcggcaaagctcgccacgacctgcggcggtaccaacgcctcggtggggtcgaggcccacgacgctggggttctgagtgttgtcaatcgcttcgatcaggcgatccatgctgctccttatgttatctacagacggctgaacatcagctgggagccgatgatcgtggcgagggggcgtccggtgacctgccagccgccaaacggggtgttacgagccctggagtggaactgttcagggtccacggtccattcctcagcggtgttgagcaccacgaggtcgacattgtcggcgtcatccacgcggctcaggtcgagcagtcggttgacgccttcacgctgcggctgagcgtcgctctcccccgcaatcacgccatccggatcatccccagtgggcgcgggttcggcgtagtcctcgaccagcgcggccacgtcggttggcacatgccccatgagttcggcgggtcccacggacatgagctcgatcagacgctcatcggaaatgaagccgccgtcgacgagcaccttgtggcacacgccgtacgcgcattccagtccgatgatgccgttgggtgcctcaaggaagccgagttccttctctgccaacgtgtgcggcgcatggtcggtggccagcagatccacggtgccgtcggcgatggccgcgatggtggctttgcggtccgcttcggagcgcagcggcggattcatcttggcgagcgtgccgtacttgagcagcgcctcgtcgctcaacgccagatagtgcggcgcggtctcgcaggtgattggcaatccttcggccttggccttgcgaatcgcctcgaacgagatggcagtgctcacatgttggaagtgtacgtggacaccagtgcggcgggccgcttctatatcgcgggccacgatcttgagctcggtgtcttccggaatgccaggcacgccaagttcgcgcgagaccgggccttcgttcacggcacctgtatcgtgatgctcgcaatgctcgattaggtacaggtcggaggccttgacgttctccagcacctggtccaggatctccggcgtcacagcggaaccgtcgtcgctaattgcggtgatggggtgcgtgagcatggccggcgtcttggcgtcgtcctcgaatccgggcacgtacctgagccagtcggcaacgtcgcttgcctcatgaccggcgcgatccttggacgcgcacacgcacagatcgtaacgaaccggcaattgaacatcgtgcgcagtatcgtactgctgcaggaagtcgatgacgttgtcgaagccggcatccagaacctctttcgcaccggccgcttccaggtcagacacggtctgcccatccagtgccggcaacgtgttcggcatgatgagcacgttcgtgtatccgccggatgcggacgcgcggcagccggagaccatagattccttgtaggtctggccgggatcgcggaagtggacgtgcgggtcttcgaaaccgggggccacggtcagtccggtggcgtcgatatcggcaccgtcagccacggcggaggtgtcggcgaagtaggcggcagcggtcccgggcaccacgaggtcgatgacttcgccggtgttccagaccttgatgttgcgtagggtgatgctcacagtttggcttcctcgtcgcagtagtcgcagcggtattcgagccgttcggagtgcacgaggtggaacatctgcttgatgccgggctcggtggtggtcacgcagcgcgggttcacgcaggagatcacgccgacgatgtgctcgggcaggttcggctgcttcttttcgacgatcttgccgccgcgcaccacgtctacggtggcctggcgggccacgaagccgagcacgtcgaggtcgatgtccttgtcatcctcgattttgatgatgtccttggagccgtaacgcttggagttggcgttcatgatgagcgcaagcttggttttggccgggtcgattttcaggtattcaagaaccttcagcgaggttccagccgtcacatggtcgataatgatgccgttctgaatgctggtgacttccatcaggcatgaacctccttggagttgagcggttcgtatccgggcagttcgtcgcccaccacggtgctttcgagggccatgcgcacgagcatgccgttcttgacctgttcgaagtaggcggcacgcgggtcgtcgtccacgtccacggcgatttcgttgacgcgcggcagcgggtgaagcacggccatggacggcttggcgagctgcagcttctcttcgtcgagaatgtaggtgtcgcgcaggcgcaagtagtcgtcttcgttgaagaagcgttccttctgtacgcgggtcatgtacagcacgtcgaggtcgccgatcacggaggccaggtcgcgcacttccacgtaggagcagttgtctgtggcgttgatgcggtcgatcacgtactgcggggtcttgagctcgtccgggctgatgagcacgaagcgcacgttgccgaagcggcacagggtctcgatcagggagtgcacagtgcggccgaaggtcaaatcgccgcacagtcccacggtcaggtcggtgatgcggccgaagcgcgactgcaacgtggccaggtcggccagcgtctgcgtggggtgcatgtggccgccgtcgccggcgttgatcaccggcacggatgcggcgcgggaggccaccagcgcggcaccctccttcgggtgacggatggcgaccacgtccacgtagttggacacggtcttcaacgtgtcggcgatggattcgcccttggtcacggaggccagctgcgcgccggcgaatccgatgaccttgccgccgagacgcagcattgcggtctcaaagctcaggcgcgtacgggtggagggctcgtagaacagcgtggccagcactcgcccatcgcaggtatgggcaacctctttgcggtgggaatcgatgtattcggccttatgcagcaggtcgagaatctggtttgtagacaggccgtccagcgttacgacgcttttgccgaccattggcgtttcttcagacaaggctcaccttttcgctcgtggttttcaggtggccacccttgtgtgacctaatataacttacgccatttttcggacagccgcattcaccgagtgttcacctgaaaatccaacgaatatgctgtgtctgtatagctgatatctgctttggaacgccagagctcattcattaggtcgatttgacgttcattaggtcactgcaccctcgtatctgttgttggaatgccgccattccaacaaggtatgcggcggcggaccgacctaatgaacgatgaatcgacctaatgaacgtagtgaacgcaatacaagaaaggtctatcgctgcgcgcggcgtcgatttcgttccagtcgcggcgcgatcacgtgcatacgcgggcgaggggcggtttgcggctgcggcgttgcggcggaggccgtggcggtggctgctgcagtcgcctcaccttcggtctgcccgtagaacaagcgctggcacacgtcacggcatttgcgcatcaccgccagcaggtcgttctcgaaatgctggccgcggtgggcgccgtagccgaggtagacggcgatgccgcccagcgaatagatgtcatcaggcagaatatcggcctggttggcgcgcccgctccacagatagttgccgttgcgggccgcggtgcacaacgtccaggtcttgcgcagctgaatcgcgtcgatagcgctgatgagcttcttggcttccagcacgtccaatgcctccaacgtgccgttgacgcgcagatctttgatatcgccggcgtgctggagctgcatgagttgcacggtccattccacgtcagacaagccgcccttgccgagcttcagatgccgttcacggcgcacgccgcgcggcagacgctcggcttccatgcgggccttgagcttgcggatgttctgcaattctgcttcagtcagttccgcggtcgggtagcgcagcgggtcggcgatgttgatcaggaagtcccgcgccagttcagcgtcgccggccgcgtaccgggcgcgcagcagcgcctggcgctcccaggtcgaagcccaggattcgtagtattcctcgcaggaggcataggagcgcacgagcgggccgttcttgccttccgggcgcaggtccaggtcgagttcgatcttgggttccagcgtcgtcgggccttgcaggatgttgcgcaggtcttccacgaccttcttggcgaaggcgttggcctggccgtcgtcggcgtcgtcggccggacggtagatgagaatggcatccgcatcggagctgaagttcacttcgcgcccgccgtaacggcccatggcgatgacggtgatgccggccggcgcggtttcgacgccgaacgcggcgatctggtggcgcacggcccaggtcagtgaggcgtcgatgatcgcgtcatacacgtcggtcatggccttgagactgtcggagtcgctgatcacaccgctcatccaagacaggccgatgcgttcgatttcgtggcggcgcatggcgcgcatggaggtggcgaactcgttgatgttcgagccgaaacgttccagcgccgagccggtctgcacatccaatgcctcgcgcgtgcgggcctgcagattgccgtcatcaccgagccaactgatcgattcgaccgacttgttgagcgcgtcgcccaggaatcgcgagttggacaggatgtggcacagacgctgggcagcggaggtggagtcgcgcaggaagccgaggtagccggattcggtgccgaagttctcctccagcttgcgccagttgagcaggcccatgtccgggttctggccctcgcccagccactgcaagacggcgggcaggatgatgcggttgattttggccgcgcgccccacgccggcagtgagcgcctgcacgtggcggatggcggcgtccgggtcgccgaagccgatggattcgaatcgttcctgtgcggcctcgacgctcagcacgatctggtcgttctccatctgggcgttgaccggcagcatcgggcgatagtagatgtcgaggtgcaggtggcgtacttcgcgacgggtgtcgtcgtatttgtcgacgagttcttccgggtgcaggccgaacgcgcgggcgaggcgacgcagctcctggttctggttgagctcgtccacgtcgatgtcgcgcttcttctcgaggcctccgaccgaggctcggccgaggtccgggaacaggtgcgtgcgcttcagggaccagatctgctggcgatgctccatcacgcgctcgaagcggtagtcctgggacatgcgcacggcctgtttgcgcgagacatagccgccttcggacaggcgctgcagcgagtcgagcgtgttgctggtgcgcagcgattcgtcggtgcggccgtgtacgagctggagcatctgcacggtgaattccacatcgcgcaggccgccgcggccgagcttgatttcgcggtccttcaggggcgcgggaatcagatcctccacgcgcttgcgcattttctggcagtcgtagacgaagttcttacgcttggacgcgctccacacgaacggccggctcatgtccatgtaggcctggccgaggtcggggtcgccggccaccgggcgggccttgagcagcgcttggaactcccagttctcggcccactgctcgtaatagttcttgtgagaggagagcacgcgcaccagcgcgccgtccttgccttccgggcgcaggccgccgtcgatctgccacagcggctgctctgccacgcccatgatgacggactggcagacgcgctgcagcatggtgcccatcttggtgcccacgcggatcagcgtctgatggtccacgtccttgtcggccggttcgaccacgtagatgaggtccacgtcggagacgtagttcagttcctgtgcgccgagtttgcccatgccgatgatggtgaagcgcacgtgctcgttgccctcggtttcgtggcgggcgatggccagcgcgccttcgagcgccgcgtccgcaaggtcggacaattcgctgctgatggtcggttggatgcgaatcggatcctccgccatgacgtcctgcgcgatgatggcggccagctgccggcgataaccggcacgcagcgccgtggccgcttccgccagatccttggaggcgacgggcatggcctgatcgtcgggatcggcgccgaccgccatgagcagacgggctcgacgctgtgcgcggttgaacaggtgactgtcggcgctgccgacggacgcggcttcgacgagttccggcctgaaacgcatgaacttgcccatcgcgtcggaggcgccgagcacggtgatcagacgtcgaagggcaccggcgtcgggaatgacccgatccagatcccgccgactggactgcatcgcgttgacgatatccacgaaattgcccagcgccacgtcggggtcgcacgcatgggccaacacgcccagcaattcggcgcatcgtccatcggcgatggcgtcggccttgagctggccgaacagggcgcgagccctgtcgaggtcttgcagacctgccctgatgaggtccatggagctgggtttgaacatcgacgattccataagattccactatatacgctcatgcccttccgaatggggcatgagccgggaaggagtcatcgggcgacgctgatgagctccgaggaatccatatcgtaatcggccatggcgtaggaacggatggcgggatcatcataggtgttcatgtaataggtgttggtcttggacgagtatccgctggtgaacagcgtgcgttcgaactggccgttgcccatcttcgccatgccgtccaccatctgcacggagccgagggtgtggaacaggcgcgacacattggcggcttcatcgttctgctgcgggtaatgcgcgttggtgtaggccacacgaacgaagcgggacggggagctcacgtcgcccgggatgccatgcatgcccacacccgcaccccaggcggtcaaggaggccttgccccatgaagtcggttcggccatctcgttgctgacgcacatgtagttgcgcagattctccatatggaagtcgaacgtcggctgattggtcagcacatcgacgtcatcatgatgcacatgcatgccatcggccatctgctcgacgacgatgctgcgtttgccgtcgccgatgaaccagtgcagcagcgactcctgctgtcccggcacgatctgggagacgagcgtcacgttcctgagcgcctcctcgacctcgtcgacggagtcgaaattacgcgccacccacagcgggaattcgaacgtggcgacgttctccgtgccttcgaccggttcgtggacgaacgaggcgtaaccagggaaattcaagccggcgatggccagaccatgttcgttggcgcagtcgaaatacatcggcctatcggccatgaccacgcccacgccgatcaccgcgttcggcttcgccttgccgctcgcaccgaacaccgtgtcatagtggtagccgcacggagtgaccaggatggtctccccatatgagaaactccagtcgagattacggccgaaataggtgttgccctcatcatcggagaaacggacaccagtgcacataacggacttccttccatcgctttggttggcttgcacgttcatgatacccatcggccgctgggtgaactctgggtttcgccagcaggttaacgtgcggcgcgacgcattgagacgcgccgcgccgcgatatgcgtcaaccttgcgtaccgaggaacaacggttccacgttgcgccagatacggcgcgtggtggcggggtggttcatcgaatacaggtggacgccgtccacgccgtgggccacgaggtcggcgatctgctcggaagcgtagaggatgccggcggtacgcagcgattgaatgtcatcctcccacctgttcagcagtgcatcgagtttgtcgggaatgcgcgaggcgttgcgttcggccatgcgccgcaccgacttggcgccgcgcaccggcatgatgcccgcttcgatcggcacggtgatgccggcggcgcgagccttgtccaggaagcggtagaaatcctcgttgtcatagaacaattgcgagatcagacgggtgacgccggcatcgaccttgatcttcaggttctcgatgtcctgatccaacgatccggactggtaatggccttctggatagcatgcgccgaacaccgtgagatccggtttcatggatctgatgtaggacacgagatcgctggcatggttgaaatcgccgaccaaacgttcgccatcgatgtagtcgcctcgcaaggcgagcaccgcgctcacaccggcctgctcgaacatgtcgagggcctcgtcgattttcgccttgtcggagtacaacgcggtcagatgcgcgactgcgggaatgccgtactccttgctgatcgtgtgggcgatgcgcgcggtggcggtgcggtccgaatgggtgccgtggccgtaggtcacggaaatgaagtcggggttcagcccctccagaccgtcaagggtgtcatagatggtgtccacgggagcgttgcgtttcgggggaaagacctcaaggctgaacatcggggaatgcatgctgatttccttacataaacccgagctccctcatccggaagggagctcggtgatttccgctacttgtcgagcctggcgcgcacggccttggcggcggcgaccagatgttcaaggctcggccaggtctcgtcgttgcctcgggtcttcagaccgcagtcggggttgatccacaccttctttacgtcgatcttgtccaggatctcgtagatgcgatcctcgatctccttctcggaggggatgcgcggggaatggatgtcgtacacgcccggaccggcttcggtctcgaaccgcgcgtcgtggatggcgtcaagcaccacgagatcgccgcgggacgcctcgaaggagatcacgtcggcatccatcgcatcgatgtcgcggatgatgtcgttgaactcggaatagcacatgtgcgtgtggatctgggtggtcggcttgacggcggaatgcaccagacggaaggccgggatggcccagtcgagatacttggcgtgccagtcggacttgcgcagcggcagcttctcgcgcagggcggcctcatcgatctggatgatcttgatgccggcggcctcaagatcgaggacttcgtcgcggatggcgagagcgagctgcttggtctgttcctcatgggtgatgtcctcacgcggccaggaccagttgaggatggtcaccggtccggtgagcatgcccttcatcacatggtcggtcttggactgggcgtacgcggaccattccacggtgatcgggttggcgcgggagacatcgccccacacgatcgggggcttgacgcaacgagtgccataggactggacccaggcgttcttggtgaacaggaagccgttgagattctggccgaagtactcgaccatgtcgttacgctcgaattcgccatggaccagcacatcgaggccgatctcctcctgtttgcggatgacggcgtcgatctgcgatgcgatgaactcgtcataggcctccttggtgacttcgcccttgcgcagcttggcgcgctcggcgcgaatctccttggtctgggggaaggagccgatggtggtggtcggcagcagcggcagcccgagggcctcgcgctgcagggactggcgctcttcgcgggccggctgacgcacgtagtcggcatcggacagcttgccgatgcgttcggcgacggccggatcggcggccactcgggtgccgtcgaacaacgcctgattggcggcgagggccgcggacgacttcttctcatcctcggtggcgtcggtcagggccgcgatctccttgagctcgccgagcttttggaccgcgaatgcgaagtgcttgaggtcttcggccgggatgccggtctccccttcggtgctgaacggcacatgcagcaaggaggacgcggtggagacggccacatcggcggtgacctgcttcagagcatcgaccaagccgagggaggtggcgtagttgttgcgccagatgttgcggccgttaatcacgccggcgaagatggtggtgccggcggccacgccgtacttggcgacggcttcgaggttctcctcgcgaccttcgttgagatccagcccgatgccgtcgaaaccgaacaggttgacggtctcatacacgtcggcgatgtggccgaagtaggtgttgagcagcaccttcacattgcccttggcgggcaggatcttggtgtagagggccttgaagagctcgacatcgcccggctccttgtcgagcacgaggtacggctcgtcaagctgaacccacgcggcgccaagatcgttgaacctggcgagcacctcggcgtagacggcggccaccgcgttgaccagtcctttgtcgatctccagttcggcggcttccggagtacgcgcgagcttgaggaaggtgtacggtccgatgaacacgggcttggtttcgacgcccaaggacttggcctcgttgaattcatcgaacggtttggtggaattgagcttgatttcggcggacggttcaacctcgggcaccagatagtggtagttggtggtgaaccacttcttcatcggcagtgcggttacatcacccttgtcgccctggtagccgcgcgccatggcgaagagcgtatcctcctgatcgtcgaaggcgagacgctggtaacgctgcggaatcacgttgagcaggatggcggtgtccagcatctgatcgtagtagctgaagtcgttgctggcgatgagatcgatgccagcggcctgctgcagcctccaatgcttggcgcgcagttcggcggcggtggccttgacggcggcaaggtcgttggcacccttccagtaaccttcgatgatcttcttcagttcacggttctgcccgatgcgggggaagccggagacggaagtcagagtggacatgaatcctccaaattgtgtgcgttcgtaacccgattcagggtagcaaacattcggattccggcccctataaatagccgcagagtgtcgctatcaacggaatttataccctgacgatcccctcccggcagccccaggtcgcacgcggtcacggagggtcgattcagtcaaaatccttcacattgatgacggcaagcaattcgccgctatgaacctgccattcatcgaacggtttgtccaaccccatgatcacgacggatgcgggcgagagtcccagattgagcagatcaagccgttcggcatcggagtcgggcgaggcgagccattgggcgctgatcgataccgtcggctcatgacccacgatcatgaacacgcggttcttggccttgacgtgggcgagctcgtcgaacaccgcctgcactccccgtcatacaggctgatgcggtagtcgacgatcggcttgtcgccaaaggtcttgagcatgcggtccagtgtctggcgcgtgcgggtaacggacgagcaggagatttgatcgggcaccaatcccagcgactcgatacccttgcccacggccttcgcctgtttcagacctttgtcggtgagctcgcgttccgagtcgcccttgtcgccgaacagctcggccttggcgtgcctcatgatgatgaggatatggtcgtatttcttcgctgctttggcgactttgctcagcttgatgcccatccgtggctcccttcacgaaccgcctgcccggtgtggcggtgtggcgttgcttccagtatagaggtgtgtgagcgctcacaaactcatcgtttggcggttattcgtgcgtgttgccaagttctcccacctgacggtcgaggtcacgcaacaccttacgtagtttgtggtcggagatgtcgcgcagttccagttcctcgatctgcgcctcacgctgttcgtcggtgagcgagtcgatgtcggtctgtgtgtccttggtcacgcgatcgcgctttctgagcgcctcgaacccggaggccatggcgcgcgagataacaaggaaaccggtatggccgatcatctggtggtcggggcgtacggcgaggccttgggccttccatgtgcgttcgaacgattcctggatctgcggctcggtccagcagccggccgcgcgcagggcttcggccagtcggctcatctgcgtggtggtagttacgtaactgaccaacacgccgccgggggcaatcacgcggtatgcctggtcgagcctgttccacgggtcgagcatgtcgagcatgatgcggtcgaaccagtgttcgggcagttcggcggccacggagtcgaagtcgccggttttgagatcccaccagctgggggcctcgccgtaatacagcgtggcgttggcctgagccactttggcgaattcggggcgcagctcgatcgtggtcagatggccacgatcgcccacggcgtccagcaggttcacgctcatcgcgcccgagccggcaccggactcaagcacgcgcatgccggaacggatgtcgccgagctggacaacctgggcgatgtccttcggatacatgatctgcgcgccgcgcggcatcgacagcacgtaatcggccagtcgcgggcgcatcaccgcatattcccagccgccgatggcgcgcgacgacttccacggcttgttcttgtctttctctggataaacctggttgacctgcgcctcacgcttggcgtgcacggtgaggatgacggtgccttcggtcttgccgatcacatcgtcatgcagaatcaggccatgctcggtctgcgtggagccgccagccacaagctgatcggtgatcttcttgcccttgcggtcggtgaactgcaccttctcacctgcggtgagaggcccgcgcctcggctccataacttgctccttgcgtgctcggtgggtcaatcgctacaagtctaatgcatgtaagctcgttggtgaggtgatgacgatgcgaatgcagatgacaagccagatcgatgccgacggcaatgaccccattttcctgatgttccacggttacggcaacgacgaaagcgagatggtgcggattctcgacgccgtatatgcgccgatgcggccccgtccgcaattgccgccgtacccagctatatctcgttccgtgccacctacgcaaggccctatatgggcggcaattactggtatcccgacggctgcggcgtggacgagcgccaacgcgaatgcgcggcggtcggggatgcggtggcttcactgctggatgcctcggcattcgcccatcgcaggaagatattgatcggtttctcccaaggcggttatctgtcatatcgtctggtcaaggtgcatccgacgttgttcaatgccgcgatcctgctcagtccttcgttcatgggcgaggaacaggcggcgcttgactccactacccgattcttcctggcgtatggcgcgcaggaccgcacgattccgctgcccgaccagcaaacggcccatcaggtccttgaacgggccgggcatctgacctatcgcgagtattccggcatggcccatgccatctgtgatgaggaaatcgccgatatccggcatttcctacgtgccatatgatgccggaatagcttcaatatggaatatctccgttcaaagaggtaccggtccaagtagaagcggctcaacaatggcggaatggcgctggccatgcccattcatcgcgcgatggttctgcgatcagctcaattcccctgccggctgatgccgcccttatgaccggtggccttgaatggcgtggcgcgtgccgtcaccttcggccccggcagattcgtactggtattggattgaccgcggagcccgacagccggctgggactcggagcgtcgaccagtacccgtgatgttggtatgccgtttgccgtcgtgcgcccgtttcccaccagcaccttcagcctcgtcaatatcaatgcccttggcgtgcaaagcacgcgcccaccgctcatccatcgtgcgcctcacacatcccattcgggtttccacgtgtactgtatgtcgtaggcgcttgaccagaacaggtattcgttctgcacaccggtcacgaagatgtccacgagctcggcccggcgctcttcgttcaaaccctccacgagctgttcgatgtgttcaatcagccacgccgagctactccagaactcctcggtcttgtacatgtccacccagctcttgtacgggttggcatcgagcgtgtccgcgaattcggcggcgagacgctgaccgtagtcggcgtacacccaggcgcagggcagcacggcgaccaggatatcaaccagcggattgccgtatgcgatcgacaggatgttcgacgtgtaggcgcgggcgaacgcagactggcgcaccgagttcatctcctgctcgctgatgccgtagctcgccatgtatttacgatgcatggcggattccacattgaagatgccgttctgcacatccgccatgaaccgcatgacctcgggatcctgggtcttggtcaacgccagcgcgtgcaccttggcgtaatcgttcaggtagcggtaatcctgcagcaggtagaacgcgaagcgctcgcgcgaaagcgtgccgtgacccagctcgcgcaggaacggctgccggtagccctcctcccagaccaggtcggaggcctggcgcaggcgctgggcgaacggcggcaggtggttcagggtgatcgggccgaatgcgacggcgtcaaaagacatcgtttgcccccttcgatggtgttggccaacaggctccaagggtcaggcacagcgcctttctcaacccgttcgccaccacgatggccggcagcttgcattcacgggttcccctgcaatgcgcctcattatggcaacacgaaccgacaggtgccggctgcgcctaggatgggaaatcattgctgcacgccgaaaaggggaggcgactgtcatgaggtatttcacgaccgacacgcatttcgggcatccactggtcacggtgttgcgagggttcacgacgttcgatccgacgcactcgcgctatgaggaggtgctgcgcgcgcatgatcgcaagaccgccgaagattgggccaaggaggagacgttcggcgcgggtctgacgtttcgtcaggtcgccgatacggatgcgcatgacaaggcgattgtggatcatatcaacactttggtcggcccggatgatgagctgtggattctgggtgatatcggtttccgcacatcgctgacccatctgaagaactgcctgcgagcgctcaattgcaagcatctgcatggtgtgatcggcaaccatgatgactggtggctggaagaccgccccgcactcaacctgttcgaaagtttggagccgcacgatacggttaagattgagggactcggtacggtcaatctttcacattacccgtatcgggaggatctggcatacagttggcccgatgatgtggcgaagttcagcggcaaggcgttgccgtttgacggtcgcagactgctgtatggacatacgcatcagctttcgccagatggtgcacgcccggaggcactgaatgttggcattgacacagcattgaccgccgttgagatgtatgcacgctgaacacgcgcctcaacggcattggtctcgtcatctctcgctcacaccaacggattgccggcaagacgggtcaattcggcgttcagctcggggaaatgctcgttgccgacgaacggaccgtattccgtgccggattggaatgggcaccatgcctgaatggtcatatgcttcagtcgtgaataaggcaggatgccaccggtgcgatcggctgcgggatcgctcgccatattgaattggatttcagcgtcgagcatctgtgtatgcattccgccgtgtcgaaatagtcgatgccggaatcatgggccacggccacggtacgtgccgcatcggcggcatccaacgcgtccatgcgcatcacgcccagcgccactcgtgacgcaatcatgccggattgtccgatttcctgagtcttcatagtgtctcatttctgttatcgtgaatcggcgaacgggcactgtccgcttcgttgccgggcagcaatctccattgccgctgcttatgtcaccttattgcttgaagtgcacttgaaggcaactcgcaggcaggcagcgcgcgctgccgggcgcgtcttcgcgtcttcatgtcttcgctgtgaccgagacatcgttgtgccgtaatcatgcccatttcttgtatgatgacctctatagcaacagagctagggggattccatgaatactaccgattcagccaaagtcagtgatgccaacgccggcgcaaacaatgtcatccatatcccgcacaatcccacgcttgccggattggccacactgacccgcaacgtggcgtacgagaccggggccgataacctggtgatggatatcatctcgccacaatccaccggcgatgacgatgaccgccgctaccccaccgtggtattcgtgcaaggcagcgcctggaccacgccgcatcgcgactacgagatcccgcaactctcggctttggcccgcgaaggctttgtggtggctacggtgaatcatcgcgatgcctcgagcgatccccacgacgtgttccccgcatatctcgaggacgtaaaagcagccatccgctatctcagggcaaacgcacgtcaatggcacgtggaccccgaccgtctcggtatctggggcacgtcgtccggcggcaacacgtcgctgctggtggggttgaccgccgacgatccgcggtatgaggacggcaccaatgccgctgagagcgatgcggtgaagtacgtggtcagctgcttcccgcccaccgacatgcttgaagctgtcgacgcattcgacgatgagaccaatccattccggctgtattatttcggcccgttcgcggccgtggtgggtgcgacccatgagaccggcatcaatgccgaggtccgtcagcgcgcggctgacatgagcccctacctgcaggtgcgggatgaccaacagtatccgccgatgctcctgttgcacggtaccgccgacaccgtggtcccctaccatcaatccgtcaagatgcgcgaccggctggtcgagcacggcgtggacgcgcagctggtgctagtcgacggcgccgaacatgagtacgatttctggagccaacaggtcttcgacgtgattttcgatttcattcgtgagcggagctgaacggtaaggacacacgggcgcgtcctttttataggttgccgagttctcttttagccaattttgttggatcccctatctgcgcgaacataccatgacagttctagactgtgttctaggactgtcaatcggcaatgtgtatgaagcgtgatgtgatgggtcagacggcgattgatggagttgagggacttaatagggccggtgaactcggtgaactcggcagatttagccgttcgcggcagctgatgtggggggtcatgcgctgtatctgatttggtggtgtattttcttccgcccgaatgcgcaggtcaaaggcggcgcgctgcgcgtattcggtattgcgtgcattcttgtggccgggcggtggcgggcatcgtcggagtagtgttagaatgttttggcatcagtaagttactttagcacgcggccgatttcctctttgagagcataccgtctcgggtactttgccatgatctccttggcgagagccttggcttggtcgagtccgaaaacgttgcgatattgctcgatccacatggcaacgaatcggtattcgttgcgatttccctgttgcagatcgcgatccagcggcagctgctttctgatcagtcgttctgcttccgcgctgtgattgaggctgatgggcttgagcaaatcacgcaggagttccggccgctgcccggctaaggccaaggcctcatcggataggcgctcttcagtcatgagtcgtgcaaggactttcccaccgaaatcatgctcatgatagttgcgcagaatgttctgaacgctttgaggccagcccgatttgccgaccatcgatttgaggatgggaatgcaacgttcgtccgccactgaatcactgtgagcgacgtagtactcatataattgtttgatgccgttctcatcgttcagtcgttcatagcaggcctccagcatggtaagctcgccatgcggcagttgagcggtgagctcccaataccccgcatgcttttgcgcggcatcccaatcgtaagtctgttccaagaaaacggcggccccggcataatccccgtccaggaatttacgtgcgatgacggcaaatctgcattcggccacgtccgtgtttttggacagtagctcatcggcactaattgcgtcgccgccgtacagcagaaagtcatgatggagtttcatcagatagtcctgtgcagctcgccaatcgtaatcggtcaggttcgttcgatggccgtcaatggaatccccttcttgtcatgaaggaattgctgggcaacattcaatgtggactgcgcataggtgcggcacatgaacgaggtcgtgccgatctcgcggggctgatgctccatctgttctatgtccgccgtacctcgtgcgtgaatatccgcgaatgggatgacgcattccagcggcgtgtgcggccaaaacagcatctcgatcataggggtatcacgcatgaatctcaacgctgcaatcagcatctgctgcgcttgctcgcctgtaacgattggtgccgcggcatacgtataagcgaggatccgctcattgaggtgttcgatatatgtctgtagcgcaccctcttcatcatcgacttgtctcgcgaaccacactgtttttcgcaaagccgcgcacatgcgtctcatggccagcggatagtcgttcgattgttctgcttcctcgaatacggccatcacgccgtttatggcggcatctccccattcgaatttccagccgtagtccttgccgagatgtcgccgcatgggagattccatgacgcgattcacggtgctttcgggcatcaatggttccatgccgctcgcgattgccggattcgcagtcacgatggcattgatttcgtcctgattccaaaccagatagaaatgctgagcgggcgtccaccgttctgatttgcgcagtcccactcgttctcgaatatgttgcagcactcgattgaacacttcaggtttcgatgcgagaggatttgctgctacgggtatgtctggccgagagtcgtcctgctttgcaatcatcgcatcgtatgtcacgttctgctgatgattaccgccgtgtttgtaatcacgcaacgtcaagagcgccgcaccaatatgcttgcagtatccgtcatagtcgtaggggcaggtgcaggatgcgaacacgatatcgttgccacgaagtcgaatatcgacatcgtagagttcagaaccgtgcacttcggcgtggaatagtccggccgacaattcctctaacccaccgattctatgctcgtccacgtaatcatatgctcgctccaggctgcgggaggtcatctcctcttcgaactcgtcgaaatgggcagtcatgacgggcctcctaatgattggtcatacattacggtgtgggacgtagtagcctaatgcagttcggctatcatctgttcagcatcacccatgcaacatcatgtcacggtgcttgtgccaacggaacagacgctcacgatggcggttcagcgtgaaacgatcccacatctggtcctcggcccactcaaccgtgccatcatgttcttcatcttcgggattgcccaaggtatcaaggaaccgctcgaacccatacgccccgccgacatcctccggaggcgcatcccccgccccatcccaaagctgaggatccgcaacgtgcacgctgcggtaggtacgcagcagcttgatgtcatggatccaatcgtcaccataatcgtagtaatagcgagcggtacgcgccttgggaaacacgtcgcccagctcggtttccgaagcaatgcgaacttccggcaacggctctaccggcatatattgttcgtatctcgcctcatggtatgagggctcttctccccacaattcttccacttgcacctgcttcccatccgggaatgtggcgcagaagcagaacagatgctcgccgtaccacataaagcattcctgcaataccgcatgcaaatcaaagaacgtcaatgatgccggcaccagaatctcccgccagcattcgcgcccgtcaaggcgcaaagtgactcggaaacgaaatgccgtgttgccattgcctgccatgaagactcccttatcaacgatgaagttattatcaccgtaacagagtccagggcaaaccactgcattacgaatctgattcgcgccctcagaaaaggccgaatcatctgttcaatctccgtgtcctgtggaaaagactctaacaataaccggtactgttcatcatcagcaagtccaatatgccatgtgaccaggtgcgggacactcatgtgatcagtcgctatggcggggagacgtgactttggttcgtaccgtcgagcagacgcgaatgggatagccgtgctgctcgtgtccgatatcggctggggcgtgctgccgctgtactggcgcacgctatccagtatgaatgccatcagcgtgctcgcgtatcgtttggtcgccacgttggcggccatggtcgcgctgttggtggcgttctccggcctgcccaccgcgattccgctggccacgttctcctacggcgtgcagcacagccattacctgaccgtgagtttcatccaatatctcaacccgctgatccagttctgtgtggctgtgctcctgctgcacgaaccgatgcgcgcgcagggctatgcggcgttcatggtgatttgggtcgcgatcgcggtgtattcgttcggcgcgatttgggcgtattgggagcggctgaagccccacgcacgttaagcgcttccttaactcccctccccgaatgcgattacccagtggaaacaagactacatcagaccagtatgcaccgccaagcggcgagtaacactccacccgctacaatcagcagtatggttgttccgcaaaagccaacgctggctcaattcgaggtcatgttcgaaggcacaccgttgattcttgaacgtgccaccgattactgggaatcgggccgcgtgagttcggtgcaggagattgcgccgcagctgtatcacgcgcaggtgtccggcagtgccgatgactgttatgacgttgacatccgcctcagcaaagacgctcgcggcgagaacgccaatgaagcaaacactgatgaccaagccactaccagcagtaacagcgaccacgaatccacaaccgacgacaattcgattcgcatacaatccgccgcgtgcacctgcccgtatcagagaacaccatattgcaagcatataggtgccgtgctttacgaactgcgcaaacagctcattggcgcgcacggcaatcaccacaatgatgacaccgccaacgctcacgatggtgtcatcgcactcccccgcaccgtgctgtatcccatccagcaacacctcgacacgcgcgcagagcagggcaaaggccatctgctgttcctgtggtccacccaactgcgcgaagccgcaaagacgttctgcgcccagccagacgaagaacgaccgctaatcccgctgatcgacgcacaaaccatgctctccgacacaatccgccgatgccatgaacgtttcattattcatatcagtaaacacagcgatgcgtacagcaaatcatgtgactacacagaattcatcaaaaccgtgcaggctatcgcgggcaatgccctgcaatccagtgattacgcgagcgcatgcggcaacctgcgactgtgcatacacgaagtccacgcgcttctgctctcgtccgagaacgatgatggctccgaacctttgctcacgcttatggatgatctggcgatgcgcgtgcgatgctatatggagaatgtggcggaattcgccgactcctctaccgccggcaaggcattgaacaccattgcgcaggccgcgaacgacaaagacatgcggcaatgcgaaccattgaacagtatgttgctgatttccagcgcgctcgctttcgcccaatatgacgacaaacgcatatgggccattgacgtgatcgagaacgcgataacgcgtaatctggaatactcgttcaacgaagagagcgaagaaagcgacgaggacgacgaggatgaggataacgaggatacgagcgaagtagacgacgaaaccgacttcatttcggatgaatcgttacacgtattgcagttgttcacactcatgagcgcctacgacctatacgctctatccaacgatgacgccggacgcgagcagcttctgaaagactacccggagtcaatggccctcacgctgatgaacgctgcgaacatgattcatgaagagcgcttgcgttccgcatacatgctcgcacaaggtttccttctgtcgagccgggatatggaagatgtcgatatcgatgcccggcataacggtctgctgccggacctgctgccccatggatggcataccatcatggaatgctgcgccgagggactcaatgacgttggactgctcgccaacgtgtatcggtactacattctttcctgcaacgacagatccgatacccattacgtgagtaaactacgcaatctgttacgcatctacggcggtcttagcgcagaagaatggcatgacgtggctgatgggctgaccagagattgcgcccggaacatcatcgaccgcatcaagtaccagccggaaataaccaccaaaggcggcacacagcgccacagcagttggcgcaatcccgcttatgagaagctcatcgtggatgagcggctttcggacgcggccctgacctattacgtcaccgtcgattacccgccgctgccattgctgcgcaccatcgccatcgaacaccccgaatcggcaaaatcgataatcctcgacgcgatgccatacggcaccatgggcacggccgcgttccggtttacggtggaacgtggcgtcgacaatacattgacggcacgccgcgccacataccagcagatcgccaaacagctgcgtcgtttcgccgcagtgttcggcgatgaggagacccgtgtgctggcacacgagattgtcgagcgttatccgaatcgtactgcgttgcgggaggagctggcgtttgcgttgtagtgacgacattggcaacgcggtacggcattcggcacatatccattgactatgcagagaaatgccagcctgttcttcgctgagattcctgatgatattggtcagctggctgcaaacccagaccttggccaaatgctcatccatgaggaatcccttgcctttggcatagcggacgacgacacccggcatgttgagtgcattttcagcgcattcaacatcatctgcgtgcgcttcgcgtgcattttcagcacaatatccgtcacataccttaatggatgcagcactccttcaaacgctgctgcaggccttcgtccaccgcgaaaaggtacagaccgtggacgccgcgcttgagcaggacattcaactcatgcttcaaattttcttcggcaaaatctcctaaatctttgcgcttattggttgccagatagttttggctggcctttgcatcgaacacgattcccccgttacgatacgtcaccgagggtccaatgatcacaccggcatagttcaaatcaaacccttggatggtgaagatggagccaatctcatctatggtgtacggcttctccgcccaagacagttctttgtcgatgcctttcctgcttttcggagcggaatcttcgagctgatagttccaaggcttgcagaattggtcagaacttattgcggaatgatcgaatccatggtcatccgcaagtcccatacgccatacgccggaagtatcgcgatgcagttccacattccaaaagccatgcggatcattctgattctcagatttcgccgaatacttccagtcataggtggccaacaaacgggacagtccagccccatcccaaccatcgggcttcagctgggctttcgcgtgaatggcattaaacaaatcaaccggcgagtcgaacaccttaacgtcataaggttctcgaatcacttcaccatctacggcatactcgcccgtatcaacgggcaaagggccgatacctttccccgaagcgaatcggtcaatccactgaatcatcgacttactcgcggcaatacggaattgctttttcaaatggacatgcgcaatgtccacggaaatggacggcagatgatattcggcgcccaaatcaaccgctttgaatgcgccgattttcccggtcgcacatgcgatctgagtcgaatcagagtccagctgaagtttttccagcatcgctgggtcccactgctggctggactgcataatctgattgtgatcaaagaccgcaatcaccacccgggctctgcgcagaatgtcatacagctggttcttcccggaatatccctgatttccttgcgtcatcaacaaatgggcctcgtcgatgagcacgatgtccgccaggccttgcggttggtctggaatgcctcgaccatgctcattgcgtaagctgaatcgattgatgaactgactgggcagcatgaccacttcatcagatttcttctgcaaacccagtttcgtggcaatctgattatatacgtgcacctgttccttatgattgacaagaatgtatgaggaaagccggccgttcgccgtttgtgacagctcaggataatcttcgtcttcggaataggtgtcgccttggatgccgatttcagccgcgattctgtagaacaggtggcttaacaggaccgttttgcctgtccctgcagcaccttgaacaaagattaatttcggatggcggtctgaagattgctcatcggctttcttctgttgccggctatcggcaaccaaggcggcaagttgcaccaaaatagattcttcggcttcgagctggctatcgctgagtttatgaaaaggcgatgccttgaacaacgcggaatctcggatgatctcctccgccgggaacaggtcagaatcttccttgtgtaatctcaaccagatttgcgagaaaatccgatcaaactggtctgcggtgtaataatcgccttgcgcattggtccgtcgattgttgagccttttcaccgaatcggtactggacatatagtgcataagacggttttcgacatccagggttaacgacttattgaatttgggatgtgaaataacatattgccgatatgcatcatcattccgcgagacagcatcagctacagctttccagtcctcgcgttctttagcatctctttcaagatgctggaatgtacgatgccgtatatcgttggtctcaccgacgtacaccgtatattcgttcttcatcgaatagcgattggtctttcctgaatacacgacataaaccgttggatatgccaacacatatcgcagcatgaaatgttccagatcggaatcattaacactgcgccccatctgcttctcgagggattcgtcaaaagccttttcaaaagcttccctactgtattgaccatatggcaggttgatgacaaacggcgccaagctctcactgttcataatcatattatggtccatcatgagctctggtacatgaccaacattcagcaagtcctataatgtcagtcatgatcagtgacagtaccattcaatcgattcgtgattttgtgtcggagcgtggctggggccaataccacactcctgagaacctggcgaagtccatcagcatcgaggcgtcggaattgctggaatgctaccagtggacgccgcagtcgccatccatggatgagggacatgtcagagaagaactagcggatgtgcttacgtattgcatcatgatggccgatgcgcttggtgtggatatggatgacatcgtcatgggcaagctcgcaaagaccaagagcaagtatcccgcggaagccgtccgtgatgacttcgaggaatacgagcaccggcatctgaatgctcgtaagacggatgacgatgctcaatcttcgcctagcaagtagcttgttccatgcggctgctatcaccatgccgtgattccgacaccaccactcgataatggtacacacggaaccaatcaaggatgacggatggccggtggcattggtcaccggcggcacgagcggcatcggcaaggcgactgcgcggatgctcgctgtgcggggttggcgtgtgattgcagtgggactcggtgcggacgagaatatccctgagactcagcgtcttggccacagcgaactgtttacctacgagatggatgtcaccaaacggtatccattacctcatgtgtatatgtaatatcaaggtcggggatacagtacaacacctcaaatattcgcttgacagcatgccaatctccctctgtcaatccgcgatatttcgggaattcatgcatcgtataccatctcacacaattcaatgcttcatgaggaaactctgaaacttggtcttgcgattcatctaattcccgacgtcggctctcacgcatgaagataagcaccgcagccacatgcttgcagtacgttgcacgttgggaatattggcatgtgcaggcggcagaaatcactttgccatggcgcaaacgaatgtccacttgatagtcgtcattcccgcgaaccacggtatgccaaagattctcagcaatcatgaccggcggatcaaccttgccggcatcgtaataagcttctccacgcacaaaaatcctgcgttcaaacaattgaaagaaaccgtcatccacttctgctgtcatacggcctccttgccctatgtatttcaggataacgcttgtcgcccgctttttgtcatgtcatgcgatattttcaattgctgcgagcatcgcccggaaccaatattcgctttcggcgttccatggaccattccctcatattcgggactacagtaagcgacagatatgaagctactgtgccccagtccgaaggaggacattatgggattgtttgattcgctgaagaacatgtttgcgcatcatgagcaccatcatggagccagcatcggtcagccgctcactcttaccgacaccaaagcagtgctcgctttcatcgtgctgcaccaacatctggcagatatgcgcaaggtggccgaagcggtcaagcaattgcaggatgagatgcctcagtacatcacattcggcatgtcgcattattacagtgagcccaagcgcgtgcgcttccagtccgaaggtggcaagttcatcgatgcggacgccatcgccaccgcatttgccgagaccaccgtattgcaggacgagtgcgaaatccagcatcttatgggcgatatcgaagacaaccgtgagcatcgcgatccggcaaagacgccagcagtaccgattgacgaactcgtgcgcgtcaccaatgaaaggcttgcgaccggcaacgatgaggagcgaagtcgtgcatggctgttcgccttattcgatcagctcgatgacattgccgaggcgacaaagaacaacctggagccgcttgtcacagcgttggatacgactctacaaaacagctccgctactattggcaactccgccactaccgacgccggcagcagcagcaacaatgccaatgccggcgatgcacgttcccgtatcatctccctaatcgccgacgctctcttcccggccgcagaatcctcgaagacgagcaagtcctcagcatccgccgccatccgcgaactgatgctcaatcccaccgcaacatcgctcgattacatgccagccatagacgtactgcgcgcccacggtctcactatttgccggtgagtccgagaagtcaaccggtggttcatacggcagtggttcatgcggcacataccgcacggaactgctatgcacgaaccactgtgtccgagcaacgagaacgcgctacttctccagcttctccaacttttccagtgcctttaacagcgaatcgacatgtcctttggcacgcacgttgtagcgcgcaatcgccacggagccatcgggattgatgacgagcgtcgagcggatcacgcctacgtgcaccttgccgtagagcttcttttcgccgtatgcgccgtacagcttgtgcacggtcaggtcgggatcagacagcagcgggaacgtgagatgatcacgctgtgcaaacttgcgcagcttgtcaagtgaatccttggagacaccgagcactgtgacattcttcgacgccaatcgggcgagattgtcgcggaaatcgcaggcctcggtggtgcatccgggcgtcatcgcggccgggtagaagtacagtacaaccctgcggccggcatcaagcacgtcagacaggttgattgatccgctctctgtaaacccaggtataaccgccggcagagtgaaatcgggcgccacgctcccctcttgcagacgttccggcattgaatcagagctatcaacagtagtggtcatgattcccatcatagaacccttatcaacagcgctagtaaagttattcagaggtcagtcacacaactgcggatcggcaaaacggcgattctgcaacaccggcaatgttcgacgcgcggaatcaagacactcacgactcagctcagcagtaatgagatcggcttccctatcgcccgccgccgcatcacgcgcgaatccgtcgatgatctccagattccgttccggttcctccgccaccgtaaattgcgcaaccgcgacggacagatggataacgcccgttttcttgcgcagattcggttgtgggttccgatgaaaaggacatggcccggctttggtgcgattttcagtcgcttgcacatgaaaaccgcgattggaaagaaggccggaagccatgtccgataagatcatacggttcgacgacgccctgttcgggtcgacggtgatcgagcgctgccggaggcgcgaatccggcgtcgaggaggcgctgatggagatgtgcctcgcgggcgtgggcacacgcggggtggacgacaccggccggctgctgtggggcgagcggatgccatcccggacattgagcgacagactcaagaagatccacaaggggatcgacgagtggcggaaacgcccgttggaatccgagtgcccgtacgtgttcgtggacggcgtgcggcacaagcggtcccggggcgggcgcgtggagaacgcgggcgtcctcgtcgccatcggcgtcggcacggagggccggcgcgaggccatcgcggtcgacgagggcatgcgcgaggacgcggccggccgggagcggttcttccgaagcgtgatcgaacgcgggttggggggcgtcggaccggtggtcggcgaccggtgcgccggactcgtctccacggtcaactcgatgccgccgaacgcaagatgccagcggcgcatggtgcgtttcatgcgcgacgtgccctccaagacgccgcccggtcacagggaatgggcgtccgccgccctgaaggccgtcttcgcgcaggaaaaccgcgaatccgccatggccaaggcggggacggtcgcgggcgaaacggaggaacgcaagctcaaggcggccgcgaaccgcctgcgcgggggcgtcggcgagaccgccgcctgcctcctgccggggttccccgcgaaccatgggatcaagccgcgcacggacgacatgatcgggcgattgaacagggagatccgccggcgcacccgggtcgtgggcggcttccccggctccgacagcgcgctcatgctcgtatgcgccggaatccgctacgtcacctcacgctcgtggtcggaccggcgatacatggacatgtcccggctcgatgacaacccaggcgcagcggcatgaaagtcacgccaacagctggccaacaaccaatctgcgcaaaaaagcggacactaccgacagatgaccactattttcgcatgatgaacaaaccattttgaattcacaattctctatgctcggcgcagcatacgttctgccacatcgatataaatattgcaatcgaaaatgacacatacggcggagctcatcagctctccagaagttgcttcaaataagctgaatcatgcacccgcactggtcgagtatcctcatcaaagccttcattggtgtctacctgctgcttgatgaaatcaaaagcctgctgaggagtgacacgaatgctggcttccatctgttctttcattatcgtcggcataagatcgttccctccttccccgttcagtatatattcaacttatttctcactactacagcacggaaggatcctccgtctgagagcaaacgacatagcctcacaccagtcccaacgttttgaaggcgttggccaggccgtcctcgtgaatgtcggtggtggtgaagtcgcagaaggcttggatgccatgaatggcgttgcccatggctacggatgtgccggcggctttgagcatggcggtgtcgttgtcggagtcgccgatggtgatggtgtcggcaatggcatagcccagcaaagaagccacgtcgcgcacagcggtacctttgtcgatgccgttgatgagcagttcgccgttattcggcgagatcttgtcgtatgagccgtgcacgagctcaaaccatgggctcaaatcacgttgagtctcctcgaaagtcacgtcaggattcggcgaggtgaagtatgaccccttgctcacatgaatcgtatgtcccaacgtggagccggccggaacctcgacctcgtccagcagatgccagaaccgcgcaaactcaccacgattccacgtcttgcccttggactccagatggcggcgataaccttcggaaatgtacatgccgtccgcaccctgccattggtagctttcgatatgatgctcggcgaaatacgccatcgccgcatcaattgcctcgggcgatatgaggtgctggaacagcagcttatcgccaatattcgcctgcgcgccggctacggaaactacaccgtcgaatccaagatccagaatgctgcgttcgatttttggcatggagcgaccggtacagatgaagagcttgtggccgttggcctgggcttgtttgcaagcgattttggcagattcgggtacgacgtggttttcgtcggctagggtgccgtcgatatcgatgaatacgagtttgctattggttgtcatggttgccttcgtaactggttggacctcccccagtcagcttacgctgacagctcctccagaggggggcgaagaaaatcccgcctaaaaacctacaagcatcacacggcgtaggcggcccagcggccgtgggtgtgctggacttcgatgggcataccgaacaattccgacaagcgttcgtcggtcaggccattctccaacgaaccggtgtagacgatggtgccagcaccgggattacccattgaatccacgcccgcttcggtggcgtcctcagcaggaatcggctttcgtcccatgatagcgatgtggtcgaaaccagccggaatctcctccagtcgatgggtgaccagcaccacggcacgctcggagctttcctcgccgattcggctcagcgtgcgcatcacctgctcacgaccacccaagtcgaggccggtggtcggctcatccatgatgagcagctcgggatctcccatcagcgcacgggcgatcaatacgcgggtgcgttcgccttcggacagtcgccacatctccttgccttccagataggagacgcgaaaatcgcgcagcagctggcgggcgcgggcgtattcctcttgcgtgtaggtgtcgcgccagcgcccggtcacggcggacaggccggtgaccacggcgtccagcgggtcctcgaactcggggaactgccggcccaggtcggccgaggcgagaccgatgcgggtgcgcagtttgaatacgtcgtatttgccgagttgatggccgaggatgaatacgcggccttccgaggggaacgtgcgggtggccagcatgtcgaccgcggtggatttgccgatgccgttcggaccgaacagcacccaacgctcccccgcgttgatggtgaggttcacgtcggtgatgatgacgcgacggttgcgccggaattcgacgttgtcgagttggaggacggtgtttgtcatgagtgaaatactacctatgattcgcggtctgacgactcccctcagtacgcttcgcggacgactccccttaaagaggggagccaagaaaccggtacctgaggggagctggccggcgcagccggactgagggggcactcgttgcagcgctacttacttcttctgctcgtcgagcacggactggtagacttccacggtcttgtcggcgatggtctcccagctgaacacgtcgcgggcgcgttcgtagccggcctggcccatcttcttggcgagttcggggtcagccatgatcctgtcgatggcggcagccatgtcgtgcacaaacttgtccggatcggtgggggtgccggtaccgtcgtgcagctgatcgatcgggaccagatagccggtttcgccgtcgaccacgacttccggaatgccgccagtggcggatgcgacgaccggcagaccacaggccatggcctcaaggttcacgatgcccagcggctcgtagatgctcgggcagatgaaggcgtcgcagccgtgctccagcgcgttgagctcgggcttcgggagcatttcttcgatccacacgatgttgccgcgctcttcgtccagcttggcgaacgcgttcttgacttcctcggcgatttccggggtgtcgggcgcaccggcgcacagcaccacctggatgtccttggaaatcaggtgcagggccttgagcaggtacggcaaacccttctgacgggtgatgcggcccacgaacagcagggtgggcttcgaacggtcgatgttgtaacgatcgaacaccttccagcccgggtcgtcaggggcaggggtggcgaagtcggccatggtgatgccgttgtacaccacgatgaccttgtccgggtcgaggttcgggtaggcggtcagaatgtccttgcgcataccgccggacacggcgatcacacggtcggcgtgctcgtaggcttccttttcgccccaggagctcaggttgtagccgccgccgagctgttcgcgcttccatgggcggaacggttccagggagtgggcggtgatgaccagcggcgtaccgtgcagcatcttggccaggtagccggccaggcaggcgtaccatgtgtgtgcgtggatgatatcggcgtcaacgtcgttggcaatctgcagatccacgccgaaagtcttcaatgcggggttggcgtcagccagctcagaaggcgtgtcatagccgacgaccttcaagctgcccttagcatcggcagcattcgggatagcaggaatgtccgtctcggtgcgcttgccgtcaaacgcacgcacggtcacatcaacgcgctcggccaaaaccttggacagctcctcggcgtgtacgccggcaccaccatacacgtgcggcgggtattcgcgggttagaatatcaactttcatcggactgcctctccttcgtgcgtcagaaagaaactcaagcacttcttactttagggcaccgcatacaagaaaacgcacaacttccgtcgtgcgttttgcttttcaagccggatttaccgggcaaaagatcagactgccgtgccgttctgatccaaattcggattgtgcttggaatcgccagccgtaaagaacaggctcagcacacccacaatgaacaccgcggaaacggtgatgatcagccacatcggatggcttggcagccacataaccacgaagaacgcgataatcgcgatggcgatcagcgtccagctacccacacggaaccactgacgcagcgaatgcggtgccttgaacatcttcggattcgtgtagttcgggttagtggtcagcagggtttcggtgtccgcaatcgtaccgccgctgggcttccactcggtgtcgtcggtgccgtcctgcagacgctgggacttctgctgcagctggtattcgtcaatcattcccgagcgaccgcggccttgggtctggtcgtactgcgacggcactcccctgcggcctgctttggcttgggcacggcgttctgcacgattcggcattccactactcctgtttcgacggtgacactgttggctatattactcgcttatcggcggcaatttgccaccagtccatcggaacccactgtgtgtcattgtattttcagtcagtgatgcgggcagtcggtgatgcgataagtttgcgtatggaagtcgcaagtgaccgcagtgccgtccgcgaataccgaacgctgcaccagcggatcatcatccacgaactcgtgacgaaccagttcctgcatgccgacccgctcatggaatgcagcgaccgtatggcagcgttcgatgtcgttttccgtgcgagcgcgctgttcgtcgtccatgtcgccgtcaacgccgatgtatgcggcatcgcgaatcaggtatggagctccgccgttgagcagggcgtacagcatgtaatcgtcgccgttcgccacacgctccatcatccatggttcgataatgcaatcatggtagacgaggttatacagcggcaccggcacaccttggcgcggctcgttgggtgagcgcatctggaagtcgtatggcgcgtaatggcagaatatcaggcttggcactgcccagtccgatacctcttcggacgaggagaggatgccgtgcgagagcagatattcgaagcattcggcgcggcggtcaaagcattcgcggcgggtcatgcggtgttcggggttcgagcattcgtcgccttcgttgcaggtgaaaacatccaagtatgcacagtcgagcttgatgccgtgtgcggcgatttcggcgaaattgcggcgcacgtagtccggtgcgagctcggcgcacaggtaggtctggtggccgcccgcccagcgtgcgtgttcgggcatcgtaccgtctgccagccgaatcgcattgttggcatcaaaggtttgcgcggtgaagtagtaatcgcggtactggtcatgcgtgccgaaaatatcgccttgctcatggcaggcgtcgaccagcgacttcatgccttcccagccgcctgcctcctgacaagccggcagatagtcagggtgtgcgttgtcgtatccgggctgtgcccaaccatccaagtgcatgtacagtcggcctgcacccatgctgtgcaatgttcgcatttgcttttcgcgctgcgcaaaggtgaccaatgaatcgtttttctcggggtgatccttatcgtagtagtacgagtcgggctgtactttggttttgatgccgatgtgcacccatgaacgaccaatcaggtcacgcacggagggattgcgcgccgccttttcggcgagcgtacgcaagcgacctcgttcattgacgtacgaacgataggccttgcacaccgccgtgtgatcggcgtggtcgaggaactggtagcgtaccacgcggcgataattcattgtgccgaggcttggctcaaaccaagtattgatatgggtgtacgggccatcgctgggatggtcgatgccgtaaccggcattccatggagtttcgcagatggcgatatacccgtgtccgtctgcgcggagctgcgcgaaccacggcatgtaaccgccagccgtttcgaagcgaccgtcgaaggcgatgtctttggtgctcacggcggtaggccatgtgttggggatcatcacaccttgctcatgggtgatgagcgtcgtgtcatggtcgtcggcgcaatcgaagtccatggctgcgggccacgtcacattggtgatgttcaggccttgctcattgagcggaatccattcgaagagcacatcgcctgaggcacgctccacccatacataggtttcaaaggagtatgcgctgtgcccaaagccggtgaagatgctgcgaatgccggttcccgtgccggtttcacgctgctcatgggtgatggaagtggcatccgcgaacgcgaaggtgccttgcgcgcattgcagggtcggcttgaaatcagcgcaggtattccattcggcaccgtcgcgcgtaaaagcgaactgcattgttcgttcatcgaatcgcacggtagtgccggatacggtgaattccatagttaatgtgctcctgtatgttctcgattgctcccgcttacgggagctcgctcatataacaagattaggggtggtctgctgtttgagaccacccccagtcggctttgccgacagcccccgccagcgggggctagcgctgtctgtttattacttactgcttactgcttcttggtcagtgcggtgaacactgggccgccgccgtagtcgaatgcgacgccggagactgcggaggtgctggctgcggtggcattctggttccacaacgggatagccggaaggtcctgcagcagaatctcctcaccttgctgataatacttgtcggcttcctcggtggacggagcggaaagagccttgtccatcatggcatcgaaatcggggttcttgtagttgccgctgttgccgcccttgccgtcggccgaactggaatcgtacagctgtatcagatagttgtccgcggatggataatcagggccccaaccgctgcggtatgcggaggtcatcttgcctgaatccacattggacaggaattcgtcggaagtggacatcgggatgctcttggcatcgatatccagcgtgttcttgatgtagttgcagattgcctcaacccagttcttcgcagtgccatcagcattgtacgcaatgccgaactcaccgctccacggggagatggcgttggccttggcccacagttccttggccttggacgggttgtacttcagtacttcatttcccttgagttccttggagtaggcgctgattggggctgcaaggaagtcgacggcgggcgtggcggtgccgtggaagatcttctcggcgatggtcttacggtcgatggacatggaaatggcctgacgacgcaggttgccttcctcgttctggccgaaatgttccagccattcaggaatggtgaaggtgagcgtattgccaccgggctcgttgtatgccttcagcgacttgtcggattggaaggaggtaagtgcggtgtcaggaatcgtgctcgtgaagtccaggttgccaccgcgtaggtcggcgtatgccgaatcaggcgaggtgtagatcttgaagttcaggccatcgttcttggcgacacgattgcccttgtagtcagggttcttcaccatttcgatgctgtggttgtgctgccaggacacgaacttgtatgggccgttgctcactgggtgctgaccgaacttcttcgggtccttgaacgcggattcgggcaacggcatgtaggcgtggctgccggccttgaccgggaatgccgagtcgggctggctgagcttgacatcgatggtgttgtcgtcaacgacggtcaggccgctcagcgtggccttggggtccacgtccggcttttgcagatcatcatagccttcgattgtgctgaagaagctggcgctggcctgcttgttggcactgttggcggtgtaattccaagcgtctacgaaggagcgcgcggtcaccggagtgccatcggtgaacttccatccgctcttgagcttgatgacgtaatgcgtggcgttgtcgctggaggtgatgctgtctgctacctcgttgtggatgccgccccgcgcatcataggtcaccagaccggcgaacagctggtctacaaccttgccgccaccggcctcagtggtgttgccggggaatagtgggtgtgccggctcactgccgtacacggaaatgatgttggaatctgaagcattactggaattggagatgccggtcgatccgcagccgctgagcagcatgacgattgccgcaccggccgcgaccagtgcagtgacatgacgtgtgttcaagaatctctcccgaatattttggcgtcgtctttttggcgacgaaaggcaccataggagcttcatgttaaccatgtatgcaatattctcgaaatatagacattactgaagactcaaggcagtaattaatcccagaaacgcaaaaatcccctcacgaagaagggattttcatgtttctgtttggaaagtattcagcgaggcagcatcatcggacgctggctggccttaatcggggccggcagctcgctcttttccttggagaggtactcgtccacggctacggcgcaggagcggccttcggcgatggcccagaccacgaggctctgaccacggccggcatcgccgcacacgaacacgccgtcctgggaggtggcgaacttgtcgttgcgggcgatgttgccacgcttgtcaagttcgacgggcagctggtcgaggatggtctcggtgtccgggtgcaggaagcccacggagatgaggaccagatcggccggcagcacgcgctcggtgccgggctggcgggtgaaggggccgttctcgccgggggccacagagacgaccttcaggccggtgacgtgaccgtgttcatcggccacgaagccttcggcggtggtcgagttgtcgatggtgaccttggccttctcctcttcggtgccttcgaagttcaccgagtcggtcgagtagatgtactcgccaccctcttccatggaggaggtcttctggtaggtgcgggcgaaggtcggccacgggctgttgtctgggcgtgaagacggctctttcggcatgatctgcagcacggtgacatccttcgcaccctgacggatggaggtaccaaggcagtcggaaccggtgtcgccaccgccgatgaccaccacgtgcttgtccttggcggtgatgtcgtgcaccggcttgacgccgaagatacggcgcgtggcgtcgggcaggaagtcgagggcgaagtggatgccgtccagctcgcggcctggaatcttcatatcgcgcggcacgcgggagccgatggccaccacgacggcgtcgtaacggtcacgcaggtcatcccacgtaatgtccttgccaatttccacgttggtgcggaagcgggtgccttcggcctccatctgcttgacacggcggtcgagcagacccttctcaagcttgaagttcgggatgccgtaacgcatcagaccaccgatggcgtcgtccttctcgtagacgacgacagtgtggccagcgcgggtgagctgctgtgcggcggcgaggccggcagggccggagccgacgatggcgaccgtctggtcggtcagacgctgcggcggcagcggcttgacgtagtccaaatcccatgcctggtcgatgatggtctgctcgtcaagcttgatcatggtcggcggctggtggatgccgagcacgcaggcctgctcgcacagggccgggcagatgcggccggtgacttcggggaagttgttggtcatggacagacggttgtaggcgtcttcccacttgccctgacggaccaagtcgttccactcgggaatcaggttacccagcgggcatccggtcatgcagaacggggtgccacaatccatgcagcgggccgcctgcgtttgggtccacggttgcaggccggtttcggcgtgaacgtcgaaccagtccttgatacgctcctcaacggggcgttcagccaactctcggcgggtacggaccttcaggaatcctctcgggtcgcccatgtcagcgcgctccttccataacctgctcgtacaccttttcccaggcgccgggcgcattgaaatctacattgttggccttggcttcttccatggccttcgtcatggccacgaactgcttcggcaccacgtgagtgaaccgcttgacggtttcgttccagtcctccagcagggccgcggcgaactgggaaccggtctcttcggcatgctgcttgaccagtgcgtacaccagcttggaggtttcggcatcaagcgacttgaagagcagtgcaccggacttgatggcactcgggttgaccttcttcatatcgaggtcaagcacataagtgttaccaccggagaagcctgcaccgaaattgcgtccggtggggccgagcaccacaacagtgccgccggtcatgtactcgcagccgtggtcgcccacgccttcgacgacgaacgtggcaccgccgttacgaacgccgaaacgttcgccggcgcgaccggccacgaacatctggccggacgtggcgccgaaaccggtgacattgccggcgatgacgttgctgtgcttgtcgaaggtgacgttgtcttccgggcgcacgatcatgcgaccgccggacaggcccttgccggcgtagtcgttgacttcgccgtagatgcgcatggtctcgccgcgcgggatgaacgcgccgatggactggcctccggaaccgtgcagggtcatgtcgatggtgtcgtccggcagaccttcctcgccgtaacggcgggtgatctcgtagccgaccatggtgccgaccgtacggttgacgttgcgaatcggcatttcgatgcgcacgggttccttgtgttcgagggccggctgggcaagttcgatgaggttgttgtccagcgccttctccagctcgtggttctgctcggtggtctggtgcagaatcgtgccgggtaccgggccggcctgcttgaggacgttggacaggtcgatgccgccggacttccagcgcttgatggcttcgttctggtccaggcactcaacgtggccgatggcctcctcaagagtcctgaagccgagctgggcgaggatctcgcgcacctcctcagcgatgaacatgaagaagttgaccacatactcgggcttgcccttaaagcgggcgcgcagctcaggatcctgggtggcaatgccctgcgggcaggtgttcttctggcaggcgcgcatcatgacgcaaccttccacgatcagggctgcggtggcgaagccgaattcctcggcaccaagcagggcggcgatgaccacgtcacgaccggtcttaagctcgccgtcgcactggacgacgatgcgggagcgcaggccgttcaggatcagcgtctgctgggtttcggacaggccgatctcccacggggtaccggcgtgcttgatggcgttgagcggggctgcacccgtaccgccgtcatagccggagataagcaccacgtcggcatggcacttggccacacccgcggcgatggtgccgacgccgaactcggaaacgagcttgacgtggatacgtgccttcgggttggccatcttcgcatcgttgatcagctgcttcagatcctcgatggagtagatgtcgtggtgaggcggcggggagatcagctccacgcccggggtggcgtgacggaccttggcgatccacggcgggaccttggctccgggcaggtgtccaccctcaccaggcttggcgccctgggcgagcttgatctgcaaatcggtggcgtgcacgaggtaatcggaggtcacgccgaagcgggcggacgcaatctgcttgatgcggctgtagcgctgcggatcattgatacggtcgtcggattcgccgccctcaccggagttggagcgtgcgccaatcgaattcatggcgatggcaagcgtctcgtgcgcttcctgcgagatggaaccgtagctcatggcaccggtggagaagcgcttgacgatctcagaggccggctcgacttcggagatgtcgatcggcttgcggttggtgttgaacttcatcaggccacgcagggtcatgagacggttcgacgtgtcgttgatgtggtgcgaatacttcttgaacatctggtagtcgccacgatgggtcgactgctgaagcaggaagatggcctcgggatcgttgaggtgatcctcgccggtacgacgccacttgtagtcgccgcccgtacgcaggttgcggtgcggggatgcgctccactggttcgggtaggccacgcggtgacggatggccacttcctcggcgatctcgtcaaggccaacgccgcccacacgggaggtggtgccggtgaagtattcgtcgatgacttcctggctcaggcccacagcctcgaacagctgcgcgccacggtagctcatgatggtggagacgcccatcttggacatgatcttgagcacgccggtggaaagcgccttggtgaggttcttcacggcggtgtccgcgtcgaccttgaggtagccattacgggccagatcctcaacggattcgaatgccaggtacgggttcacgcaggcggcaccgtaggcgatgagcagcgcgacatggtgaatctcgcgcacatcgccggcctcgacggccatggagatctgcgtacgggtgtggtgacgcagcaggtgatgctgcacggcggaagtcagcagcagggacggaatcgggccccaggtgtggttggattcacggtcggagagcacgatgaagttcttgccgttgtcgatggcctcatcgatttcggcaaagatctcggcaagtcgatcttcgagggccttgccgccgccggcgacctggtacaggcccttgaccacgtacggacggtagtagccgccgaggatgcgggccttgtcgaggcgcttgagctgggccatctcatcagagttgaccacgggcagcgggatgaggatcttcttggcgtgcagttcggaatcggacagcaggttcggttcagggccgatggcggattcaagcgaggtgacgatttcctcacgctcccaatccagcggagggttggtgacctgcgcgaacttctgggtgaagtagtcgaacagcatgcggctgcggctggaaagcgcaggcataggcgcatcgttacccatggaaccgagcggttccttgccggtgttggccatcggagtgagcaggagcttcagatcctcttcggtgtagccgaaggcacgctgacggcgctggacggactgtccggagtggctcacgtgctcgcggcggggcaggtcgctcatttcgaccgagttgccttccacccacttgcggtacgggtgctgggaggcgagggtcttcttgacctcttcatcgggaatgatgcggccttcggcggtgtcgaccaggaacatcttgccgggctcaagacgacccttggacacgatgtgctcctgctcgatttccggaatcacgccggcctcggaggccagaacgatgtagccgtcgtcggtgagctgccagcggccggggcggaagccgttgcggtcgagcagggcgccgacctgggtgccgtcggtgaagacgatgtcggccgggccatcccacggctcgataagcgtgttgttgtactcgtagaaggcgcgcacgtccgggtcgaggtcggggttcttctcccatgccggcggcagcatcatgcagatggcgtgcggcagggagcggccggcgaggtgcagcagttcgaggcactcgtcgaaggtgccagaatcggagtagcccggggtggtgatcggcagcagcggctcgaattcgccgagcagttcgctgctcaggcggccttcacgggcggagagccagttgcggttgccctggatggtgttgatctcgccgttgtgggccagcagacggaacggctgggccagcggccagctcgggaaggtgttggtggagaagcgggaatggacgatggcgatggtggccttcatgcgctcgtcgttcagatcctcgaagaagtgagtgagctgcatggtggtgagcatgcccttgtacgtgatggtacgggcggacaaggaggcgaagtagacgcctatctcatgctcgacgcgcttgcggatgcggaaggtcttgcgatccaagtccacgccggccagagcaccgttcggagaggcgaccacgagagtcttgaaccccggcatggcggcaagggcctgcaggccaaggccgtccgggttggtgggcaccacgcgccaggcgagaacttcgagtccctcctcgcgcacgattttggcgatggcctgttcctgctgaccggaggtttcgatatcgcggtcgaggaaggcgatgcctgcggcatagtggccggcttcgggcagttcggcgggcacggtggcacgcatgaactcgtccggcatgctcatcaggatgccggcgccgtcgcccgtgttctcctcggcacccacggcaccgcggtggtcgagattgaccagcacctcgatggcgtcagtgacgattttgcgttcaggacgcttgttcaaagtggtgaccatacccacaccacaggcgtcatgctcgttggcgggatcatacataccgtccggagcgtggaccgtgagatcgagcggggctttgaatgtcaccggaatcacctcaattggttgtggacacgtaagggaatcgtgtctcttcgttcattgctgttgacacagtaccgttgctccatgtcatttacgtttcgcgtgtccatattccgaatcaggcgatccgcgacgatgacgggcgggacgtggtcggcccgctacagggcttcgccgccgtcatacgcacgttcggaggcgcgaagacagggttcgccctgcaccacttcgacctgcgagggcggcatgccgtcaccggtgcgtttggcttggatccgctcgaacagcatgcggaaggatcgctccccatgtccaggaaattctgcgtgtaactggtcaacgcgggattccacatggcaccgaagttgcggtcgtcgaaccccacgacgctcacatcatcgggcacgcggcgcccgacctccctcaggcctcggatcacggccacggcgatctcatcgttgtcggcgaagatcgcggtcacctcgtcgcgtcgtcccaggacgcgaccggccttgaccgactcatccagatcatcgtcgggcacgatgatcggatcgggcgccgcgatgccacgttcctcgagcgcatcgcgccagccgttggtcctggtgttggcggtcggccccgccgggcgccccacgtgaaagacggtgcgatgcccgagatccagcaggtgcatggtcatccagcggccgccatccctttcggcgttgatgatctgataatcgccgtctccgaaactaccgcccaccacgaccatcggcatgtctttgggaatgtgttcgagcgcggcgatgccggcccgatcatattcgtagacgatcactccggccggcctgatcgacaggcccatgcgcacacgcgcctcgacggattccatgtcggattcatccagggaaacgatgttcagcaggaaccggcgccttcgcgcggcggcctccacgccatgattcgtttcggatgtggagaaagcggatgggttggcggcgaacaccaccacggaatccatctcccggttcgataaggcacgcgccacgatgttcggctcatagcccaactggctgatggctttggcgatgcgttcgcacttgtcctcggcgacgttgacggtgccgttgagataccgggagacggtcggtgccgaaaccccggccaacttggccacatccttgatcaccggtctggtgcggcccgtgcttttcgccatcctcatctctcccgccatagccgccggacatggacgccgtcatgcacccgcgtcccggtcacgaatccttggttttccgcgtctcattgtaggccatggcgcggagggcgacgtatgggccggatgcgccaacgagcgggaaacgccgagggcggaatttcgctcttgcgtttgtcatcgaaccgcgctattctgaaaccggtttcaaaaggaagccgatatataactcaaagccacaaggctttgaccaacgaaaggaaacatgatgtctttcaaggattccatgatgcgcggtctcgctatgtacggcatgagctccacgacccagtacggccgcgccaacgacaccatcctcgccgacctgatcaacgaagccaacaagagcgctcgctgaatcgacgggacgcacgcctgacgacggatgtcgcatcaggacccgaacgtcatcgacagcaaggaaacaacaggagcaaggccgttttcggctctgcatgaacgaaaggcagtgactatgtccttcaagaattccatggtgcgcggtctcgccctctgcggtatgaactccgtcgcccgcgccggatacgccgacagcaagatgttctccgacatcatcgccggcaccgataaggacgcccgctgaaccgccgcggacgattcccgttcagacaaccgataattcaacacagtgataatcaaacacagtgataactgaatgacaatcggacaacgaagtccacttctctctcgcccccatgccatgtgtccgggtaggcggcttgacgaaacgttcatttcatccgcatgacccgcacgatctgctcggtggtgcgcgtcacattggcggccgcatcggccagcaggtcgttgaggctcgaagcgccgggcgcgatgccgaaaaccgcgtcgatgccaagtccatgtaacccgtcgattcccacaccaacacatccggccacggcgacaacgggcttgccataccgtttggccgctccggccacaccggcaggagctttgccgaatccggtctgagcatcgatggcgccttccccggtgaacaccacgtcagcccatcgcacggcctcatcaagaccggattgctcgatgacgatatcgacgcccgatcgaaactcggcgccaaagaaacccttcaacgcggcaccgatgcctcccgcggcaccagcgccgggcacatcgctcacgtccacgccgaaacggctttcgatcagacgcgcgaaatgcgccaaggcggcgtccaacgtgacgacatcatcggcaccggcccccttctgcggtccgaacaccgcgctggcgccagtgggaccggtcaacggattggtcacatcgcaggcggcgatgatggacacgttcccaatggccgaatccatcgttgtgatgtcgatgacggatacatcggccaaggccgctcccccacgtcccagctcgtcgccgttcgcgtccaggagacgcacgccgagggattgcaggaggccggcgccggcgtcattggtggcgctgccgccgagaccgacgatgattcgtcgaacgccaagacgggcggcggcgagcaacagttcgccggtaccataggatgacgcgatcagcgggtttcgttcctccgcgctgagtctggcgagaccgctggcctcggcggtctcgaccacggcggtcgcgccatcggcaagcactccgaaccggccttcgataagtcgaccgagcggatcatgaactggcacggcatgcatcgtacccccggtggcgtcgacgagcgcacacacggtcccttcaccgccatcggccatgggaagacagcgaatctcggcatcgcgatcggcattctcaatcccccgagccatcgcctcggccgcctgcatggcggtcaagctctctttgaaggagtcgggggcgcataggtagcgcgtcatgattcgagcatactccacgacgctccggtcctagataccggcgagatcgaagaaccgttcgatgaccgtgtcattgatgagcctgccgcgccgcgtgggcaccacccggcgtccatcgaccacggtgaccaggccctcttcgatcatcggcgtaagccgatccacggcaatgacgcgatcgatgcgctccagatcgagcccttcacgcatacgcagaccaagcatgatcagttcctcgaggttctcctcggcggtgatccgctcactatcggcccatggcacacggtgttcattaatggcgactccccagagacgggggtgggcgatgtcccaactgcgcaggccgtacccattggaagacatcgcatggcaacggtaatgggaatgggcgccgggacccagccccgcccaatcgacgttgcgccaatacccgagattatgccggctctcgtatccggggcgggcccagttggaaatctcataccaatcaagaccggcttgggtgaacagctcgtcggcgagctcgtatttggcggcctcatcatcgtcatccggcttgggcaaggtgccggcggcgatccgacggcccattttcgtggtgggttccacggtcagcgcataagcggagatatgatgcacaccgagatcgagagcggcctcaaccgaagtgcgccaatcctcaaggctctcccccggcgcgccgtagatcagatccacgctggaacgcagtccggccatggtggcggcgtcgacgccggcggccacgttggacggcgtgtgcgtgcggtcgagcgtcgccagcacgtgcggcacggctgactgcatgccgaaggatatgcgggtgaaaccgccgtcggcaagctcggctatgtaagcctcatcgaccgtatccgggttggcttcggtggtgatctcggcgtcgggcgtcagaccccagatcgcgcggatggcatccaccacggccaccagatcggcggcggcgagaaccgtgggagtgcctccgccgaagaacacggtggaagcggcaggctcctcgatgccgtgatcgcactgccattgcctgatcagagccatctcccggatgaccatctgggcgtaatgaccgcgcgaggcgcccgcaccgaggtccgtggccgtataggtgttgaaatcgcagtagccgcaccgccgcagacagaacggcacatgaatgtagatctcgtaagtcaaccgtcactcccctcagccatccgtgccgaagactccccggcgaggcgagcctccggcacccgctcagccttccgtcttctgcgcggcgcgaatcttgtctttggtgtcgcgatcgttggaatcctcgccggtggacagggcggcgatgaacgcctcctgcggcacctctacatggccgagcatcttcatacgcttcttgccagccttctgcttttcgagcaacttgcgcttacgggtgatgtcgccgccatagcatttggcgagcacgtccttgcgtaacgcacgaatgttctcacgcgcgatgatgcgcgaaccaatcgcagcctgaatcggaatctcaaactgctggcgaggaatcagactacgcaatttcttggtcatcatcacaccgtacgaatacgccttatcgcggtgaacgatggcactgaacgcatcgaccttctcgccctgaataaggatgtccaccttgaccaaatcggcggactgctcgccgtcctcgtggtaatcaagggaggcgtagcccttggtacgggacttgagctgatcgaagaagtcgaacacgatttcggccagtggaatgcggtagtgcatctccacacggtcggtggagatgtactccatcgtgcccataatgccgcggtggtcctggcacagatccatcaccgcgccgatgaattccttgggcgtgatgatgtcggcggcaaccatcggctcgacgatcttcttgatcttgccgtccgggaattcgctcgggttggtcacatgatgctggctgccatcctcggcggtcacgtcgtaggtgacgttcggggcggtctggataaggtcgaggccgaactcgcgggagagtcgctcgttgacgatttccatgtgcagcagacccaggaagccacagcggaagccgaaacccagagccacggaggtttccggcgtgtagatcagggcggcgtcgttgagcttgagtttgtcgagtgcatcacgcagttcggggaattgcgcgttgtcgatcgggaacaaaccggcgtagaccatcggcttggggtcgcggtagccaggcagcggctcggtggccgggcggacggccgaggtcagggtgtcgcccaccttggactgactcacatctttcgcaccggtgatgatgtagccgacctcgccggcacccagcgctttggtgcgagtcatgtccggactgatcacaccgatctcgatgggatcatgggtcatgccgatacccatcatgtgcactttttcgcggtcgtgcagttcgccgtcctccatacggatgtaggtgacgatgccgcggtaggagtcgtagacagagtcgaagatcagcgcgcgggcgggggcatcggggtcgccgtgcggggcgggcacgtccatgacgatctggtcgagcaggtcggccacaccttcgccggttttgccggagacgcgcagcacgtcgctcggctcgcagccgatcagacctgcgatctcctcggcatgcttgtccggttctgcggacggcaggtcgattttgttgagcacgggaatgatggccagatcatggtcgatggccatgtacaggttagacagggtctgcgcttcgatgccctgggtagcgtcgacgagcagcaccgcgccttcgcaggcggccagtgcgcgggacacctcataggtgaagtccacgtggccgggggtgtcgatcatgccgagcgtgtattcggtaccctcaaaggtccatggcacgcgcacggcctgggatttgatggtgatgccacgctcctgctcgatatccatacggtcaaggaagcgatcgcgcatctctcgctcgggcacaatgccgctcaactgcaggatgcggtcggccacggtcgacttgccgtggtcgatgtgtgcgatgatacagaagttgcgaatcaccgactgatcagtggaacccggctgattgtgttggacgaccaacgcattcctcctcttggcatatactcaaacttcacctagtgtagccgagggactgtattcggcgtggcattgcgcgggtttttccggggctcatgctatcctttaactcttgtatgtccttataacacacatcgtttggagtaaacgtggcaaacattaagtcgcagaagaagcgcgtgctcaccaatgagaaggcgcaccttcgcaacgtggctgtgaagtccggcctgaagaccgccatccgcgccacccgcgaagccatcgccgccggtgacaaggctgccgccgaggccgcctacaaggttgccgcccagaagctcgacaaggctgctggcgctggcgtgatccacaggaatcaggccgccaaccgcaagtccggcctcgctgttgcgatcaacgctctgtgagcataagcctcttaaggttttagcaagtccccgcaagtcatctggcttgcggggactttttatatctccgttcaaagaggtacattggcggtcttgcgaaatgacatctccgttcagagaggtaccggatacgggaaaacccaattataaacgccgtcattgcaacgcttatactcgatgtttcgtgcttcaggtacctctttgaaagcaactagccctgaggcggtcttgaatcatcctgaggcgtacccccatcatccatggtattagcgtggtctcggccagctgattgctgaatatgccgtttttcgctaggcagatacacacgatgacgttcgacggctccgggcagagtgacgttgaagcctaccgaaaacagtcgcagcgccaccacgatgataacgatcagtacatcgagcagcatttccgagcgcatgtcgaaccagccgtatctcgcgccacgccataccaacacagtcaatatgcagccgataaacgagggcacagcatagaggtgtttgtcccgaataatcattggcacgtcgccaatgaagatgtcacgaatgaggccgccggccagtgctgtgaacatgcccaggaatacggcggtcatgcttgaggaaccgtatgccagcgcttttgcggtgccgttgactgcgaatagtccgaggcccagagcatcgatgacagtcatcgtccatttgagtttggtaatctccgggtgggccaccaccacgataatgccggaaaacagcgtagtgagcacaaagcctttgtcggtgatgccgaccggcggcagggcaccgagcattacgtcgcgcacaagaccgccgccgagtgcagtcagccagccgcacagcataatggtgaagatgtcatagcccttgcgaatggcggcaagcccgccggacagtccccaacacaaaatagcgaagtactcgatgaccacaaaaacgatgttgttctccaacgccacctgcatgagccgctcccctcttgtgccgcttcggttcgtttcagtccgtcttcgttctgttcccattcatccttatccggcgctaccgcccgccgtacccgagcttacaacaggccttgcctgacgcaattggactagagaacaaaccgaataaatgctattgccggttcgactccactctttttctcttacagcgtcgccagcgcgccaaactttgagcagccaccgacgttagtccttctcatttgtcggaggtcggccaaagtttggcacggcaccaacgatcatgcgctccagtgtcgttgccgtgccaacttatgtacagctaacgacgctaagcccctttttatcgtcgtttgatcgccagaacttgacccgttaacgacgctaaggtgtctcagcgacgtcagcagtccaaaccttgaaccattactgacattgaacatcccccagcgtcgccagaagctcatgtcttgtctcaccaccgacgctatagtagtggaggccttcatcaagagcccaaatatagattcactcatcgcatccgaatgtagttttcaatggattcaacgcgtgattcaacatcgcgtagacggttgcacaatgctgcttcaatatcgataccgtccgagagggctcgacgcacgatggcgaggatttcatcggcgtaggcatcggccttctcatgttcaggagaattgtcaccgtttgattcggattgaatcgccgcttgaggctgctcgtcatcttgcttcgtgtcagccgcagccggctcatcaaacgccgcgaacaatctatcagcattcggcgatttggagatacgagaaacgactttggccgcgcgaggcgacgaaccttgagcgtgggaaatgccctcaagcacggatttacaatgcttttcctgttgtttcatcttttcccatagagccactacggcttccggggattcgggttgggtagtctctctcccgtcgttgccgtcagcatcaaaagcatcagaagattcggaggaattgccggcatcatcagccgcaaacacatgcggatgccgagtgatgagcttgttcatcaaccggtcggcgacctcgtcaataccaaaaggatcctcggcatccgattcgcagacccgcgcctgaaacacggattgcaacagcacatcgcccagttcctcgcgcatgttgtcacggtcgtgagtttccaccgcgtcgacgtattcgtaggtttcctcaagcagattcttgagcagtgactcgttcgtctgcttaccgtcccacgggcagccgcccggcgaatacagcacgtccaccacggccttgacccggtccggcgccgtaaccgcctcaaccaccggctttaattccgaacaatgctcgaagcctgacggcaaacggtaggctgaagcatggtattccgtcatgtcactcatcttgctcataggtttgctcctgttctcatctggatgaaccataaccaacccgcgcaacgtgtagaagacctagatcatattatttgttgcgaaatgttgctaaatccatctgtatccctctagccaagaacatttccaatacgccaagaccccttggaattgttgatgttccaaggggtcttaatcagaaacaaaaggtgctagttcagcacaccttccacatccagtaacgtataatgaaatcaacggctcccacggaaagaacggcggaattccaacgatttgatacgattggtataccattggaataccattcgccacggattgtttgttggagaatgttggagaatgaaggatgctgaatgcctaggataaggaaaaccggagcggtctaccccatccgccacgagcagcggaaaacactcaaggacggcacggtaaagacatacgtgaactggcaggccaaggtggacggccgatgggtgtccgccaagacctacaaggaatgcgacaggaaaatagccgaagccctcaaggagaaaaccgaatggggcatgggcgtagaccgcgccacccggctcggcgagtacgcggaacgatggttcgagctgaaacgacgcgacctgaaacccaagtccatcaacaactacgcgagcctcataagcgtgcacctgtgcaagtacgcgaacgagaagctgggcgaagtgaccgcctcggcggtgcagcgcatgatagccaacatgcgcaacctcgacggcaccccatgctcgtacaaccggcagcttggcttctacaacatccttaaccagatattcaaggcggcggtggccgaccggctgatacccaccagtccggtcaccagcgcggcaaggccgaaacgcagggacacgggattggccggggaccggcgcaccatcaacgggcccgtggccgtgtcggcggacaggcgcagcggcacgcaggaccgcaaggcgttcaccgtggagcagatgcaggacatgctcgaagcgtcctccgacgacctgtttctgggcgcacgccaatggtggcgtctgctcaccggcatgagacagggggagatactgggagccacattggacgatctcgacctgtggcgggacaagacgttggaaaccccggacagcggcgagatatggataggcacctacacggtgaactggaaactggaaagcctcgacaaggagcatgggtgtggggagcccggcagggacggaagatacccgtgcggcttcaaacggccttcgagctgcccccgataccggtggagggtgccggacggatacgacatgatacacctgtgcaaagggtacgctttgacgccgccgaagtccgcgagaggcaaggtcgtgccgataatcccccagttgggcaccgtcgtgcaccggtatctggaggccacggagaatatcatcccgaacccgtacaacctgatattcaggacgcgcgagggtatgccgttggccgcgttggatgacagggccagtttccgcgacctcatgcgcagggcgggcatacccgactacgagaaccggtacgggcatgaatgccgcaactccgtcgtatcgctcctgttccacatgaaggttgaccccggcatcatccaacgcatcgtcggccattcgagcatagccatgagcgagcattaccgcaccgtgccggtagaagatttgatgcgaggcatggagacgataagcgacgggctcggtctgaagcagatcgaatggaaggcgtgaactggcgcgccgaaacttgccggccatacaatggaagagtaagttaatcaccttgaatgtccagcggaaggaacgttacggaggcgcaccatgacaagcatattcgacgtggccgcttacgtgctggacaagctcggcgtcatgaccacaatgaaactggaaaagctctgctactattcacaggcatggtccctcgtatgggatgaacggcgtctgttccccgaacggttcgaggcatgggccaacggcccggtatgccccgacctataccatgcgcacaagggcatgttcaagatcacgcgcggcgatattcacggcgacccgtccaacattgacgaggacggcatcaacaccatagacgccgtgttgaaggcctacgggaaaatgggagcctaccagttgagcgaactcacccacagcgaacgcccttggaaggacgctcgcggcaatctcccccaaggcgccatctgcaacaccgagataactgaagccgccatggccgaatactatgggagcctcaccgaatagtgggccaccgcagcaaaaccaagagcatcaaggccaaagccccgagctcttcaaaacgtgtgcccgcgcatcacgtggcgaaaagctatcatgtccccgaatccgccacggagattcccaaagattccgtgaaccgtcgcatcgtattccgtttcgactgcgttgaccttgaggccgactgtccatggtcgctcgcgcacatgagcgacgaggagcatcgactgctgctgttgaagatgcgtgacttcgaaaaggccacggtgggcgagatcattagcccctcatatcaggcgttcacctgctaccctgatttcacccaatgccccaaccagacgccacaggaccggctggcgaaatactatgaacgcgaaggcgatgcgttggcccggttccgcttgggcggcaccgaacgcctgtacggtttccttgtaggcaacgagttccacattctctggtgggacccgaaccatgaggtatggccctccactaggaaacacacctgaccatcatattgtagtggtatacaaaatggtcccgttctccaatacaggaagacgagaccattgtctttcgtttactgcttcgctgtatatccgacagcaacacatgattccatgacgctattcagatcagatagcacttgaaggctgtcgtattgggcatcagcgtaaccaagattctgtgtcgcatacacaatcttcaacatcggagcattcaatgcggcaagactcgctttcatatcggggtcggcctttgggaatgcctcgttgattgtcttgaccgccaatgaagctcccgagaaggcttggacggcatcatggttagccggatcgcggaagtacccagataccgctgccacatcatcaatcagggactgattaccatcgaagaggacaccgcaggctcccatcgtatcgggcgctacgctcggagcgctcacatatccgttcaactggaccttcgcggctttgtatttatcctcccatgcatacgacgattgttgagcggaattgacttcttcgctcatggctccgacaccgaaaagcatgcccacgaacagtgcgacgatgataccgataatcaacaagacgaaaaccggcaccggaatcgtgattccttttttacgcctatgagatacaggctgtgatggttgcatgcctgctggcggcatgggctggtaaaccggcgagctcatgttgtttccccttctcttcattgggtcaatggtttatgaattttatgtcccatgcttgattatcatggttgcatcggtagggacgatagaaagatgtcgtccggtgagccgctacctagactcagcgcatcataaatattgtcggaggcatgttcattgacttccttcgttttggtgtagtcatgaatgacgaagccgaccacggcgatgatcaccgctgcgataagaatgctcacaacggatttgccgatgccggtatcgtgattgtcggattgagaatccttcttccttatctgctgttcctgcaattccacgagtcttttctgtgtctccaatagctggcgttgcagttcttcctgcgtcatttccggctttgacttgtccggttccgattcaggccgattctgttcaggctcgctcaaaattattcccttctatccattgaactggtgccttaatcctaactcgatatggtcaggttgtcgtgcagccaatgccggtaatcctgcagaacgctgacggtgataccgagttcctgcgccatcgcgtacggttctcccccgtacaagtcctcggcgtgcatatagtccacggggtttatcaacgccaatgcggtctccttgcgcgtcaggcattcctccttctcacggctcaacagacgcagcccgtcatcgaagtgcttggcgtggataagctcatgctgcaatgtacatgcccgttgttccatgctcattgtggggtcaatgtaagcggtgcgggtgatgggatcgtattccccgcactgcgaaccatcgaacttcctatcctctataagtactcccatatgacgcgcctcaccggtgaggtcagtccatgttttcacgcccggactccgcattcttgttcttatcctcataggccgctttctcgatctgaatcttcttgccgagaacatcttcaagctgggaagcgactgaggcatattgcgtttgaggctccggcgcagaggcttcttccagaataaggaaaggatcgcaccctaaggcttcggccactgcgtcaatatcttcggtgttgaagcatcgttcaccacgcaattttgcgtaataggaattacggcctatccctgaagctttgcataggtcatcgatggtcattttggcgtctctgcgcctgttttcaattgtctctatcactcgttgagtgaactgcgattcatatttactcataactacattgtaccgaatttcggtacgtttgtaaatttcgtaccgtttccggttgacaagccgtaccgtatgcggtacgttaaagatatgcaaacgaaaacaaaactttcaaaaacttcggtgggactgattcaagcagttcgtgctgaggcagcaagacgaggggtaagcaccccggagcttgccaacagagtggggcgcaacaagaaattcttctacgaccgcttcaatttcaggaaggctttctccaccgacgatctcaacgacatcgccgtggcgcttggcataacaatggcagacatcatcagttcagctcgcttagccgccggcatgaagtctcctgacttggaggtaacagcatgagtgtctatcagaccccaacttggactcgccgccacgcgagactgactggctcccccagtcagacccacgtagcgacatgaacgccagccgcctcacgaacgggtttgctgcaactgagattgcagcacggcgttttcacgagagatatggacgattgcagccgcgagattcgctagaccgtacgccatcttccgctgagctgggtcagctgacagccttactgctgcattgaaatcatcgcaagcggaacttgcatagttctccgcttcactagccataaaaatcacctcctctccgaatcgagaaaacaatgcttagtcagaatcgtaacctctcccagaagctcgttgtggaggaacgtcgcacccgtgaatacttcaccggcaacgtcaccgaagatggtctaatcaacgcggaaatcgacaccgattacggtgcccgtcccctcactccgagtcaggcgcgtttcgtcgccaaggcccttgaagacctggccgactgcgccgacgagaagaacgaggaataacaaagtcttgccgtggccggtcggttcccttattcaccaaacaagactacaggcgaacaaatactgaccatactacgaccgttcacggcaaccatcggcccgtcccttggcgattagggggaatcggagacgccgacaaaccgtcacccattagacactcctgtctccgtttgaaatttcatgacggttggcgtgggaagttcaaatcttccacgggccacggaaaggataaatgatgaacaccaaggattatggacatcactgttcgggctatcagcaccctgacggttcgcccacacgctatgagacacgggccgtgagcctgtgcatggcgggcttggttcttggtgttctcacgcttctcttccaacccagtgcgggcccgtggagcattctcgcgggtttcctgtgctgttcccccgtcgccctgtgcttcatgttggacgacgaataactgaagatttccgggcgtggtcttttcctcatttctaactcgtccggtggtagccaagcgcacggtggccgcagccgagaagccttccaatggtcatggacttcaaagactgcaccgggttcgactcccggcttggcgctcagaaaaattgaaccccttcgcgtccttgcgtcggaaaccaataaaagggtttcggacgtgtcagcaccggcgtagaaggacaaccaaataatcaagcccagtggagggaaacaatcatggaactcaccccattcgaccgtatgagactgctcaacgaggcgcgtggactattgccgcaggacgagcttgaacgtcgggcgcgcgtgattctcgacgatcccgccgctccttctgagacatcgaaggaacccgactcgcctcgtcttatcatcagcgacttcctgcgctcgaaaggattcgagccgatgaagaaaagcgctctgcatttcggctcccgtctggccgagaactacaagatgaagttcggcgcctacccgccgaagcacgggaaggcctacatctactacgagatcgaccggcctctcatggaggagacgtgggctcagattcagacggaggacgccgactgatggcatctgatttcaactccatcgccaaagccatccgttatctcggtgattgcgtccgttatctcgcggacaagtatgtggccgtgaacgatcgtgtgtactcggattggaacgaggcctcgaaggtcgtgggggacgttggccgtgaccatgtggccgattatgcggaggcgtcgcacaagcagggcaagtcgcgtacttggcgtcacagtcacctgatggaacgcgaggaacaactgtccatgcagtcgaggggttctcatgttgactccgaatgatgtccggcatagaaagttccgcacgtatcgttccctgctttacggagaggtctacgacgcggaggacgttgacgattttctcgactcggtggccgacaccatcaaggttttaggcaaggaagtactcaaagcaagaaagaaaaggcaatgaccgtcgagcagatgaccgatgacgattacttcgcgttggacgcggtggatcagacttcgttgaagaaaatgctggtaagcccgttggcgtattcggattacctgaccggtgagcatggttactcttcggcgttggagtttggtaaggcggcgcacagcatggttttgggcagtggcccgcaggttgtggctaaaccgaatctgcgtaccaaggagggcaaggctcttcgtgacaggctggtcgaacagtatggtgcggacgacatcgtgtggctgtcctctgatgatgtggagaaggttcaggccatgcgggacatggttggagactttttcacgaagctggatggtcagccggaggtggcgatgatcgccaccgaccctgataccgggttgttgattaagggcaaggcggactggttgccgtccactcccgacccggatggtgtgctgcgtatccgtgattacaagaccacggtgaagtcgccggacgagttcgagcgttcctgctggcagtacgggtatcacattcaggccgcgttctacatgagtctctaccggttgacgatgcccgactataaggggccgttgggtttcgagttcatcgtgcaggagaagaacccgccgttcgactggatgcgctacgagattcaggaggattcacccatcatcaccgaactggcggaaccgaagataaaccacgccttgcagagcatcaaatggttccgcgacaacacggagaacccgttggaggcgatgagagcctacgggttgcccaaatacccgcaggatgtcgtgttccccgactggaagctgttggaggaagaggaggagattgaatcatggcggtagtcaagaagaaccgtaaggcttacggatacgattacgcggatttgccgtcgattctcctttatgttgacgaaaccctgcaccttgaggtcaggcagcatgtgatctacgatgtggcccctcatttcccttatgggtgcgtggtcacgtccatcaggcagaaggacggcgaatggtccgactggctggctcccatcccggttctcgtgggagacgagacggagggcggcaaccagaaaaggaagaacacgctggcgcaacggtatggttccgccgaaacgtatgcgcgacgctactcgttgaacacggcgttgggattgtcttccacggataatgacgcgcagacctccggtttccagaaacgttccgtcaagttcatgaccgacgagcagaaaacacagatcgaccggattcttgaagactgcaagattccggtgggtcaggagaacggtttcatcggcaacgttctgcaaacgcgggtcgcctatggcacgttgaccgaatatcaggcgcaacggttcatcgacgcttatcaacagcacaacgacaaggttaaggaggctcccagtgagcagtgagattggtttaaacgacgcgaaaccgggcatgtggatcgagttcgatgatgcgtacgggcattatgcgggtgaactgcatgagatgaaggattcggaagatgttatacactctctcatcctaagtatgagcgataggcctccactgtacatcgagaccgaggatgagggcaatctcgtgattctcattgattttggtgatgggtaccgtcacggttccgcccggaacgtgcacgtgtatgagtcgaagcccgagacggaatccgtcaagcaggctgaagatgatggcgggcaaccgttctggaaaggcaaaacctgcgaggagctagccggattacgtgtcaaggtaacatacaagaacggggccgtgcttaccggcgtcaccaacgaagatggcgacgttgtgatatctgattcaggtcgcgttgcccccttgtctcgctactacggtaatggacgctttgctccaacgatttatatcaagtccattgaactgttggatgatgccccgcgtgagcgtatcaccgatatcgcgaaggttcgtcccggcgacaaggtggtaatgaagaacggcaacgagtacacggcggtgaatgtgcgtcctgagtgtacggacggctcgtccctgcaactgaacgtcgagggtttcggcattgcagtcgctttatgggcggaggactccgccttccaatatgcgtatcgagaaccgtacacgatggccgaccttccgaaggagccaggattctacaaggctcgcaccgaatcggtgtggaagcatgacggcaaacgttggatgccggtgctctcccacgatggcaccatcgcccccgccttcccatgccagtcccaatcccgcagccagttcttcaagaccagtgtccgggatgatcgtttcccgttcacgaaggtggaggcgagcttcgagtgactttcaccccgagaccgggctgcaagtgcgcgagatgcctgtgggctcacggggacaagatcacgctcccccaatgccctacatgcggcgccactgattgcgccggagcccaatcacacatgctggtctgcaatcagacggccagcaagaaacacaaggtctacccgtataggaggtacagctgatggccggagaggcacgagtcgttttggagaacgccagtctgggcgctgacccggaacagaagcaatcacagtcgggacaaccgtatctgagtctgcggttcgccattactccttactggaagaaccgtcaatccggccagtatgaggacggggagacggaatggtggcaggccacagagttcgacacccggcagatggaaacctatatgcgtgaactgcacaagggcgattcgattcgcgtcgaaggcgtgttaaacattcgtctctatcaggacaagcagggtcagacgcagatcagccgcgaggttcgtttcgcgcgcatctcgaagaatcttcccaaggcgaagcaacagcagcagggtttccagccgaattacggtcagcaggcgaacaattacggccagcagggctacggggtgccgaactaccagcagtccgcccaacagctcaaccagcagttccagcagcctcctgtcgacccttggagccagccgcagggcactgcctctcaggacgagttcggcaatggttagttctaacccttcgcgtgagacgtgccgtcttgtggatagacgggatggcgaacgttgcgtgagatgcggggcgacatggaattgggctggtttctcccgtcatcaccgacatctgagaagccacccgttccccggcctgcacttgccatcgaacctgatcctgctgtgtggaagcggttcgaacgagggttgccatttgtgggtgcatacccatcagcgtgaggcgatggaacaggggtggatcgtcagcggtttaaacgaccaccccgaacaggtgccggtacgaatctacggcaagggccttgtgctcttggacaacatgggaggctacacgttatgcagttagaccccatcgaacaactctacaaactgttctgtcgtgaatcatcgttcaggccagccttatacaagctagacccggtgttgtttcgccggttcacgaacggggagattcgagtatgacacaggcgaggaagggcccacgactgccgttgaaccggttgggtgaggcgatacttgccggctcgtggctgtcaacccagttgggcagacgattgtatgcggctgaggcgcagacattcggacgcatggtgtacgacgagtgggcgaaaacccatccgggcacactcccctacacggtgagaatcgattccagtcagaaaaccgcgtacctgccagaagacatgcctctgctgcataaggcgctcacacggtacacgaacagcagatcataccaacgcatacaagcggaaatcaaaggagaaacaccaatgagtgagaaaccattctgggaaggcaagacctgcaaggagatggccggactgcacgtcaaggccacatggaagaacggcaccattgttactggagtgttagatgacgcaggagatattaatttaggcgataattggtctttgtacacgtcacgtggctatgactcttcctgtgattttgagccaatagacaatatccaatccatcgaactgttggatgaccccgagtatgagcgcatcgacaacatcgaaaacgtgcaggtgggcgatattgcctgcacgacggagggaaaccatttccgcgtcatcgatctcaagcctgaccctctaggcgacatgctcctgcgtatccgcatcagcgagatagacggtgagtactgcatcgactccgatgatttcgcctacgctttgcgtcggaagccgaagctgcccgaccatgacgggttgtggcgggataaggacaatgccttgtggagcgtcgccatctccggcctggacaattcgaagttggtcgctttgcttatcggtgacccggaatcccccgtcaccgggtctgtttggtcgggcctcaacagcaagcacgtgacctctcaagctccgttccgtccggccaaggcggtggaagcatgaacatccacccgatcattgataaacctccatcgtttccgcaaactgtcttacgcctgctcacaggaagcactcattgctgtgactggtgcgagaaacgctggatcaaggttcaccgcactggccaattggaatgccgaaaccgtcgatgtccctactgcgggcaatacggatgcccccgagccgaaaaacactggaagaaatgccccgtgtggaatcacacgatcccgcctgcatggctataccccgtgttgaatcggctctgcgaaagagatctgcaacgaatggcgaagaaatcgaggaatgatgcgtgacacgattctgtgcctatgcgacctgaccggtgtcatggcccgcccttgggtggaacacgggtatcaagccgtgttggtggacccgcagcatggttgcgaccatgaagacggtgcctacctgaaactggcttgcaccatcgaggaagcgttcgaccagatcagcgtactggtccgttccggccggctcgcgttcgtggccgggttcccgccatgtacggatatggcggtgagtggagcgcaatggttcgcccgtaagtacgaggccgaccacatgtttcaggcgaaggccgtgagcgttgccgaacaatgccgggtgatcggtgaaatgagcggcgtcccgtacatggttgagaacccggtgagcgtactcagccgtgtttttggtaaaccctcccacacgttcgacccgtgcgactacacggcctacgagcccttggacaattacacgaaaaaaacgtgcctttggacgggggggggattccagatgccgcctcgcagccaggacatgagcctgccggctcctgaccggaatcgtatctggtacatgagcggcaaggacagagccaacaaccgaagcaagacgccgctcggcttcgcccgcgcggtttacgaagtcaaccaaggaaaggcaacggaagaatgaatcttttaggtgaaaccaaggatgcgatatcacgaagcgggcattcgaccgatgacgttcgattcgtcggctcccgcgacggggagctgggaattccgtggagtcaggccgaaccggtgcttgacatcgattacgacgaaggatacggcggtcaggagatagccgccgatctggtcgtggtgttcactgatggcgggttcctgcgccgcgaggaatacgacggcagcgaatggtgggagtacgagccaccgttcagaggcccggagacgcagaagccgttcaaactcgtgaagctgaccagctatcgcacacggttgcttgtggagatcaattatccgatggaggcaacggaggaatgagcgacatgaggagcttcatcaaggttagccatgaacgtttcactttgattctgcgcaaggggatgctcccgttccactggattgcggagtctcatgtcttcccggacaagggttatgtcacatcggtgcgagagcgcgccaactacggcgcagtatgggcgttgagcagtatgggcgctctcgatcaggtcatgccctcgatctgggaggacatcaaatggttggacgaaaggatggactgatgcgttttcacaaaattagcccgtgtcccaaatgcgggggcaaggtcaaggcgaaatgggaggagcagcattatctgtccgctttggtcttccggtgcggcggatgcaggtataagccgtatgttctcgcgttgaagtcgaagcccgcagtggagtgggagtggccgaaagacatgatgctcgcagccgccatccgtcgttggaatgcgatgtgcaacggggacaagcgttatcggttgatctacgagagtctgggaggcagacgatgagtgtcctgtatcacggcggcgtacccgatctgaatacgggcgacatcatcgagcccggtcacagccgggacaatttcgacgactgcccgatatgccgcgcccgacgcgagcagggcgcggacgcacccatcgacgcgacactgcaccccgaccaggtgtactgcacccccgaccgtctctacgcgcacttccacgcgagcatgtacgggcgcgggaacgtctaccaggtgcgaccggccaattgcacgctcacccgcagcggcgaggattccatcgaatcctaccggtgtgaccggctggaggtggtcagggtggtggacgtgcacgtgacgctgacatggaaggaacgccgcaaactcgcccgcaagtgggccaaggccgacaaggagcacgacggcaaggcgttagacccgaatccggtgccgcgcaacgcgacccctgaaatgctagcccgctggcaggaaagggaaatcgcactcgcagaaagacagatgggaggcggacgatgaatgaaccgtttgacgtgcagaagatcattcacgaccgcattgtgatgcactccaagtatggcgtgcagggtgcttggaatgacgggtatatcgcgggcttgtcggccgcattgtgggccgtggtaacggctgacggagtgaaccgtaccggctgcaagcatttcgatctgcacaatcccggacaaaaggagatgggccttgagcattgagacggaatcgttcgacttgacctttggcagcatccactatgccggcacgaggctcactatcccgattgacgatgacgaatacatggtttatcgggtagagatcgccaatcatcggcgtggctcttccagcttggtgacgtttcacctcgaccgggacgactcccgcccggagcacaagaccgttggccaatctgcaagcgcttatctgagcgtggacgaggcgaaacaaatcatgcaggcactgcaacaggcaatcaaggaggcggacgatgagtgacaaggcgatgccgttgggcaggaagttcaaggttcggttgaccatcacgccggaggaaaccggaacgcccgtggacatgctgggattcacgttcaccagcggccggaacgggcatacggaactggacgcaatgtacagcaacattcccaaactggttgacgacgggctcgactcactgtcgattcttgtgatcttcaaaacactggagatgtgggcccagaagggatatgagctgtgccagcccatcgttcaacgattttacggaggcagacgatgagctataaggcgaagatattcacccgcgaggagtttcgagaggtcgtcgcagccgccatctacgactacgaacaagcgcccgcgaaatgcctctacacgaccaaggatgcggcagaccaactctacggccattacggcgaggaaaccgaggtggaggaatgaacggagtacagcttaccaaccatctgaccgcgcaattcagggcctcagccctgagccggtacgaggccagaatcaccgaggacggcgacttcagagcctacatatacgccatgagcctcaaacgtctcaaacgcaagtgcgagaggtacgcgaagcgtgaacgcaaggccatcgcatatgtcgccacgctcaaggagggatcatgagcgtaagtagtctcaaaacgcgaagaaggaattgaattgagcggctggcgtgacaaggccgcgtgccgtgacatggaccctgacctgttcttcccaaccacgtccagcgaggaacgattggcgctcaaggcctgcgcccaatgtccggcgatatgcgaatgcgcacggtacgcggcgcaacacgacagaatcagcggctacccattgcaaggcgtatggggtggcgtgaacaggagcagaagaaggaatcgaaatgagtgacaaggatatggtcacggtttacgaacgacgtgacggcagcaaacccggattatggtccgtgtaccggtatttggggtgggacgtgtttttctcgttctccctcgcggtgggcatcacgtcaaagaatacgatgatggccattgttcaagcgttttgtctgctggtttttcttggactcaccgtctggcagttgaaccatctgacttggagcatcaccgactatcgggtgcgtatcagctctaatttggagaagggggctcatgttgagcaaagcgaaaagtaaagcatggcaactgctcattgaagactcgaaccgtccggcagaggagattcgcttggctaccggacttcgggtcgatgtgatcgagcagatgcgcggggacgtgcaaaaacgactacgagacaacccggagttctgattatgagaccgagttatctgcccgtccagtatgagcattgcccgtactgcggaggaatcttgaacgtattcggggactgcgtggactgccagtttcacgatgacccgactgaatggtggatggacgaatgagccgacagaaagccaaaggcacactgcttgaatccaaggtggtcaactatttgcgcgcccggttgggtgacagcgagcagacgatacaccgtgaagtgttgcatgggacgaaagaccagggcgatatcaccggtctgcgtatccacggccagccggtcgtattggagtgtaaaaactacagcacctatacggggagactcaaggagtggatgcaggagggccgtaccgaggcgggtaacgctgacgcaccttactggttcgtcgtgttcaaacagaagggtctcggcttggactcgctgtcaagcatggacaaccagcccgtgctcaccgacttaaagaccctcgcattgatagcaggacatggaatcatcgaaggagacgaagaatgagctacgacctgttcatagtggacaaggatgtgccggaaccggaatggtttgacgtatgcgaacgggacggcgagcatgtgcggaccgctcatggccattatttcaactacacgtataatctatccgcgtttttcaccgattacaaggtccatcctaagcatgacctggacgggttgacggccggggaggccgcagcccgtatcgacaaggcgttgaaagacatctacttggaaccattgtatgttttgcgcggcaaatacaatccgccgaactattggggcagcgtggacagcgccatcgcatggttgaaactgatatacgactattgccgggaacacccggactatatcgtgagggaacgctcctaaggggaaatgatggaagataggaaactcgttgatttcgcccgttggctgaacgatcatccgggcgaatggaatctttggccgtatctcattctcatacaggccgaccgcagggataccgtcgcatcgatgaggcttgtcatggaacgcatcaaaaaccatcagtacgacgagttccgcgtggacaccgtattgctcgaatacgaactattcaacggtttcatgggcttcgataagggcagcgtgcatgaaaacggtctcgcgttgaagatgaggctcaaagcatgaccgcgcgggggacgaccggaaactcatgcactggatagcctcacacggatacacggtggtcagggccacgaccggccactggaaagtctacgacaacggcgtgctgctcacggcgacgagcggcacgccatcggactggcgaagccgccacaacttcatcaagacgttcaggagacgatcatgtcagaccccgtgaacccggaacggctgctggaggaggcggaatgagcatcgtcggcttggcgcatttcatcgaactggccgtgttcttcatcatcgggatacaggcgttccgctacctattcaggaaatggaatatatccctatccgatgaaggcggcgacgcgatgacgatcgttgccttcagctttggattgatagcggctttcgcagcgcatggcgtctgctgggcgttcatgcaaatggtgttccccgattacacgtactggctgataggagcatgacaatggtacgcaaaggatacgttcaactggtcaacagcttctacatgaaccgtaaggtacgcaagctcaggcacacatgcccgagcgcaataggcgcgttcacgatgatgcttactttctgcggagacaatctttcagacggacatatcagcgaagacgatgcgttttacgtgttggatatcaccgattcagaaatcgatgcgctttgcgaagtcggcatgatcgagccggacgggaacaacgggtactacattcacgactatctcgcacacaatcgaagccgcgaacaggtgcagaagaagcgcgaaagcaatgctgaaaattaccgaaaagataaaaacgaggcgaaaacctccgattcagataactttcagacggctgaatcgcgtctgaatcgggacaaacaccagaacaccagaacaccagaagaattatctaaagataattcaactccccctacccctcgaagccggacttcggtaatctgcttgaccgtatcgaggctttctatccgacgaacaggtttgacgggaaaacctcccagtcccgtatgcagctggaggtcgattggccgaagatcgtgaaagccgctggagactccgacccgagcatgtttctcgaagccaaggctcgagcgtatgcggaggccaccgacgagcagtacgtgaaaacgttcagccggttcatcggcggtgaactgtacgcccgcaactgggagaaacccaagcccgaagcgccgaagccacgaccagggcaaccgttgaaatcccgaagccagcagaaccttgaggcgaatctggcgaaaacatggcagtacatgacacccgaggaacgtgcaagataccagcagcagggaggtttcaatgctcagcaggggtgaggcagcagctgtattgtcgcttatcaacgcgcatcacggcaacgcgcaatgggatgacgttcagcttgaagcgttccattcggaactgaggacggacatcaccgccgccgaggctcaggaggcggtgagacgcttctatgcggagaacgataccggccgttggtgtggttcgggtgacatcaacgccatcgtccgccgactgcgcgtcaaggcgaagccctcggaggcggagatcgcgcgtgagtgcgatgcgcggggcttggagggtgacgcggcgtggctgtaccggcgtcagcgcatgttgggccgtcaacccgaggaggcggctcgaatcacggcctcgagtcgcaacccgttggagttggagccggcgaagccgaagcggcgtacaccggtacggcatttcctcggcgcgggcgacttggggttgggtgacatactgccgcgacacgccgaaccacatttggaaaactagagacgcccgtgcattattggtcttgctgacacgtccgaagctcttaatgagtgaaggtctaggtcagtttgtctttttcccctgaaaacacgaggctctgccgctatgacggttgctggcgggagatcgtgaccgacgcgccgtccatgctcatcgggcatgggatacccgagaaccggagcctgttgtgcgcatggcatgaacgccagctctccaacgacctgcaatggttggaacgcaacctgcccgacctgaccgagtatcgcatcaaccgcgcctacgggcacaagaacggtggcggcgggaacgcgggcacggctccagcgcccgtaagggaaaccctgcacgacctgctgtacgctgacgacgaccacggttatccgggcttgcaaggcacactctacgagtgggtgcgcagcctgaaactgaacctgcgtgaatcggcgccgctggccgacatggtttaccgaatcgccaatcacccgaaactcgacgagcacccgtccacgcccgtgtacgcggaaccggttcacgggctggtgcgcaaactgcgtcgtttcctcacggacgatgacggggaaaccgtgttgtacgggccatgccccgccaacgggtgcctgggccagctctccggctatgcggacgcggagacggcgaaatgcccgcaatgcggtttcagtatgccggtcgcccttatcagggcggaacgggtgaagcgtctcctccaatcggaggcggtgagaacccgtggcgaactgttggacatcatcaaggcgtgcggaatgcgcgtgaaccgcagcactttgcgtagttggatacatcgaggccagttgccccagcagggcgaggatacgtacagcaatccgctttaccggttcagtgatttctaccgtctcgcgtccggcttgtcggaggacgcggacgtgtgggagatcatgcaggtttcgcaaaaccaatccaaggaaggagacaacaagtgagcaatcagattcaaccatttgacttcaacggcattcaggtgcgtgtcctaaccgatgaacacggcaacccgtggttccttggagcggacgtatgcgccattctcggtacggccaccaaccatattcgggaatacctcgatgccgatgaaatcaccaatatccgtagtacggatattgctcagaacggcggcaaggcacccgttttcgtgtccgagtccgataccagccactcagccccatccactcgtcaggacggggcacacaacttcaacaagcaaagggaaaccaatgagcgacaacctcaaccacatcaacgcgcgcatcggaggtgaggcatgagcacgatacgctacatcagcctgttcagcgggatcgaagccgccaccgtcgcatggcgccagctcgggtggaagccaatcgcatacgcggaaatcgagccatttcccaaagccgtgctcagacaacactatccggaagtaccagatttaggagatatgaccaaagttgactggaaacaataccaccatgcggcagatgtcgttgtgggaggaagcccctgccaagccttctcgatcgccggcctcaggaaggctttggacgatccacgcggccagctcatgctcgaatatctccgagcttgcgcagagattgatccggaatggatcgtctgggagaacgtgcccggagtactgtcggctgaacacggacgggctttccaatcgctccttgaagccgtggccgaactctggcctgatggcggggcggcatggcgagtgctggacgctcagttcttcggtgtggcccaacgacgcgagcgtgtgttccttgtcatcaacactcgagactggcgacgtgccgccccggttctttttgagcgcgaaagcctgtgctgggattctgcgtcgagccgagagaagagggaaacccttaccggtggaactgcgaacgtcattggaaacgcagattcacacgttggagaatgcctgacacccggtgagagccaggcacgccgcgtgtatgcggctgacggcgtgatgccgacgttgaacgcgcgtgagcatggcgggcagaaccagcatgcggtcatgctggacttccaccagcaggacggcaggttccaggcgtcgaaccatccagacgtgtcgaacacgctcaccagccacatgggaaccggtgggaacaacgttccacttgtgaaagcgttcaaatggaatcaaggggaacgctcgcgcagtctggcgatcggtgatgtgagtccgacattgagcaccgaccataatccagccgtctacgagatagcgggaaacatcatcggtcgcggcccaatgaacggcggataccagcttggtgttgccgacccggacgaaaacggcgctttcacattgacttccaccgatagacatgcggtggctggaatcgagagagagagagaagtgatgtgccgggcggacagccaggcgaacgccgcattggactccgacctcgcgccgaccttgatggcgcactccgcgaaggacgcgccgatcatatacccatcatgacaagcaacggagatgacgtgttccccgcgctgtgcgccactgacggaagcaaacggttcatcgacaaccagtccatcaacggtgggcgactactgatcgacaggaggcgaacatgagtctcgcattcaaaatacgcggagggaaagcggggggtaagggattcctgggacaggaagagctttccgccacactcagcacgcacaacgaccaatacctatacatggaagaggattcgatgaaaggtttaacggttcgcaggctcaccccgttggaatgcgaacggctccagggattcccggacgggtggacggatatcccgtggaaaggcaaaaagcattcgccggacagcccccgttacaaggcgttggggaattcaatggccgttccggtcatgagatggataggcgaaggaattcaactcgtcgaagacaacaaggaacttttcaagaaggacaaccaatgagcactgaaatacaacgattcgacttcaaaggcgctgcactgcgtaccttgaccgatgaggcgggggagccttggttcgtcgccaaggacgtatgcgacatcctcggcatcgataccaatcatctcggagaaagccttgattccgacgagatgaataccctccgaattacggagggaaataccagaggcaatccgaataagaccatcattagtgagcctggcctgtatcgtctggtcatgcgttcgcggaagccggaggcgaaggagttccaacgctgggtgacgcatgaggtgctgccatcgattcgcaggcatggtgcgtacatgaccgaatcgactttggaaaaggcagtcaccgaacccgacttccttatccggcttgccacgcaaatcaaacaggagcgggcggaaaaggagaaggcccaagcacaggtcgaacggatgcgtcccaaagcgttgttcgctgacgctgtggaaacctcgaagaccagcatccttgtgggcgacttggcgaaagtcctgaaaggcaatggcgtggatattggcggcactcgcttgttcgcgtggctgagggacaacggatggctgatgaaaaccggcagctctcgcaacatgcccacgcagaaatctatggaattgggcttgttcgagatcaaggaaaccaccgtggttcactcggacggtcacacgaccatcaacaagacgccgaaagtcacgggcaaaggtcagacgttcttcgtcaacaagttcctcggacacagggagattactcaatgagcatcaatcttggtaccacggaagtggaattgagcttgtactccaaggcgcttcaactagccacgttcaccgtggaagtcccggtggtgggcgaactggaaccggacagcgtgtgcataggcgacgacatgcagccacgcgcgcacgtgacagtgacgctgccgcccgacggttccgtcgaaaaggccgttaaagccggggtttatgcgttccagaaggcgttcaacgagtcgatggaatcgaggaacgtatgaactggctgaagcgactgctgcacttggaggagccggaacctaagctaccggtgttggagccatgccctatctgcggacgcacacccaagccgaagtatgtatacgacgacatccttacccgctactactgtcaggaagactccgtgtggctgctctcggagtggtgcgatcattccgcgagtatcttctcgtttgccccgtttgagggcaaggacgttccgaagtggaataccggttgcagactgttaaggacaattgctgccgtgccagttcccgaatgccctgtctgcggggagaaacccaccgtgcaaccggataccgagtcggatattccccagcttgtctgctcatgcaacgaactgttgggcaacgatgggataaccaacgtctatcagcgcaaacacgagtggatacgtcgttgcgtggcgttgaaacgcaagcaggacaacgtgagtgaaatggaacaactgatcggagaaacacaatgaacggacattatctcatgagaatgctcaaaaacccgtggaacgactctattccgagtgttccacgggttttcttgtataatcgggcccatatttatggttatcagttattagcatcgtcattctataacagataatcgattatctgttatcgtcttaacgattccgccacggttcggctagcctcgttggtgacggccagacggttcatgtcgtagcggtcaagcatctcgcgcgtgctccagccgcctgaggccatgatctccctgtcggggaccttgcggcgtcgtgcttccgtggcgaatgagcggcgcagcgagtgcggcgtaattctccgcgctgccttcactttttcgcccaggctggtcacgacgccggcaagctgcggataggtgacgcgcttgcccctccagacaagcagcggccctttccgacgttcgcctatcgctcgttccaccgccttggcggcgcgttgccggccatcctctaccagatgatcgcggatgaccggcaaccatgatggggtgagccgcagtttcttcttccggctcatgcctcttccactttctcggctttgaacgtggaatcgtattcatcgtaagagatgtcgctgagccgcctgtatccggcctccttcaacgccttgtcgatatccggcgaccaatcggggcccgaggggtcggacggtgtgaacgcgataggctcgataccgtcagtgtcctcggtttcggaatgcagccaccaagggtcgtcttcgtacactttgtcggcaccgtctgccggatagaggctgaagcggaatgtaatcatgataaatttcctcactttcctgtgaggcgtgctatgctagtgcacgcctcaaattcgttgaatggttttgttggcatacggctggaagggcctaatcttccggccgcatttttttactcgtggtaaccgcccgtcaattagcaccggacacgcactagttccaatcgactggggcaagcacccgtagggtttcgtcattgttgacgatctcccacaatctcgccatgtcatcggccttgatctgcgggtaatcatcattcctgtcataaacgatgtcgaaaccgtccaatccggtgagataatccttgatattgaccaagcctttatcctcagccttatcgatggtgccggtggaaacgagcgtgtcaccgaacggggagagtcgggggacgccatgccccgaatacgtccaattgccgataatcacgtcattgttggggaatatgatgattccgctctcattgttggttgcgtcgaaaagcgtgtcgaagtcagtcatggtagctccttgggtatggttgcaaaacgtcccgaacgatatgctcgggacgcactgatggtaagaatgtttcaatccacgcccggaaaccgggtgacaacacggcattgaacgccggtaatggtcaagtctagcactttttagcgtcggtgtaccggctcggcacgggcgtggaatcgccccactcgtccattgactcagaagtcagctcccacaagcgttcgaccttgagcttcccgtcctggaacagcgtgtccgcgtaatctcggagttcgtcagcgtcgcttgcggacaatccggcgcggccgcaagcctccatcacatcgtccatcatggttgcgtcgcctttatgagcctgataccacgtgacgatacgctcgaaatagtcgagcggaagcgccgaagcgttagagttaacctcgaaatctgacctcatggccgcgtacaggtttcgacccagctccttgagttccctgacgctctgagaaacgtgagtaggcatgatattcctcctgaaaaatgttcgggcacgacagtcgccgtgccccttgtgttttggtttgctaattcccagaaggtcacaagatagtcctatggccttcagtgtatcaagattttgagtattccttgcatagatcggcggcgaacttgctgagattatccgggtcaagcacatagctttccccgtcctcccccgcttcgtcataccatttccacacctcatgcaaggcagcttccatacgcttggtgttcagaccgccgatatccgagttgccggcgttcccgaaaccgtcaacgactgagaaagcctcggtcagatttttaatgccaagaatttcaacgccttttataacgcaagaatcaatctcagtcgcctcgctatcctcaacgctgagatagtccagaaagctcgagtatggcaccaagacacgcttcgcgccatgcttaaccgcgtaggccactacgtccttggcgctaatgggagtggaatgcacgtcaccatcggcattgattttgccgatagccacaagccccctaagcccagccaggtagacgtggagatcataatctggattattattgtattcagccagccctcgaaccaccaacgctatggcaaggtcacaaattccgtcagccttgcccattgacgccggcgcaagattcacgttgatgcgacagtcgggccatgtgataccgcttgcttgcattccgaccttgatacgctctcgcgtatcggataggcttgcgtccggtaatccgataagactgaaatatggtagtccctttcgtagaaacgcttccaccgtgacgccatacaggtgcttgccggtcgtgttaattgtcttgcatacgatgctcatttgattacctcctgattccagtccaacatgtcagcggccaaccattgaccgccgcccgaagcattcgcgtacagccaagcccgatatgagattcgagccgccttatcgcgctttacccatgcctgaagccacatgagacgcaacctccagccgggtatgcgccgccacagttccgtgttcgtggccgggtcgaaacgctcataacggtagacagcggtaatcattccgactccctggaatcaagttccgtaccatcctggcgactggcggcgaacacgtcactgccgatatcgtcaacgtcgtatagatcgccgtcaccgttctcctccacccaatcgcacagttcagcgaaggtcaatcccttgggagccttgacctgccggtattcgattgtcgtgacatgctgggagatacggtaggtctccataccgtcgtcttccgccatcgcggcgaaaaacttcaagctggcgcggaccttgcgcatacgactgtacgccgtatcgacaggcacaaggtcattcatcatctgggccacgtcatcgtcggcgtcatagccgccgtccgcaagctccctcaactggttttgtacgtgctccagcgaatcccattcgatgaaaaactcacggccggacggcaacccatcaaccttatatccatccaatacccacaggacccgcgcctcggacatgccccgcaccttttggcatacatcccctagccccgagccctcaatcaacgcctgcaaattctccaacttgtcttccatgacaaaaccttcctttgtattgttcggtaaaacgattgacggaacaatagaacgctctaaagtcccgtctaaatgctgatttatgtgaaaaccgcaccatagaaagccctatgatgcggttctaaatgatggtttctataagaatggcctcatagaacaagtccatgaggccatgaaaacgataacggctatacgctccgcctgtatggtggaatgtccaacgtggcttccaatccgtcgttaacatgctccgcgtccctcaacgagagtcgtccgaaccattgcagcagttcgctcctgttgaagtagaagcgttgcgaacagcgcacgagtgacggcttcaacagcccctcggccttccagtcgagcagcggcacgtcgccggcctcatcccaatcagtgttgccggttatcttcgccacgatacccgacaccagatcaccgtcaacctcggtgattaccacgggacgcggcttgccgataccgggatggtcgggaaactcgacccacatcagccacacgtcatacaggcgcggttcacttggcgtactggtcatagacagcatcctccgaatcattccaatcggcgggcagtatcacatggcccttctccgaacgctcgaacatgtaggcattgtgaacaggcggcaccggatagccgtccggcgtgtgccgcgtcggcttgaacggcaacccgttgtccaccagagactggcgtaaaaacatgttgactgcggtgctcaggctcatgcccatggaatcgtagagcgcggcggcacgcgccttgacatcatcatcgatattggcgaccagcttacccataataaacctccttaacggttaacagatggtatcaatcatataccatattgggatagaatagtatccgaatttttactagtagatgtaaatctcacccgccttgtgtttccacccgtccggcgcgtcagggaacgccttacgccattcaggtgtcagagatccaagcaaatcggcgtaatcatcaaacgagaacacgtcttcatactgtgcctcaatatcgtgtgccacaccgtccagttcgcccaacatattcatgaactgttgagtttcgccatcgggatacacgtattgggtgatcataaggttactccgccagtcgtccaagtattctcggacgcggtaatcgatcaacgtaagtttgatagtggcgctcatagtaatctcctaaaaaagtattggtttggtttataggtatgggatgccgtccagcggaagtgaggaaaaatgctggacggcaagaacttagaacagcggcaaagcaaaccgcttatcgggtaaatcggtggcgttcaacgccgccagaatcagatcggacgtatgcagtggaatgttggcacgcacggccgcgatattcccggcagtgtaggcgcaaccggacgattccagcacctcacgaatcttcgccgtggatatcctgacttccatcacagcactcccagcaaatcatcgacaagcatggcgatagcggtttgataacgctgatacgtggtggaataagcacagtcgtaaacctcacgcgctctcttatccagcacgtccaacgtgaaaccgctatcagcggtcaaacgttccatttcatcattgtcaggcggcgtactgggcatacagccgacaccctccaaggtgtccatcgcgcgccggcgtaaatcatcgatgaaaccatgctgaccatcgaacacggcggatagctcatcttcgttgtcatcggccatttcccacgccgacttcaacaacagtcgcgtggccttgtctctcagctcgctcatgtcacgccgccttagcccacaggttacgggcaacggccacgtaatcggccaccgcctgttctaactgcttgtcactgccacgctcataccttgcacggtaggcgactacgcatttgccgttggccgaagcgatgtacgccacctttttacccttgctggtacggaacgccttgatatggcccaaaccttgcagttccgggcattccttagccatcatcaggtcaggcagagtcgcgtaggacacggcaaacgtgttgaccttgggcgggacttcagggatctcttgagtgatcggggccggttcatcatcaagaaactcatcctcaccagcccatttgctttcatcttcaacctcggtaggcggcagatgacgcaccataccttgcttaggccaatggtcaatagtcgtaaaccgttcgttctcgcatgtccaacgggactcaaaatcagccaccgtgataccggaaacgcttttagcatccatccccgtcagcacgggaaccgtgaacccgtaagccttacgctcattgtcaggcaccagaaaccagccatgttcaaggtcggactggcttgctttcataccatccaatagttcggcgtatttcttctcacccttggcctgaacattccaagacgtgccagcggacgtttccgacaatcgccagatacgcttcagccgggcgtttacataccgcacgtcatacttactattgtccttacgcaagcgtacccacatgccgctcacggcattcacgttacgcgacgggtcattagccagcttcttcattttgtttacctcatttcaaaaaaatcgattgtcagatctgcacgccacggtgataggcgtaatcgccatacacgcaagtggcagtgtcgttaacgccgtaaggcgtggaacattggggagtcggctggataaaaccaacccacctgagaaagagagtggccgcgactagcgcggccacaagcagaacatgacggactctcaacactcgccatcctcagtggcttcagtgtagaaaacgtcgtccatctggtcattatcaaaacgctcattgatgtaatcggacaacgcttcaacgtcgccgtcgttgtagagtcgggcgattcttccacaccctacgccgttgccttccagcatgtaagcgtcctgggcccagtagggttcgcctttgaaagccgcgttatattcggtttcggtgacatacccgtaatcgcccagacggtagatgccctcacaaggctgaaacccgtcataccggcatttaggcgtaagtttcgcgtcaacacgctccaccatatccgtaatatccttagcggtaatcattgttagctcccttaaaacagcgggggcacggctcccatgccatgccccgaaacgattgatttaacgatggactcgcaccatgtagccgcgtccccagtggtcgatcacggcaatcactctgcgtaatacctagccgggttattctgcatgtcaacacgccgccatgccctgaccagttcgacagtcgaagcataccgttcaacagccgaccgactacggtcgtaccggacggccatatcattgtcgaaaccgataaccgtgtccgccatgatatgacgcgcctcttttgccgtgatggcctcacgatgccagttgccatcaaaaacgtcgtcggcaacccaagcgtcacgctcagccctcgaatcaaacaccatgagataccccggccatgacccgtcatcccattttttgccgacaccgtaagtccagtagaaagcgtaatgatagcgtgccatcatgccacctcgccatcgaagtgacgttcggcggctaccgcgtacagcacgtcatgcatggtgtcggtactgtagccgttgatattggtgacaacttgcaaagtctgctcggacacaccgtaatcatcttttagcgcgtcccacatttcctcgatagacattgttgaatctcccttgaattgatgaagcgcggagacagccgcgcgactgaatgaacttgggcggagaatgccgcccgacatgtaaaaggtcacagccacgggttacgcgcgaatacgctcaccgtcatggtgtcctcatgagcttggtacccgtaaccgtcaggcatatagacgatatccgtgtaaggcggttcgctaccgtcgcccgcaccgtcatgccaatagcactgcggcaggtcggaaccgtcttcgagctcgcagtagggcgagttgacggcaagattgtagacgtcctcaaatgtgtaggatcgcggcgcggcctggggcaccgactgcgccggcgcggactgtaccgactggctgacaaccggcgcggcctgaaccggctggctgacaaccggcgcggcaaccggcaccaactcgttaacccgcgcttgtacagcgtcataattatcaccgagagcggcacgcctcgcctcaccgtcaccgtactcaccacggataacagcggcggcgagagcgtcaatatccaccggttccggctcactgacaagcttggattccggcactggtatcggaaccagcacgtgaggggtaacgtcctcacggataggctgagtagtctcggcggcattggccggaaccgacaccatgccgcacagggcggcgaacgcggcaacagccgcaacaaacttcttacgcatgatagtcctcacttccatgtgaggcggtacaatgagtaccgcctttttaatctctcaattgataaaggtcagccccgcaagtgttggcgcacttacggggcatttatgttaggccaataggcccagtgcctagactatgggataaacccagtgagctaggccaactgtgtacaatgcccacagtcaggcaaagaattgattagggcgcacacctagctttcgctagtgttttcttttggcttatcagcctctaacagcttgcgcggattactgaccttgagcgcgtcagccaccttgatgacgacgttaaacgaggcgtcacctaggttccgagcgccggtctcccaagcagctatgcgctgctggttcacaccgtctaccctatcggccaactgcttctgcgtcagccctcgcttctgccttaactccctaagactcatggctcacctcgctcttcgctacagtgagcccaattatacctttggcttaatcgcagacggggtttctgatgccatcgcaccgcgttctttcagcggcccccgcactactcgcaaggcctctgccttgcttcgctatccctcaccggcctgtagccgggatgtcggtatcactgttcagttatcaaacttctggactcacagactggagcctgtctagcgccctgaggtctgtggtctctgcttggctttccgccttgcgtggttcccactatacacactcccaactgggagtgcaaatcaggtacggcacgacaccacgcaacccgttgcaaacactcgcatctctcggcgtgtcgaaacccacaaaacacgacacaaaaaccgcgcggcacgacaccacgcaacacaccaccagatcacagacccgcagacacagacacagccatgacatagaggcacaccaccacgtcacaactcacagacggataggccacgtcaccaccacgtgacggactcacacggacggatagacggagagggacacgagacagtcaggacagccgtacaacacgaccaccacgtcaccctcacactcaggcaacaacgcataggtacatgcacacacgggtaccacgaccaccaacataggggcggagaggggtaccggcacccgttatacatttggccgctaggtgtctggtttcgcccgtgaatgccgctcccagacttttttgaattagcgtgacatggtgtgtcgcaccaatgattgcaacggttttcgggctgtggtcttttccggtttctgtgcaacgcttgttgcaacgcttgttatgagtaaactgtcgtgtagatggattgtcggggattggagcaaggctcagattcctgacaaattattattcaccccgtatgccattggcgtcggggttttgtttttgccgtgccttcagatcacatcaacagacagtgttggtgtcgtttcttgaaccggggcgcggtgtggacggttggcagagtccggttgattgcagtggcttgctaagccgccgaacgtcgttttggcgttccgcgagttcgaatctcgcaccgtccgcgaagtatcgagggtcgctcccttggtgctttatgaggttggctgaataaacccggattgcatgtatgccgggttaaggctgcgtcacggcttagcggcaccctttagcgggggaagtgtgacgaggaacgctacagcggtacacggttagtgcatcacatgctcggcgttggtggtaaaacgcaatccaccacctcgcaattcttagctcatctacatgtcgtagaaggagtttcctaggtcgtttctatgaagcggcctttgttttcccgatctggtctgctacgtaggggctgggggtggatgacctacgggtcgcgccacaatcggggtctggcggtaggcacgtggagtgcgcgtcggctgtaacccgactgcctttggcaatgggagttcgattctccctgccgccacaatcgcaatgtagtgccaaatatctggttgttaggactggggctgaatacctagggggccccggtcgcagagaacgtcgggtagcgcccggagatcgtcgcattatattcgtgcggcgcgttgcgagatttggagaggccagccgattggcggcggcaactgttccgaaaacagtctgcccttacgggcgtgtgggttcgactcccactctctccgcggagacggctggtcggacgtctgacgagcgaaatattacgacctatatgcccgtggccgagtggttcaggcaccggtctccaaaaccggttacggaagttcgattcttcccgggtatgcgatgccttgagaagaggcagctcttggcggtgacagcttctcagtcatcgccagtcgccggcggcggcttcacgccatgccgtacggcaataactgaatagccttcctctagtgggaggcatggcattgtagctcagtttggtggagcggacgcctcgtaagcgtcaggtcgccggttcgagtccggccattgcctctaggtgccgtccgaccgcagaacacggcctttctctcgctgcttatgctgcgcaacggacggcaccgtcccctttatcaaggagtcgtcatggcttggtcgagttcgaatcgcagggaacggttcaatccgggttgggagcggactcgcaagctgatattggagcgcgaccatcatcgctgccagtggccggtgaccgacgagttcggtttcactcatatctgtggccgtccggccaatcaagtggatcacaaggttcgcaacccgtcgcatgacgatgactcctccgagaacctgcaatccctgtgccaataccatcacgagcagaaaacctgtcaggagtccgccgaacagcgtcgtaagaacagggagcgtcggaaggaagaggaatggtattcgcatccggcgtatcgacggactgtctcgtaacgggttgcggcgagcttgccgcggccgatggattgtgccgtagccattacaatcgcaaggcttattccggtaggccggtgacgcctatccgtgcccgtgtgtgtccgatgtgcggtatggcgttccagttgacccgatgctcgaagattttctgttcccctacttgtcgcaagcggtttcaacggtttcgggcgaagcacccgtatacaacattggccagtgccccaatccgattatcgaatcggagcctttgactcccgagccggtgcggagcatgacgtatggggctttcacggaggctgatatctgggccaagtgtgatggtacttgcaggggttgcggcaagccggtttcaaaagacattgacagtccggacgccggtactcccgcgtggattgtcccgcccgaggacggtggtgagccatcgttcgagaatcgggcgattttccattacaggtgcgtgcgacgccacgtctgacgcgccttctgcagaacgaagcccgtcatgggacgaaagtggtgagtcatggctgggaacggaaggaaggcggcgaagcccaagacgggtggcggctatgaggtcggagcgccgctggccgaggtgccggaggattggacattcgaggaattggagcccatcggccccgaactaccggacgcttccgaactgaatcttcttgatggcgtgtggagcccgttcgtccgtaaatactatgacgctttccgtcgtacccctcaggcgcgccagttgcgcacgaaatgggagtggtggaatttcttctacaagctggccgtcatggacaagagcatcaagaaacgctcctatgacggtctggccccggagatgcgccagtccatgaaccagtatggtgatacccccgacgctaaacgcaaactgaagatggaggagtcgcaggcgaacgacatggccgctgggatcgtgggcttccagattcccgatgacccgaacaacgatttcgatgatcgtgcgcgggcggtgctctgatgcatgatgtcatcccgaaactcaacgcgaaggacaggcagcgttcgctgggccgtcttgcggtgtggtggatcgaaacgttcacgctcatcggtcgcggcgacgcgaagggcatgcgtatccgccactccccgaatacttccagttcatcatcgactgctatgcgctcgaccgtaatggtaggcgtaggttcggtcaggtgttcctcgcccgtccgaagggctgcaacaagagcggtttcgccgccgagatagccatgttcgaggctttcggcccttgccggttcgctggttgggcgaaaggcggggaaacctacacgttcctcggcaagacctatacgtatcgcaagggcgagccgatgggccgtcccgtgaaatcgcctctcgtggtgtgtctggccaccgcggaggagcagaccggcgaggtctacgacaccatctactacaactgcaccgaagggtatctgaggttccttgccggcgatggcatggatgcgggtaagacccgtatcctgtggccgaagaccggcatggagattcgatattcgacagcagccgcgcgaagcaaggacggtggccttcagacgttcgtgtgcttcgacgaggttcaccagtacaacaacaagcgcctgcgtgacctgttcgacatcatgacgcagaatcttacgaagcgtggcgtcgccgccgacccgtggtatctgatgaccacgaccatgtatcagccgggcgaggacagcgtggccgaacgcgcgttcaagacggcgcatgatctcatggagggccgtctgcgcggctgggaggatttgctgttcgaccatcgttacgccgacttggcgttggacgatttcgccgacgacgagaaacttgagcatgcggtctacgaggcgtacggttccgcgatgaaatcgcctgacggcaaggactacatctttctccccgatgggcgcatggtgccggtcggccctgatgggcgttccgccgaaggctggtcgttgagggacgagggcgtcgagcccggcccttcgaagtacggttggtgtgatttgcggcgaaccgtgaagaagattctcgaccccgcgtatgacccgaacaacgccatcaggttctacttgaactcgttggcctccgccgtggatgcgtggctgaccgaggacatgattaaatcgcatgcggttcaccgcgacatcgtggacaaggccatcgcctcgcgtgacctgaaccggttgaacgacgcttggcagcaggtggtctccgacaccgatgaaatcacgttgggcttcgacggttccgtgtccgatgattccaccgcgctggtgggttgcaggatacgcgacggcatgctgttcctcatcaaattggagcagaagccggacggcccgcagggcgcgaaatggcgtgttgaccgtgattcgttcgacggcagggtgcgttgggtgttcaaccattacaacgtggtcggcatgttcgcggacacggacgaatgggagccgtacatcgcgcaatgggaattggattacggcgacaggcttcaggtgtatccgaggtcgaacggctcgcacatccgcttcccgatgaacggctacaagcgtgacgtgatgagcgaactgaagaccatgcgcgccgcgttcaacgagcccatgagaaccgtatccaaatacgacgagcccgatgtgacgaacatccaactgttcgccgaccctcggctcatcgaccatttccgcaacggacgccgcaaggacaagcccgaaggatacctcgtgttcaaggagaccccgaacagccctcataagatcgacgccgccatggccgggctcctcgcctaccgtgcccgcgacatctacttgggtgccgccgtttccaacgaagaggagtcgttcgcccccgtgcgcgtctggtgaatctgatgaaaggaggccgcattggccgaactgcagagccttatccccggcgacgaggagcctgacggcgatgccatgctgctgacccagctggcgaacggcctcgtatcccgtattccgaccctatgcacgttgaagacgttctatgacggcaaggagcaggtgccggtcaaatcgattccgaaaagcaccaaccagtccggctacgcggtctaccagaggttcgtctccatctgtcaattggatttggcgaaggccatcgccgatgcggtgatacaccgccagcggcccaccgggttccggctcatcgccgacaagacgatgcgttccactaaggcggacgacatgtggtctcagtgccgcatggaattgaagagccgtcagatgttccacgatctcgccgtatacggcaacgcctacgcactggtcaacaagaacaagctgccatcgcatatcacggtgctcagcccgtggaacacgtacgtctcctcggacgaggattcggcggtcaactactggtacaaggccagcgagggctgcgaatatctcgccctctaccgtctgatacgcaatgatgacggcagcgtgaaggacgtctactgccgcatcgcctacaacgagaccgactcccgaagcctccttgaagaaggcgacgaggaggagatatacggcatcgccaacgacgattccaagattcatccaacgctgtcacccacgttccaatgggatggcggtgcggaaagctcctatgatttcgcggagaaatgcgaatgccttcccatcgtgcgcatgcacgcgccgggcggcaagggccagttcgagccgcatatccctacattgggcagcatcgaccagcagcgtttccagcgtttctgcattcaggaattgcaggcgttcaagcagcgtgccgtgtcgatgagcaacatgcctcagttctacaaggagtccgacccgcaggttcgtgacggtttggctcaggccggagaccgtatcgactacaaggatctgttccagcaggggcccgacgcattgtggctggttcccggtgacgcgaagttctgggagtccggcgtcacggacatcaacccgctcatcaccgccgtggcttccgacatcaagcatctcgccgcctcctccggcaccccgttggatattctcagcccggacgtttccggcagcgcggaaggcgcacagctcaagcgcgagggtctggtgttcaaggtcgaggacatgaacgcgcgtgccaatgacgggttcacccgtctcatgcgcatggcgttggaggccgatggcaacagcgccgccggcgaacggttcgagaccgtgtggaagcccatcaaccctccatcacagttggagcaggctcaggccgcgaactattcgaagggcattcttcccgtcaagacgaacatgcgccgcagctacggcatgaccgagatcgagatagccgaggccatgcaggacctcatggacacgcagttcgctcaggccatggcctccgagaacgcgatgatcgaaggcaagacctcccagcagtcggcgggcgtcctgcccgacgagacggattctctcgcgttcaccgataccacgagtgaaaacgacgtggtgcaggcggatgagcccccgaccgtggacggtgaatgatggccgttatgaccttggaggtcgcatccaacgcgctccaatcctcacgtcagaggctcgtcaacgagtatgtgaggctggcccgcaccatgtggctcagcctcacgccagccgactggtggaacgacgccgtgacctacggcgcagccgcgaggctcgcattgctggaactcgccctgataggccaggtgcgcaggctgggaatcagctacgctgaccagacgctgcgcatggtgggcgtcgctcccgccggcaatgtgcagcagctcgtctatccgagggtcaacaccgacccgtggctggtggccgcacgccccgcagaagactatcgcggcgaggccgtcaagaaccccggcataaggccggaaacatggcccaagaagggtgatgagctgttcgatgaggtcaacaagtggctgcaatccgcgttgcagcgattgcagaccaacgtgtgggacaacgtggaacgggcctccaccgacgccacattgggccggtatcgcggcagcaaggtgctcgaataccgcagggtgcttcatccggagctttcccgttccggttcgtgcggcctgtgcatagccgccgcagaccgatggtattcgaccgcagccctgctccccctgcacgcgaactgcaagtgcggcgtcgcccctgcgggctccgactacgatcccggattccaattgaactccgacgatctcaaaaagctctacgaacaggccggaggcaccacggcggcggcgttgaagaacgtgagggtcaagaccatcacgcacggcgaactcggcccgatcctcatggcgcaggacgcgagggatacgccgaacccggttcccggcaaggattccgacaagtggaccacgccggaccggaaaaccacgctccaacagttccagcggatgaaggaccgtgcgatcgagttctccaaacgctacaagcaggtgtccgacaccggcaaggaagtccacttcagatacgagggccgaacctacaggttcaagccgtcgatccatctgaggcaatcatgggcataccaacgtgccctgctcaaccaagtgcagtcgatgctcggcaccgctgcctaaccaagaaaggccatcatggctaacaatcaggagaatcagaccgtcacggacggttctcagaacgccggtcagaccgtcacggccaataccggtacggattacatcgcgaacagctcgatcactggtcccatcaccgattccaatctcgccgccaatagcgtgacccaccagagcatcatcgccaacgcagtgaccaccgagaaacttgccgcgaacagtgtcgatgagacggaaaacggccccgactggaaggcattgtcccgtaagcacgagaagcaggccaaggacaactacgagcagcttcgcaagaccgaagccgcctacgaggagtcccagagccagctgcatgacttgcaggtggaaaacgcgcgcatgaaggcccagaaggcccacccgcagatcagcgatgacgtgttcgccctgtgcggtgagaccgaaccggagaagatttccgaatgggccgaaaaatacgcggcactcaatccagttacgtctccggtgaaggcagaacctgtgcgggagaaggccgaacaaggggcacgtacccgtggcgagggagccccgaagattcgttccggcacatacgcagacggatacgccgccgccaaggcacgtcaggagcagcggcgccaagcccgctccgccaagtaaccacaaacattcaatcgaaaggaaaagcacatggcatacgagaatgtgcgctccaccggcaccgtgaccgtggaggagaacaacgagtggcgtttcggcaaccacaccgacgacggcatcgtgagcgtcaccctcgacctgtccacgttcaacgtgaacgacaagacgaagcgcgacaaatacctgaccggcctgggcgacaaggccacgaccatctggatcaagagcggcatcccgctggccaagatcaccgccagcggcgaatacggcccgtatgacccgaatgctaccgatggccgtcagaacaagatcgccggcctgctggaaagcatggtggagatcagcgtcacgttcggcggctgggatgtggtcaacggtgcgaacgtcggcatgcgctaccgtggtgacatcatcaagagcaagctgccggtcgttcccgccgacggcgcggtgtggggcggcagcttcttcgacatcgaggacgataccgtcaccccgctgtccaacgcttcggccacctccaacatcacggttccagcaacggtcaccgcggcgaacatcaccgacgcctccaccgtcggccgcagcatcctgaccgccaacgatgccgccgcagctcgcaccgccatcggcgccggcaccggcaactcgaatttcgacggctcctacaacagtctgaaggacaagccgacgattcccccgcctacacgctgcccgccgccacggcgaacgcgctcggcggcgtcaagcaggtgaccatcgcggcgggtgccagcgcggcggacatcgtgaccgcactcaagacagccggcatcgccaagtaaccaatccaacaacccttataagcccgcccattgtggcgggctttcgtatatctgaaaggaaccctcaatgagtggaaccctggaaaagaacatcatcagcccgtccgaggcgtcgggcgtggtgcagtccggcttcgatttcatcgacggcctgctgccgttcggctccgtgttccccgtcaagtcgaatgacggcaaggacacggtgacgtggcagaagatcatcccgccgaaggagaccgacgccatgaagttccgcgcctgggacgcggaggccgctcacggcaagaccgtcgcccagtccggcgagaactacacgggccttatcccgctgtcgaagatgggccacatctccgaacgcgacgtcatcaaccacacgggcgattccacgtggctgcatgacaaggccgtggaaatcctcacccagttgggccaggaagccgccgtacgcatcgaactggcccgcatcgccgccatggttgacgcgaagatcaccgtcgaggagaacggcctgaaggccaacacgtggacgttcgaccgtccgaacagcatctccaagctcactcccgccaaagtctggtcggacgtgaagtccgatccggtcaccgacgtgcagaagtgggtggacgccatcaagaaggagcgtggccgtactccgggtgccgcgctgaccaccagcaaggtcatcgacgcgctgcgcaccaacgagtcgttcatcaccgaatacaccggcgtctccctcgccaactcgaagccgcgcctgacccgcgccgaagtgctggacgtgctgcgcaccgcctgcggcctcgccgacgtgcgcatgatcgacgtgctgtacaccgatctcgaggtcaacaacggcttcaagatgccggtggacacgaacacgctgatccccaacggcacgttcatcatgttcccgtcgtacaacgacacgggtctcggtttcaccgcctccggcccgacagcagaaggacaggatcccgaatacggcatcaacaagagcgtgaacgacggtttcatcggagccatgttctccggtggcgccccggtcaagtacgacctgtgggccaacggcacgatgatgccgatcctgcaggaggccgtcagcaccgcgaaggtttccgtcctcggatagtaaggaggggtcgtggcttccatcgattccatcgactggctgaaatggttgcgtgtcaacgcgctcgaccagcccgaccttctccttgaccggtttcccaacgcatggctgctcaatgagtgcggggtcgctgccgacatggttcaggctgaatgccagaacgtggccccgcgttatcagaacggcctgttgaaggagcgcacgcttggctatgtggtgagccagatggtgttgcgtgtcgtccgctaccggcagttcaagaccgaatcgaacggcagctactcgtatacgaacttcgatgcgcaggacaatccgcccggcaaggacggttccatgaacctgtacgtgtcgaaacgtgagaaggcgctgctggaaggccattccgactcgatgggcccgatgggtaccgtgcatatgggtctcgaccgcgcctacggcctgtgaggcgcttatggagacctatgacatgggccacctctacgacggggtggacatcgacgagctgggcggaggtcacctgtacgaccgtacggaattgaccggccatggcgtccaacagttgttcgatacggattacgtgatcgtggtcaaccgtcgtcatgtgcaggacgcgcatggaggctatcacgagcaggtcggcgacccggtgaaggtcgtgtgttcggtcgaaggccgggcgcagcaggccggcatgttctccatcagtggcgccgaggacaagagtccttccgggcagaacggcgggggccttcaggaggtcacgcccttgcagattctcgcacgccagtggcccggtgatattcattcgcgtatctggtacaagggcgactggtatgacgccgatggctatccgacatggcgtggcagcggcagcgtgctttcccgtcattgggaggttcgctgccgtcgcgtggtcatcggcggctacgtgcccggcggcattcccgaacccgtatggtcgaaggaggtgggcgccgatgggccgcgtgaccatcagaccggggataggccgtgacgtggcgctcatgttcggcccctcgataaccctcgccgcagccgagaaagcggccgtcatggtcaaaacgcagatgggggttggaacggttgacgaccgtaatcatgcggtggcgcgagcggacttgacggatcgcatcgacgtctccgtccgccccggccatgcgcaggaccattcggtcgttctcagcgtcaaaggccgtgagggaacggaaatcgcctcgcatttggagttcggttacgtcaacaatcgtgccggacgtcgtttggccggcatgcattccatgcgcaacgttgcgtcgaagctgaaggtgtaggccgtcatggacaacatcttcaaacacctcgccatcgatgtgagggaaagcatcgacgccgaacaggtcgtctacgaactgttgaaccgtgaatatccgaacgaggattgggcgtcggtcgcagtgtacagcgaaatcgacctcgacctgaacgccgtgaccgagaacggccgggtgattctctatgaggtgtctcccggccaacaggttgacaggggcttgtggcggttcaccgtgtcgttcaccgttctcgccgccgacacgaacaatccgagcggttttgcccgcgacctgtaccgcaccgtcatgggatggccgttcgaggagaagacctcggcgggcaagatcagccgcatcaacagcattgattccccacaacgtcgcagcgacgccaaggagaaccaaggcaagaacatcaaggaatacggtttcgacgcatcaatggacgcgcgggaccttatctgacctacaggggtcggccacatggccggcccttttcttttacccaaatccaatatccgaaaggaaccatcatggctattaacggcgatgcgctgcttcaggccgcgcgaggaaccgtgttcacggcccccgccaagaccgccatcccgactgccggcgtcaaacagtttctgttgaactccggtagtgtgaaggtcggcaccgcggacactcccgtttgggataatctcggccacacgtccaattccaacaagatcagcttcagcaaggacggcggcgacaccaacaccatcgacacgtggctgatggccgccgcacgcacttccaccgaagccccgaccatcaccgtcagcggcgccagcgtgcagggcgacaaggcgaccctgcagaaggtcaccggcggctggactggtgacaacggcggcgtgatcgtgcccatcaagccgatcgtgcagaagctcgccttgttcgtcctcgcctacgatgacggcgacaaactgtccttcggcctgtacctgccggagaccgatttcacgttcgacaccatcgacctgaccggcgacgagttcgccgagttcagcttcaacgcggtggtcaagtccaccgatgccctgaagaagggcccgaacggcgagatcggcggctacgcgctgttcagcccggaggatttcaagtaaggtccgcagccatccgcgctgcggatggtggagacccgccagccacagtcgaggctggcaaggatatccggctcgcaggccagtcttccactctcggcggggtgaagctgccggctcccccgcctgacattgattcatccccatacggttctcctatccgggccgtatggggattctccattcacggatagggtttcacggataggaggacggcaatgaccgccaagaaaaacgacaccaagactccgaagaaggagtttcccgaaactttcggccagcttgtcgaggaatacccggagttgaagggtcttccagagctggttcccgcacgcgacttcaacgcggagcagtccgctgatttcacggtgcttctcacgcttctcgacactcagatgccggagctcgacaccaaggatgattcgatggacgcagccctgctcgtcgcccgcgtcgtatccatctccaatgatttctacaagggtcttgccaaggacgagaaggcttacgaacagtgggccacgggccgtgacggcaacgtcctgttctcagcgttccttgccctgagcatgttctacagggtcgaactgggaaaatccgaagcgtcgaggacgcctaccgaaactgcccggtcgaactgacctgcgacttcagacgcttctacaaccttgatatgcccgccgccatccacgagtatgacggcgggtttctcgtaaggctcctgcagggtttgtcgggttatgacgagtccctgtaccgcgaatggctgctgaaccatcccatgcgatccgagaccgccgatgagggcgaatcacggcgcatgctctcctatcaccgttattcgcaggacacgagcctcctgttgggcattttcaaccatgtaggcgcgttgacgtgcgggctcatggaaaccaagaacggcaagcaccccgagttcacgccgattcttccccggacacggagcagccggaaaagccggtcgaggcgagcctcgattcgatgaaggccctgttctcctcctgataaccgaaaagaggttcgccaatggcagtatacgagggcggtgccgttggcatcagcatctacccggacaccacggagttcggtttcgaactgcgccgcaagctcgccaagtacgcggatgacagtctcaccattccgctgaacatcgacgtggacgacgcgaactggacggcggcgaaacggcgcatcaacaacgaccgtctctccaagaccgtcgaggtgcgaggcgatacgagcgcgctgcgcaaggccgtgcaggatatcgaggagcgtgacatctccccgaaggtcgatctgaccaagcagctgcgcgacctgcgttccctgcgtcagagggtcgaagcagccaaccgttccttccagaagttcaaccgttcggtcgatacgagttccgccaagttcaagcacaacaagacgctggtgaagcagtacggcgacgcgatggacaagacgtccacgctcacccgcaagtacggtgaccggcaaatcaacgtgctggataagacgaagcgtcgtatccgcaccctgcaggacgcgattctcaagttcaaaccgttgggttcgaacgtcgtggagatgaaagaggccaacctcgccattgcccgcatcaggcgcgatatcaaacagcttgaaaacgatccgggcgcgaagattcgcatcgacatcgaccgttacgcgaaggtcatttccgacctcgagaacgtggcccgcaagaccgacgagctgaaccgcaaggaagcccgcgtcaagttctacacggacggcgcggacaagctcaaacgcgagctggacgaccttcgccgccgttacgtgaacctgcccaaggagatagaggactcctacaggcaggccatcgaccgcatgaacacagccggccatctcgccggacgtgacaaggacttcaaatacgtcgcgaacctcgatctcgatgtgagcgaggcgcggcgcaaggcccgtgatttccagaacgaccacgacaagctggagatggacctcgacctcaagtccgctgcggcttccgcccacctcatgtacctgacccgcccgcgcagcgtggagatctacgcaagattgcatgccacggacatgggcaagctcatcgacggcatgctctacggggccaccggccttcgcggcgtcaacaaccagttccagcgattggtgaacctgttcgatacgttggacacgaaggttcccatactgggtgcggtgggcgccgtcatcggcggagtgtccgccggcgcggtgaacctctcctccagcgtgctcggcgtcgccgccagtctcggagccatgagcaaggccgcgttcgcggctcccgccgccatcaccggcttgggtgcggcgttcgtcgtgctcaaacatgcgtggggcgaaaaaggcaccacgttcagcgaccagatcgacatcgccacgacgaagctcgccggtttcggcgacgccatggacgaggcgttctacgagaaggcgcgtccagccatcagaagcctgatggacgatgtgagcggcacgcttatccccggcatgaccggcatcgcgtccagcgagggcaaggtggtcgaggggctggcggacatcatccgcgagtccgacaaggccggcgagctgtccaccatattctcccgtacttccgaggccgtggacaatctcaatccgggactgcggagcgtggtggagtcgttcctccgcttgagcgacggcaccagccagtacctgcctcgcgccgcctcctatttcagtgatatggcctcgaagttcgccgactgggtggataagacccgagccaccggcgagatcgtcgcgtcgatgaagcaggtggtcgaacaggccggttatctgaaggactcgttcaagggcgtgtggggcatcgccacaggtctgtattccgcgttggcggaaagccagaacgggctcgaggggttcagcacggctgtaggcaaggccgaccgtgcggtgaactccgccagattccagaccacgctcaaggcgtgggccaagggcgcggaagccgcgaagaacgagatgcgcaacgccttctcggacatcggttccgcagcctacgagctgcgcgacaccactgcgggcatgttcaccgatgcgggcaatacgatcagctcgttcacccgtaacgcgagccgtcttctgaagaactcgaaggacggtatcagcggattctcgtcgggagtgtccgaaggcttccagaaggtgttctcagcggttggcgacgcgagccccgcgttcaaccagctgttgaagaccgtgggccagttgtccaggacgttcggcggtacccttgccgccacgttgaaggccagcgcgccgctcatcaccacggtcgccaaagccgccgaggccaccgccaatgcgttcagcaggctgcccgaaccggttcaggccgcgataggcctgtacgccacgttcggcaaggcgggcatgaccgcttggaacacggtgaagaccggtctggtcgagaacacgctgcgcatggtcgaataccagaaggcgttgaacgggctcggcgtgaccaccaagaccgccggcgcgagcatgaaggatgcggtcagcggtttcatcgccgccaacccgtcgttgaagggcatagccgacagtgtgaggaacgcgaacggtgtgctaggaaagaccggcgctctggccaagggcgcgggcagcgccgtgctgggcgcgttcggcgggccggtcggagccgccgtgaccgctggcgtggccgtggtgaccgcagcctactcggagtatgtgaaaaccgctcaggccaatgagcaggcgtccgagaacattcgcaccgcgttggagaaggtaccggattccgctcagtccgcagccgagggaatcaccgaggttggcaaggccatcaaggagaatttcgacaacacggattattccggcacgaagttcgactggtggtcggatatgaccacgggttttgattcggtgagcgacgcggccaagaagctcggtctcaacgtcagcgatctcaccaagtccgttaccggttcgcaggccgaataccaggcgacacttgaccggctcgatgcgacgattgagaaatacaatgtcaacgtcggtcatggcataggcaagaacgccgatctggcgagggccgcgcagaaggtgaaacccgcgcttgaggatcagcgcaacgagtacatagccaattccgaggccattgcccaagcgaacgggtatgcggagggttatgccacgaagctcatcaagcttggtgaggattccgattcggtgtccatcgccatttccactcaggccgaacgtactcagatgctggccaaggctcagcagactgctgcggattgggcagaacgtcaacgcacagctcagcagaatgcgttgaacgcggcttccgactacggtgaaacgtattccaatatgggggatgcgatagcccgcgtcaatcagttggccgcgaagagcggcccggtttgggatgcgaacgctgctggcattcagggcgtgacgggctcgttcaacacgatgagcgaggccggtcgtgaggcgcagtccgcgttggagaatctgggcaattccggtcatgacctgttgaagagcatggtcgagtccggtgccagcgcggatgaggtgaaggcgaagcaggcggaattggcgaagcagttcctcgccaccgcacacgacatgggtgttcccgccgatgccgcgacacggttgcaggagatctatggtctgacccccgaggaggtcaccaccctgttcaaagccgaaacggagcagaccaagaccgctctcacccaatatctgagcaatctgcgagccatcttccccggggacggtaacacggcggtgttccagaccattctcgaaggcatcaacagtggtgccatcacgagcatggatcaggtcagctcgaagatggacgagctacgcaagaacgtcagcaccgacggttccggcaagtacacgattgtccttgacgccgatggcactcaggcgatcgtcgccaccaatatcgtcaagaagcatgccgaactgttcaaggccggttctgatggtaatggttacacgaccaagctgaacgccgacgatctgacgaaagccacgttggattacgtcgaaggcaatctcaacgcctacgaccagttggctccgtccgccgacctgaacgcgaaggacaattcaggcccggcaaaggccagcgccgatgcgaacgccagcaactgggatgcccagcatcccaccgcgtcgttcgacggtgacgcggcaggagccgcaaacgccaagaggtcggcctcaaatcagggctggcaatggaacggcagcagctacaacgcccagttcggcgctagtacggcaagcgtatctagctccttctggagcgccatgcaatccggttgggaatgggcgaagcagaagttctttgccgtgttcggcatcaaacgccagaacgccgagggcggcgaggtagctggttcgaatgtcaccaagacgggccgtgtggtcggtcagggcaacaatacgagcgattcggttccgttgaacgcctacacggacgtgagcaccggcgaatacgtggtgcgcaaggccgctgtgcaaagcatggaatccctgtacggcaggggaatcatggccgctatcaacgcgaccggcagcattccaagcaagtacatcgcggatgcgcggcgcaccagccagatcaccatgccctccggtgggctgaacggtggttccaagtccggaggctggtcgatgcccatcgaaaccagttcgggcgacacgtacaaccagacgttcatctatccgagcgtcacaccaatcgaggttcagaagaacaacaagctcgaccagtacgcgagtctcggtctcttgcagtaggaggaaacgatgctctccaccatgtcctacaagctcaacggggtcgcattggatacggagaactgtctggtcatcgtgggctccacgctcatgccgggcatcagcacccgtagaacggtcgccacggtgcccggcgtgagcggaaccttgaacctcggtgttccgcccgtgttcgaggagcgtgagatcacgttgaaggtggacgcattcactccgaaagtgtatgaggagtcttcccggataatgcgattatgctccatgccgaatctcactctcactcgggtgaaggacggtgtggagcagtccacgcgggtggagctcacctcgttgaccgccgatgacgacagttcccatccgaacaatctggtgtcgttcaccgcgaagttcgccatgcccgacgtgtggtggcatgaaccggagtattgggatcgtccgttgtcgttgaacaaggacggtctcgtgttcccccgacctgtcaccatcaacaaattctggacgagatggtcgggagaagcgaacaacagtacctcactgttggcggatttcatcaccatgtggcgcggcgaggtcaacaattccgagagcctactgttcgaggatggtatccccggcgacggtttctggggcgacgccccgttgacggacatcgtgttccgttttcccagcaccgtcacctccgtctccctgaccgaccccacgtcgaacaccggcatcagttggacgggtgctgcggacagtgcgaaacccctctatatcaggcccgacatcatgcgcgcatggcgttccgactatgcgaactcctggactccgaccggcacggatgtttccaccggtttggattatccggcgggaggaatcctgcaggtatggccagacgtttccgaactttacagattgaaggtcaccgccacgggcgcgacgggcgatgcgctcatgcatgtgcgacgcgcatggtggtgacgggaaggcacttatgaagaacctctccatccgtttgaaagcgtacaagccgaacggtgacactctgggcctgctcccccagccgtcctcgttttccgcgagtttcctgcacgatgacacgggcgcgctccgattggagtattcccgtaaggcgttgaatgggtcgattcttgaacgcaagctcgaaaccggtctggaaatcgcggtcgaagtgtccgatggcggcaaatggctggaaccgttgaacggtcgtttcgtgctcatctcccgcagtcgtgacgccttggactcttcggatacggtgacgttcacctgcccctcctatgcatggttgttgaacaaggcgctcatgctcgacctcgctcatctggagggtgacggggacgataagggcaagcgtgtgttcaagaaggcctctgccggtctggtcatgcgcacgttccttgatgagaacaagacccgtggcggtatccccgtcacctgcggtttcgacacgggcagggattcggcgggcgctgcgtggaagagcgtcatgacgcttgcctacacgccgggcatcagcagtctcaccgcgttggcgaatctcgccggcaacaagatttgcgactgggctttcgacaagcggacattgaaaatctggaacatggactccacggcattatgccgtgatctgagccgcatctccgtccaattggcgcatgacgtgctcgaagccccggaagaggaaagcatcgaggcattggcctcgcatattctcgtgcagggagataacaacaaggctttcacgagggataatcccgcagcgccttccccttggggcaagtgggagacgtatctatcccagcagggaatcagcgatgatgataccgccgccctctatatgcaatccactctggatactgcggcacgtgttcgaggccagtatacgagggccctgcgtgtcaacgatgctccgagtcttcctctcatcgattaccgtccgggtgactggatcaccgcgccaaccgtcatgcatggggagaaggtgcgtgtccagcaggtcacgttgagcttggaatccaatcagttcaaagcttcggtcgtgttgaacgacaaggtttacgatgcgaccgtacgtcaggcgaaacgagtacagggcatcaccggtggcgccatcaacggcggcaccggtggtggcctgcccgctccggaaaaagaccatcggacgccgaaggccgtgactggtcttgtggtgcagacggacgcctatatctccagtcgtggtaccgcgttgggtttggctaccttgcagtgggctgcggtctcgcaggcgacggataatacggccatcgatatcagctcgtatcgggtcgaataccggaagaatcttgcgggtgcgccgtgggtttccggtggcgtgacggacgcgcagcggctcacgttgggcatcggcggtctggaatgcgggcaacgctatgagttccgcgtgcgcgccgtgcccacgtattccgaccggttgggtgactggtcgaacgtggtcgtggctttggtggcgtcggacgtgacgccgccgagcatcccgtccaagccgatactcacctcgaaattgggtgtggtggacgtgcagtgggacggcaggaacaatgccggcggcggcatggagctggacttcgaccacgtggaggtcggcatttccgattcgaacgggaattggaaataccgggacagcgtggcgcgtgacggctactgccatgtgaccgggcttgaactgaacagcacatggtggttcgcgctcaggagcgtcgatcattccggcaacaagtcggcgtggagcgcgggtgccagcgtcaaggtcgccccggtgctcacgcaggaggatctgaacaagagcgccgaacagattctggcggcggcgaagaacgacgcggcccagcaggtcgccgtggtcgacaaaaaactcaccgagaccggcgcgcggatcgaggcgaacaaggaggcgcaggacaaggccgacgcggcgataagggccgacgtgtcgaagaacgcgcaggccatcaccgacaacaagaacgcgcaggcctcagtggacaaggcgcaggacgccgccaccaagaaggtgtcggacgacctcgcggcggcgaacaagacgatcaacgcgaacaaggccgccaccgacaaggcgctggccgaggccgagaagaaggcccaggacgcctacgacaacgcggtcaacgcgcagaagaccgccgacggcatgcactccatcttcaaggggcccgacgacccgcgcaacgacaagtcgaacacggtgagggccggcgacttctggttcgtaacccagaaatactggacccgttggctcggcgaggcgaacaacagcacctcactgctggcggacttctacacgtattgggagggcgcggcgaacgacagtgcgagcgtgctcgtgccgttgagctcgcgcgtcaccgccgtgagacagttcgacggcacgcagtggaacgagttcaacctcgtcgccagcaacatcatcgccaccggctcgatcaccgcgcagcttgtggacgcggagttcttccacggccgcaccatcgtcggcggcacgtaccgcaccgagggcggcaacgtgaccatcaccgactcgggcatcatattcagctaccgcaaccggcacctgctgagcttcgccagcgattcgagcggcaaatggcagctgaccatggacgcgccgatcgtgtcggacgcgagcatgagcgcgccgaccatcacgggcggcacgatcaccagcgccgtctacaggaccgcgaacggcaggctgaccatcaacgacgcgggaatcgttctgaagaacgcctccggcaccagcacgctggcggcggactcggccaccggcagcgtgaccctcgtcggcaccgtgaaggccagccaggtcaccggttcgacgatcacgaccacgaacgggcgcatgctgtggaacgatgccggcctcgtgctgaaggacgccaacgggagcataaccctgtacgcgagttcgatggacggcagcgtgaccatgaagggctcgctgaccagcggcagcacgctctccggcgtgaccgtcaccggctcgatcatacagaccacgggcgccgcgaacaggggcgtcaagctcaccagcggcggactcgtcggctacgattcctcgggcaacgcgaaattcgcgctggacaccaacggcaacctgaagatggacggcggcatactcgccaacggcaccctgaccgcgcccaccgtcaacgcgggagtcatgaccagcaccgtcatcaacgcgccggtcgtccagtccagcactgcggataacacgggttggaagctgcggggcaacgcgctggacatgtgggactcgaagcggaaccacaccgtgcatctggacggcgagggcgcgagcaacctgctgaccggcacgttccagaccggcctcaccggctgtcgagtcgtaatatcaccgacgttccgacagtcgacgatcaacagcgatgaaaagaccgaaggctcaggcatcgaattcaggcacgggcgcgacggtcacgacgcctacatcgcgtcggaatcccggaccaactataagggcgaggtctccgccatcgtaatcaacggaggccggttgaacgacaccgatccggggtcgttcatgcgtgtgggcgaatacaaggctacggacaacgccaccaaaaccggcgaagtcttcctagccgcttaccgtgattattccaaaggcagcaagagcggtaaagcgcaactgttattgcaggccgacccgacgtccaaataccatacatcagccgaactctcagcgagggacccgaacggcagtgtcggcgtggaggcggacatcaactccgggtatctgtacctcggcgggttcctcggcctgtttggcgcggggcgcggaacgttcaggacggcctattttcgtaacgggataatgagcggcgaagggtggctgacgcagacgtacacgtatgcctccccggccaaatacggcttataccatgcgcatgtctccgccgacgcaatggggtcggtcatggtcggttcgaacaatgattcggcgagcggctgcggcctgtgggcgcgtggcgtcggcaacggcgtcaacatcccatacggcactcagctactcgccatcctggccgaacagtaggaggtgccaatggaaacggaaatcaacggcgacgtgttgaccgtgaccggtgacgacgggacgggtcatctcatcccgttggacgcgatcgcctcgtggggcgagctcctcggctgcgacacggacatggaagcggtcgcggcgatcatacgggtccggacgaacaggtcagacccgggcgtcatcgacccggccaccggacgcaacgcttggaccagcgcctacgagcagttggagcatgacgcgctcgtcgacctgaatcaggtgcgcgccgcatcactgcaccgcgcgttcacgcccaccggggcgctggccgccgacgggcgtgcggagacccgccggctgttgggcttggatgccacgaccatagtggactcgtacgaggcggacgcggctctcgccgccgcgcgggcgttggacgaaccgaacgccggcgagccggtggagccgtcgatacggttgcccgccggcgtggacgccacgagcctcgccaccctgctcgccgaacacgcgacggaaatcgaccgggcgcgaaccagatttctgaacgacgtcacaccaaccatcaccgataggagataaccaatgacagacacaaccgaaagcctcgtgcaggcggacatcaacgacgtgctcgacaacatgagcgcccgtaacgccaccctgacccgcgaactcgccatcagccaagcacaggcaaccgcactgcaacgcagggtcaaggagctcgaggccaagcaggccgaaaacaagtaatcagccaaaccattttcccgaaagccaccccacggggtggcttttctcatacccgaaaacagaaaggggccggaatgacgtatctgcgcaacctcacgtatccgcgaatgatgctcggcaaccccaccaacagcacggtctccatgatcgccggcaaccagaagggcgtcaccataaccgcccaggaaggccgacaggactgcttcacccaaatgtggttcaacacgccacgggacacgagcctcgtgttccagacggacatctggaacgtggtcggagaccagtccaccgtgcgcaacggctacgtcctcatcgccgagatagacccctggaattcactgtgctccgccgcgtctgcaggcagaacatccctcaagttcacgccgaccagagacttcattatccggctcgcctgccccgattcgggcagcgccaacttcacacagcccctgctcatgacggaagccgactggaaccagatgcgcgcactcggcgaaggctacttcgacggcgacctcatgccattaaccaatggggggtgttcctatgtttttgtcaactccttggggagttgacgtgtcgggattccggttggctgtcgtgggcgcgcttcgccctgccggtggcgtccggcgtcctttcccgtgtggcccggttcaggctacgagggctggttcctggtagagggttccgtttttgagcatgctgtagatcacgtcgcagcgccgacgcgcgaggcagatgatggcggcgttgtggtgtttgccctgttcgcgtttgcgcttgtaataggccacggagggcgggtgtttggtggatgcgacgaacgcggtctgccacagcgcgttcttgaggcgtttgttgccccgcctggagggccgttcgcctttgatgctggtgccggattggccggtgacgggcgatatgcccgcgtaggcggccagatgggcggacgatttgaagttggcgatgtcgccgccgatgccgagcaggatgttgcttgcggtcctgacgcctatcccgggcatcgacgccgggaccgtgagaagagggtggtcctccaggagcttctcgacctggcggccgacctcgcgccgccggtccctgatcgtcttgatgtcgcgggcgatggaggggatgatggtctcggccatgagggtgccgggcacggtgacggtctgctcgccgatcgccttgaacatgtcgtcgatgatgcggccggcgcgaagcccgttggacttggcccagtccttcacgtcctcgatcccggcccgtttcacgcccatgggcccgccgtatcgttcgagcagcgcgagcgtcgcgtcgcgcgtgattctctcgcccttgagcgcgcgttcgaacgcggggtgggtctgcagcagcaggctccgcaggcggttgacgtggcgggtggattcgtgggcgaggtcctcgtcgtggccggcgagcagcttcagggcggcgagggtctcgtcatccgggcccgcgtccctgagcgtctcgggcagcttgagcgcggcccacgcgatcacatgcgcgtccctgcggtcggtcttcgcgtccccgggcagcagctgcgcggtcctgcgcatggccgtgccgggaaggtaggcaaccgcgatccccatgttccgcgccaccgtcaggggcagggagccgatggtgttgggctggtccacgaccagcagcacacggccatgcttggagagcttgcccagcatcgtgcggatggccttctcgtcctgtttcaacggcttgtcgtacagggtgttcccgtcatggtcgagggcgtgcgcgtggtgcgcgctcttgcccacgtccaggccgacccacacgtcgatgtcgtccggggtcatcatcgttcctcccgtcatgaaggttttccggtcgccgcgggctcggaggagtccggacgcccgcgccgcacccacattacgacgagacctgcgccatgcgcccctgaagcgtccgtgtagccggcctggttcctatcagcggtcatcgggcgtccccgttcccggcgacaacacccccggatcatcgacgacagggcaggaaagtcataccggaaccggcgacccggccccgaccatcggggcctaccaaacatggtaatggggtgtaacaatcctcatcccgttcatgccgcccaccctgatcattgggggttggccgcatgacgctgataaccaaccattaccccaacccgttgttcaactcgcgtggggcattgccctccccgagtggcggttccggcaccataacctgcatcgacgcgcagcggcaactgcgactgcagtcgaccgacgctggaggcgtgcaggcggcacaggcgttgaccggactgccggcatcgacgcgcatggtgttccagttctcctactggacgtccgacaagtcgctgcgcaacggatgcctgtgcatcatcggccgcaacgcctccggctggacggagctggcccgtggcggcaacccgcagtccaatggcgtccacgacacggtgacgatcgagttcaccaccccgcaggatgccaatggaacccagatcgtgttcgacagtcccctgaaaacgggcgcggtgacggtgttcgaccggcccacgctcatgaccaaaaccgactgggactggtggcagaggaacaatcacggcaggctgctctccggcgatctcatgccactcagctgaccgctccccgattggcggtggcggcatgacctacatcaccaacctgtacaccgacccctcatgccgcaggaacttaagcacgtggtccaacggcagtggcgtgaatgtcgagcacatcgacgggcacttccgctacacgaatactggcaacaatagctggtcgataatcgactggtatagctggcgtgaattgatgagactgggccgtgtcgtggtcatcgcctacacggccaccagcgggctgagcgtggcagtggagagcggcatgacactcgtctccggcacgaccccatcgggtgccgcatggacggcggcgaagatcaacagggacggcaaccgcagcatctactgccgtggcagtggcagtttgacgttggaggccatggccgtgtacgagggcgacgattggccgaccgtccaacaactcctcccccggttcccgtggttcgacggaggctcgatgcccctccggaacaattagcgaaaggaaagaaggtcatgacctagatgaccgagacgatacccgtatgggcaacgatcctggtctccgtgatcaccacgtgcggcggcacggtcgccggatggatactgcgccgcatcgaccaggcgggcaaaccggacccggccctgtcgcagagactcgatcaggtggacgcgagcctgacccagctcgaccagcgtctcgacccactgcaggatggggtgaaaaccatgctcctgtgcaaattggagcagatgcagcgtgagatggtcgacgctggcggtatcgccgacaacgacctcaaaacccgcgccgaaggcgtctacgccacctaccacgcgcttggtggcaacgggcacggcacccaagtcaatcaggacatacaggacgcgccgatagccccgagaaaaccacaggcttagcccccgccgaccccgacgggggctatttcatgcccaccccacacataggaaggaaaacgaatgggcagattcaaaaacagaagcaagccgctgcaggccctcatcgcggcactgttcgccgtgctgctcgcgtgcacgccggcgatcgcgatggccgacatggtcggcatcgacgtgtccggctggcagggctcgaacgtgacctgcaccgccagctacgacttcgccgtagtcaaggtgtcccagggcgtaggcttcgagaactccagttggcgcacgcaggccaagtgcgtgacagaccggggcaagagcctcggcctgtaccactacgccggcggcaacaacgccgaggccgaggccgactacttcgtcggccgggcgcgcgactacatcggcagggccgtgctcgtgctcgactgggagtcctatcagaacgcccagtggggcaattccgactgggttcgccggttcgtccagcgcgtgcacacgctcaccggcgtatggccgatggtgtacgtgcaggccagcgcgctgggccagatacccggcgacgtgcgcgccaactgcggcctgtgggtcgcccagtacgccagcaacgcgcccaccggctaccagagccgaccgtggaactacgcggtctacggcgaggccatgcgccagtacacctccaacggctggatcagcggctacaacgggccgctcgacctcaactacttcagaggcgacgcaagccagtggcaggcctacgccaaccccgccgacgcagccaagcccgcaaccccgccgcagaccgagaagccgccgacccagaccatcgacctacaggcactcgcgaccgccaccatccgtggcgactacggcaacggccagcagcggcgcgacgcgctcggcgcgaactacgacaaggtcatggcgatcgtcaaccagcgcctcgccggcaccgcgaccgtagcgccgcagcaggccgcgcaggccaacacgacccgcgtggccgtccgctccggcgacaccatgagcggcatcgcctcgcgcaccggcctgtggccgctgtccaagtggagcgtgcccagcggcaacctcaacctgatctaccccggtcaggtcgtcacctacaacggcggcggcagcgtcgccaccggcagcaacgccccaccgtcccgtaccgtgaccgtccgcgctggcgacacgctcggcggcatcgcggcacgcctcggcatcggctacacgcagctcaccggctatcgcagcggcaaccccaacgtgatctaccccggcgaagtgctgcgctactgataacccgacctacctaggaaccctgcacccgacaccgggcgaggttcctaggttccaaatcacagaatcgaggacaatatgaccgacgaaaacaccgaactgaagaccgccggcacggagccgaccgtgcccgattggctgctgccgaaccgagcctatgacgtgctcaaatggctcgcgctgatcgtgctgccggccatcggcgtgctcgtgcagaccctcggccccgtatggggctggacgtgggccgatcaggccgcgacgaccatcaacgccgtcgccctggccatcggcgtcgtcatcggcgcaagcaccctcaaggccaaggcatccaaaaccgaataaccataaaaacaccgcccctccatccggcataacgctggacggaggggcggttttcacgttttgggagtagctttccgaggctcattttttgcccacattttgcccacatttttcgtaaaaacaggttaaaaaccgttaaaaccggttaaaacgaaaaaaaccgctcagccctactcccgcaaggcaaagcggccattttccaacccactctcagctcagcgcgtccttcaacaaacagaagaagcaccatccgcgccagccgggacatccgaatcacaacccgcacccatccaacagcaaccatcaaccaacaccactcgcccagcgccagacactcccgtcacccctcagcccacacctcgaccgtctccctcagccccatcatgggacgtgccaagcaccgactcaccctcaacttttcctgacactttatgaggggaagatgacgttgatgtcatctgaaacttacatggacatctaaaaatagggcgttttttgacgtttttcattgattgatgtaagttttggcgtgccaaaacttacatcaatcaaaatccacggcttttctgatgacggataatggcactggagctgtgtcttcgataaggtcaatatcgagcgtttgatcgccgcaggattcggagtcgcatacaacccggtacgcatggccggcaagtagtcgcagcgaataaataccaccgcccctccccagcagtaacgctggacggaggggcggttttcgcgtatttacgctttcatgggcggaagattgaaatacaatcgggcgattcgctcagcttcgcggttctccctctcattaccaagcaacagaagccagatggcattcttccccgctagaggaatcggagcctttagctgctttatacagccctgctcttgtaaaaactttgcaccacggctcagtcggtttcgcgctgtccgcgtgcgggccattgttgtttctgcggcagtgtctaaatcatgttccttggaggcgatgaccatgcccataccctctatcatcttgtcccaaccctcccaataacaccagtaggcacggtcttgatatacgacggcgtccacatcctctttgtcgattaccttcgaggccatgtaggtcatcatcgacaaagccagtaggtctagcgtctgcttgccgttttcatcagtcttggagaatttgccttggcttgcgagagcatatacgcgatctacattgcggtagcccatctgttccgtcatctttcctccacgccctcgactaaacttgggagtggaactcttgctagggtttcgtttttcaaccctgtggagtcttcacctccatagggttttttattcacactcacatgataacagatagtcacaccataatgggaatagtgagtcacagtcaacgctgattattgctcacaccgacatgtgaacatacataaatagatacaaaaaggcttacatgaatatttatacaaaaaccgatttttgatttttcgagcgaatcaccgtcgattccgccacgccgaaaccgttccgcagcccaacccgaagatttgttggagaatgttggagaatgacattcctagacgccggaaatcttacccgagatacgatgagaccccttgcaaacattgtcgttcgtaaggggtctcaatgcctaatcagcgggcttttcagcacaccttccacatccagttgtgcgggtcttccacctcgccgagctggatgccgagcaactcgttgcgcagggcgacggtcagctcgccggagccaccgtcggcgacggtgacatcgaacttctcggacttgaagcgaccgatcggggtaatgatggcggcggtaccgcaagcgaacacctcagtgacctcgccggacttaatgtcctcgagcagctggtcgagggcgatcatggtctcgaccacgtcgtggcccttgtcctgaagcagctgaatcagggagcgacgggtcacgcccggcaaaatgttgccggtcagggacggggtctccacgtggccatccttgtgcacggccatcatgttcatgccgccaagctcttcaaggtaggtcttggtggcggcgtccacaaagcagacctgctcgcagccgttctcgatacccttatactcaccgagcagggaggcagcgtagttgccaccgcacttggcgaaaccagtgccgccggggccggtgcggaaccacttgtcttcaacccagatgctcaccggcttgacgccgcccgggaagtacgggccggacggagaggcgatcacgcagtagtcgacttcctgcggagcgcgcacgccgaggaacggctcggaggcgaacatgaacggacgcatgtacagtgtgtactcacggcgtgacggcacccagttggcgtcgcgcttgaccagcgcggccacggagccgaggaagtcgtcaaccggcagctcgggcaggtatagacgcttggcggaattctggaaacgctcggcgttcgcatccgggcggaacagccaggtggagccgtcagcgtgacgataagccttcagaccctcgaaacactcctgtgcatagtgcagcacagaggcacccgggtccatcttgagcggcgcgtacggctcgacgcggcggtcggaccagccttcgcctttggtccaagtcatgtgagtcatgttgtcagagaacacctggccgaaagccggcttgtcgatgagggactgacgcttctcatcggatgcggggttgtcgttcggcagtacggtgaacggttcggtgagctggtcgagcgctgccggatcgtggtgcgtattttcagtcattactagctacttcttcttgactttggcagcccgaaagccaccatatggggtgtgtgctgtgcgcttgtggcgcgagctctgttgcatacttttgcacacccatgtgttactcgtgtggcagagttcacatggtgaaaaaacgaagaagcccgcaccgttctcaacggctgcgggcttccacgtttcagttatgttctgaattgttcgctatcgaagcgaccgactcacttggcgtcggcagccggagcagcggcggcgtcagccggggcggcagcagcttccggagcggtggtggactcggtggcatcctccggcacctcgacggtgacgacggactcttccggatcctcgatgtccagctcgacgccctcaggcaggacgacatccttggcgaacaccttggtgccgtcggtcaggccttcgacgctgaccacgatcttctcgggcaggttggtgacgtcggcgcggaccttgagctcctgaatgtcgacgaacgccacggcagcacccttcggggtgccttccacaaacaccggcacctcgacgtcgatcttctcgccggccttgacctcgaggaagtcgatgtgctcgatgatgcgcttgaccgggttcttctgcacgtccttgacgacggccatcttggtgttgccgtcgaaggcgatggtgaacagggcgttggtgtgacgcagggccagggtggtctcgcgcatcggcaaggtaacgaaggcgggctcttcgccgccggcgtagatggtggccggaatcttgttggcaacgcgcagacgacgagcaacgcccttgccgaactcggaacgggcctcgccctcaagcttaatggtggtagccataatggatactccttgtagtttcgtttcgtactgtctcgctcagacgccacgacgcgccgaaagacaccctacaaagagtgaaatacgccgagtcgataacggaagctgtgtcatgtgtcagcacgcacacttccctcgccaaagcaacaattgtcaattatacgccaactccggactttgcgtggtgatgtttcgatgacgctgcatcccggccgtcccagccacgtcaacgcacggtttccgcgaaataatccctagctttgtgaagaacgtacgcttacccgttctcatcatacggttttcacgaaatcgtccgccatttcgtgaaaaccgtacgctcagcgacactcagtgtacggtctttcacgaagttggggatgatttcgaaaaataacgtacgatggtgagtaccgtatcgggaggttgatatgactcgttcggacgacgtcatcaatgaggatgaccatgacgtcatcgccgcacacactcgcgttgtcaggggtatggctgcggcacttgccgcgatagccgccaccggagccggcgtcacagccgcggccgccaacgtcatgttcacgttcgcgctggacaccaaggccaaacgttcgatgttcaacatgccgcacgaggagacgccgaaaggcatcgaattcgacatgtccgagcagcttgaggccacccggtggttcgaggaggccaagcaatcggtcacgctgcgcagccatgatggattgaaactccacggctggctgttggacccggattgttccgacccacagccgcatctatacgcgatctgctgccatggctataccggagagcccgcggaaatggccaaatgggcgcatcgctatgcgcaactcggttttacggtcctgctacccgcgcagcgcgcccatgagttgagcgaagggcgttacgtgggtatgggattgctggaaagcgacgatctgttgggctgggtttcgctgatcaccgcagctgatccggatgcacgcattctgttgcatggcaattcgatgggcgccgccacggtgatgatggcggccggcgatgcgcgactcccccgcaacgtcgtcgccgcgatttccgattgcggatacagttccgtggtctcacagtttacggataatgccgaggcgatgttccatttgccgcactcgttggccgtgctgctggtcaaagtggccagtcatgtgtctagacgcaaagctggataccggtttgaggacgcctcctgtgtgaaggcattacggcacgcgactattccgatgatgttcattcatggcggagcggatacttttgtcaatccgaagtatctggacatcaattacaacgcctgcgccagcatcgaccgcgagaagctgctgattcccggcgccgaccacacgatgagcgccagcaccgatccggaccgctattggcgtcgcgttaacagctttgttaagcgggtgtttggactgtagtagatatagagcttggctcccctcacagaggggagccaagaatggttacgcgagcagttccttgacggcggcgatgacggcctgcaggctcttctttgcatcgccgaacagcatctgggtgttgttctcgaagtagagctcgttctggatgccggcatagcccataccacggccacgcttcatgaccacgacgttctgggacttgtcgacgtcgagaatcggcatgccggagaccggggtgccggggcgacgagcggccgggttggtcacgtcgttggcgccgacgaccagagccacgttggcctgtgggaactgcgggttgatctcatcgagatccacgagttcctcgtagggtacgttggcctcggccagcagcacgttcatgtgaccaggcatacggcctgcgaccgggtgaatggcgtaggagacttccacgccgtggcccttgagcagttcgccgaggtcagcgagctcgcgctgggcctgagcctgagccagaccgaagccgggcacgaagatgaccttctgcgcgtagacgagctgaacggccagatcgtccggcgtggtctccttcatggtgccttccagaccgtcgccagcagcggcggcgtcagcaccaccgccgaagccaccggccaagacggagagcagcggacggttcatggcctgagccatgaggatggacagggtcacacctgcggaaccgacgagtgcgccggccacgatcagggcaacgttgtcaatcgccagaccggacatagccacagccgtaccggtgcaggcgttgagcacagagatgacgacgggcatatcggcgccgccgattggaatcacgaagaccaagccgtagcacagggcgaacacggtggtcagaatcgaccacagcagacgctgttcgggctggacgcacagcatgaccagcgaggcgacagacagcacggcgaacagaatgttccatacgcccttgcccggcaggttcagcttcttgacccacttgatgccctgtagcttgccggcagcgatgagcgagccggtgaaggtcacagaaccgatgagaataccgagaccagcggtgatgagcaccacgatgtccggggtgccttccttggtcaggatgtcgttcagggccacgagtgcggcggcgccaccacccacggtattgaacacggagaccagctgcggcatatcggtcatcttcaccttcttggcggagacgacaccggccacggcaccgatcaggatgccgacgaccagcaccaccacggcgacaatgttcacgaagcccttggcgaagagcacgatgaacgccatgagcacggccacgaccatgccgaacgcagagatctggttacctttgcgggcggtcttcggcgaattcatgaaatgcagaccgaccacaaacaggacggcagagaacaggtaggcgaaccaagcgacgatgtcgatggcgccaacggttgcggaggtcattacttcgactcccccttcttctcgttcttgctggacttgaacatctcaagcatgcggtcggtgaccacgtagccaccaacgacgttcatggtgcccagcacagcggccaagaagatgaacacgtaggccagcgggctattggcttcggctgccacgatcacaacgccgacgatgacgatgccgtggatggagttcgcgccggacataagcggcgtgtgcagggtggcgggcaccttgccgatgacctcgatgccgatgagcagcgcgaggacgaacagggtaatggaaacgacgagagtaggcacggtattccttcttccttacttctcggacttctcggcatcggcagcagctgccggggcggcggcgcggccggcaaccaccagcgcgtcgtcaagttcttcggcgagatcctggccgagcttgccgtcacgcacgaagtgcacgaggatgtcggccacattgcgcgaaagcagattggacgcagtggtggcgacgccggaggccagataaggggcaccgatcagcttgacgccgccctcggtgacctgctcgccgacggcggagccctcgacgttgccgccgaggtcggatgctgcgcagtccacgatcacggcaccacgcttgagacccttgacaccggctgcggtgagcagcaccggaggcttgcggcccgggaccttggcggtggtgatgatgatgtcaaagccggcggccttctcgtcgacggcagcctgctgctgagcctgctcctcggcggtcagcgcacgggcgtaaccgccctcaccctggcccttggagaagtcaagtcccagatcaaggaacttcgcgccgagggactcgacctcgccctgggaggcgggacgcacgtcgtacgcggtgacgaccgcgcctagacgcttcagcgtaccaatggcctgcaggccggcgatgccggcaccgagcaccagcgccttagccgggcgaatcgtgccggcggcggtggtcatcatcggcaggaaggaaccgtaagcatcggcggcggtgatggctgccttgtagcccatcacggagttctgagaggtcatctcatccatggactgggcgctggaaagcttacggggcagcttttcgatggcgatgcccaccagaccggccttctcgagcgcggccatgtaatcggcatcggtgaaggaaccgagcatgccaatgacccactggccggccctgagcttggccacggtctcggcggacggtcggtccacaaaaccgagcgcgtcggcttcggcgagcacctcgtcacggctggtcaccttcgcaccggccttttcgtaatcctcatcggtgtagtcggcagcaatgccggcacctgcttcaatcagtgaagagacaccgctcctcttcagccgggtgacgatatccggcgtcagcgcgacgcgggattccgtttcggacgtttcgttcaaaacgccgaacaccacggtggcttctgggttttgcgccatgagagccctttcttgttctacttcaaaatggacatggttatccgcatagaaagtgtagtcggaaggtaaaggccatgacttgagattccgccaatcgaaacagaaacgaacccgaaattagtgagaaatacgaatgtgtccatgcgcattgcggatgaattgctcggaagtcgtccaacaatcacccggcatcgattagcaaccaaccgctcagtaattatcgacaatcaccgtttcgtagctcacggttactcaacaatatcgggacctgtgcaatattttgccacgcactcccctaacccgccagaatcctacggttgcgtaaggtgacgagttcggtttgggcgattacaatttgaactttgagaagcgttcgcctcatggctggacgacactgaaaggtttacaggagcaagacttgtcggttatcaattccttcacgcagcacacgatcgatctcacccgcaaggcgctcaggttgggatccgacttcgtccacccggtccacgatgacaccccggacgagcccgattacctgtccaacgccgacgtgccggtcgagaccaacatcgctttgcctcacagcgacgattgggacgacggccacctgaccgtcaccgacatcgaccccgccaccggcctgctcaccacctccaccgaaggcaatccgccgctggacgaaggtacgtccatctacgacctgtatgcggaccgcgccgaacgtatgggcgatgagccgctgtacacctacaagtccggcaacgattgggtgaccgtcaccgccaacgagttcctggctgacgtgcgtgccgtggccaagggcctgattcattacggcctgaagaagggcgatgccgtggcattcatgtgccgaacttcctacgactgggacctgaccgacgcggcgatcatggcgtgcggcggcgtgctcgccaccatctacgacaccgattccgccgagcagattcgcaatatcgtcaacaactccgatgcccgactgctgatcgtgcaggacacggacatgcgtaagaaggcggatgggtccgtcgaagagtgcccgtccctggagcacatcatcaccatcgagaccggtggcttggacgaaatcaaggcctacggcaccacggtctcggacgaggagctggacgagcgcatcgattcggtcaagaagaccgacctgtgctccatcgtgtacacctccggttccacggccgcgccgaaaggcgtggagatgacccacgagcactactgccaaaccgcgctgaatctgccggcctacatgcccgatctgctgcacgacaagaggaacaccatcctgctgttcctgccgcaggcccattccttcgcccgcgccatcaactacatcgtcgtctcctcgaacgtccgcatctacatcgccaccggcatcaagacgctgatcagcgatctgcaggtggccaagcccactctcatgatcgtggtgccgcgcgtgctggagaaggtgtacaacgccgcgtcccagaaggccggccacggccccaagggcgtggtgttcgcctccgccgtggtggctgcgcagaactatatgaaggaagtctccgccaatggcaaggcaggtgcactgacccgcactcgccgcgctgccttcgatccgattgtctactcttcgctgcgcgaagtgctcggcggtcgtgccaagtggattgtggccggcggtgccccgcttgacccggaactgctggctttcttccgtggcgcgggtgtgcctgtatacgagggctatggtctgaccgaaaccaccgcgccgtgcgcgttcaacccgctgggtacgccgttccacgctggttccgtgggcatcgcattccccggattctccctgcgcatcgccgaggacggcgaaattcaggtcaagggtcgtgccgtgttcccgcgctatcacaagaacgacgaggccactgagctgtcgttcaccgaagatggctggtatgccaccggcgatctgggccgcatcgacaacgacgggttcctgtacatcaccgggcgcaagaaggatctgatcatcaccgccggcggcaagaacgtctcccccggcccgatcgaggaggtcatccagcgttgcgagatcgtctcccaggcgttggtgctgggcgacaaacgcccgttcatctccgccctggtgacgttggacgagaagtcgttgcgcccgtggctcgccgccaaggggcttgacgagaacatgtccctcgaggacgcggcaaggaacgccgccgtgcgcgccgaagtgcagcagtgggtcgatcgggccaacgagggcgtctcccgcgccgaatccgtacgcaagttcatcatcctgcccgaggagttcacccaggagaacggtctgatgaccgcttccatgaaggtgattcgccccaaggtcatcaagcgctactccaccctcctcaacacccagatgtacaccaagcggaagtaaaccgtatagcaaaagctccctctgacgagggagctttttcgtctatacgccctagaagcctaggcgctccagctgcttggggtcggactgccagcctttggctaccttgacgtggaggtcgagcttggctttttggccgacaatgcggttgaccggggtgcgcagcttcttcttgacgtaggtgaggttcgaggcgcccttgccgatgatgatcggcttctgggagtcacgctccacgtaaatggacacgttgacctgcgccttgccgtcatagccctgaccggtctcgttgtcttccggatagtcgatggaatcgaccaccacggccagcgaatgcggcagctcgtcgtccagggtctcaaggaacgcaccgcgcacgagttcggcgatggtgtcttccggacgctcctcgctgatctgatcgtccgggtacatctgcgggccctcgggcgtgtgctcaatgagcacgttcttcacttcagccagattgtcgtgcttcagggcgctcaccggcacgatgtccgagaaatcggcgaaatcgttgatttcgatgagcttgttgatgagttgctgacggccaagctcgtcgatcttggtgacgatggcaatcagcgggatgcgccacttgaacgtaccgtcctcacgcttggtggcgaagtcggtacgcagtcgggaaagaatacgcttgtcgccggggccgatttcctggtcggcgggcagcaggaaggccaccacgtccacatcggccaaggattcgtcgaccacgtcgttcagacgctggccaagcaacgtacgcgggcggtggataccgggcgtgtccacgagcacgagctgcgcgtggtcggcggtcaggatgccgcgaatcgccttacgggtggtttccgggcgagaggatgcgatggcgatctgcttgccgatcaacgtgttgatcaacgtggatttgccgacgttcgggcggcccaccacggccacgaatccggagcgatacggcacgtcctgcttggtcacattctccgtttcaccggtcgcgtcgacttcggcaacgccggcaacatcggaagcatcggtgacgtcaatgtcatcgacgtcgttcgtgctgttgttctggtcggtcatatcactccttgctggcggtatcatcgccttcgacgggctcgccgtcagtttcctcatgggtcctgctattttcctcgccgccctcgacgtgcgccggttcgacgacgatggtggacaccttcttgcggcgtccggcggagtccacggcggtcagtcgcagaccgcgtgtcacggccgaagcaccgacaatcggcacgcggcccagaatcttggtcagcaggccgtacacggtatcgacatcgtcctcatcaatgtcgatctcgaagatctcctccagatcggcaatcggcgtacgggcgggcatcttccacttgttgtcgccgattttctccggctcggtacgctgggtgcggtcgtgctcgtcttccagctcgccgacgatctgttcgatggcatcctcgatagtcaccatgccggcgatgccgccatactcatcgaccaccacggccacatgttggcgggaacgctgcatctcatggaacaggtcgtccaccggcttggattcgggaacaagcagcggctgccggacgatggattcgaccgtgcgctccatggccgccgggttgaaggcggtggcgcgcacggcgtccttcaaataggccacgccgatcaggtcatccacatcctcaccgatcaccggcacgcgggagaaaccggagcgggagaacagtttcagcgcggaagacagtgtggagtcgcgctccatgcagatcatatcggtgcgcggcaccatgatctcgcgagtcaacgtatcagacagggtgagcacgttgcgcaacatttcggagacttccggatcgaagtcgttggactccaccagtcggtcgatggcggccttgccctgctcgagctgaatcttctcaagctcctcgtcatcggacagatcggagtccttggagcggcggcccggccccttggaaccggacttgtcgccaccgatgcgtgcgaacggcgtgagcttggtggccaacgacacgatgcgcgagttggaaatcatgatgtcgaccggcttggtcatgccggcggtgcgcgggcggaccagtacggagaccacggctacgataatcgcgaacaggaatccagcgagcagttcaacccacagttccgcaccccacagggatgcgatggaagacaccagtacgccgtcgagcacattgcaggcgatgcggaagaacgcacagctgccggcggtggcgtaacggtcggcgatgagccgttgcacgcgatgaatcttgtcgatcttcttcatcttgaggaactggcttgcttcggagtcggtctgcacctcgaggatgagattgttgaggctggctcgcgttacgcgggccacggcaccttcagcggcggccatggtcagcgaaagccagacgaacagggccgccacaagtacgagaatgacggtgacggcgatcagcgtggtactggaatactccataatgatttttcggtgtccttgaatgtccttgaacggtagagaataatccgaatttggtgtgattgatttggaagtttatttggaatcgaggtcgcggccagcaccgtgcgcggcgtcgtacagggccagcgcgtcgggtgtgccggcgggcagcgtggcctgcacgttggcatcgtggcgcagggcgaagaaggtgagcagcagctgtcgctgcaggccgaacatctggcgctcctgctcgggggtcacgtggtcgtagccgagcaggtgcaggatgccgtggatggtgagcaatagcatctcctgcatggtgctgtgcccggctgcggcagcctgttgggcagcgacccacgggcagatgacgatgtcgccgagcactccttccatcacggttttgccgtcgcctgggcgcagctcgtccatcgggaagctcatcacgtcggtcggaccttcgaggttcatccaacgcatgtgcaattcggcgatgggattgggatccacgaacatgatggtcaggtcggactgggtgctcacgcgcatctggtcgagtacccaaatacccaaatcggagaagaccttggggtcgatgacccactgggtttcattggtgacgtcaacgctcatcgtctgtctcactttggttggttgaatccgcttgctggcgggcatcgaagtcggtatggttgcggcggcccttgcgttcgatgtcgcggtggtcgccggcgatggcggagtgacggtcgtaggcggccacgatctggccgaccagctggtgacgtaccacgtcctcggttttgagatgcacgaatgcgatgtcgttgatgccgcccaggatgcgttcgatggtggccagtcccgagcgcggcacggtaaggtccacctgcgagatatcgccggtgatgaccatcgtggtgttgaagcccagacgggtcaggaacatcttcatctgctgttcggtggtgttctgagcctcgtcgaggatcacgaacgcgtcgttcagcgtacgaccgcgcatgtaagcgagcggcgccacttcgatggagccgtcgtccatgtaccgcttgagctggtcggcgccgagcatgtcgccaagcgcgtcgtacagcgggcgcagatacgggtcaaccttgtcgttcagcgtgccgggcagaaagccgaggctttcgccggcctccacggccgggcgcgtaaggatgatgcggcgaatctgcttgtcctggaaggcacgcacagccttggccacggccagatacgtcttgccggtgcctgcgggaccaatgccgaaggtgatggtgtgcgattcgatggcgttcacgtaggccacttgtccggcggttttcgcacggaccggcacgccggcggcaaaggtgatgacgccgggaaccgtgggcttgcggtacgtcgggtcgtgggagccggcagaacgtgcatgggcgcgttcgtttgaggtcgattgcgccagtttgtcatgcaccgggccgtgacctggatgttcgaggcgcacgtggttcttgagcacgttctggtcgagcatgcgacgcacggtgtcggcgtccataggcgcggtgtaggcggcttggatgatggtgttgaccaaatcctcggcctgtgcggcctgggcttcggtctgcttggagcgggagacgatcgccacgcggttgccgcgcacgataatcgtcaggtccggaaaggcgcgctccacctcgcgaatgacctcgtcaaccgggccgagcacggcgacggggtcaagttggggcgggatggtgatggtacgtgtagtcgttgccacgaagcggatattcccctactactcgtcgagcttttcgccggtcatcacgtgcgcgtgcacgtggaagacggtctggccggcgtcgagaccggtgttgaacaccagtcggtaggcgccgtgaaattccttgtcggcgatgttctgcgcgatggagacgatgtgggccagctcggtcgggtcgtcggcggcaagttcggcgacgttggcgtagtgcttcttgggcaccacgagcacgtggaccttggccttggggttgatgtcgttgaatgcgtaggtcgtctcgtcctcgtagaccttgctgctgggaatctgccctgcgatgatcttgcagaacaggcaatcgtcggattcgctcatcatgctccttggtttgatgttgctacgcaccagcttagcgcgtgggcgttactcgtaacgtcccaacacccgagacaacagcgacaacgctacaggaccggccgtcgcggctctcagaatattgtgccccagtacgcagctcaccgctccggccttgacgaaatcagctacctcctgctcactgatgccgccctcaggcccgaccaccacactgacagtccgcggccgaccgtcctggagcgtgcgttccaccaactgcgcaaccttctcctccacgccggaccacgtatcggtagcatcctgatgcagcacaatcaccacatcgccatgcacgcaggccctgcggcagatggccacgacctctttgctggacgcgcacgcctccaattgcggcttaaaggcgcgccgcgactgctcggtggcggcatccagtaccgaattccacttcttgtctgtacggccgaccttccacttggcaatggatcggtccgcctgccatggcaccacttggtcgacgccgatctgcgtagccatatcgatggcctgctcatcatggccggttttcgccaatgcctgaatcagcgccaaacgggtgagctgctcgggttcgcgccccacttccacgacttcagccagtccggcttcaggatcggccatcactgcctggattctcaagccgttgccgtcggaaagttgcaggctgtcccctgccttgagtcgcatggcctgcacggcatggcgcttgatgtgagcaggcagggttagcttccagccggcgtggagttcgtcgctgttcaccgggacgtcgtcgacctgcgggtcgaaaagaaaaagggcatcagtcatgacttcaaggctacacgcgacacgccgggcacacgcgcgaattgcatccctgtaatttcatgctaagctatttactcgttgtccaaacgacacctgcccgggtggcggaatggtagacgcgctagcttgaggtgctagtgcctattttatacgggcgtacgggttcaagtcccgtctcgggcacagataaaccccttgcattgcaaggggtttttcgttatctgcacacacgaaaggccaccaatgcagttcatcacgctggacaccgttgacgacccgcgcgtcgaagcgtatgtgagcctcaccgaaatgcagttgcgcaatcgcttggaaccagccaagggcgtgttcatcgccgagtcccccaaagtcatcgaccgcgcgctggccgctgaccgcgaaccgctgtcactgctggtcgaggaaccttggctggagggcatgaaagacaccttcgacttcatcgacgggcgctggggcgcggatattcccgtctacgtggcctcacctgagcagctcaagcgtctgaccggctaccgtttgcatcgcggcgccctatgcgcgatgcgacgctggctgctgccctccgtagccgaggtctgcaggagcgcccgccgcgtggcagtaatggaaaacatcgtggaccacaccaatgtgggcgcactgatgcgttcggcggccgcgctcgatgtggatgccgtgctggtcacgccctcctgcggtgatccgctgtaccgacgagccgctcgtgtgtcgatgggcaccgtattccagattccgtggacccgtatcaccgggttcaacgacgacggtaccgaaaacaagcattactggccgttccagggcatcgacgagttgaagtcgctgggcttcaccactgtggccatggcattggaggatcgttcgatttcgttggacgaactgacacgccgtctgcacgcgcctgacgaagatccgacgcatatcgacaagctcgcgctgatcttcggcaccgagggcgacggcctgtcccaccatacgattgcccgcgccgatttgaccgtgaagattccgatgagccacggcgtggatagtctgaacgtggcggcatccagcgcagtggcgttctacgcgacacgctaaggaatcgcacgcgcccctaaaaggccgaatccttaacaaatctacgaaactgttcatcgcaagttcacggcacgcgggtggcaaaagccttgcatgttcgattttttctgcaattattaactatgtaaaccgaatgcaaggaagcatccggcccagtagtgcggtgtcgaaagacgctcagtaacagagaggacagttacgatggccaagaatcccaagattctgtcgattgtgcttgcaggtggtgaggggacccgcctgatgccgttaacccgcgatcgcgcgaagcccgccgttcccttcggtggtgtgtatcgtctgatcgatttcccgttgagcaatctggtgaactccgggtaccgtcaggtcgtggtgctcacccagtacaagtctcactcgcttgaccgccacatctcccaggtctggcgtttctccccgctgcttggttcgtacgtctcccctgtgcccgcgcagcagcgtctcggcaagcattggtatctcggctccgccgacgccatctaccagaccatcaacatcatcgaggatgtccagccggacatcgtggtgattgtgggtgccgaccacgtctaccgcatggacttcgaacagatggttcagcagcacatcgagtccggtgctgagttcaccgtggccggtatccgccagcccatcgaggaatcgaaccagttcggtgtgattgaggtcgatcacgatcacccgaacatgatcaagaacttccaagagaagccggccaacaccaccggtctgccggacaatccgaaccagattctggcttccatgggtaactacgttgccaacaccaaggccctgtttgaggctctgtctctcgatgagaaggctgccgacaccaagcacgacatgggcggcgacatcgccccgtacttcgcttctcgcaacgaggccggcgtctacgacttcaactcgaacgagattccaggctccacggccactgatcacgcttactggcgcgacgtcggtacgattaagcagttctacgatgcacacatggatctgatcgcctatgtgcccgagttcaacctatacaaccaggattggccgatttacacgatgtccggcaacctgccgccagccaagttcgtgcacgcgggccgcgaccgtctgggccacgccaccgattcaatcgtctcccccggtgtgatcgtctccggcggtgaagtgcaccactccgtgctctcccccaatgtgcgtatccactcgtgggcacagattgtcgattccgtgctgttcgacggtgtgatcatcaaccgccgtgcccgcgtgtacaaggcaattcttgacaagaatgtggtgctcaccgaaaactccactgtcggcatcgataccgagcacgatctggcccgcggcttcactgtcacgccagacggcatcacggttgtcccgaagaacaccatcgtcgatgactgattgaccagtccagacatggaaaagccccgtatcatgcggggcttttctcgtatagagctccctcatcagagggagcttactaagcgctatcagtactttggcatgttgtcgaagttgaagcctagggcggcgagctggtcgcggccttcgggtgtgatgcgctccatggtccagcgcgggtcccacgtccagtcgatgcggaactcctcgaccagaccggccagtgtggaggcgcattcgtcctcgataaggtcggtcagcgggcaggccggcgtggtcagcgtcatcgtaataatggcgcggcctagctcatcgatctcaatgccgtagaccagacccaaatcgatcacgtcgatgccaagctccggatcaatcacctgatgcagtgcctcgcgcacgtcttcggcagtggcgcggccgatatcgtcaatcgccttgatcggaatctcgctgccatcggactgttcgtcatcccggcaaccgcatttgccatggtgaccgccacacgcacaggtgtcatcgccggacgcagcagagtgctcgatcgggcgtccgttcgggaagcccttggccaaggccgggttggccatcacgcggcgagcggcctcctcgtcctgcaggacgccgttgacggcatcgaaaacggatggctgtggttcgggaaccaaattatcgttggacatatttcctcagttctttgcagcgagggctttggcgatggagtccttcagcccttcccagcctagcagagcgcatttgatgcgcatagggtatttcgacacgccttggaataccacggcgtcgccgagcttttcttccaggttctcgtcgtccagaccggcaccgcgcgattccatcagcttgtggaatgtctgttccagatccatggcctcgtccacggttttgccgcccaccagatcgaccatcaccgacaggctggcctgcgaaatggagcagccgtggccgtcccacaccaatcgcttgatggtgtgcggttcgtcatcggagacttcgacatggatggtcgcctcgtcgccgcaggtcgggttgaactggtgcgattcaccgggcgtgcagtattcgtggctggcttgcacggtgacattggccgccgcgtccgcggactgttcgaccgccgcgttgggcgcaaaggattccttgccatgcggatgttttgacgcctcgaggatgacctcttggtacatctgttcgaggtcatccccgctcataccgaattcgttcatggtgatctgttttactccactccaaagaacttacggatacccttggccgcttcgaccaatgcttgggcatcttcgaccgaattgtagacaccggaggaggcacggttggatgcgtataggccgaagtggcggtgtaccggctgggcgcagtggtgccccacgcgaatcgcgatgccctgggcgtcgatgaactggcccacatcgtgcgggtgcacgccggccacgtcgaacgccacggtgccgatgcggtccacgttttcgcgcggtccgaggatacgaatgccatcgatgtcgccgagcttcagcagttcggcggcgatggtcttctcatgggcttcgatgttctcaagaccgatattcatcatccattcggcggcgacgcctgcggccaccacttgggcgaccggctgggtgccggcctcgaaacgggccggaggggccatgtattgggcctcgtggtccatgtaggcgagctcgaccatggagccgccgaagttggccggcggcagggcttcgagcagttcgcgcttaccgtacaggaaaccgacgccggtaggaccgtacatcttgtgcgcgctccaggcagcgaagtccacatcaagcgcatggaaatcgactttgaggtgcggtacggactggcaagcgtccaagatgaagatcgaacctacttcatgcgcacgcttgatgataggggcgatgttggtgatggcacccgtggtgttgcccacgtgggtgacagccacgaccttggtacgctcggtgatgacttcgtcgaggttgtccgtacgcacacggccgtcctcggtcaggtcgatccacttgaaggtggcaccggtacggtaggccagctcctggaacggcagcagcaccgaatgatgttccgcgcgcgagacgacgatctcatcgcccggcttcagggcaaaacgcttggcggcttctcccccacggcccagcgacgcattgccgaacgcggtggcgagcaggttcagtccggccgtggcaccaccggtgacgacgatctcttcttcgccttccgctgcattcgcgccgaccagcttggcgaccttggcacgggcctcttcgaaagccatggtactacgggccgccagctcgtgggcaccgcggtgcacgccggcgttgatcgtacggtagaagttcgcctcggcgtcgatcaccgcattcggcttctgcgaggtggccgcagaatccaggtacacgagcgggtgcccgtgaatctcctgattcagaatcgggaactcgccccgaatctccttaaaatcaaccattatgttcccctacttacgtaacaattgtacgaaacgagtgggagtcggacatggcctgttcgcgaccgtaaagacttggcctgagcggcccggaacgtgtcgagaatagggcatgtcagactcccacggtcacggtctcaggccagcgcggactcggaatcagcaccctcgggcaggtactggtcgtagccgttctcttcgagttcgtcggccagctcagggccgccggtcttgacgaagtggccgtcggcgaacacgtgcacgatgtccggcttgatgtacttcaagatacgggtgtagtgcgtgaccatgaggatgccgaactggttggcttccttggcacggttcacgccttcggacacgatgcgcagggcgtccacgtccaagccggagtcggtttcgtcaaggatggcaaacttcggcttcagcagttcgagctgcagcacttcggcgcgcttcttttcaccgccggagaagccttcgttcacggaacgggaggcgaacttcgggtccatcttgaggcgcttcatggctgcggacaggtctttggcccactggcgaataccgggagcctcgccgtcgatttcggtcttggcggtgcgcaagaagttggtcatggacacgcccggtacttcgaccgggtattgcatggccaggaacaggccggccttggcgcgctcgtccggagtcatcttgaggatgtccttgccgtcgaggagggcctcgccggagtcgaccacgtacttggggtggccggccaacgtgtaggcgagagtggacttgccggaaccgttggggcccatgatggcgtgggtttcgccggagtggacggtcagggtggcacccttcaggatcggcttgatgccttccttggtttcgacgtggacgtgcaggtccttgatttcgagtgttgacattgttgtgctcctaaaaatgctgttcttacttgtcttcgaggacctgtgccatggcgtcgttttcgccacgggccagtcggcggtcaatcacggtcatcagatgttcggagatggcaggaatgccgatctcctcgacgagttcgccgaagaagccacgcaccacgagcttgcgggcgtcggtttcggggatgccgcgggattcgaggtagaacagttcctcgtcgtcgaagcggcccaccgaagaggcgtgaccggcaccgatgatgttgccgttttcgatttcgaggttcggctcggaatcggcgatggcacccggggtcaggaccaggttgcggttgagctcgtaggagtcggtgccgggggcggtgggctggatgagcgcgttgcccacccaagtggagtgcgcgcccttgccgtcaagcgcgcccttgtagaccacgcgggacttgcagtcggggtggttgtgtaccaccatcgtgcggtgttcgatgtgctcgccggggtccacgaagtagatgccgagcatgttgaggtcgccttgttcgccgccgaagtcctgatccatgcggatgcggacgatgtcgccgcccaaggtcacgacggagtggcgcagggatgcgccttcgccgacgtggatgcggtggttggccacatgcttggcggttttggcccattcctgaacgaacgtggtggagacgtgcgagtccttgccggtggtgatttccacgccttcggccagtcgtgcgtcaccgttgtgttccacgacgacgtccgcatgagccttgtcggcggcggcgatcaccagatggaaagcgtcgaggtcctcccccgcgccgtgcaccttgacgagcacgggctgggcgatctcaccggacagttccagaatggttgcggtgtggccggattcccattcgactgcggagacgcggtcgttgggcttggacacagtgccggacaggccctcaccgagcttgatctggctgagcttcacgccttcggccaacggcgagccgtcaatcatggagacttcgatctgcgtttcgccggaaggcttgaacacggtgaagaactcgttgatgcgctcgataggcgtgtagcgccattcgtcctgcttgcggctgggctccgggtagtcgcctgcgttgaacgaacgcacggcatggtccacggaggacggcatggcggccggaatcgcgtacgggtcgttggggtcggcgaccggaatcttgatttccttgacgggtgttgtgttgtcggtcatcggaatcagcccaccgatccttccatctgaagttccacaagtctgttgagttcaagcgcgtattccatcggcagctcgcggctgatcggttcgacgaagccgcgcacgatcatgcctcgcgcctcttcctccgtgagtcctcggctcatcaggtagaagagctggtcttcggaaatcttggaaacggtggcttcgtgggccatcgaaacgtcgtcttcgcgaacgtcgacgtgcgggtaggtatcggagcgggagaagtcgtcgaccagcagggcatcgcacacggtcgagttggacgaaccgtacgcgcccttgacgattttgaccagaccgcggtaggcggagcggccgccgccgcgcgagatggacttggcgacgatggtggagctggtgtgcggtgccaagtgaatcatcttcgcgcccgtgtcctggtactggcccttgccggcaaagccgagggacatggtggatgccttggcgtacggttcggcgaggatgcaggccgggtacttcatggtggccttggaaccgatgttgccgtccacccactccatcgtgccgccctcacgcacgtaggcacgctgggtgacgaggttgtagacgttgttcgaccagttctgcacggtggtgtagcgcacgcgggcgtgcttctcgacgatgatctcgacgatggcggcgtgcagcgagtcctcggaccagatcggggcggtgcagccttccacgtagtgcacgtaggagccttcgtccgcgataatcagcgtacgttcgaactgacccatggccggggtgttgatgcggaagtatgcctgcaacgggatgtccacgtgcacgcccttcggcacgtatacgaacgagccgccggaccatgccgcggtgttgagggcgccgaacttgttgtcctccgggggcacgacggtgccgaagtacttcttgacgagttcagggtattcgcgcacagcggtgtccgtgtcgacgaagatcacaccctgcttcttcaggtcctcacgaatggagttgtagattacctcggactcgtactgggcagccacgccggagacgaggcggttcttctccgcctccgggatgccaaggcgatcgtaggtgttgcggatatcgtccggcagctcctcccacgacttcgcctgcttctcgatcggcttgacgtagtacttgaagtcgtcggcgttgaagccggagagatccacaccccaatcgggcatgggcttttcgaggaacgccttgaatccacgcagacgcatgtcgagcatccactgcggctcgcctttgtcggcgctgatcgcgcgtacgacgttctcatcaatgcctcgttttgcggcttcgccggcggcatcagaatcatgccaaccatagttgtagtcgccgaactggctgatgatctcgtcatccttcttgatcttgtcctcgttgacgcgggtacgatcagccacatactggctcatctccacgtcagcggcggcgtttggcgctgtgttttcggtcaccatcctgccttccttgtatcacacttaaccctatgaaaacctagcagaacccaagtgcaaacactagctgccctgacgcatattggctgtgggcttgattacatgcgggcgccatcgggccatgcggcatcacggatggcgccaaacggcgaaggcgtggcggcgaagcatcctgagatgccgtgccgtcacgccttcatcgtgcgcggaccgaccgcgcgggatccacggtcagcgggccgcctgatggccgagcgccgccttgaccagaccggcgaacagcggatgtggcttggtcgggcgggacttgaactccgggtgagcctgggtggccacatagaacgggtgcacgtcctgcggcagttccacgaactcggtgagctcgccatccgggctctggccagagatgcgcaggccgccttcgcgcagacgatccttgtacgccacgttgacttcgtaacggtggcggtgacgctcggtgacatgcgtggtgccgtacagttcggcgaccagcgagccttcctccagctcagccgggtaggagccaagacgcatggtgtggcccatgtcgcccttgccggccacgatgtccttctgctcttccatggtggcgatcaccgggttggcgcaatcgggctcgaactcggaagagttcgcgtcttcaatgcccagcacgtggcgggagtattcgatgaccatggactgcaggcccaggcacaggccaagggcgggcagcttggtttcacgggcgaacttcagggcgccgatcttgccatcgatgccgcggatgccaaagccgccggggatcacgatgccgtcgacgttgtcgagagcggcggccgcaccttcggtggtttcgcaacggtcggccgcaacccacttgacgttgaccttggcccagttggcaaagcctccggccttgatggcctcggtgacagacaggtaggcgtccggcaaatcgatgtacttgccgacgatggcgatgttgacctcgtgcttggggtggtggacgcgctcaagcaggtctgcccattcatcccaatcgacatcgtggaacggcaggccgagctcacgcaccacgtaagcatcaaggccctcttcgaacaggatcttcggtacatcgtagatgctcggcgcatccacgcagttgaccacgccttcggcatcgacgtcgcacatcagggagatcttgtctttgatggactggttgagcgggcggtcggaacgcaacacgagggcgtccggggagatgccgagttgacgcagcatcatcacggagtgctgggtgggcttggtcttgagctcgtgggcggcggaaatgtacggcaccagggaaacgtgcacgaacatgcagttgtccgggccgagatcgcggcgcacttcgcgggcggcctcaaggaagggctgggactcgatgtcgccgacagtaccaccgatctcggtgatgatcacatccacgtcatcggaagcctgggcgcgcatacgagacttgatttcgttggtgatgtgagggatgacctgcacgcactggccgaggtattcgccggcgcgctccttgcgcagcacttcctgatagatctgaccggtggtgacgttggccttctggctcaggaagacgtcgaggaaacgctcgtagtggccgatgtcgagatcggtttcagcaccgtcttcggtcacgtagacctcaccatgctggaacgggttcatggtgcccgggtcgacgttgatgtacggatcgagcttttgctgcagaacatggatgccgcggctgcgcagcaaacgaccgagcgaagatgcggtcaggcccttgccgagagaggaaacaacgccgccagtgacgaaaatatgcttggtgacgtgctcttgagaattaccatgtgttcttctaaccatggaattccactctatcatccgtgtatgacccggcgtgttcatgacgtggccggtgtagtcgcgcgtaggcggcccgtctcgtcctgccttggccagcatatggtcgaatacacggcgcacttcaggcccatagggcgcaccaggacgaggattctggtccgattcgtcggaacaggaatcccgggctcaacgtcgactgatacccgggattggctggagggcttggttctattcgctcagcaagtgcgccacagcatcgagcgcgagcttgtagccgtagaaacccatgccggtgatggtgccggtggccacagggctgattacggaacgcttgcggaactcgtcgcgggcggacgggttggaaatatggacttccataagtggcaggttctcatcaatgaccatgtgcgcggcgtcggcgagagcatacgaatagtgcgtgaaggcggcggggttcatgaccaccggggttttctcgtcggcggcttggtgcatccagcgcaccatttcggcttcgtcgtcggtctgacgcacctcgacttcgaggccgaggtccttgccccattcggcgcagagcttgcgcagggtgtcgaggtcttgacgaccgtagacgtcgggctggcggacgccgagacgtccgaggttagggccattgacaacgatgactttggtcatcgggactccttttgtttgtgcttctctccctccgccccttcggggcacctccctcatcagagggaggaagaaggtagatccgactccggggcacctccgttagaggggagccaagtacttttttctgaggggatggcgaacggcacggcctgtggccgttcaattattgctggatacgatggaaggcttcttctacggcgtcggcgggcgggttgtcgaggtgtacgacgtgaccaatctcgtcaaggaccacgaaacgcagttcgttgccacgggctttcttgtcgcgatgcatcaatgcgagcacgtcgtcgaacgagccgccatgccacgacgtcggcagacccagcgaagcgagcaacgagcggtgatagtcaaccagatcctgatcgatgtaaccgatcagatgggccagctcggcggcatacaccataccgacggccaccgcattgccatgcctccagcggaagtgctcgagcttttcgatggcatggcccatcgtgtgcccgtagttgaggaattcacgaagacccttctccttcaaatcggaggagacgtgatagaccttgacctttaccgtgcgctcaatgagctcggcaaccacgtcttcgagcggcgagccaaggaatgtagagccgacgaaagcgcgcagttcagctgcgtggtcttcgaggatatgaaggatttcgggatcgcggatgaaaccggatttggcgacttcgccgagaccctcgatgaagatgtcattgggtagcgtagccagcgtcttggtgtcggccagcacaccggcaggcgtgtagaacgagccgacgaggttcttgccctgcggggtgttgatgccggttttgccaccggtggaggcatcgaccatggccagcagcgaggtcgggcagttcacatagcgcacgccacgcatccacgtggcggccacgaaaccggccaaatcggttgcggcaccgccgccaagccccaccacggcatcggatcgggtgaaaccttcgttgccaaggcgttcccaaatgccgttggccacggtaatggtcttgccgggttcggcatccggaatcacgatgtcggaaacctcatagccgccctgacgcaacagagcgcgggcacgatcggagtgtcgctgcaccgactgagtgtggataagcgcgattttggcgggtttgggtcccagcacatcggccagatggttcatggcaccttcgccaatgaccacatcatacggctcaattgccgctccggtaacatgcactgctcgctcagataccatatcaatcactttcttcgctgcgccctgaggcgtaagccccgggtatggacatgaacgttggcgacctcgcggaatactgggtcacgctgcttgaacagttttttccaacgggagttggcgttgccattgagcatgggccggcctcccccacggttcgcgcgttccatggcttccgccggatcggcatcaaggtagaccacacgaccgccatggtcgatgtaggaggcgagggcatgctgggtggaggacgtcatgggagcgccaccgcccagcgaaaagataccgtcgaaatcctcaagcatatcggcgatgagatcggcctcgacctcgcggaatgccggctcaccgtattcctcgaagtaggagggaatcttcatgcccacttcacgttcgatctccacatcggcatcggcgaacggcagacgcaacatatgcgccacttccttaccgacacgtgttttgccggctcccatcatgccgatgatgacggcgcgggggcgtgcggtcataatctacgaatcctctcgacgattggtgggtacagttgctgatggttccgtggcagtcgtcacgaaaccatacgcccttcgttcagcgcatgtgctccggccacgaggcgagatacgactcaaggttgcgccgtgtttcggcaacactgtctccaccgaacttatccagcgcgtacttcgccaaagtcagacgcaccatggcctcggccaccacggatgccgcaggcacggcggtgctgtcggaacgctggttgatggcttgtgcggattcgccggtcagcacgtcgaccgtacgcagggccttggggatggacggaatcggcttcatggcaccgcgtacgcgaatcacctggccattggacataccgccttcaatgccgcctgcgcggttggacagacggtcgatgcggccgtcggcgttgaccacgatctcatcgtgcgcctgcgaaccggggcgggaggctgccaggaagccgtcgccgatctccacacccttgaacgcctgaatgcccataatcgcggaggccagagccgcgtccagtcggcggtcggactccacatacgtgccgatgccggcaggcacaccgtaagccagcacttcaatcacgccgcccaacgtatcggcggccttcttggcttcattgatgcgttcgatgatacggacctcggcctctttatccaacgtacgcacgggagaggcatccaacgcttccagatcgtcaggtgtgggcaacggcaaatcagggttggtctgcacgccaccgagcgccaccacgtgggctacggtgcggatgccgaacgcctgatccaggaactgcttggccacctcgcccaaagccacacgggaggcggtctcacgggcgctggagcgctccagtaccggtcgggcgtcgtcaaaaccatacttgcgcatgccggtcagatcggcgtggcccgggcgcgggcggctcagcggcgcattgcggccttcgcgcggcaggtcatggtcgagtgcatcggcgctcatgacctcggtccacttcggccattcggtgttggcgatttcgatggccaccggcgagccgagggtcaggccgtggcgtacaccggtcagcagacggaccttgtcttgctcgaacttcatgcgggcaccgcgaccatatccaagtcgacggcgtgccagtgcggaaacgatatcgtccgtgctaatacgcacgccggccggcaacccttcaatcatggccaccaatgcttctccgtgcgactcccctgccgtctgccaacgcagcataacttccctcgtttcatgtgtgtacgtctatgagtacgtctaactaggggttaatgttaagctatgccatacctgttcacgctacccggtctgctatgtgggcttacactgtccattgaggatgttcgtcatcggcgggtgccgatcgcatgggtggccgtgggcgcgttaatccagttggccgccgatttcgcgtatggagtggtggcgaacgacctgttcgtgctgttgcaggcactgttgttcaccgtgctatgttgcctgatccagttcgcgttggcgttgctggtgccgcggtcattgggattcggcgatgtgaccgccttgatacctatgggattgtctgtcggactgtttggcctgttgcctgtggtggtctggtggctggcgatgggcgttgccggcatcacatggattgccttgtggacgcgattcgacccacaacgcacatcaccggcacatgcgggcaaggtgccgtatgtgccggtgatattggcgggcgcgattgtggcggtggtggttggggtgttgtcctagatttctcctccatccgctttgcgggagccccgggcttaagtcgagcgttacattccccgcagtgctcccctcagtccgctttgcggacagctcccctcggcgagggagccaatgaagagactaatgtccgatcagcttccccaagcgaagggagctaacgggatgactactggttttcggcttgccacttgcgtagttcggccacgttctggtcatgttcatcggcggttgcggcgaacttggtttcgccggtgtccagattgaccgtgcagaagtacagccaattgccgctttcggggtgcagtgccgcttgaatggcactatcgccgggattgctgatcggcgtaggcggcaggccggagatcttgtacgtgttgtacgggttggactcgtcctgggtcatctcggtggtcacctgcgcgggcttgacgttattgccataggccacggtggaatccatgcccaacgacatgccctgctccaaacggttctcgatgactcgcgtcactttgccgtagtaatcggctttgttgacctcggcctcggcgatagaggcgatgatcatcacccgttcgcggtcactgccggtcggcacgcccaattcatccaacttggcgatacgcttatcgaccatggccttgaggatttccgaagcgctcttcatgctcttgacgttgtaggttcccggctccagccatccctcaaagctaccgcccgcttcattgggcagaatatccttacccttgttcttgataatcgtgtcgaattcgctttgggcaatgccggaaagcttcgcggcgtcggcgaacacatcggtggcacgttcaccgggacgaacctcaaggaagcccgatgcctggttggtgtcggagagaacggcgatcacatcggatgcggccatatgcttcttcaatgtgaacgttcccggatagagtgtcgcgctattggcgttgaccacgctggtgaacgcggcagtagacttgatgacttcggccttgagcagcttatcggcgatctccgccgcaccttggccctcgctcacggtgaattcgacctcgccatagcccggtcccggatagtccgcgatggccgtcgactggttgctccggctgtcgcgccatgcgatgagcttggttacgccgaaatagccgccgccgataagcagggcgacgatggcgatagcgatgataatgccactgatacgcttgcgcttgcgatgtgcacgtcgcttgcgcatctccttgcgggatttcggcggttctggcggcttggccccgcgcattggttctgacccctgttcgacccaatgcgtgttgtcatcaaagaactcgttaaaatcatcggtcataaccgatacctcactactcccgggtacggtcgagtgccgtctgcaaaatcaccactgccgactgctggtcaaccaccggcctgtgcttgttcgaagctttatgggcctcgaacagttgacgatgcgcactgactgttgttaatctctcatctatcaatgacacctgcggaatctgatactccgtagaatcactgtcttcactctctgcttgcagcctcttctccagattggccgcccacctgcgcgcttttttggcgcttttgccttctgtaccgtccatctgcaggggcaatccgacgattacatggtccacatgttcgtcttcgatgacgttcaggacctcgtcaatagcaaagaaatagtcgccggcaacatgaatgttgccagcagggtgtgcaaaggtaagctccgggtcggacagtgccagtccgacccgggcattacccaaatcaacgcctaaccacaccactggcggaatcaggctttctgcgcctcgtgcttgagcgcttcgagggcctcgccgatcttggaggcatcgacaccgccaccctgggcgaagtccggcttgccgccgccaccaccgccgaggaccttggctgcgccacgtaccagatcaccggccttgatgccggccttgcgggcggcctcgttggtggccacggcgaccatcggcttgtcatcctcgttcacgccggcgagggccaccaccacgggggcgtcttcaccgagttgtgcgcgcacgtcgagcacggtcttgcgcagggcgtcgaccgcgccgaagtggcccacgttcttgacagccaccttgaccggggccgcggagtccttggtgtcagcaaccagcgccggaaccgaggcggccagctgggactcgtacatggaggccaagcgacgatcggattccttgagcttggcgagcagggcgttcacacgctcggcgagctcgtccgggcgagcgttgagcttgtcggacagctgggagaccagcgcgtgctcacgagcgttgaagtcataggcaccctggcccacgacggcgtcgacacgacgcacgccggagccgatggaggcttcggacaggatgttgaccatgccgatcttgccaacgtggtccacgtgggtaccaccacacagctcgcggctccagccgtcttcgccgatggagaccacgcgtacgatgtcgccgtacttctcgccgaacaggtgcatggcaccgagtgcgatggcgtcgtcgaacttcatttccttggtggtcacagcgaggttgtcgcgcagcttgtcgttgacgcgctcctcgactgcggagatcacggacttggccggggccttggaccactggaagtcgaagcgcagacggttcggggcgtcttcggagccgcgctgggtggcctgcgggccaagctcctcacgcagcgccttgtgcaccatgtgcgtggcggtgtgagagcgggcgatggcgccacggcgggccaggtcgatgttggcgttgacttcggcgccgacgaccagagtgccttcggtcagacggcactggtggacgatgaggtccttgatgggcttctgcacatcgtcgacttcgagcacggcgccgtcgtcggacaggatctcgccctgatcggcaagctgaccgccggcctccgcgtagaacggggtgcggtcgagaatgacctcgacgttggccgggccggtcacggcgggcacggagcccttgccttcctgcatgatgccgatgaccttggcacgggcggacatgtccgtgtagccgaggaagtcgatcggcttggcgagcgtcttcttgaagtcgtcatagaccgacaggtccacgttgtggcgcttcttgagggcgtcggcgcgggcgcgggacttctgctcggccatgagttcgcggaacttggcctcgtcgactttcacgccttggtcggcggccatttcgagagtcaactcgatcgggaagccgtaggtgtcgtgcagagtgaacgcatcagagccggagaccaccgggtcggcggtcttcttggccttcttgacggccacgtcgagaatctcgatgccgttctccagcgtacgacggaatgcatcttcctcgccgtaggccgcttcggagacatcgtggaaggtgtcgttgagctccgggtagctggcgaccatggcctccttggagacgggcagcagctcgggaatcaccggatcggtcacgccaagcacgcgcatggcctgcacggtgcgacgcagcaggcgacgcagcacgtagccgcggccgacgttgctcggacgcacgccatcggacataatcatcagcgcggaacgcacgtggtcggccacgacacggaacttgacatccgcggcctcgtcctcgccgtacttgcggccggacaggcgctcggcggcctcgatgaccgggaagacctcatcggtctcgtagatgttctgcttgccctgcatcaggtaggccaagcgttccagaccggcgccggtatcgatgttcttctgggcaagctcgccgacgatgtgcaggtcggtcttggacttgacgttgtcgacctcgtagttctcgaacacgaggtcccagatctcgatgaagcgcgtctcatcggccgcgggaccgccatcacggccgtattcggggccgcggtccacgtagatctcggagcaggggccgccagggccagggccaccggtggtccagaagttgtcttccatgccgaaaatctgcatgtgctcgggatcgaagccctcgttcttccagatggaacgggcctcttcatcgtcggtaaaggtggtgacccacagcttttccgggtcaaagccgtaaccgccctggtcctgcggggtggtcagcagctcccaggcgtagtggatggcctcttccttgaagtagtcgccgatggagaagttgccaagcatctggaagaaggtgccatggcgggtggtcttgccgacctcgtcgatgtcgagcgtgcgcacgcacttctggttcgatgtcatgcggcgcttcggcggggtctgctcaccaagaaggtagggaatgaacggcaccatgccggcgatggtgaacagcgtggtggggttcggggaaatcagggatgccgaaggcatgacgagatgatcatgtttggcaaagtaatcgaggtatcgctttgcgatgtccgcagtgcgcatgagcggatgaactccttgtttgggtaatgggcgcagttgcgcctggtattggtggaaaaagactggattatgaggactagtttgttctagctggttcagtgactagatggcaaggcggcatgcgcgtgtcagttggcgcgctcgatgtactgacggttgagctcagcctcgcgggctcgacgggtggcattgaactcgttgatcaacccttcgagtgttttcatcggcacattgtcctgatcggggccaagcaggaactggcgtgccgcatcaggcgtattggccttgacataggcctgtgccttggtgacggcaacgattccgatggccacgccgacgccgacccagaagatgcgtttgaacatcactcccccttctcggcggtgtcgttgacggtggttttcgcggcgttcttcgcaaggaaggactgccccgtggttttcagcgcgtagaaggtggaagcaatcttgatgatgggcttaccgaggaaggagccatacagatcggtcaacgcaccaacgttgttggcggtggtggaagccgcggcggaaatcttgttcacgtcttcaagcgacttgttgacctgcttgacggtggtcacgccttcgtccagcgcggggatggcgtgttcaccggactcccggaccgtctgcgatatctgatcaaacatcttgcccagcctgatcagcggatagatcatgaaaccggccaatactgcgaacgcgatggccgcgatcaggccagcgatctctccgacttccattgttgcctccttgaggtcacacttactcggataagggtagcactcctcccctatttacccgtgcaactgacgataaaatacgctatttgccgtatgagacgatggtcacggcctgcgaaaacggtttggtcgtgtcgaagtcgagtacggttaccgagccgttggccggtcgttcgctaaggtcaagatcggggcctccgaaacggtggccgaggctgagcagcgtgttaccgtgcgaaatctgaagcacatcatcgccatccttgagattggggttgctggcgatgagctggaatgctccttcgacgcgcgtccagtattcttcatcggattccgcgtcatggaaggggtcggcctctttcaggaaatcacgggaggcggccagaccaaatttggctacgatgtcgttgtagtccttcgcgccgtgaggtccacccgcagcggtccaagccagcgacatgtcctgaccctcgaagtatccgtagcattgttcgcggaaatgcatatcggccgtgagttctggccgtgcatgtccggcagcctcattgatatcgagaattcgcttcgctgtgatttcggcgcgagaagtatcggaacaatatgccgccgcaaaatcatagcccttaagtttgtgcccggccctgtcggcatcggcaagtccggatgcggtgagcggcgcattgcaccatccctgaagacggttgtatttattgaacgtggtttgcccatgacgaaccagatgcaaatgcagaatcagggttcccatgctaccgcagtccgctaaaacgcaggcccgtcgccccctccatggcacgcgaaccgcaggagaccgtcgacgaaaccgacaacaggcccatgcgagtgctcggctagcgcacccccgccgaggcattcgccgacgaactactagaaccagccgcgaacaaggatgttgcacttacaaatagataacaggccccagctgacatgactgatttgaggtatgatatacgtatgtcataccactgttataaggagtaatgatggctatcaaggagaagaccacaatcagtctggatgcgcagaccaagcgtgacggcatcgccatacttgacgccatggggttgaacctgagcacgtttgccgaaatgtctctcagacaattggtacgcgacgggcgtctgccattcacgccaagcgtccgcccttcattcgaaaaagacaacgagggatatcccctgttcaaagcgaacatggatgatccccgcatcgtgacgccccagatacgtgatggtgccgtgatcctgccggagggttgggacgatgatgaagactgatccgcgccagttcgagatatggtgggtgccgttcgcttttcccgacaagccaggcaaagcgaagaaccgtcccagcgtgatcctccaatgggacgacggcacccgcatcgccttggtgaccaaggtcaccggcaacacctggcgcgacgaaccgggctatgtggtgctgcgtgactggcaggacgcgggactgagcaagcccagcgccgtgcgatgctcgcaactgctgcggctgccaagcaatcttttcctcgatgacggcccgacaggaagactttcggcatatgatgccggccgcgtcgcctgggcgatcaacgaactctatccgggcctactagcctgagagcaaccgataccgtcaccatccctgtcgaggtgcttgccgcagcacgggtcaccgacgtcactcttgtcaagtttggcgtgatgggctgttgtcgcgggcgaatcgttccccgctaaccgctaatgcagtccgaaacagccgctgcctcctgcctcccgataaaaatgaattcgtcaaattctttcgggcagcgaatgcagatacatgtatagagcatctgtactattttcaagaatgctcattgtctgcggcaacggttcggcatacacagttttataatccacctcatcgtactctttccgaatggggaaagccaaacgttcatcgtcaacagaaaagtctgcttgtataccctctttattccctcttgcatctacacgaatccatcggtcaatggatctcagataaatggcattcaaggcatggatgcagtatccgctttcaggcgtactgcctaacgtaagcctttgatagcatattccggcaggaatgccatttgctcttaatagggcggccaataaattagattttgcccaacaaataccgacgccctctcttaatgcgtctgaggctgttgccgtgactcttttgtcttggacatcccatgaatgcttgatttcatctctaacaaaatagtaggcggcttttgccagttcgatttcgccttcagtggagtcttttagttccttggcttttctttgcacactcggttcattccaatcgatatagtgcgaaaaggcaaggtagctactgatatcatcttgaatatccaacatataacacctccgagaatcccgattcgtcgctctcttactttttaccccgttgcgaggttggttgtttcagcaagtccgacatagcggcttctcaccaagctatctcattttcgtgcagaccgatctgccacaacaacgacgaccagattggccagcaccatgacaacaagcgtggccaccaacgcaatcaatgcctccgatgccatgttattgaagctcttctccatggccccgccaatgatgatttcaagggcgatgaggaacagggcacatgcatcaacgaggaatatcggagcgtactgcttgtgaatccgattccatgtgtcttcggatgacattgttgccggcgttttgatgcctaccgaattctgcaaaggcaacgttccgttctttgcatcacgatagaccccgaccaaaaacacgccgacgaccacggccacaactacttcgacgataagcatgcgtcaaggatatttctctccccccctagactagtaatggtttgaatcccgcctgcccaccgatggcaggtcgattacgcgaggtgaccatatggctccagtggagcgtcatatcgaggaagcgctgtatcgcagtgccgtggaactgatcgagcgaaggtatccgacaggatggggaggcgcggcggcgatgcgactcgccggcaaagacaacggtaaacatgacggaagcaacggctcggaggcacttatcgtcacgagcgtggcgattgagacacccaatgccgccgcttcgctatgcatcgaggtcggagcgatgtgcgaggcgatgaagcttgatcgccgtgtcacccacaccatctgcgtcgtacgcgatgacgaacacgccccgttcaccgtgttgtctccatgcggcatctgtcaggaacggctgcgctattggggcgacgacgtgatgtgcgccgtttcagacaacaatcagggagagcatccgttgttcgtgccgctgcgcgacctgcagccgcaccattgaactcagatgtacccactcgccgaattggaacactacgagcgataagccgccctcgattgaaatccctacctccctaagctatgcagtaggctccgcccgcaagtcacactggtacaattttcaggtttgagactgtagcaagttgagtcgctttatcagtaagtctgtatttggaggtatcgatggcccatcgtccgcttatcggcgtggtcccgttgtgggacgacaaattgaatagcctgtggatgctgcccggctatttcgacggcatcatcgaagccggcggtatcccggtgatgctgccgctgaccgacgacgagaccacaatcggacagttggtcggccaatgcgacggattcctggtcaccggcggccacgacgtggatccgaaacggtatggcgaaacggccggccccaagacggtcaaactgtgcaaggcccgcgaccggatggaggagcgtctgattccctccgtcatcgcggcggacaagccattgctgggcatctgccgcggcatccagagcctcaacgtcgccttgggtggcacgctgtggcaggatctgccggacgaacatcccagcccggtcgtgcatcatggcgacaagccgccgtatgacccggtggtccacgaagtgtcgatcgcgcccgattcgccgttggcccgtgcgttgtggccgctgggagacaacggcccgagtgaggcggaggccgatgaggtcgattccttcggcaggccgtatcatccgcgcgcctatacgctgggcgtcaacagctatcaccatcaggcgattcgcacgctgggccagggactggaaccgatggccaccgcgccggacggcatcgtggaggcggtctggatgccggccaaacgtttcgtctgggccgtccaatggcatcctgagttctcccaccgcgccgatagcaaccaacgtcgcatcctcagcgccttcatcgacgcctgctgacgcaagctcccgccaatctcgacgaaacgccttccaggaagcagaacggcgtgattccgttcatccagtctccgggaaaacgcccgcgccccggaacgcgagaaccccgcgtcccttgcgggagcggggtccaagcggtatgtccttgattctgatatttcagataagggggcccgaatcagcgggcgtagaattcgaccacgtactggatgttgacctgcaccgggatctcttcgacctccggcttacgggtcacagtggccttcagggacggcaggttcacgtcgaggtagccggggaccgcaggcagcacgtcacggtgcacgccttcggcggcgatctggaacggaaccatggtctggctcttggccttcacctgaatggtctggccgggcttgacgcggtaggacgggcggtccacgatgttgccgtcaacgaggatgtgacggtgcaccacgaactgacgggcctgggcggtggtgcgggcgaagccggcacgcagcaccaggttgtcgagacgggtctcgaggtcggtcagcatggcgttaccggtctggccggcagtacgggtggccttctcgtaagcggcgcgaagctgcttctcggagatgccgtactgagcgcgcagacgctgcttttcgcgcatacgcaccgcgtaatcggactcggtgcggcggcggtcacggccgtgctcgccaggagcgtacggacgcttttcgaagatgcgctgagccttgggggtcagtgcgatgccgagggcgcgagacagacgcacctgacggcgagaacgctgaacgttcgtcattggattaatccttctgtcgttatctgaacggaacgcttgccttgcatatgcctggcaagcgctgagccgggcctccccagcgcttcgtcgtgaacgaacacgaacgggttggttttcttgcgatcacctaccgccgacccgctgatgggctatgactccagacggtatctacctgctggcagacaccagcagaccatattacaccgaggctatggacagcactccggcgtccatgcgatacacccggtctgcgtattcgagtgcatcgggatcatgggtgaccatgagaatcgccgtgccgttgttggcttggtctctgagcagacgcattacgatgtcggtgctctcctggtcaaggtcgccggtcggctcgtcggcgatgagcaggctcggctggttcatcagcgcgcgggcgatggagacgcgccgcatttcaccgccggacagctcgcgcgggtagctgtctgccagatcggcgacaccaagctgggtgagcagcatgcgagctcgggtggcgaacaggtccggacggctcgcagccgtgtttgacggcgtgttttcccggtctgtgattggcgcaatgacatccggcatgaacaggtcggcggctgcttcatcattggtggcagcggcttgtgccacggcatcggtcgacgcaacagcgtccacctgagcaacggcatccgttgcttctgcgttttgggcgaacggcagcggctccggaaacatcgttgcgggcagaatcacgttgtcgagcacggtcaggttgccgagcagggtctggctttgggtcacgaatccgatggtgcgattcctcagcacggacagtgctttatcgcccaagtcggccacattgcgtccagccacgctcacggttcccgaggtcgggcgaatcagcccggcgaccatgttgatcagcgtgcttttgccgttgcccgaccggccgacgatggcgatgaattcgccggcatcgacggtgaggttcacgtggctgacggcgtcgaacggcgtgccgcggcggacgaactggcgggtcaggtccgtcaaggtcaacagatggtccggggagggcgtctcggttacgtgcggcgaatccgacgcagtcggcgcgttcggctgagctggcgtggtcggcgggagattggtcggcccaaccgtggtcggctgaagcggcgtagttgtctcagtcatatcactccccctctcgcagggtcaggtaggcttcgggccggccgagacgccacatggtggccagcgaaccgatgatgccgatgctcgtagagcacacaacggtcacggcaatgaatccgatcaccgcaaccgggctggcttgcagatacggcaattgaagctgtttgccgatcagcgaactgaatgggaaaatcaccaggctggccgcgccgacgccgattacgccaccgatcagaccgatgatggcggattccttcagaatgatggcattcaacatgccgcgcgtggcgcccatgatgcgcagggacgcgaattcgcgtttgcgttcgttcaccgacgaggcgaatacggcgagcagcacaatcacgcccattacccagatcaccgccacgaaaatcttgaggtaggtgacaagcgcggtcagcgaagttctggtgttggcggtgatgccgccggggtatacgtaccccaaatcggcgaaccgggagtcaagacgcttgatgttctcagccacggtctgcgcttcgtaaccccgctgcgtcttgatcatcacggtggagacggcttcgcctgcatattcggcgggcatgacctgcttggagaccttggccgaggcggcgaccatatcaggcacggtgttttggctgatgaacaccgaattgtcgaggctggtgccggtgttggcgagctgggcgacgaccggccacttatggccgtagagttcgatggtgccgtcggtggacacgttgacgtttgcgccggcaatcatctgaccgtcttcaagggggccttcgaactgggatgcgacccatggttcgatgacgaagtcagtgtccgggtcgtaaccgatgatctgcagcttttcggcacagcaggcggcggccagcgacgatatataggtctgttcggtggcctgtgcgatgccgtcggcctgcatgacctcgtcggcgatgtctttggtgaaatagaaagtgctgggattgccgctggtgagcagcgcttcagccttctgcgcggtgttttgcggcacgaccataaggtcggcgcccaggcgcttctccatactggtcatgccggtgttgaggttcatggtcagcatggtgccgccgaagaacgtcagcgcgaggatggtgacgacggcgagcagtgcgccggtgcggaacggcttgcgtttgaggttttcaatcggaaggccgcgcaatgcgatatgggatggcacgatgagtccttatgttgcttatagtgcggttgcaataagcgagaccggagtccagcgttcggaatggctgggctccggccgtctgctcgatcagttgcgcttggcggcgcgagagtcgagccagatggcgatggccgcgaacacgatggtgagcacgccgagcacgatgagcgtgggcagcataaccatgcggcagtgcatcatcgcgcccttgcagatgccgatcaggaaggtgggtacggcgagtagtagcagggcgttggctgcggcggcgatattgaggccgatgcgaatctgcggggcgacgaacaaagccacgacgccaaacacgaggatgacgacgccgatgccggtggccgcctgctgcgagtagtggcaggcacccggcatgtcatggccggtgcaggcgtgcgcaaaggtctggggcgcgatggtgatcagcgcgccgaacagaatattgggcacggatgcaaacagcttgttcttcataactactttttcctctcccctgttcccagggctcgtaggcgcaacctccgcattatgcccagatagtgatgaagaacacaagtcttgttttttgtgaatttatttggtatatagctcagcccctcgtcagaggggccaatctatctacaacttctcaataggtgctacgcggagcatgaggcgtttgacgccggcggagccgaagtccacggtgattaccgaattgcgacccttgtcttgcgcgtcggtgaccttgccgagaccgtactgatcatggctgatcatgtcgcccacggcgaagtcggcgatattcaggccattgtccttggtgagcttcgagctgggcacggcagagccggtcgaaccggatttcggtgtggtgcggcgcgtggtgaccttgccgccacgggtaccgccatatgaaccggacgaagaaccggaacgggaacgcggcccgtaagacgaccccgaacgggagcgagacccgtaggaggacgagccggagcgggaatcatatgatgatgaacgggaaccgtacgaagaacctgaacgggaaccatacgacgaggagccggaacccgagccatacgacgacccataccgcgaccgcgacccataggacgaacccgaaccggacgaaccacgcgagccgaacgtcgacgacccgccaaacgtggcaccgccgaaatcgtcatcatcccagccgcccaaatcgtcggcgaatccatcggtctcccagttggcgcgcatacgctccacgccggcttcacggcgtttccaatcaatcagcgaatccggaatctcgtcgaggaattggctgggcatcatatcggcggcctggccccactgggagcggacggcggcgcgcgtgacatacagtctctgcttggcacgcgtgatgcccacataggcgagtcggcgttcctcctgcagttcagtggtgtcttccatcgaacgcgaatgcgggaaggtgccctgttccatgccggtcaggaacaccaccgggtattcgaggcccttggcggtgtgcaaggtcatgagcgtcaccttgccggagtcctccgcctcaccgggcagctggtcggagtcggccacgagcgcagtggtctccaggaatgcggacaacgtggcgtcaggcgtgttctgttcgaattcggctgcggtggactgcagctgggagaggttctccagacgggaggcgtcctgcggatccacggatttctcaagttcggcccttaagcccgacttctccaatacttcggccacgatctcgctgggcttggagtcgtgcgcgtgcgtgaactgcgagagcgcgcccatcagatcgcggaatgctcgtagcgaggtagcggtgcgggtcggcacctcgatctcatccaagtgcatgagtgcgtagaagaagctggtgccatgctcgcgcgcgtaggcgagcagcacgccttcggcgcggtcgccaagcccgcgcttgggcacgttgagaatacgacgtagattcacatcgtcgtccggattgacgagcgcctgcaaataggccagcgcatccttgatttcgcgacgttcgtagaacttggtgccgccgacgagctgatacggctgattcgtgttgatcagcgcctcttcgagcgagcgagattgggcgttggcgcggtacatgatcgccatgtcggagtaggcgatgccctcttcggcgtgcaggcgcgcgatttcggtggctacccactgggcctcctgctgggcgttgtccgccgcgtagccgacaatcggctcgcccttgccgagcgcggtccacagtttcttgggcttgcggccctcgttgttgctgatcaccgcgttggccgcatccagaatggtctgcgtcgaacgatagttctgttcgagcatgatggtcttggcgttcgggaagtcctgctcgaagtcctggatgttgcggatgtcggcgccacggaacgcgtagatggactggtcggaatcgcccaccacggtgatccaggcggggccggacttgccggcgttcggcgcgcccgggatggccttctcccccgtgtccacaccggccagctcgcgcacaagcacgtactgggcgtggttggtgtcctgatactcgtcgacgagaatgtaacggaagcggtgatggtagtactcggcgacggccgggtcggtgcgcagcaactcgaccgtgcggccgatcagatcgtcgaagtcgacggcgttggccagggccaagcgatgctcgtattcggcgtagatcaccgcatagatggcttcaaggtcgcccaccgtgccgaactggtagccgcgctggccaggcgtgaagtcgggcgcgtgaacggcgaggttttccttccaaccggtcagattgttcttgaggtcggagatatggccgaggatcgagcgtggagtgtagcgcttgatgtcgaggttgaattcggtggcgatgattttgacgagtcgctcggagtcggcggaatcataaatggagaagccggacttgagcccgatggacttgccgtcgcgcctcagaatgcgcacgcaggcggaatggaaggtggagacccacatgcgctgggccaccgggccgatcagcgaaccgagtcgttcgcgcatttcggcggcggccttgttggtgaaggtgatggccagaatctggctcggccatgcgccgaactggctcaagatccaggcgatgcggcgggtcagcacgcgggttttgccggagccggcaccggcgccgatcagcagcgcctgaccgcgatattgcacggcttccgcctgctgcgggttcagatcgcctacaagttcctgcgcgctgcgtgcaatgacttccggctcgtcgtacactgttgcctccctttgaatcgcgacattcatgtttaccacatgcacgggtcagcgtaggacaacgtacacttacgagtatccatatcactcactgacatacagcaatgggaggtctaatgcaggaacttgaggagcgaatccaaagcgagggaacggtgaaggagggtgatgtgctcaaggtggacgcgtttctgaaccaccagtgcgacgtgcgtctgttcgaccgcatgggttcggcatgggccgctcatttcgccggcaagcacatcaccaagattctgaccatcgaggcgtccggcatcggcattgcgtgtgtggcggcccagcatttcggcaatgtgccggtggtgttcgccaagaaggcgcagtccatcaaccttgacggcgaccagtacaccaccacggtctattccttcaccaagcagaaggagttcccggtgatcgtggccaagaagtatctgaacgccggcgaccatgtgctgcttattgacgattttctggccaacggcaaggcgttgcgcggtctgattaacctgtgcgaggcggccggtgccacggtcgagggcattggcatcgccgtggagaagggcttccagggcggcggtgacacgctgcgcgctgaaggctacgatgtggattcgctggccatcgtcgagtccatgaatcccgagaccggcgaaatcacatttaggcactaagcacattgcctgctcccgccggcgggagcaacagagagaagaagagaatcatgtcagagaagaaaaccaagaattccgtatcctttgaggcgctgtcttcgctggacgcgccagtatccttctggaagggcattccgttcggcctgcagcatgtgatggccatgttcgtggcgaacctcgccccgatcttcatcgtcgcctcggccgcgaaaatgaccccggcccaatcggccaccatcatccaggccggccttctggttgcgggcctaggcacctgcctgcaactgtacggcgcgtggctcatcggctcgcgtctgccgatggtcaccggcatctccttcacctacgtggcggccgccgtggcgatctgcgcggacaagggctatggcgcagtggtcggcgcggtaatggtcggcggtctgctggaactcgtgctgggtttgacggccaagtattggcgtcggttcgtgccgcccatcgtctccgccatcgtggtcacgtcgatcggcttctcgctgctcaacgtgggtgccacgagcttcggcggcggcagcggagccaaggacttcggttcctggcaaaacctaacgctcgggcttatatctttggtcgcctgcctggcgttccagctgttgatgaagggcacggccaagcagctgtccgtgctgttcggcctggtagtcggctatgtggcggccatctgcatgggcaaggtcgatttctccggtttccagaacctcgccatcgtgtccgtgccgcagttcatgccgttcaagcctgagttcgactggggttcgatcatctccatcggcctgctctacgtcgtctcctcggtcgaggtgctgggtgacaccgccgcgctgaccaaggtgggcctgaaccgtactcccaccgaacgcgagaccgcgggcgccatcgccggcgacggcctgatctccaccgtatccggcctgttcggatgcctgccgctgacctcgttcgcgcagaacatcggattggtggccatgaccaaggtcgtcaaccgcaaggtgattctctccggcggactgattctggtgctggcgagcttcgtgccggccatcgccgaggtgttcaactcgctgccacaggcggtgctcggcggctgcacgatcatgatgttcggcaacatcattctttcgggcttccagatgatcgccgaagcgggcttcacgcagcgcaacatcacgcttgcggcgctttcgctgaccatcggcatcggcttcacccaggtgagcgacatcttcgcgcagttcccgacactgttccaacaaatcttcgcctcgaactgcatcgccgtggcgttcgtggtggccgtgatcctgaacgccgtgctgcccagcgaggagcacttcctctccgcgcccaaggaggcaccggccgcggacgccgagtgataacaacgcgacatatcagctgcgcataatcacatgatgatgccctatcgtcttgcaggatgatagggcatcattgattttgagagagactacaagttgaaccatgagttcgagccggtggcgtgtcgatcaatcgacatcttcccattcgaggatgtctccgggttgacagtcgagcgccttgcagatggcgtccaacgtggtgaagcggacggctttggcacgtccgttcttcagaatggacacgttggcgggcgtgatgccaatttgttcggcgagctcgccgacgccaatcttgcgtttggccatcatgacgtcgagattgatgcgaatcgtcatctcaaatcacctgctcgagttcgctcccgagccggacaaggagaacagtttccatacggccacgaacgccgcttcgatgcagagcaggaacagcacgcccataatgagatatggccagtgcatcgacgtctggctcgggcagaggccagccagcgcgccgctcatcgccgttctggagctgtcgctactcggccatcagcccctcgaaacggaagtggatgtctcggaacgagcaaatcagccccttgaaacgcaaatagacgattgcgaatcggcttatcagccgcgtcaaccttgcaatacagatgtcggcgtatcattccccggtctgattgcgcggatgtcatgaagcgtgaagaattgtcacgaagtcgcgtgatggcgcagccgccgttcaggtggatatgccacgctgtcatgatgacggccgagccggaacacggcaaatcccgcatgctgcataggccagccggtcacggtcagccatgacaccgaaatattggaggcgcaatgggacaacaggtgcggtacggcagacgccgctcccatggcgcgggcgcgctgattgcagccgtcatacttgttgttgcggtgctgatcgcggcatggacgctgctgccacggctattcacgcctcacgagaccgcgcgcacggccgaggaagcatattgcgcggcggtgtcgcccgacggagcccgccgcaccttgacgcctgatcaggcgcagaacgcggcgctgattgcgaacatcgccgtcacgcgcggactgccggatcacgcggcgacggtggccatcgccacggccatgcaggagtcgaggctgacgaatctggactacggcgacttggattcgctcggcctgttccaacagcggcccagccaaggctggggcacggcggagcaggtgtccgacatgacctatgcgacaaacatcttctacgaccatctgctgcaggtgccggattgggagacgattccggtggaggacgccgcgcaggaggtgcagcgctcaggctacccggaactatatgccacatgggatgcgatggcacgcgcctgggcctcggggctgaccggtgaacggtcggcggacgtcacgtgcgcgttggagccagcaatctcctcggacgcggacgggttggttgccaacataggcggtacactgccgaatgtcaatgtctcggttgcgcccccaaatggcaaaaccggcacgaacaacggcgctgcgaccaatacggccagcacaacgttgacgatcacgctgccggacggcctgtccgccgacaaccgcactcgactttgctggcagacggcaggctggctggtcacgcaggcgcatcaatacggcattgacgcactgcacgcggacggcatggattggaaccgcagagccggcacatggaccggcaccgaaaccgccgagcagaccgtcaccgtcacgcttgcgtgatgtgacctataccgccgttgcgaccacaaatccgactggctggagcctacgccgtcgatgctgcctgaggcacgacacggatatgttttttactcgttcgaatgagcccaatccacgacggcttcgatgttattgccatccgggtccagcacgaatgcggagtaatagccgggatggtacgggcgcggaccgggagcgccgttgtctcggccgccggcggcgagcgcggctgcatggaacgcctgcacggcttgctggctgtcagccaggaacgcgatgtgtgtgaccggcgtgaccggcgaagcctccgcctccggcccgtcaatcggtgacacgtagaaatcggagtgcagggttccatcatccacgccgaatccgagcgtgggctcatgatgcgccttgacgatatagccgagcggtgcgagcgcctgtttgtagaatgtgatgctacggtcgatgtctttcacgtgcaacgtcagatggtccagcatagtcttggtcgccctcccctggttcttgtattcgattgctgcttgcagtgtaagcccgaacgtttccccacagggccgcgcatggctatgatgagagcaatcgcacgtcgagttcgagacaatattcaaaacgaatccaaggcaataggggaatgacgatgaccaaggcactgattgtggtggatgtgcagccgacgttctgtgaaggcggcgaactgggagtcgaaggcggcaacgcggtcgccgagcggatcgccgattatgtgaacgcgcatcgcagcgagtacgcgtatatcgcaaccacgcaggactggcatatcgagccgggcgcgcactggtcggcggaaccggatttcgtggacacgtggccgaagcatggtgcggccggcacgccgaacgccgaattgcatacggcgatcaaggcgctgaatatccagcatcatttcaagaagggccagtattcggcggcatattccggttttgagggcatcgaggacaataccgaccgtatccagacccgcgaggaggtcacggccgagcaatccgccggcaagacgctggccaatgcgctgaaggccgccggcgtgagtcgcgtggatgtggtgggcatcgccgaatcgcattgcgtcaaggacaccgcgctcgatgccgggaagcttggtttcgaggtcaccgtgttcgagggcctgaccgtaccggtcagcgaggagctcggtgtcgctgcccgcaaacagatgacggcggccagcatcacattggccgagtcccgctgatcaggccggatatacccagagcgaacgcacgaacacttccgtatattcaagcccgacactgccgcatagtcgcctagtcgatatgtgaagaaggcttttatggttacgatgctgctgacttcgatattccgcaacgcctcgtccgccgtgcatgaagtcgaaccgcatccgcaaggcaagcgggtcgcgttcatcccgacggcgagcgccgtggaaccgtggggccagttcactcggcgttgagcaaacgcgcgctgcaacgcctcggtttcgaggtggagcaactggatgtggaagatgtgccgagcgggtccgccgaacgcgtcacgcgtagcatcgccgaggccgactacatctatgtgggcggcggcaacacgttcttcctcctgcaggagttgcgccgcaccggcgccgaccgggccatcatcgagcaggtgcgcgccggcatgccgtacatcggcgagtccgcgggctcggtcatcacggcacctgacatcggctatatcaagctcatggaccgcacggacaaagcccccgatctcaccgattacgcaggattgggcttggctgatttctgcgtggtcccccaccatcatgcagcggccatgggccacgccgcacaacgcattctcgaccggtatggcgccgatctcagtctcaagcccctcaccaaccggcaggccctgctcgtcaaggatggcaaaacccggttgctgcgatgatgcgggtcgtcggcccgtcgcccattcggcatcgccgtggtgtgtccggcctgacatgcctatcgagcggcatcaatcacacagcaatgtggttgggaacctcgccgaacgtcaacacctgcgtacatcagcacggcaaaatctgccgaaagacgcccggcgcacgagatgccagccggccccatccgtcacctcagtgccgtaccgggccaggcatggccttgagcaacgggatgaatccggcgcacagtaccagggccacgacggcgagtatctgccagtgggcggagccgagccagccgccccacgtgccgacggcaccgccgatcgcatacgcgaacctggcacggccgctgaatttggccaggtcaccaccgctcagcagcagttgtcgcgatacgatcacgccatgcgccagcaggccatagccgaggttgttgatgagccatccgacgcacaccgcggcaaactcgggaaccagtacggcggcaagggaaatcgccgtggcgattgccccgatggcggacacggcgcgcatgccgagttttgcggagagccgcatgtagacaaacgatccgatgatgctgcccacgccgccgaatgcgtagaccacggtcagcatatcgctgccgtaccgggagccgatgcccagtaacgcatagcttgcccacagcgacggaatcagcgcaagcagcagcgatgcgaccagcagtctgacccgggtcaagcgggtgaccggagtgcgctgcggcgcgtgtgacgtgtcggccgccgtggattcgtcggcggagccgtcgccgtcaccgccgcccgcaccatcgttgccgaatcccggcatgaactcgcgggtgcggaatcgcgtcagcgcgcaggcaaatgacagtgccgacgaggtgagcagcatggccatgatggaggcgttggccaaggccgatccggcaacctggcccagcaacgtaccggccacgctggcaatcacggcgacgtagccgctgtacttgacgagcatgtcatcgtcgtcgccggccgcatccacctcgaacacttcggaggccacgtcgatgacctgcccggtcatcagcagcaggcatgacagggccagcagcagccacttccaatacgtccaaccgttgggcaccagcgcgaccgccaggcacagtacgccttccacgccctccgtggtcgcaagcgaacggaacgagccgaaccgctgcacgatccatgcggatatcggagaagcgaagtcgatgaccagattgaacgtcttgcggaacgcgatcacccatgccggcagtccgacgatcagaatcgaaggaatcaccgacccctcgaaaatcgcgttggacagcatcgaaaacgtcatacccaccaacgcccatcgcaacgccctgctcaataccgataatcctcgcataccttagttccttgtccttgccagtgtaacggaattatgacttctcaatcgtccccccgctgtctaaatgaaagtgcaacaccctttcactggttatctggacaatctccaatctaaagggtgttgcactttcatttagacagcgccccccatatccgcatgtcactgctgccatcataatgagccagtagacgcctttaagcgttctgacaaccatggaatcgaaaatcgctatgcacatcatagaacagcactgccaaggcaagaggtctgaccagtcgctcaatgagaacgggctgatcatcaccgatggtttcgcggcagtggtggatggagcgaccagcaaaagcgtgcaccaccctgccggccttgttcttggccgcgtccagcaccggcgcgaggccggcggcccattcgcgcaccgaacggccggcgagcatgtcgttgccgcccacgcacacgatcagcacatccggccggtcgttgatatcgccgatcatccggtagcgcacgcgccgggcggtcgcgccgagcttgccgaccgtacgccaggccaccggccgaccggtacgcttgcgacgcgcgcggcaagcagcggcataatgcctttcgactggtcgtccacgccacatccggccaccaatgaatcgccgaccatgacggcacgaatcggcttcacgccgttcgcgcctttccaatcggggccgatcggcgcctcgatatccaccccgcgacccttggcatcgaacaaaccgaaccgcttgcccttcggctcggacgccaacttccccggcccttggcccacatactctcaatcggagcaacggcagcatcaatcacacgcaagattcccacggcccccaacatagtccgccctcctcgacctcgttagcggccagtatcaacccatattcaaaaactcgataaccatcgtcaattcgcataatttgaacgttttaggtgttttggtcgctttggacgttttatactgtgatagataaaaaggaggtcaccatggcagaatccgacaaactcaccattccacgaacaatccttccatccatcaacattgacgacatgacgacattggaggcattcaccgcacgatttcttgatgagcagatcttcatcaaagatgccagcggcgtggagactcccctaccttcgcagctttgcgacgccgttaggcagacggccatccttctcgccgaaggcaaaagtgtaatgatcagtgccaccgaacaagatctgactaccgaacaggcggcggcaatgctcggcatttcgcggcaaacactgataagactgcttgataaaggacttattcctttttcacgtccgtccaatcaccgtcgcatccggctggaagacctgcttgaatacaagcgagcctcgaaacacaccaaggattgcgccctgagccaaatgatcggcgtcggggaagacgccgaattgtacgacctgcccgagccgaccccgcaggaagccatgcatgcggtatcggaggtaaggagagtacgggccgatgctgtcggtgtttcttgatgccaatgtcatctattccatcaccttgaccgatgttctgctcaccttggccgagcatgacctttttcttcccctgtggtcgcctaacgtattacaagaagcacaggaagccgcctcccgaacactgcctgacgccgcacaacaagccttccgaaaaagactgataatgatggaccaggcattccccgaatcctccatacatgttgaggaatcggaatggagccaattcgatctgcctgacccggatgatcgtcacgtacttgcggctgcggcacagggaaaagcagacgcactggccacgcgcaatatcaaggattttccccagaaactgcttgactctttctccattcaggtcatcacgccagatgatttgctctgtgtattacttagacgaaatccggaagccacagctagcgccatacgtgagcttatcgattctcgacatcggccaccgataaacattcccgactttgctaaaagacttgaacgctctggcgcaacacagtttgcagccgctattgcgcatatacgacagcctctcggcaatcattcgtactttgaccagtaacccatgaattctggatgaattggggtgaaccggcggggctggaggcgagcgggcggcggattatggggcacaatggtgtcaaggaggccgccatggtcgatgactatactgccaaaatgactgagctgatcgaactcatgcgtctgatcggcaacgatacgcagcagtgcgaggtcaaggaatgcaagcgcaagatctcctcgaccatcaccgatacgctgtccgcgttctccaacggctccggcggctggatcatccttggcctgtccgaaaagaacgggttcacgccggtcgagggattcgacgcgcgcgccatgcaggaggcgctgagccaggcgtgcgagaagatgacgccggtggtgcggcccgtgatcgtcacctgcccgttcgaaggcacgaatctggtgttcgcgcgcatcgacgagatgctgccgcgcgacaagccctgcttcaccaccgcgctcggaccgcacggcggctcgttcatccgcaccggcgacggcgaccggcgcatgacctcctatgaggtcgaccggctcatcgaggagcatctgcagcccacgtacgatctggatatcgtgcccggcgccacgaccgatgacctcgacccgcagcttgttgccggattgttggcgcgcgtgcgcgagcagcatccgcgcgtgttcgccgaccgggacggcatcgacgtgctgctggatctgcaggtgttgcgccatgatgattccgacgagtcggaggtcggcggaatactgcgtcccaccttggccggactgctggcgttgggccgctatccgcagaagttctatccgcggctcggcatttcgatagccgtgtttccggggacgagccgggacgatgtgttccggggcgacgagcgattggtcgcctcgaagtcggtggtcggttcgattccggtgatgatcgacgatgcggtcgactcgttgatgcgttggattggcgcgaagaagcccgattatccgccgctcgtgttgcgcgaggcgattgcgaacgcgctcacccaccgtgattattcgcccgatgcgcgcggcacgcaggtgcatatcagcgtgttcaccaatcgcatcgagatcaccaatccgggcggtctgtatggcatggtgacacatgatgtgctggcgagtccgcatccggtgacgggtgcaccgttcgtctccacccgaaaccagttcctgttcacgctgctggagtccacgccgtatccgggcggcgggtttgtgaacccagaaggcggcgacggctaccagcgcatcgccgccgcgttgcgtgaggccggcatcgagccggcgaccacgcgcaacgacatcaacacgttcacgatgaccatcaccaagcagcgcacgatggcgaacagttcgccgggcgacgtggtcaaggcgattatgaccgtactggagcggcattcggcgatgagcgtcaaggagatcatgcgcgaactgcagttgacgccgctggccgccacatccggtatgcgcgagctgatgaaggaagggcgggtcgcccgagtcaagttcgccgatgacccggtgcagcggtatcggttgaaaggctgatttctcactcggccagctgcgtggtggcgggcgcggccagggcggggcgggagcggcggaaccggccggcggccagaccgatacagatgaacatcacgccgaacagtgcgaccaatcccagcgagccggcccagccggcgacgcttatgccggtttcctccgccgtgccggagccgagcgcgttgtcgatcgcggtgcaataccaccagccgggcaggaacttggctatggtcaccatcacgccgggcatcatgtcaaccggcaacgcaactcccgacgtgaacatgatgagcaggccgaagatattggcgaatccgttggcagccgcctccgaaaacccgaattcgctgagcatgaatccacaggcgacggtcatcagcgcatatacgcaggttgcgcagaacgtcatcagcactccttcggcgctcaatgtcaacggatcaagtcctgccgcgaccatcagaccgacagccagcaccagataaccgacgcatacgacgagcgcgaatccgctgagcgtcagcaaccgctggagtcccatcgacgacatgcgttgtggggatgcggtgagacgacggcgaacttccccggtggtgaatgtgcccagaatcattgatccgcagacggtcatcgccaaaaacagcggatgcagcgcggttttcatggtgttgccgaatccgctggccgccatgtccgaagcactttccgcgtccgcgcttgccgtgtcgatcacagcgaccttatggttcgcgtccatgtcactcgccgatgcggcagccgctttcgatgcctcgaacagatcgccgacgctgggtttctcaatctgaccggccggcagcctatcaagcatgtcctgattcgagaattcaccaaacccgcccatgccatcttcagacgaatcacccgcagtgtctccaatgtcgatgccggccatagctgcgagcgccgcactatcgaccgtcgtatgcgagccaatcagtgccgtacgcgtgagtgaaaggaacccgatgacgttcatccgggccatcgagcctgcgccggacgtatagctggtgaccgtgtccacgcttggtggattctcgcctgtcgccgcggcatcaatgaaatcgtcggcgaaaccatcggggatgatgacgatcagatccacccagttcgaggcgacggcttgttgcagagtttcactagcatcgtcaacgttcaccagttcgctggaatccgacaggtatgtgcgcatcgatgacgcgatgccgcccctgtccgagtctcgatcgatgacggcgacacgcattttggccggctcgaatgccgcggctgcggaatcggatgtgccagacagcatcgaccagctgatagacagcatcatgatgcccacgaacacgaggtaaatcaacaggtaggccctgtgcgagaacagtacacgcaatgtggctttacaggtgttcatagcgttgcctcctcagcattgcgatgccagccaagaggaataccgcgctcatcgccagcaaaatggcacaagtggtgatgaacggctggtagctgtcgtagtacaaaatgtcgtaaaacaggttcgtcacctgttgcgcggggttgatggtgccgaggatgggcgcgttgcgtgctatccagtcactgatctgcatggcgaagccgccgtacagtccggtgaacagcgacaatatgcaggcgattccgctcgacaaaccgtatttcgtgtcgtaggaaagcttcggtaccgcgccgagcagggtgcctgctgagctggtcatgaacgaggcgatgatgaccgcgaaaatcgctgccggttcgcgtccgccgagcgagacgttgcaggcgagccggatataggccaatgcgatggacagggcgaccgacgagcacagccagcaggagaggaagcccgcgacgagctgtttggcccggctcagcggcgctacggtccgccgtatgcccagcgcggacaggttcgcctgtgcggcggcgactgtgctgatggagtatcccatggccatcatgcaggacatggccagcagcgcgtaatagtatcgggcgatcgcgtcaggctggaaatgcgtgagcgtcgtctcatgggtcatgtcgacgttctgcccgacgctgttccagaagttccggctgagcgcggcctgtggattgtcggcgatggtctgccgggtgacggcgtcggtgcggttgtacaggtcgatgacgccgcgcagggccgcgaggctaatgtccagtccgctgttttgcgtggagtctttggctgtgacggcggtttcccggctcacggtcatcgccaatcggccgttattgtcggcggtcagatagccgttggcagtgccgtcggcgagccgttgttcggcctccttcacggtgccgactgtggtgatggtcagcagcttttggtcgattccggcgtaggtcgtgtcgtctgaggccgattccgtttccccggccagcgcgtctacgaaggtgcgggcaccgtccgcctgctgccaacgggtgtcttcgatgacggccatcggcaccggcttgagttcatatgcttcggccagcccgccgaacagtccgttgaacatggtcgccagcacgatcgggaacacggtcatccagaacaacgccaaccggttgcgcaagttcgctttcaatgcgaccagaaatgtggtccacatgatgtctccttacctgctcccgctgacgggagctgtcggcgaagccgactgagggtggttgttgcaaggccacccccactcgcttcgcgggagccccgctagcgggggcaagattgttagtcccttagcgccttgccggtgagttccaggaatacgtcattgagggtgggcgggcgactggtcaggtggccgatgttggcgccggagcgtttcaccgcgtcgagcacgtcggtcaggttgtgttcgccgcgccggcatcgcacgtcgagttccttgccgtcgtaggtggcttcgattacgcacggcagcgcacggacctcagccatcgccgaatccgccagatcgagcgtttcgatggtgatgcgctcgcccgtgtcgatcatgttcttgagctcgtcggcggttccgagcgccaggtgccggccgtggtccatgatgaggatgcggtcgcagatctgctcgacctcctccatgtagtggctggtgtagatcaccgtggcgccggcctggttgagccgctggatgccttccagaatcgaattgcggctttgcgggtcgacggcgaccgtgggttcgtcgaagaagatcaggtcaggcttgtgcgcgatgccgcaggcgatgttcaggcgtcgcagcagaccgccggacagtttgccgggccggaacttgcggaagtcctggagaccgacgaattcgatggcctcctcgaccagcggcgcacggtcagttttcttcggcacgtacagcgagcagaagtagtcgatgttttcggtgacggtcagttcgttgaacacggccacattctgcggcacgatgccgatacggcgcttcagcgcgtatgaggtcggcgtcatcggctggccgaatacgcgaatcgtgcccgaatcgtaggtgagcaatgcgaggatgcagttgatcgcagtggttttgccggacccgttcggcccaagcaggccgaaaatctcgccctggttcacgtcaaggtcaaagtagtcgagcgccaccatgtcgccgtagcgtttgaccagttggctgacgtgcacggccagagccgggttggttgtcgagtcgtgttcggaagctctgttgtcggttgccatagccactcccttccttggtgattccatcatcccaagaaggggccggacgccgccacaagcaaacgtcacgacttggccgtacaggcgtgacatttgtcattacggcccttcggcgtcggtctgcatggccttgtacaccttatcgaccggcatcaggctgatctcgtccatcgcatagttggacgccctgtggctttgcgcaatcatcggtatcatccctttacggttgtgtcgacaacatccgacgcttgtgcctcatctattcgggaagtgtagacccgttgtcttggaccgtcatgcgaataattccgcacgcccgtcaagttcgttgtgttccgcacaccgctagactggtggtggaagagcgtcgagccggggaggtgccatgcgcgtgttggccgagaagggcttgctgctcgtgctgggcctggctttggcctggcttgtcggggtgcggctcgatggcgtgttcatcgccggcctgctgttggccgtttccgtcgccggattggtggaatggctgcgccccgctgcacaatggtcttgggtattgtgcgcggcgtttctcgccatcgccgtggcggtgccttcatggtgtgcgttcatgccgctcatcgcctacgatactgcacagctgccggcccttgcctcggccggagcccgaactggggcacggactgcggcaagcggccgctcccccagtgtctcgcggaccgcggcctctcgccgttcccttgccgatgcaatacgttcggccccgcggttttcggtcgccgcgcgctggatatgggtgttgccgccaatcgcgctctggttcgcccgtggcaccgaccgtctccagacgctggtgatgacgatggtcgccctgcttggattcgttctgggccgggcccgcgcctcctcggacgaggcgcggcgcgcgttgctgcacgcgcaggacagggcgcgcgaatcctcgcgggccactcgttcgcgcatcgctgacatcgatgaggaacgcgcccagtcgattcgcatggcgaccctcggcgagcgcacgcgtatcgcccgggagatccacgacaatgtgggccatctgctgacccgcgcgatcatgcaggcgcaggccggcaggacggtggccgaggcgacgaacgatacggtcgccgcgcaagggttcgccacgttgggtgcgacgttggatgatgcgatgacgatggtgcgccgttcggtgcatgatcttgaggatgacggcactgatttcgccgcgcagatcgatgatgccgtcacgtcgttcgacggcatctcccccggtttcgccgtgacgctggccaacgatatcgccaaggcgcccgcgccggtctcgcgctgtttcacgaccgtgattcgcgaggcattgtcgaacgtggtgcatcatagtgcggcgcacgaggcgagcgtaacgttgcgcggcttccccgcgttctggcagttggtcattcaggatccggggccggccgtgtccgagtccgatgggtcccggacggccgctgcccgcccgcgtgcgatgcgtgccacgcgcgtcggctcgcgactcgccgccgacagtgttgccgatatgtgcggttcggccgatgagctgatgcgcggcatgggtttggcggatatcgaatcgcgcgtacgcgcccttggcggcactgcggtttgcgggccgtatgagggcggctggcgtgtgttcgtatccgtgccgaagaagcgttggaccatggaatcgagggattgatgagaatcgcaatcgtggatgatgatccgatcgtctgccagtcgttggagacgattctgacggccaccggcacggccgaggtgctatggacggcaaatgacggcgataccgccgtgcgccgttatttcgagacgccggcgagccgaccggacgtgctgctgatcgatattcagatgcccggcaccagcggtttggatgccgcgcgcgatattctggccacggacccggccgcgcgcatactgttcctgaccacgtttgcggaccagtcgtatatcgcgcaggcgatggggcttggcgccaagggctatctcatcaaacaggatgtggcggcggtcgggcctgcgctgcaggcggtgatggcaggtcaggtggtgctcggcgcggaagtgctcggcaagctcaccgaacggactccggatcctgccgattccgacgattccggagataccgccgattccatcgaaggcctgcttggcgagcgtgagcgtgagatcaccgcgctggtcgccgagggcctcgataaccgcgacatcgccgccagactgttcctgagcgaaggcacggtccgcaatcgcatcagcgcgatactggacaagctcggtctgaccaatcgcacccaactcgccatcctctggctcaacgcccatcggtgaggggcctttggtcgagtaggtctctccctccgtcatcgcttcgcgatgccacctcgaacgcgattcaggacagcttgcagctgacctcttattcgctcgttctcactcaccctcgcctaaaaacacctccggcgttttcttcacggctcggctcatcagagggaggttgtgaaaaaccaacctcagctgtttttcatgacgatactgtcgatggtgttggccacgcgctcgcagtcgtcggagcactgttcgaggtgacggtacacgtcatgccaggcgaacacctgcagcggatcggtgcaggtggtgtgcagcgtgcgcatcgactcgatgaacaggtggtcggcgtccgtttcgatcgtgttgatggcgaacaccagttcgcgcaacgtcttggaatgccggaatcgcggcagttcgttgaccagctcgcagatgctttccgtggcgcgcaccaccatatccgacatctggaccgcatcgtcgcgcatgtcggtcacattgtcgtagtacatgcggttgagtacgccttcgatgctgtcggtcacatcgtcgagcacgtggccaagctcgtcgatgtcctcgcggtcgaacggcgtgatgaacgcggtcaccagttcgtccatcatgtcgtggcgcacctcgtccgccgacttctcaatcgcgtgcatgctgtccatgcgttcgcgcagctggtccggattgaagtcgtgcatgacctcggacagcagcttcgcggcctggcatgcgtagtccgcgctgcggcggaatccgtcgaagtagaacacgtctttttgtctcgccatgatgggtggattcctttctagaacacgaccatgaacagtttggccattacgaagctgatgagaccgcaaccggggaaggtgaacacccaggtgagcatcatgtcgcgcaccacgccgaagttgatggcggagaggcggcgtaccgcgcccacgcccatgatggcgctggtcttggtgtgcgttgtggagacggggatgccgagcacggtcatgacgagcaggcacagcgcgcttgacagatcggccgagaagccttggtatttctcgagtttcaccatgtcctggcccacggatttgatgatgcgttcaccgccgacggacgtgcctacgcccatgatggtgctgcacagaatcatgagccagaccggaatcatcacaccggtcacgctgggttggccgttgcagaacgccatgccgaggaacagcacgccgatgaacttctggccgtcctgcgcgccatgcatgaagctcatggccgccgcgcccacgatctgcgcgtaggtgaagaacccgttggtgcggcggcggtccatgccagcgcaaatcagggtcacggccttgcataccaaccagccgacggcgaagccgaacaggaggcttgcgaccagaccgtagagcaccttgacccattcgcccatgttgatgccgccgatgccgccttggatggcgatggccgctccggacaggccggcgatcaggctgtggctttcggaggtgggtatgccgagcagcgaggcgcccacgctgtatacgacgatggagaacagcgccgcgcatagggcgatgagcgctgcgttcgtgtcgccgccgaaatcgaccatgttgctgatggtggaggccacggaagcgttgagctgcgtcatgatgaagacgccgaggaagttgaagatggccgccatgatgacggcggagcgtacgcgcatgcatcgcgtggtcacgcaggtggcgatggcgttgggtgcgtcggtccagccgttgacgaagatgactcccagcgtcagcaacgttgtgacggtcagagccgggttggaaagcacttgttggaggaaatgcgccagtgagacgtccaaggggaatcaacaccttcttcttcgggggcggaagccgtcacactgattgtaacggaagaatggctacgtagttcccatggcgcgcgggttttatggtgttgttatgttgcgcgccgcgcatcctttcgtgaaaacagagcgggacagtcgtatgcttcgattcggcgcctgcatcgacaactctcgtcatctaccgaggattcggtcatgcgtgtgcgaaaatggacacggtgtcaatcaggaggtgcacagtggttgtaagcacggattcgagccgcacaatgcccgattgggtgaagtacggggtgttctggcacgtgtatccgctgggcttctgcggtgccgatatcaggcccgccggcccgcgccagttccatggccgcggccttgacgcgatgatcccttggctggagtacgtgcgcgatctaggcgcgtccggcctgctgctgggtccggtgttcgagtcggcgacgcatggatacgacacgcttgaccatatgcacatcgatgtgcgattgggcggggatgccgcgttcgaccagctgattgcggcctgccgggacatgggattgcaggtggtgctggatggcgtgttcaatcatgtgagccgcgatcatccggccgtccgggcggcgcttgacgagaccaccggacgcttgaatccggccgacaacccgtggcatggtctggtccgcgcgcatgtcggcgataatgacgaacccgctttggatgtgttcgaggggcacggggatctggtggcgctggaccattcggctgacgagaccgttgactatgtggtccatgtgatgagccattggctggatcgcggagccgccggctggcgcctcgacgccgcgtatgccgtgccgagcccgttctgggcgcgcgtgttgccgcaggtcaaagccgcacacccgtattcgtggattttcggtgaggtgatccatggcgattacccgcgcatcatcgaggaatccacgatggattcgatcacgcaatacgagctatggaagtcgatccagcatgcgctggagacggagaacttcttcgagctggattggaatctcaagcggcacaacgcgttcctgaattccttcgtgccgcagacgttcatcggcaaccatgacgtgacgcgtatcgcatcgcagattggcccggccaaggcggcgttggcattggcggtgctcatgacggtcggcggcgtgccaagcatctattacggcgacgagcagggctatgtgggcgtcaagcaggagcgtttcggcggcgatgacgacgtacgtccgaagttccccgactcccctgccgaactgtccacgctgggagagccgacataccgactgcaccaggcgctgatcgcgctgcgccgtcgcaacccatggctgatggatgcgcgtaccgaggccgtgaagctggaaaacaagcacttcgtctatcgttcgacgagcgccgacgcccagcattccctgaccgtggacctcaacatcgagcaatcccccactttcaccatccgcaacgccgacggcagtacagcgtatcaatactgagctacctcatcagagggagctcatcatttaccgccgaatgcctcggatcagcaggtcgagcaggtacccgtacgaccggtcgacccgttcgcggccgcgtgtgcggggttgtgcggaacgcagttcgaattggatgaacccgtgtatggacacccagatggaggatgcaatcaggtgagggtcatcgtcgcggatgcgaccgagtcatccagcaatctgcgcagggtgcccggcagggagccggaaatggattctgcagccatcacggattccttggatgcgccaaggatgtcctggggcaggtaggatcctcgcagcgcgtccgtcaggccggtggtgtacgtgccggcctgcagcgaccccatgatgccgacgccgagcgtgccactgagttcgcggatcgtgtcgttgacggcactgcccatgccttcctcgctgaccggcacggccgtcatcagtgtgtcggtggcggtccctggacgagggcgatgcctgcggccatgacggccgcgaacggcagtgtggcaatcgccatctcgagcgccaaatacccacgcagcgcctggaaccattaggtcgtgaggaagatgaaaccgaacaggcacaggaaggcggcgcaaatggccaacgtgccgatgacgtcgcacacccagaacacgctatcccatgcgaaccgttgcagcaggatgccgccgatgaccgggccgagcgctatgcccaccccggatgtgccgacccgcagtccgacgaccagcccacgcataggcgatccgtcgaacaacccgatgatggatggcagcgtggctcccatcaagttgtgtattaatataacatatttatgaaacaatgatacacatcatgtcgggaacaggcatccgcatcgaaaacaccgacctacaacacaatcaggcccggcgaccatcaaaggtcgtcgggcctgattcatacgcgctgtcggactaacggcgtccggacttcatacggaatggcgcattgttgcgattcttcttggaatggcggcggtttgggccttccatgttgccgtatttggcgatcatgcggcgttcgtgacgcttggcaccttctgaacgctcgtcgcgtacgatgcggttctcgttcttgcgatggatgcgcttgccgccttcgccctgacgggtgttgcgcatggactgcctgcggccgtcatgggaacgctcgtcataggagaagccgtagccctcgtggctgcgctcattgcggcgcggcttacgcggacgctcgaaatcgcggggatcagtacgatcgaagcgacggcttgatccatgcttacggccgctgaaatcatcgttgcggccgtattcggccccgtcgcgcttgtcgaattttccgcccttgccgtaccgatcattgcgacggctgcgaccagaatcgcggccttcgaacttgccgccacgacgatcgtcgtaccggttcttgccgtactcgttgcggccatcatcctgacgctcgccgtaacggttcttgccgtatccgtcgcgacggccgcccttacggcggtcatcgccatgctcgaacagatagtcgcggcgctcggcctcggggttgctcatgccgacgcggcgttccgcacggttgcggttcttcttcacggccttcttgctggccttgtcgccgtgcttgcgctgcggctcgccttcggcaacaaactcgccgccttcgttctcgtgctggaattcggtctcggcaacgttctgctcgtcgcgattgcgattgcgattgccgccgcggccggactcgtcgcccgccgcgttcttggcacccttgttcttgcccttgcgcgggttgcccacgggctgcgacttgtcgaggctccagccatccacgcgctcggcgcggtcgcccacaagctcaagcacttcgggcgaatcgtgggtcacttcaatcatcttggtcttgatgccggcctggttcagcaagcggcgcgtctcgcggcgctgctcgggcagcacgagggtgaccacgtcgcccgccttgccggcgcgggcggtacgaccggagcggtgtacaaaggacttcgggtcggccggcggctcgacctgcaccacgagctccacgccgccgacgtctatgccacgggcggccacgtcagtggccaccatgacgcgcacatcgccggaatcaaatgcggcgaggttgcgatcgcgctggttctggttcaggttgccgtgcagctcggcggccggaatgccgttctgcgtcagattcttggcgagcttcttggcctggaacttggtgcgggtgaacaggatgcggcggccttcgcccgaggcgagtgtacgcacgagttcgtgcttgtcgccgcgcgtggtctcgaacacgtggtgggtcatcagatcaggttcggtggtggccgaatcgacctcgtgcaccttgggatcatgcaggaaggtgttcaccacttcatccacgccgtgatcgagcgtggcggagaacagcatgtgctgggcgtcgggcgaaatctgctcaagcagtcgcttgaccggcggcaggaagcccatatcggccatttcatcggcctcatcgatgaccacgacttcgacggacgagagcgtgagcgcctgctggcgcagcaggtcctcaaggcggcccgggcaagcgaccacgatatcggcgccggccttcagatcgcggatctggtggatgtacttgacgccaccgtacaccgtggtggtgttcatgccaaacgtgtgggccagcggcatcagcacgtcgttgatctggttcgcgagctcgcgggtgggggccagcaccaggccgcgagggtgcggcaggaagtcgtcggcgcggcgctcttccaggctggccttcttgcggcgcttgatttcgttgcggaactcctccatcgcgatttcgccaagcgaatcataggagcccagccgggtgaccagcggaatggagaaggcgagggttttgccggagccggtgcgccctcggccgagaatgtcgcggccggccagtgaatcgggcagggtgtcggcctgaatggggaatgcggtcttcttgtcatctgccgcaagcacgcgcaccagcggtccgggtacgccaagttcgccaaaggtaagggggcgggattccgcgctgtcgttcatctggaaatcagcggaatcgtcacgatcatcgaaattattacggggcacagtggcctttcatgtcaaaggttatgcaaattacgcaagctttctgagcctagcgtaagccccctactttacttggtgctcgccacgctgtcatcccactctttacttatgaccccatggggcggtaattggcccatgaggcggtaacttgcccatgaggcggtttgaagaaattgtgaaaccgcagaataaagccattttcacctaccgccccatgagggttttaccgccccatgggatgtttgccgccccatgggccaattaccgccccatgggttctaccaccatgtaaggcgagcaccgctccatggaacacgcaaatggcccctaccagtgaaggtaggagccattgtgcaaaaaggctgaaccacaatacggcccagtagcactaaaacacactacaaaatatccggatcgtctttggcaatagtgccggttgccttgccaatggccttcaggccgtggtaggccacaagaatcaccatcgtgccgatggcgatgccgttgaaggagacgccgccgatagcgaaggcgaactggccgatggcaataatcatggtgatagctgccaccatgatgttcagcggcttgtcgaagttgaccttgttttccacccagatgcggatgccgatcatgccgatcatgccgtacagcagcgtggtcacgccgccgagcacgccggcggggatcgtgttgatcacggcgccgaacttcgggcacaggctcaggatcagggcgaaggcggctgcgcaccagtaggcggcggtggagtacaccttggtggcagccatcacgccgatgttctcgccgtaggtggtggtgccggagccgccgccgaagccggcgagcgtggtgcccaggccgtcggccatgagggcggtgccgatctggttgtcgtagtcgcggccggtcatctgggccacggacttgacatggccgacgttctcagccacaagcacgagcacaacagggatgaacatgggaaggatggaaaaatcggcctgcggcaggtggaacttcgggaagccgatccatgcggcgtcaccgatggcggagaagtcgacctggccacggatgcaggcatatacatagccgataattacgccgaccaaaatgttgaggcgacccagcaagcccttgaacagcacggccacgagcagcacggccagcagggtaaccagtgcggtgtccggcgcggcttggaagttggtccacacggaaggtgccagattgaaaccgatgatggccacaatcgcgccgttgaccacgggcggcatgatgatgtcgatccatgtggagccggcgtagtgcacgagcacgccaatcagggccagcagaataccggtgaccatgatgccgaagctggcgaccgcaatgcccttgttggcggtggtgaccgcggtgatcggtgcgatgaagccgaaggacgagcccaaatagctcggcagcacgttcctgttgatcagcaggaacagtgcggtggacatagccgtgaaaaacagggtggtggacgggtcgaagcccgtcagaatcggcaccagaaaggtggcaccgaacatggcgatgacgtgctgtgcgccgataccggcggtgcgcacccaagtcagacgttcatcgggctcgacgacctcgccgggcgccagcgtcttgccgtcgccatgcagccgccattggaagatattggacatggacattgctcactttcctcgctcttgcttggtggtgcggcacacaagaccggccgcgccacgcgtcattctagcgtacggggatcgtgcggcgtccatccgtcggaacgctcacttgccgtaatactccagcaggtgggggtcgacggcctgcaccacatcgaccagatcgccgttggacaggtacgggcgcttgaattcgcgccacggctccactttgacctcccagcgtccgctcgcctcatcaagcacgggccgggcggtctgctcccaacgcacacgcttggacgtgcgaccggtttcggggtctcggcgcgtgtaatgcaggcacgtgcagttggtgatcttccagtcgtccgaatcggcgcgatgcaggaactcctcgtcggccagatcctcgatggtgagcatcagggcaagcatgaagtcgccgtgcgtgaccatgaccacggactccgagtcggatttgcggctcaacgaggtcaggatgttatgcacgcggtcctcggccacgtcggcgatggattcgcctgccggcggccgccagtacaacgggtcggtgttcttgaagttccagttgcgggcgtagttagttttgaactcgtccttggtgatggtgttgatctcgccccaggagcgttcgcgcagcacacggttctcctcccacttggctttgggcaaggccatggtggccgcggtctcgcgggtgcgcacatacggcgaaaccatgtagcggtcgaacagctgctgctggctgacgagccagcgtccgatgcagtcggcctgcttgcgaccggtggcggtgagccgccatgagcggtcgggcacggtgacgttgtcctgcgtgtacagggagttgtcgccctgctcgcccgcctggacgatgacgttcgcttcggattcgccatgtcggattacatatagatcgagcggcatgctcatctgcgctcctccttcgttgtcggtgacgtcgcgttgttccgcgccgtccgctatttcacccgcgttatggtgtcccctttgaccatgaacgcgcgacgggccatatcgatcatcggctggtcgaacttcgagtcggtgtagaactcgtcgacgacggcgtccggaccgtacagctcgcggaatcgcctggccttgttggtgttgaagttgagatacgtaaccctcatcgtctccaaatcgaccttgctggccacgaggttccgcacgccgagcctgcggcaggcctcccccaccgtcaaatcgaaggatgcggtgaggatcacgtcatccggttcgggctggtaccagggcttgatgcgcgggtagttccgatcccagaaatcgttcacgagctgttcgacgctcgccacgcgtcgggaacggttcagttccgtaagatagccttcggccattctgcccacgccgtattccatctgctcaagcgtggcccgcccgagtttgtatttgaccgcgtaccgcagcacgggtgcgatgaaacggaacaccttcgggtcgtgtcgggcggaatacaggtacaggtcgaacaggctttcgccgtcgtagatggttccgtcaaaatcgaatacgcgcataccttctgcttctactctgctgttccttgttcaaggctaatcatggcggaccggcaaaagcgcgaatatgcggtgaatttcacatgaacactgtttttggagggtcgcaaccaacttccccggcggtcatcgtccccggtccggcaccgttccggcacgcctgcgcgtctggccgaacaggtagatgccgatgggcaaggtcagcacaccgccgatgacgaacaccagcgaaatcggaatcatgtcggccagaggcgcgaagaccagcatgcccagcggcatgcccagcgtgctgagcgtggtgtcgagaccaaagacgcggccgaccacattctcatcggactcggtttgcatgatggtacgcatcggacccacgcagatggcggaggcgacgccattcgccacgtcgacaaacaggtacgccagcagattgggcgcgaccccgagacccaccacggtcacgccgaccaaagtgacgccgagcgcgaccatgcgcatgttgtcgcgcacgaccttggccccgacggtggacatgaacgcgccgccaagcaacatgccgatgctccatcccagctcattggccgcgagtttgtcggaggcggtggtcaggttgatgaatcccagattcagatcgattccctcgtattcgcgggtcatgagcagcagggtcagattcatcggggcaacggcgatgaaacaggtcagcgcgtcgcccaacaccacgttgcgcagattcggccgacgccacgtgtagtcgaatcccaccttgagatcggcgaagacacggcggacgccggcgagcggcgagcgtccctccccttcggacacggcgtgcgcggcacgctccgccgtcgcgcgtctcttcggcaccttgatcaacgccacgaacccgacgccgatgaccgccgtggtcacgtcgatcagcaggatcgaccacaacggcaccatgttgatgagcacggcggccacagccggtgccactatcatgttcgccgagttgatcacaccgtataccgaattgacgcgcagcagtttgccggagggcacgacgtccgggatgaacgactgcacggccggcgtctggatgccgccgcccgccgaacggatgagcagcaccacgaagatcgtggccagtccggcccatcccatcgcgaaacccaacgacaacacgacggtgacggcggcgatcaccatgtccggcagcatgatcagcagtttgcgattatggcggtccgcccatgagccgccgaagatcgagaccacggcctgcggcaccacgccgaacagggtggccagcagcatcgccgaaccggttctggtctgcaatacgatccaccaccagatggcgtactgcacgatgctggagcccaacagcgaaaacgcctgaccgacgagcagcaacgccacacgccggatccacgcggcatcggcctcctcgctcgccatggcctcggcatacgcgccgggcccgcccaccccatcggacgtcacgggcatggtcgctccaatctactcgtctactcggcgcttcaaggcgcatgggcctggtcccggccccgcttcacctcacaccagtaccatagaatggaggtctgatataccatccggcatcttccgggacacggtcgagcgtaaggaacccgctatgagaataatcggcatcccgttcggcatccagtcgttcaagatggccaaactcacgctctggccgttcggggcgaacgtccgcgggctgtaggtcatcgcggcacgtgcggcacaggcccggacttcacgaccttccagggcgccgccctttccattcgcatcgtctgccgtctatcatggaatgcggatgcacaacgcaccgaacgcatgaaaggacagatcatgatcaaccatgtgaccgtcaaggtgaaggatttcgacaaggaagaagcgttctacgaggccgccctggcaccgctgggctacggcaagggccccgctttcccgggcgttcaggcattcgtggcggaggacggttcgtcggtgtgggtttccaccgccgctgaaggcgatgccgtcgcgccggcccacgtggcgttcgaagccgccgacgacgacgccgtgaaggcgttccacgaggcgggtctggccaacggcggcaccgacaacggccagcccggcccgcgtccggactacggtccgacctactatgccgcgttcgtgcatgatccggagggcaacaacatcgaagccatgcacaactgatcgatcatcgaccggtcgagcgggaatcccgtcggacggaacacgccttccatccgacgggatcgtcataattcccccacccacgcccacgcatcaccgcactgccgcgactgttcagcatgccccagcagccaggaccatcacaggtaagtgttccagccaagcttgacggcgaggataatgccggtcaacacggcggcggcccgcatgatgttctccggaatacgccgggtgatgggaggcgcgatcgcgctgccgatggtgcagccgacgcacatcatgatggcgaacggccagcagacggaaccacggattacgaacatgaccgcggcggagatattcgcgccgaagccgatcacggttttcaatgcgttgatctgatggaacgggccgatcctgcccaaatcgagaatcgccagggcaagcgtaccggcggccgctccgaaatagccggaatagacgccgacgaagctcacgccggcccacagccaccacggatcgtcgcgcaatgcgccgttcaccgtcgcaccggcgatccgcgcggcgcgctccgcctgatacgattgcggcagcgcccgtgccacggcatcgcgcgcggccgctttcctccgtggattgagcgcgatgatgagcgcactgaacagaatcaacggcggtaccgcgaattcaaagaccttcgcgggcaattcaagcagcaacagacctccgatgacgccgccgaccagaccgatgcaggcatagacgaccacacgccggccctgtcccgcgagctccttgcgagcggagagcagcccgccgatgccggtaccacacacgcccaccgtgttcgtggtgttggacagcacgggcggaatgccgaatgccagcaacgccggataggaaaccaatgaggatgcgccgaccgcgtatccaacgaatccggcggcgacgccggctacaagcaccgacagcaacgtggtgacggacattcctgcaatcatggggccctcccccttctcattccggtctgtgtggcaacgggagtcaagcgtaatggttcggctcccgcgcatcgcatcatcgcccgtaacgtggccaaacaccgacgacgccacccgcattcatgaccgcgccgaggagggcgccctgaacgggcatcccgcgcagaccagcgaggcggggtccggtcggcatgccgtcccgtcgcacagggatcgcggtgcgcggtccatcaatgtgaccagtccacgctcctgtgcacgcatgaccgccatatccacgaaatcggagggcagacgccgatagtcggcgatctgcggaaccgtcatcccggttttaagatcggcggcgatgtcggcaacgatatcggccggctgttcgtcggccgcctgcccgtttcgccagccgaccgcgcgaaacgggcgacgccagtcgcgtgagagcgaggaccgtcgtatcatgcgcgccatgcggatcaccacaccaaacgcagtgtctggaaggcgatgacggcgatcgcatacgccaccgccagactcagcatgacggattgcgccgcgactttcgtgccgaattgccgccgcatctcggcgaccgtggccagacatggcgtgtaggcgagcgtgaacagcaggaacgcgatcgccgcggccctgccgtgcccgtgcgaggaccggtcgaacgaggcccgcagcttctgccccagcgtgccttccgtgccctgctgcgcggccgcggcatcaggttcgtcggcatgataggactgcgacatcgaaccgatcacgacttccttggcgacgaatcccgtaatcagcgcggccgacgcatgccagtcgtcgaagcccgccggagcgaacacgggggccaccgcatcggcgagcatgccgtacgcggaatcatgcacatcgtcgacatgcgcgaaaccgccggcaccggccgtcatgggaatgccctgcagcagccatagcgccatgatcatcgagatgatgatcacactggcgccgcgaacgaatccccatagacgcagcagcaccgaacgaaccagctgcagggcgcgggggcactggtatgagggaagcgccagcatgagcggctccggctcaagcccacggaatatggtgtggcgcagcatcacgccgaccagcaggatgatcatcaccgaaacgacgtacatgaggaacaccacgagacccgcatacttcggaaagaacgcatgggcgagcaccaggaacaccgacaggcgcgcggaacacgcggcaaacggcaccagcatgccggtcagcacccgctgacgggaatcaggcagggtgcgggtggccgccaaggccggcagattgcagccgaagccgacgatgatcggcaaaaacgcgcggccgtccaatcccaaggcgcgcatggcgcgatccatcacgaatgcggcacgggccatgtagccggagtcctccagaatcgacagcaacaggaacatgatgcccatcacgggaatgaacgtcagcacggtgatcacgccatcgagcacgccatcgaccagcagcgaacgcacccagccgccgtgccaggccacgccgaacagcccaagcaaccagtcgaggccggatgtgcaccagccgcggaacgtcacatcgatccaatcctgcatcggactggccagcgtcgtcgtggcttggaacaccgtgaacagaaccgcgagaaaaacgatgacgccgaccacggggtgcagcagcatgccgtcgatgcggtcggataaggtgacgcgaccgtcgtcgtgaacgtcaaggcgacgcaatacgccggcggtccagtcgagacgggcatcggcccgtgattcagcccaggagcgcaggtcgtcgacggtgtgcccgtcggcgtcggccgtgatggcggaccatgcggtcagcccagagggaatgggggttccccggaaacccacggcgatggcatcggccaacgcctcgccgccgtctccggtacgcccgtcgaccgcgatgaccggcatgccatccagcagacgggataaccgttgcgcatcgacgccatggccattgcgcaatgcgagatcgttcatggtgagcgcgatgacggtcggcagtccaagctccgtcaccgtcgacagcaggtagagagagcgggacagcgccgtggcgtccaacaccacgacggcgagatcgggagcgggcatgcccgacgcacctatcagcgcgtcgacggcgacctgttcatcggggctcatcggcagcagtgaatacgtgccgggagtgtccacgaactgccagagttgcgtgtgcggcgcatcgttcgcgctcttgtaccggtactgcccgcaagtgatggacacggtggtgcccggagcgttcatcgtgcgtgtcctcgcgccaagcagcgcattgaacatggaggatttgccgacgttcggattgccgacgaatacgacgcgcttcattgacgccgcacgaccggcatcgcaggtgtcgccgcgagcgccgtcacgcacggcgccattcgcggacgtctccgcatggcgattgcaacgccggcagcaatcgtcctgcgagctgcagcagtcgccacctctcaggtcccgtagattcatcattcgcgcatattctcgttctcttcgcgttacgcaacgtcgccttgcgtatgttcgtcctgcgtgaaccgtacgcggacggcccgcgcggtggcgccatccaccgcgacgcgttcgtctccgaaggcgatgacccgcccgccgaaagcgccacgctgcacgacccgcaggcccgcgcccggagccaggccgatctcgcagaggcggaaccggtgccgttcatccaggtcgatgccgtccacgacgacgcgcatggcgcgcgggcagtcgcgcagcgtcatggtggtgccgcgctcccccgtccgacgccgcaccgtgccatcgaagcggcgagcatgcgtattatccatgttttcacacatagcaggaaacgaagcaaagcacaagagtgttttccacggaagggaagcctcatgttccattcattctattcagcgatgatggcgcctaatcaccgatcatcctttgggaacagcgcatcgaaggcatgttccatcacggacttacggcggatcacaccgacgagtctgccatcaccatccaccaccggcagtttcttgaactgcttcttggcgaggattcgggccacctctccgacatgctggtcgggcgtggcggcaacgaccttgcgcgtggcgatgtccatcaccttcttgccggagagcgcctgcaccttggaggtcacggtttcgtcgtcgaacaccaccatcgtcgaaccggtgccggtggaaaccgtacgggattcataggtggcaatcgatttcatgacatcgccgtcgctgacgaagccgacgagcctgccatcgccgttcaccacgggaaggctggagacgttgaggcggatgaactcgcgcaccacatgcgtgatgtcatcgctgtccaggcagctgtagggctgatcgtccatgattccgccgatggactgttcctgggcctgcttgaacagggaggcggcgggggccacgtatgcgccggcgtagtgatgctcggcgggctggccttcagtggtttcggccgcgacttcggcggaggcttgcgcctcggaggccttggcgttgcgtgcggccttctccttggcacggctggtgacggtgaagatgcagatgatcagggcgaccagcgagatggcggcgcacagcaggtaggagaacgcgatgccgctggccgtggcggacttcacaccctgggacatgtgcgaggcggtcatggatgtttctgcggtgaccagaagcgaggtcgcaatggctgccgcgatctggcggcctgtgttggcgatggcgtttccatgggcgatcatgtcgttcggcaaagcgttgacgccccaagtgttgatcggcatgttggcgatagcctgaccggatgcctgcaatgcgcagaacacggcgacaaacagcactgatgtcctggtgttgatggtgccgagaagaccaagagagatggtcatgagcgcaaggccgccgatgcccacgccgcgagggccgaatttgtcgaatgcggcgccggcgaccggactcaggatgatgccgaccgccgcggcgggcagcatgaccatgccggtgacggtggcggattggccgagcacattctggatgaagataggcaacgtcacgttggttgcggcgactgcggcgttgatcagagtgaccagaatcacggagttgcggaagttgcgggtggcaagggtatcaacgcgcaacaatggctcatcgagcttgacttgcttgtatacgaatgcgacgaaggccacaagaccaacgacgattgagataatgacgaccggactgctccataccatcgtggaagcggacgagaagccataaagcaggccaccgaacgcgatggtcgaaaggatcacggacaggatgttgagctttgggttcttcaactcgctgacgttcttgagcatcatcgtgcctccgacaaggatgaccagtgccacgactgcgatgccaatgaacatcgggcgccatccgaaactgtcaatcaccagaccaccgacaaccgggccgatagccgggccggcggccatgacgataccggccagtcccatggcggtgccgcgcttatccggcggatagacgagcatcggcactacggcgaccaatggcaacagcacgccggagccggcggattgcagtatgcgcccgacgagcaacagcatgaaattcggcgcgacggcacacagcagtgtgccgaccatgaaagtggcaagagctccggcgaagagctttcgggtggagaatttatcaatcagatagcctgaaatcggcaccatgatgcccgagaccagcatgtagacgctggtcacccactgcacggtgccggtggtgatattgaaatcacgcatcagtgccggcaaggccggtgacatgacggtctggttgagcagcgcgatgaacgagccgacgacgatcacgcccacgacgatgaatcgggtgtgcggatcaataggctttacggaactggtggcggacccgagttccgcgtttttctgtgaggtcacagcatttccttctgttggtaacgtcatgtgtggcgatccggccccatgcttgtgtcaagacgcgaggacaccgatgagtccggacgtaaaggaaaagccgccatccgttccgcattcatatacggcaaacgattcgcggctttgcgtaagttgatggctatggtgagcgattcatgcgacgtcgactgcggatgggccatcggtacatcccggcataaggcgtgtccccgctacaccagcatcgagaatagggccattcgtggattggcaaacagaacattgccgacgaacgacccacggcaggcgcgtgcgatgaacatcgcgtagcgatacaggttcatggcatctccttgatggggtcttcgtacggcagacatcgagaagcctatcatcattcaaatcgacggtgaaacccacgcatgcctgacaatacacaaaatcttcacaaaaggattgggcttaccgcatacgctccgcctgaataacggtccggggatgaatcaggggcgagctaagggttgcatctcgtgtttccgtcatgatttctggcaaaatgtgaagctaatcatgcgaggcatcgaccggaatcggaaaggggcaaatcatgcgagttctcggcaatatcctgtggatcattcttggtgggttggccatcgcaatcggatgggcattggtgggactgattctgtgcatctccatcatcggcatcccgttcggcattcaagcgttcaagatggccaagcttgcgctctggccgttcggcgcggaaatcgtcaacctgtagattccaaatactacaaagccgccaaagcaacccttgacgaggcggccaccgacgtcaacaattggattgaccagcaagccgccaaggccgaataataaaacacacattatgctgctgcagcagccagcccttgcagaacaatgtcatgacaaaggcctgagaagacgacttctcaggccttatccgcgccgctcctcaatcgcttgtagcgacagctcccctcaaagaggggagccagagaaacacttacttcgagatgttgaacttgaactccacgatgaaaacgaaaacccaatgattccaacggttcacggacgccgcgaacggcccgggcactctaagggcactctattctgttgtcgcgaatcatcatacagcaccccggaaacgcgaaaagcgccccgctcccccgcggcgcaggcgggtggagcggggcgctgtgatgcgatgatgcaggctattcctgcgtcatgcgtcgggctttaatctgctggcgccgatgagtgcgccgacgagggtgcccagtgcggtcaggatggtgacggtcaggtcggtgccagtccatcccgcggcggtgccgatagtctgcacgcacacggccaacgccggcagcgcgataaggcccacccatttcagcacgtcgtacacgcggtcgggaatgagatagcccgcggtctcttcgtcgtccatgaattgctctccttacgaatatggggcccgcacccgtggcggatgcgggccatgatgggctagtagtagaggacctcgcccggatagatgagcgacgggttgccggaacggtatccggtgagctgtgtccagctgatgccgagccgcgcggcgatgccagacaggtagtcgccggactgcacgacgtacgtgcgcgacccgccgttggcggtggtgtcgccgttgtggcagaccacgtcgcccgggtgcacgcggttcgggtcaccggacgggacggtcacgttccaccagtcgctccagaactggctgacggtctgtccgctctggatggtcacgcaggagctgccgcagccgcccgtactaccggcgtccggcgtcgtggcggctccgcccgtattgccggagggtgtgatgtccacggcgctgccgtcgggctgcgccgggttcccgccggcgtaggcggcccatgtggtcgcgtccccgtagaacgtgttcgcgtccaacgggccgatgccgccaccgtacgcggagctggtgtactgccagaccgcggcgaacggccactggcccgtgctccacgtcggcgacccggcctcgcggatggtctcggccgcgtacccgttcgggtaggctgcgagccacaggccgtagtcggcggcgaccaccgcactccagtcgttcgacgtcacgacggatcccgacatgtagatgagcggcttgacgccccacacctcatgcacgcggtccagccagcgcttcgcccaccacgtccagccgttgtaggccccgcccggctcccagcccaggatcggcagcacgtgctgcgcacggtagccgaccgtctggctcaggaaccagtcggcctcggcctccggcgaattgccgaggtcggggcgggcgaaatggtaggcgcccgtgtacatgcccgcgtcgatggccgcctggatgttgcagtcaccgaccggatccgtgtacccgttgccctccgtgaccttcgcgatcaggaagtccgcgccgtccgccttcaacgcggccgcgttcacgcacccctgccagttgctcacgtccacgcccgcatccgccagagcggtcgtgggcgagacgccgagcagcagggcgatgacgaccgcgaggattcgcgttaccaggctcggcttgctcttgttcttgatgtccaattcctctccttactgttgatggatatggaaaagccccacccgatcgggtggggcgaaatttctgattggctggctgttaccagcggtcgtcgccgccgcgcacgaacatcaacacgacggttacggcgactatcatcacgatgacgatcatcgatgcctcctcagttcgcggatgtcctcgcgcaactccaggtgctcgcgttcggcgttggcgacgcgttcgttcaccgtcttgaactcgccgttcatgtcatcgcgcagcgcgtcgatcgcgtccatgaccttctcgtgcttctcgtccatgtccacgcgcaacggcgcctgatggtcgttcgtgatctcccacttcgtggccgactgctggtcgcgcagcccgcggatctgcctcgactggatcaccgccactatgaccatggccagactcggcaccaccgcgatcaggatcaccgcccacaacggggtaccggccggcggattcataggctgtcctttcgacgtatatgctcggggtatgggcaacaggttctgcaggatttgcggcgaacacaagccgttgacgctcgagcatatccctccccggtccacgggcaacgaccatgtggtggtcgtgcatcgtggggatgaggcggtgatgcactcgttgttcgacatggaggtccgggacgacgacgggtacaggcagtcacacgggatgacgttcaagacgctgtgcgaggactgcaacgagtatctcggcgccaactatgtggaaacgttcaaaggcctgtacctggatttcgcccatgaatccggcgacatcctcgacgggctcgaccgtgaccggaacgagtccgagaccgacggtgtggagcgatactgcgaatttgacttaggcgaggggttccgtcccctggccttcgtcaagcaggtggtgtcgaacttctgcgccacgacggcgccgggcagcatgctcgactgcaaggacttcctgctcgaccgggggaacatttcgttgcccgcgcgttaccggctgcatatggccgtccttccgaagcttgacggggagagcgtgttctccgggtggatgcgggtcctgttcgacgacgggacgttctgcgacatggcgttcatccgcatgccgccgttcgggttcgtgctctacgacacggaatccagcacctatctgcccgaccgcgcgggtgacatcacgcccatgtcacgcatgggctgggacgagacagggaaaatcaccctcgtcctcccgacggtcacgggaaggaacgcgtcgagaccttacctgtggggccggtaccagaacgccgtgtgacgggacacgccccgtctaccggtcgggttcgtcgagcgggacgatgcccatgagctggatccatccctcgttgtatcgtatggcgccggggtcgatggcgatcctcccgtacgcgtcgatcttccagcaccggtcgacgcgatccatgatcttcgcggtcacgtcgccggtgacgctctggttgtactcgtggtaggacatcgggtatcgtcccatgcccagcaccgaggcgtaccggcggtcgacctggagtgcgttgacgtacgagatgccctgatagtcgggttcctggcgacgagactgacgttgacgcgaagcagtcctccgtccacggtgatgatcccggggttcacgtacgcgtccgggtcgatcgcgagcaggtcgtcgtgcacgctgacgggcacgcggaagtagggttcccattcctgcccgtcgagccatgcggcgagcctggcggcccacacgtgctgcccggtctcgcccatgtgcctggcgccggggtcgttgccgaccgtgaacgtcttgcccatctgccggcagatgctcatgaccacgccgcccacaccagccgcgtacgcgccgtcggagcgcttggcgagcatgagctggcctatgccctcctgccaccggtcgaaccggatgccgagccggcccgtaatggtgcggaccttgccgaacccggtggagacgattccggtggggatggccagataccgggcggcctcagacagtgccggggtcgaaggattcgtccctcgcgtcatcggccctcactccctccgcaagcggatccgcccgcgcctcctcctccaacgcgttgatctccttgccgaccgcgagcatctgcttggtcaacgcggcgatggcctgggccggggtgtccggatcctgcaccgcccgacgcagcgcgtcaagactgacgcgcagcaggtcggcgtatgagacttccgtatcgtcgccgcccgcgccagccggaggcgacgatacggtggcggcgccccaccgtcgcttggacgcgagcttcctgcaattgtcggagcagtaacggcgcttgccgctactgttcttcggcaacgctcccccacacaacgcgcaccgtcgcataggcataatctcctcctcgaaaaggcgacgctcaacaacaccggggagagatatcggccctgcacccgaggtggccgtttcggggcctgccggggtatcctccccaggtcaccagtcgctcaactcgaacggtatgctcgtggccttgggctgcgcggcggcacctcccagatgggagcgggcgtacgcatccgttttgtcgctcttgatccggttgcaccgccggtgcgtgagccggcagttattgaagctcaacgggtcgccgccacggcttacgggtatgagctcgtccacctccgcactcatgggatgcggggatctcaacgtcttgtctacgggccggccgcagatggcgcacacatcgtaggcggcgagcacgcgcctgcgcagtatgtcccgccgatgcccgttggccctgcgcgggttactcctggcattcatcgtcgaacaccttgcggaacgctatgcatcccttgtcgagcaattgttcgaatcgttcggcgtcgaacatggcgcactcgccaggctcccctgacaacgggacgggcacgctcatcacggcgagccgccggtccgcgttgtcggtgatcttgagcgtgatggtgggcggcatcatgcacctccccctagatatgcgaaagccccgcaccaaaggtggggctgaacttatgagatacgtttctttcgtaattctccatacgcacttgtcgttatcttcagtacccgatatatgcagaacgctaaatgagtcattagccatacaacaatcgctgaaactacttttttccctatatcaggtaattgaccatatatcccaagggaagaccccatagaggtcaatatagttattccgagagcaagagccgacgagtatacgacgctgaagaacatgtcatccacgagtcgtgtaagttttaaattctcagcttgaatttctccatttttcacgcgttctcgcaaattttgattatatgtcattctaagttcaaatacgaagatagcgtgtgcgaacaataaacctccgaggacacctaaagccgatacgataatatcggcgtttaccgcaaaccgtccaaaacaaaaatccaatattgcgacaatcgtcggacacaataattcccgcaatacgtatttccacgcaatatttcgaccatcgtccgattcacgaatcttcggagccaatgtatccatgtagtgatagaggatgccgttatgattcaagttcatatctatcaccattttgcggatttacctgttcaaataatgtattccagtcaataacttctgagtccggtatctcttcatgcatctctccactgtcccatccagtttcaagacgaatctgttcatcatgatatttgctaaagatagaatcagaaagcacacgccttagttgtccgttatccaaacgtggctcaccgtctccggtaataacctcacgaattttcggactcttctcattgccgattgtgaacgtctttttgcgaccatcgattcccgcagcctcgaccaggactccttgtttgggaatggattcattattcaatgacggaattgtcagcatcccttcccttcccatattctttttcctcagcgcccgccagaatctcggattaagcacagagacacccttcggaggcagaacaaccaatgccatgcggccatacatcgtttccttgggatcatcgtccaatccgttatcgactgtcagctgttggtcggtgctgctaatgggaattttcatcgaaataaggctacttgaatccagccacgcttccttttcgagaatcccatcgattttcgcgaccaatcccgggataaaagcacgtaagcacttcgcgaaatagtcaatcacaaattttccgttaatggaattcatgtgttcgacggcaaagatcgccatcttcacatcatcgcctctagggcagcaaaaaactattctgactgttttcacggcggcttcgtcgggattgatgtctctaacaacgttgccacgaagtatgtccagcaattggccactttcaccgtactgaccggacaacacatcaatcagcacaagccgtccatggacttcgtaatcgcttacggaatatattcgttcccgtctctcatctttgagaatggtacccttgacgtgttctaaataggaacatagatatgctaagacactgtatccgcccccgacatccagaacgtcgcgaggaatatctggattctttttccgcgtttttacagtaaaggcgtagtagtcaacagtacttctgaccatccatgctccccagcttgaacgacatcggtgtagtttgcggttgttaccacagattctacacgcgtttgggggatcatggcgcttccccgggttctaaatagaagtgcaacaccttgtctagggttggaagtgttcgaagtttctaacttaagaaggtgttgcactcatgggtcaacagtattcgcacctgtcgtccgaggagaggatcctgatcgagaagctgcattgcgaacagcatccgggcatccgtcggaccgcggagaggatcggccgggacaagtccaccgtgagccgcgagctgaggcgcggcctgtggttcgcgtccaacgagaacgggtcgtatcgcccctaccggccgaaacggctgaagaccgggccgtggacctcgggtccgttctattcggcgctggccgcgcagaggaaggcggacctgcgtcggcgcgagtccaggaagccgcgtcgcatggactcgggcccgttgcgcgcctgggtgctggactcgctgcgcagggggtggagcccggaactgatcgagggacggttgaaggcccagtgcgccggcgacccgtcgatgcggatcagccacgagtgcctctaccagtggatctacgccaagccgcagcgggcgctggacctgcgccagtacctggcgcgcggcaggaaacgccggacgaggaaaaagggcaggaaggcgaaagggccgcgcatcccgatgcgcgtgcccatcgcggaccggcccgaggcggtcggatccaggaaggggttcggccatttcgagtcggacacggtggtcggcgccgcgccgtcgaggcgctgcgtgaacacgcaggtggagcgcaggagccgcaggctgttcgcccggctcgtcgacgacaagagcgcgtccgccacggccagggccgagtacgagatcttcaaggacatgccgccggccgcgcgcgtcgaccgcacgtgggacaacggcacggaggcgagcctgcacatgctggtggacgaggcgctgggcatgctcacgtacttcgccgacccgtacagttcctggcagcgtggcagcaacgagaacaggaacggcaggatccgccgctacctgcccaagggaaccagtttcgaggatctcacgcaggacgagctcgacgcgatcgtcggggagatcaacgacacccccatgaagctcctcggctacaaaacgcccaacgaggtatgggacgaggagatggccaagctacaatcaaaggcaaccaacacgaagacgggcgttgcacttacaaattgaatccgggggattgaggaattgatagttgctatggtaaaatccaactaaatttgatggaacacctgacatgccaaggtggttccgaagcaggaaggccttagagcattggtgatttgagcagtggcggattgcatgaggagagattccgcgtgttctgcgcattatcgcgcgtatctgccattgtaccaatcgcaatgcctgattcgatgaagttctcgttagcatagcgactttcagtgccgtcacgaggactgctttctgaatacagcttggcaataaatggcacagtccgccacttttcgatagtcacagtttgattaatgcgccttatcgaaagaggcttccatgagtcagatattgacactaaccgatatttcctactgctatccgggcgcgccggaaccattgttcgaacatctgtccgcgacattcgcggccggctgggccgcagtgctgggagacaatggcattggcaagaccacactggccaaactcgcctgcggcatgctttcccccgattcggggatagtctcgccgaacccgtgcaagatggcagtcgcctactgtccgcaacgtactgatgaaacgcctacgaatctggatgatttcgtggcggattggacgggcgagaccatcgccatccgcgacgcgctgaacatcggcgacgattgggcataccgatacgagactctctctggaggcgaagccaagcggctgcaaatcgcttgtgcgctggccggcgatcccgacgtgctggtgttggacgagccaaccaatcatgtggacggcaggacgcgccaagccatcacgcaggcgatgcgtcggttcgatggcataggcatcgtgatctcccatgatgtcgaactgatcgacgcgacgtgttcgcgctgcgtgatgctggagcgccgacatgcgcgtgggcgtaacatcacggcggcgaacacctatcagggtggatatacccaggccgcgcagcagatgcgcgacaatcaacgtgccgatacggccgccatacagtccactcgaaaggagctgcaacgcatgcagcgcatcaagcgggagcgggcgcagcgtgcgcgcgaactggatatgcggaagaatcagggaatgcgcatcgatatcaaggacatcgacgctcgcaaagccctgaaaaatctgaaaccggctatcggcaccactgtcgcacagacaagcgcgcaattcgacgggcgtatcgccgccgccaccgacagacttgctcacctcagcgaagcggccaaacgctacgacggcaccatctggatgaacgtcatgccgagctcacgcagggaattgacgcgcatccccaacgaccacgccatcgcggaccaacccgatatgctgagcatcggcccgcgcgaccgcatcggcatcagcggtccaaatggcagcggtaaaaccgcattgatacgacgattgatcgaagcgctggagcgtgatgaagcgcagcggcattcggagagaatgccatatctctatattccccaaaattccagcgacatggataccgccaacgcaatgaaccgcttgcatgctttgacggacgagcaacgcgccattgtgctcagcgcctacgcccaacttaacgccgaccccgacagactgctcgccggcggcaatccctcgccaggcgaactacgcaaacttctgttgtgcctcggcatgattgaacagccacagctcatcatcatggatgagccgaccaaccacctcgacctgcactccaaacaggcacttgctaatacgctatcctcctatgcgggcgcattggtcgcagtcagccatgacgaatggtttctgaatgccgtcacatcgattcgatggcgatgcgcgtcatgacgctatctatgagtttacgttccttcgtaagacttggatatcggcaagacgcattccttttcgtatgaagctgtatcgatggcaatgaccgagcaagaggacaccagtatgacacgaccgattatgccgcgagcacatggcaaaaaacttcacatggaggcgaacatggctcatgttccttcggccatcgcaatcacggcgatgcgaccggaggaatatccgttgctcgtcgagttcctgtatcaggcgattcatgtatcgccgggaaccccggcaccggacaggagcgttgtcgagctgccggaattgcggcgatatatcgagggattcggacggcccgacgatgcctgcatggttgctcgcgccggactaccgaacggtccgcaaatcgtgggtgccgcatgggccagaatcttcccgaacaactccgcaggctacggtaccatcgacacggcaacgccggaagtctccatatccttgcttcccgactggcggaaccgaggcatagggcaccgcctgatgacggcgttactggaccgactgcgaaccgatggtcacgccgcagccagcctctcggtccagcgcaccaacgccaacgccctccatctctacgagtcgcttggcttcaccatcattagcgaacacgacggtgaactggtcatgcgcgtggctctcgcggattgaggcagtgttccacacatcatccgcatggagccagtgcgtaagccacccactgtgatatgtgcggctgcaagtcccgcattcatacaagcaaacaatctgacatacagatgcagtctattccttattatgttttcggctttgctcttgataagagccagcaccaccatccatcctcgatgaatgtgggcaggctttcgcaatgtgccacatgacgcaacgtgtagtcggcgtggaccgcaccaccgcgcaggtgttcacgcatgaagctcacgaatgatacgacctcgaaaagctttttgggaggctcgttcccaatcttgtcctcagtgtgcagcctgtcagtctgaagtcagctttcaactggcaaatgttcaaagagacgggctagcgcagtggatagatccgctccttcgaaagcaaaagtcgcagcagcacgtgtctgcttgtccgcgttgaaggcaagcgagacaccgacggctttgaacagcggtaggtcagaacgactgtcaccaatagcgatgcaattcgaagcttcaactcccaagcattcacattgctgcctcatgaatgttactttggtttgttcatcggcatatgccgctgttttaccaataaacacgccatccttgacagcaagttctggaccgcaccatgcttcaaatccaaatctctgcgcaaggctctcggaaacgactgtccaagcgcaggatgcgaggactggcttgattcccctcgacttgcattccgcaacggactgtgcgattccttgcacaagcgggagatcgttcaaccatccgtgaatttcacttacccgatggccagtgtatccacgagcatcaatatcgcataccgtgtcatttccgatctcaccgcgtgcgtatcgatcctctgcatctcgcatcctgtcgccggtacccaaccggtccgcaataaatgcgccagagctaatgccgtatgtgagcgttccgtcgatatcaaaaaatgcaattcccgccattcatccctcttcatttactggttcagcccgaacctccagccggtaactaagccaatagcgtatcaaaaggcacacatatcagaaaagaaaggcagatagtcccattaaaccgtttcatgcgattgcagttgtccgccgctggctacggctggcagggggaagctgggaaaggcgtcccggcggaaggcccgccggtgcgttcttcttccagggacaaggaaggatgcgggcggccgtgaatggtcgcccgcattttccgtatccgtgtgaaacgggagggagcgcatcatggggcgcttccgactgaaaggacggatacgtatgtcaggtgggaagaagagcaggcgcacgatgctgatggctgccctgaccgcaggggcgttggccttgggatatctggcgccagccgcgttcgccgagggcggtggtggcggttccggcgagggcggtggcggttccggcgggcaggttccatcgcagaccgccgacgtgcattggatctacaaggattcctggcccgccactctggagggcatgaagcaggcgatacgtgattcgggcaccaccctgtcttccgatttggaggatgggtcgaatcagttcgtggatatgaatgccatccttgccgacgcgatctcggagtgcaaggcctcatacaccggggagggtgacgcggaatgccggatggtcgctgtcggctacgcgcgcctcggcaacggcgtgttcagcggttcctatgtcagttcgaacgcgcgtcagcgttgggagtcccaatgggccgccgaagggcgcggcacctaccagtaccaaggccagtcgtacacgaccggcaccacgtggaccgatcggcttggcgtgcgttcggtggatagcctggtgcaggattccatcaacgccaatcccgatgcctcgttccgtgtggtcatgctggccaagaaccagccgcccgtcgattatccgttgaccgtcaccacctcgcaccgccagcagaccgacatacaggtcggctcgaccacgccggtcggcgacaccatccacgcgaacaacggcggctcgtcgatcaaggagaccctgcacggcaccgcgatcgtgcactacgatggcggcccctacacgccgacgggcagcgtaagcaagccgatcagcttcgccaacagcggcgacaccgtgatcgacaacctggcctcgccgggtgatttcggcatggattcctgggccgagggcacatattggatcgacatccaagtgcccaggcagggaagcatgcaggcggccgtggacaccacggaccgggatccggcggagacctggaaggtcagcgccgtgccgccggccgatccggtcaaaagcatcgaggaaggcgtcagcgccgaccgaatgaccaaccgcaccaccatcacgtatgggaccggccggggcggttacgagctgagtttcagggacgtgatcgaacccaacggcgtcgattacacggtggacggcttcacgctcgtggacgccaccgacaacaatcgcgatgtctccaacgagttcgagatcggttgggaccgcgcatcgaacacggtcagcgcggtccgttcggccgacaagggcatgatgccgttcgaccacgagtatgtgttcggcttcgatgtgaccgtcagcctgccatccgattaccagaacatcagcgaccatgcgtggggcaagtggaaccagctgcccgaggccgacgcgggagaacgcgagttcgacacctggcgtcccaatcccgacaaaagctggatcatgctcgacactaatggcaagtggcaggccgtgatcgaccccgaccgcaccaaccagaccggcggcgacggcaaggtgttcctcgacggagaccgcgtggcctccgtggtcaacggcaccgtgccggcgaacctgatccaggctccgcagacgctcaccttggtcgatgattggacagccgccgattacctgttcgacgccgatgaagcggcgaacgtccgagtgtacgaggcggacgcgggcaccgatcgtgccagcagcgtgagcgacatcgccaaccgtggccgtgacatcaccgaccagtgggacatcacgatcgatggcaccgtggtcaccgccacggccaaggcctcctacctgaccggactgaagggcttggcgaaggccaggcagatcacgatgctcgtgcccggccgcgcgaactacgccaacggggccggggcgggccaggtgcgcgatgacttcggcaccgaagcggacgacgagatcacgttctgcaccgccggcaagaacggcgcggagttgaccaacgccggctcgcagaccatcaacacccacacggtcgaaaccaacgagccgaaggtctgcggttacgtgccgtccgtggtcaaggatgtggtcggggaatcctcccaaggcggcgcccaggacagcgtggacggcaagatcgtcttccccggccagcgtctcgaataccgtctggaaacccagccgcacctgcccgacagtctcgcctacactatcgtcgaggtggcggtcaccgacacgtatgacgagcacttccagccggacaagcagaccctggaggtcaccgacctgaccaccggcaagttcatccccaagagccagtaccgcagcgagtggaacgacgcgaaccatgccgtgcgtctcgtgttcgccgacgactatgtgcgggcgaactggctggcgggcgcgaatcccaggatcatcatcaggttcgagggcgtcgtggccgaggatgccccggctgacaccgtggttgacaaccggtgggcattgaccttgaacaactcggtcacgccaagcaacaaggtatggaacgatccgcccgacttccagccgggcaaggaggacacccaggccgacccgtccatttcgatcgacggcaagaccgcgttgctcagagaccgcatctactatcggatcaatctcgacgccaagcagacgaaccatgcctacaaggtgtggcggctgggcatggtcgatgactgggacgacgaatacctcgaactcgacgagaaccatatcaccgtgaccgacaaggccaacggcaggggtatgaccgaccggttcaacatccaagccatcgacggcgtggcatacgtgttcgccaaaaccgttgacaccgaggttccggcgacgggagagaccatcaagggcgacccccagccagccgatctcaagatctacgccgcgcttggcgacaaggaccacgacccgttgaaggacccggccatcgaccagtcgcttctgggcacctcgtatgaggtcacgctgccgatgaccgtcatcaaggtcaccgacgattacgtggtcacgaacacggccacccagctggtcaacgacgtgcgcaaggacaccaaccaggtttccaaccccttgaagccgatcaacccggccaaggatgtcgtggtcaaggtggacgggcagagcgtggatggcaagagcatctatctcaacagcctgttcctctaccggctcgacagctccacgctgccgcccgaccgcgcctatccgcaggtctccgactggtccatcagcgacccgctcgacacccggtacgacaagttcaccggtcaatgggccgtctacgccgcccgcgacctcatcaaggacggcgagaccttggccgagcggggcgaacgcatcgccggctccgacttcgacgccagccgtttcggcggagaactcttcgagctcgccaccgacgagcacggcgtggtcaccgtgcgcgccacggagctgatgcttggactcgtgtcggccgacaccgagcatgagcaggcgtggaccacgttcatccaatgccagcgcatcgccgtgggcggtcccgtggccaaccggttcaccgagaccatcaacggggtcgaacggccctcgaacaccgtcaccacgcacacgcccgacatgacgccccggctcaccatcgagaaatgggacgagcactccggctggcccgacggcgaccgtgacaccgttgacgaggcgctgaacatgaacgggagcgatgctcgcatcgtgttcaccatcaccaacgcatcgcccaccgaccccgacaccggcgaaggcccctggttcaaggcaagcgagctgaaccttaccgaccagctcgtcgccggcgacggccaaatcggcgagttcgagtatcccgacgactggcagacgctgatcctcaagcctggcgacagcgtggaggtcaaggccaccctcagtgatgtgaacgagcatcacaccgaccgcgccatcgtcaccggcacgccgctcgtccaatgcatcgtctccgaccccgaccccttcgacggcaaggacgaggagaagctgcccgaggacgcggtggagatcgacgggcgaaccctgtgcgcggacaccaccgtgaccagcaacaccgacgactggaacggctaccagcccaaggacaacctggcgaccaccggtaccaacatcgccggcctcatcgccgtcatcctcgtcctcgcactcctcggcaccggtgcaaccgccgcgatccgcctcacccgcgccaacggccgccacaccgggcacgagaacgacgcgaatgatgatggcgctggccgtgatggcagtcccgatggagatggccccgagccggacttcgcccaactcgtcaccactatcaatcccaaggagccgcccatgaactaataacaactacccatctgctgcttagagccaactttcgtattccagttggcagttagacggtgataccatgcaactgtcccggcaaaacggggcagtgcatactaggcccgcaggcgtagtcctgcgggcctatttcgtctgttccccatcggctttagccaacgttccccatgacagcggactatgattcgctgctttaagcactggcaagtgaaactcgatgccaggtttctctccccacggcactctagctaaatcggttatgttgcctggccattcaggcaccttattactagaactgagatcaaacaaagtgaaagcgaatggcggtatcctgatacatgccattttgcagcacgtgtaatccgcaaatatgggaaccatccatccggtgaacagcttttgttcacgcaggttatcgactataaacatatggagtctgtatcgctgggaaaacagtgctctctctatccaagagatagtccttacagtcatgcatatcaccagctgatacacagaagttcgacatcacctgcttcacaaatgcaagaggcatgagcctatctgtcttgaaatgaatggatttatccccttcctgaaagtcagagacaaggatttgctgtccagttgcacgatagaactcactgaatggcttgacgtagttttgaccaagataactattgcatgagctgcaaatcgtcttgaatccttgacctctttgcaattgccgatacttcaggccttccatgtcatcctgcccggtcaagctgctcttcacggcgtcaacgcctgaatagagcttcaccgtgtgatcattacccacagattgaggagggatgtgttcaaagctcagcggcccttctttaccgcaaattcggcaaatgtcatctgccatttcacgtcatctccaaacgttattgccacaggccgaggaatgctgcggcaatgaaatcgagaagcgcagcaccgaccagaatcaatgcatataggttgaaataactgcgcatcaatttaagttttgcaacatgaagtttctcgtttgttgattcaaagtattccatcgatcccgacacgactttttctatcgcaggaaagaccgcgccaatgatggcgagcgacgaagtcacgagtgtagcctttgcgccgtcttgcagaatggtgaatgagagaatccccacaccaatagctaatccgatggcgatgattgcgtaccatgctgctgctttccgaagggagactcgatcggcttcgtctagttcttcccagtttgaagcagcgccgagagattgcttaatccaaagatcattctgctgctggtcgttattttgcattcttttccctttcccgggcatcttttggcgaatactatagcgtcttgatttacctatttctgtaagtatgctgaacgaatgctgtgtgaatttgtccgccgctgattccacgggactgcacgaggatggccgtatgcgtgggcatggcggtgggccgtgccgttcctgtgcggaggagtgcggctgtggatttgatgaaccaggtgctggagttgttcgtgaagttcgcgacgatcggcggcggcctgtggctggtgtggggcgcggtgacattcggtggcggtttgaaggatcataacgggccgcagacgcagtcgggtctgtggcagatcgtgggcggcggcatgatcatcgcggcggcgcagatcttcagcgccgtggcgatgggctgagccggtttgaggcatcggggatcccggcatggaggatttcatcgttgcgatgctcaacatgatcggggcggcggtgccggttcgatagccactggcatgctgtcgcaggggccagagacgtggaatccggcgctttaccagttggccgtgaacgtgcatgacgtggcggtcaagccgttgacctcggtggttctggcggtggtgttcaccttggagttggcgcgtaattccacgcgcatcgagtccgaccgcgagttgggcgtgaagattgtggcgggcacgttgttcaaggtcgcgctggtatttctggcggttcagaatgcgggattgttcctgcgtgcgttcgattcggccacccaattcctcatgcagggtgcttcctcgcaattgtcgttcgatacggccggcgatggcggtcagctgggcgatctgatgcgggaacaggtcaaggacgccggcatgatggggcaggcggcgctgttctttctgttggcgattccgtggctggtctcgcagctcgcggcggtggtgttcaccgtggtgctgtacatcaggttcatcgaattgtataccctgaccgcgttccagtcgttgccgttcgccttgctggtgcatgaggacaccaggccggtgggtgtgggctatttcaaggcctatgcgcgcacgtcgctcaacgcggtgtgcgtgttcgtgtgcctggtgttctatcagcgcatcgtgatcgacgcggtgcgtctgcccgagggcgatgggtcggggatggtgtcgtgggtgacgggcaatttcggcaacctgctgatggcgggcatcctgttgttcttcgtgatcgcggtctcccaacgtgtcagccgcgcgatcgcgggcggcgagtgagcgcgatagggattcaaggaggagcttgatggcgttgcagatgcgcgtgtatgcggagatcgccagcgtggaggcgaaggtcatgtggggcatgggatggcggcagttggccgcctcggcgctcatgctcgttctgggaggcggcgaggtcgccatgttcttcctgatgctggaccagcccgacctgggctcgtacttgttgttcgtggtgtgtctgccgccggcgttgtggggctggtggcgtcccaagggcctgaagccggaacgctatctgggctgcatgctccgcctgtttttagtcaagtcggtgtttcgtgtttcgtcactaatttttttcggttttcggcatgaggagtgccggccggtggtttgttttactggttgtccgtcttgccgaacatgagggcttggctgacgcgtcggctggggctggtgaattcgatgaggcgtccgtggtggacgatgcggtcgatgatcgcggcggcgagtttgtcgtcggcgaagatcgtcccccatttgctgaactcgatgttcgtggtgaagatgatgctgcgacgttcgtagctgccggcgatgatctggtagaggagacgggccccgtcgaggcgcacgggcgcgtagccgaactcgtcgaggatgatcaggtcggcacgggcgaggtccctgagcaggctgtcgagggcgccgtcgcgtttggccttgccgagctggagcacgagctccgcggtctgccggaacctcacgctcctgccttgctcgatggcgagcatgcccagggcggtggccaggtgggtctttccgcgtcccgtcttgccgtagaacacgaggtcctgcgccttggccgcgaaatcgaggccggtcagctgctccttggtatatccgtcgggcaggcgcacgttcgcgaagtcgtagccgtcgaggcttttgggcaccgggaaccgggcctggcgcatgagccttgcccgtttggaggcctccctgttggccagttccgtggcgagcatgcggtcgatggcgtccagttggcggggcgtggcccattcgagcgtttcgtcgatggtggccttggagatgaacaggctcctcgcccgctcgcgcagcgggccggggtcggtccgtccgttcttctggttcactcgtcctccttggtgtaggcgatgtcgtattcgctcaggtccacggggtcgtcgtaggccacgggtcccaggcccgaggcgtggcgtgccgcggccagacataccccggcccggtccgtgcctccggtggattcgaggatcaccgggcatgccggccacggccgcccgccagccgctctcgccgtcggcgtgcagcagggcacgcaggctgtcgcgccgcgtggcctcgtcctgcgcgtcgatccattcgcgaagcgggtcgggcatcgcgtcgcgcacccggctgttgcgccaggccgccggccggtcgcacaacagcccgagctggctcgacgggtcgccgctgtcggtcggcttgtccccgtaggacctcggatgcgtgaccacgcgtttgccttcggcatcgaggatctccacctccagggccctcaggccgacgatcatctcatggccggcgtgttcgggcccggccgcgtaccggtggcggccctggacggtgatgttgccgtatttgtcggccttcatcctcgtccacgtgaccacgtcgaacggcttggcgggcaggggcagcagcgcctttcggtcctcgtcgaacaggccggtctggctctcgcccttcctgtagtggtccttgtcccccagttcgaggcagcggccgggcaggcgcaggttgaagctgtcgaggttccatacgccgggcaccggcacgaacagcctgcggcgcacggccccgacccgggcctcgacgccgcccttctcgtgtcccgagtacgggttgcagaacgtgtactcgaacccgtagtgcgcctggaacgcctggaacaggcgggtcaggcggatcctgtcgaaccatttgcgtccgacgccggcggcgttgtcatacacgatgcgttcgggcaccccgcccagccattcgaataggttcctgagggcctggcacgtgcactccgcgttctccccgggcatcagctggctcggcccgatgttcgagtacgggaaatccaacacgaaatgccgcattcgcgtcacgacgccccggtagcgcacgtcgacctggccgaagtccgcctggcattcgcccggatgccacgacaggtccaggaaaccggcctcccgctccgccgcggcctcgcgcctgagccgcgccacggtccgggtcaccgtcgacaacgacaccccggccccgtactcgtcgcgcaaccgctcatggatgcgggtcgcggtatgccgctgcttgcgccaggtctcccggtcctcggcgagcatgccctcgatcatgggcagccactcgtcgatcaccgaaccacgacgtcgcctcacgggcggcctggccgataggtcgtcgaccctcagatacttgcgcacggtcggctcgctgaccctctcgctgcgcgctatcgaggcgatggactcaccgttcctgcgacgcgaacggatagactgtatttggggcatgctgatcattgcctttccggacctttcccgaatggaactagaagcaccatcaggctaaggcccacgggtggtcggcatgcctttccgcctaaacccgaaaaaccttcgtgactaaaacctcaacttcctattgaacaaaaacaccggtgtcggctccacgcgcggcggccgcaccttcctgcacgggtccaccggtatcagctcctccagttcggcgtcgtccagcaccatcttcaggctgacgaaatggtccttcagcgtggagggggcgagccgctcccccagcacgcgcatgcaactgcggacatgctccggagtcaggtccgcgaggcgcacgtggccgatgacctggcagcaggcatgcaggcggccggcccgcgtccgataggtggtgggcttgacgcgaagccggtagtcctccagccagcgttccacgtagtcgttgaggtacggggatttggcgccgggcatgaggccggtgcgttcgagctcggcgatcttggcgtcgaaacgttccctggcttcggccttggtgcgccccttggcctggatcatgcggcgtttgccggtggcggggtccttgccgaggtccttgcggaagtgccagacgccgttcgcgtccctgaacacgcttccggctccaggcgtgcgtcgtttggctgccatgtcggctcccttctgtcgggagcgccctttcgagtgtgtctccggatgcggtcccgcaagggtactctaaaggtactcaaacggtgtcacaaacggcccgatacgtggcagaaacggccattttccgcgcgttcaaaaaacacgaaaaacggcgtttccagcgttccggataacctgaaaccgttggaatcacgccgttttcgccatactcaacaagctcagtggcttatattgaacttgaactcggcgtcttaccggtcttcttcgtcccgccttgccgcggatattcaatcgcatcgcaggggtgacttcctcgatcatttgacagaccgaccgacggtctgtatgcttgacgaggacatgaacgaaaggcaggccatccgcatggcgcacgatatacattccggagacaccgaacgacgaatcctcgattccgcccgcaggctcttcgctgaaaagggctacgagaagacgtccatccaggacatcctgaacgacctgggactgtccaagggcgggctctaccaccacttcaaatcgaaggaggcgattctcgaccagctgaacgccgacgagtgggccgtaaccgcgcgtcttctcgacaaactcatcgagcgcaaggacatgagtgcgcttgagaagctgcgcgcgctcatcgtttccgctgtggacgcccccgatcatctggacctggtccgttcccagctggcgctgctcaaggatcctgcgttctttacggcgaacatgcgcttctggtcgacgagactgccggagtccttccgctcgctcatcgatatgggcgtgcaggacggctccattcccacggcataccccgaggaggcggcgcaactgctctcgctcctcggcaactactggctcatgccctgcttctaccccgccgatcatgccggcatggaacaccgcatccgctgcctcgccacgatgctcgacgccatcggcgtgccagtgttcgacgagacgctcatcctgcggacgaccgaagagctcacggccctgacgccggaagaggatacagcgtccgcataggagacgcgcccgggtgcgccgcatcttgcgcatcctgatgccacagatgtcgaagcgcttccgcgcccttttccttgggcgtattgttatcacaataacagaccgacggtcggtttgtataaatggccgtggccaatcacaagaaaggaatccacgatgacgaacgcatacgaatgcacgccccaaccacaaagaagccaagccgctgatcctcttcgcacacgcgacttccgcctgctcgtcgcgggtctcggcatatcgctcttcgccaaccttatgctgcggtttgccatgtccatgtgggtgcttgacgagaccggctcggcggcggcgttcgcctccattcttactgcaagtatcctgcccacgattctgctctcgccccttggcggcgtgatggcggatcgtacgaaccgtcggaccgtcatggtggcgcttgacgcgctttccgccgtgacggtgctcgtctgcgcggcgatcttttcggccgccggtttcaatctggcggcgatagccgtgatgcaggtggtgctcgccgtgcttgacgcgatggagacgcctacggtgcaggcggcgctgccgcagatgttccgctcccatggcgaggatgtgatgcgtcgcgcgatggccgtggtgaacgtagtgaaccagacgagcacgctcgttcccgccgtgctcggcggcgtgctgtacgcggcggttggtgcgatgcccatgatgggaatcacgatcgtggggttcggtgcggccgccgtcgtggagtgtttcatccagctcggcgctcccgaccgcggcgacgccggccgcgtcaccgcggttgacgacctgcgcgcggccggacgtttcctcacccgcgaacgtcctcatgtgctgcatctggtgttgatctgcgccgcgctcaacttcctggtgacggggtatgcggaggtcggcttcccctacatggcgcgtaccgtactggggttcggctccacggcgtacggcattgcatatggtctcgtgggagcatccggactgctcggcgcgctcgtcggtgggcggatcgcgaggtcgctgtccatgcggcgattcccgatggcgatcgccgccttctcgctcaccatcctgccccaagcgctcgccatgacgattcccgcaggtggagtgatgcgactcgcggtgctcacggcgagcacctgcggaaccatgatcgccatcaccctcgcgaacctcatcgccgtgccggcgatccagatgggctgccccgagaacatgaccggcaaggtgatgtcgctcgcgctctccgcgagcatgtgcgcccagcccctcggacagatcgcatacggctgggcgtacagcgtctacccggcgggcgcggtcctggcggtgacgttcgccctggccaccgcgatgctgccgccagtcgcgcacgtaacgcggcggttctaggacgggattccatcaccttcgctctggacagctgagacatcaaaaccatgtgtggatacgtgaacggccgccatcaatcatggtgatgttggccgttcacgtcatccccgtaccgtagatatgaaaacgaccactgtaatcgcacgtacgacgatggtggtcattggatcaatcgccccggcgtcaggcctccacgagcgggcggatgtcgtccaaggtgctggggtcgaaggtcagcagatcgtggtcggcctgaaggttcgcccagaactcgggcgtggtgtcgagcgcctggccgagccgccatgccgagccgccatgccgagccgccatgccatggtgtggtgatgcgccgcctgccgttgacgatctcgccgatcggcgacatcggcgtgctttgccgtacccgtcgaggcgggtgcggacctgccagacgtcccagatatggtatgcgccgatgagcgaagcaatcggactttgattcggaaacggccttcataccgcacttgtccatcacacaaccggactggaacatgaacaggcacgcagtcacggttgcataataggattcaagtcaatagcagccttccacgcctcctcacagtgcgcaacccggaaggtcctttctattggcgaactcgaccggtttggtctatcgcaacagtcgttcgttgaggatgacaggagcgtgttcgattgacggctgcaacgcatcgagctggtcggacagcttcgactcgtcgaccaccggcagttcgagcagggatcgtgcggccgcgtgcaggtagtcgttcaacgcctcgatgcggcccggctccagcgggtaagccgggtcgttctccaaggtgacgtccaacgttttgcgcaacatctcatgctgcgcgctgcccatgatggccgcgcactggtcgcggaacgtcatacgagaatttgccggctgacgttcggacagtacctgcggaatccacgcgccgccctcccagtcggcgcgcatgtcgttcttgaacagcgacatgttatggtcgaacaacggcgccggacccagaatccggccggtacggttgtcgcgcaggaacccgtggttgttggcgtgacggtcctgattgacgatgagcgcgtcgaacactagcatcgtgcgcatcgcctcgaacgattcctcggacacggcgcgtgcggcggcgaggctctccggaaacgacgccagctgcgtcgccgcatagaacggcacgaacgacacgtcctttgagttcatcgaaccgcacaccgacgcgagcttgcccttccaacgggcgatgcggtagtcgaccgcattcacaccgagcctgcgcgccagctgcgaggcgagatactcggaatacggttccaaaccggcgttcgcataccattcggaacccgccttccacagttccagcccacgttccgtatgccgccacgccttcgggaactggccgtccgtcgtccactcgctcgacaggccgatcgcatgcttctcgctcgacgtataccccgtgtaggccacgatggcgagcgtctcgtccaacggattgtcatacaggttgatgtccgcgaacttgaggttctcaccgtcgcgttccgcccagaacgaatcgttgaccgacagccccttgcacaggtcgatgatccccagcgtatccgcaatgctcaaccccgcctgcgcaagaacctgcgtggcgaactcacgattcttcggaatcgtgcgccgctccagccacgtcgtcagcttcgcattatccggctccggagccaacggaaacggcagcaacgcgcgcttcgactcatcgaaccagcggacatgcgcctcgatcttgcccgccagcaggccctcgccatacgacgcatcgaaccggagcagcggatcatcatagagccgcagcacgtaactcgtcatatccggcccctccaatcacaagcccgctccaaagtcatatcgggcgattcacatatgaagaacaactgtctacagtatagacaagggccttggaacgcgggggcttcactctgaagtcaagtatttgatacaatttggtgcaaaaagatagtaaatagcaataaggagtggctatgagcatgcagattgccacgcgagttgatgacgagcaggctgcgttgtttaaggagacgaccaggcagctgggtaccaccccggccgatgccctgcgtatgttcatcagcgcgttcaatgattaccgtgggttcccctatgaggtgcgtttgccacgaaatgacgtggagccgtttgcgtccgagcgggacgctactgagtatgccagtcgtctcgccttgaggatgtccgatgaaacgaggtgagattcggacgttgcaggccgatggctacgccagcaagccacggccggttgtcatcgtgcagagcgatgccgtcgatcggttcgattccgtcatcacttgtctgctgacctcatacgattcctccgacatcgacacgcgggtccgattggaaccaagtccggagaacggcctgaacaaagtgagttacgtgatgacggacaagatcgtcaccgtcgaccgcaaactgctgggataccaagtcggcgtggttgatgatgcagccatggcgaatatcggccgtcagctcatgcgggttctaggtttgctgtgacgtttgggatggctggcgggcgtgcgtctacttgtgacatcgtttatgcacccttgaggccgtatgatgatggcgtcgaattcaagctctccccaacgtctaagaaatggcttccttcatattacggtcatacgaccaacaccatatgaaggaagccattatgaatggtctaacggcaatcagcttctcatacgtgattgccagtcattcaccgaatcagccgcggttgtcgaacatctgcagcagcatcttgctgggttcgacggcatagacggtgtgcggcagacgggcgctcaggtagacgatgccgccggccgtaagctcgacttcacggccttcgccgccgacgcgcagcttgccttccagcacctggatgatcacgggcatggccgcggtgtgctcgctcagtgcctggtccttgtcgaagccgaacagcacggcgcgcaggccgtcctcgcgcagcaccgtacgggagacagtggcctcctcctgaatatcgatcaacgaggccaagtcttcgatgaatccaagatgcggctcggtcgaaatggcgtggccttcggcgtcgtgggcgtcgtgcttgcaggcgcagtgcttggcctcacccgcttcagcggccgcggcttcgccatgcttgcagtggcactccttcttcgcgcccggctccgcggccgcgccctcggcgtgctcgtgcttgcaggcgcagtggtgttcgccgttggcggcagccgcttcggctgccgcggcggcttccctacgctgcttgcacttgcaatgctgctcgtcgcgtcctgccttgcatgcggtctgctgctcgttctcatcggccatgatgttctcctattcgtcgcgcgtacctcacatacgcgtcatcgcttttggtcgtttcccattatccggccatcgtgggccggcacaccgctgttacgcttcgggcttgcgtaccacgaacgcgataccggtaagttcgttgctgtacttgtcgaaggtgtgcttcatgttgagcacgcgggcgcggatgtccttgttgcccagaacgttgcgcaggatgcgcagcacaccgccgataccttcatcggcgatattgcgcttcatgtccagcaaggccatcggctccttgcctctccacagcacctcgaagccttcggcttccaacagctcgcgccattcctgctcggtgagcgggcgcgcgttcaccttgatgctgcgagccagggccttgcgcacctcatccttgacggattcgtccaggttgtccggctgcaggccgagttcgtgaatcgagtaggtgccgccggcgcgcagtagtcggaaggcctcgccgataatcgcctgcttgccacgctcggtctgcatggtaagcatggcttcgccgatcaccacgtcggcgctgttggattccagaccggtgtcggcggcgtcgcgctgcacgcagcttgccggaatcgtggccttctcactggtgagtttggagatgatgtccacgacctgcggatcgcggtccacgccacggtagctcttggggtcgcgctcgagaatcgccctagtggtcaggcccagtcccggggcgaattcgacgacatccttgccggcgatgtccgcgttggcgagcatgcgttcggtgagtttcttgccgccggggcgcagcacgtgcttaccgatgcgggccagaagccaatggccctgcaggtgcgcggggtctcggtcggactgcggcaggggcagctcgcggttggtggcgggtttggtggcagtggactgaaatgcctgagaaggctgcggtgtagtggtcatgtgtcgtgatgctatagtccacagcccgcccgcacaagggtttttcgctagaaatcagccgaatgtgagaatgctcacccgagtaggcgcctgagcatgcggctcagggacgattcaggggatgctcaggggtcccgtcaccgattccccacatatcgcccgcgttcgcctaatagaatggaatccagcattcgattcggtatccggcgcaatgccggcaaacgtgaggaacttacgatgagggtcatcggcaatattctgtggatcattctgggcggactggcaatcgccatcagctggacactgatcggactgtttctgtgcatcaccattatcggtattccactaggagttcaggcgttcaaaatggcgggccttaccttgacaccgttcggcaaaaccgtgcaatacggtggcggcgttggctccacgctggccaatatcctctgggtggtgctggtcggctggtggatggcactcggctatctgggtgcaggcgtgctcaactgcatcaccatcatcggcattccgttcggcatccagtcgttcaaaatggccaagcttgcgctctggccgttcggcgcacagatctacagtctgtaacaattgtttctgcagtaagtccggtgcaacgcattatcatcgtgcgttgcaccggacttttttatatacaacgggcatttcacacaccgcgtgatttgacggatttggatgcaatgccttatagtgcgcgaaccatgattcaacacatcgcattaagcagcaacggcgtgaacgaacacgccatctgatcagtacacctctcattgacgcatagctgaatcattgccggtgatatcgagcgactcattcgcaccatgcctcataaacgcacctgtacgagcatgtgttcttggcatcgtcgcaactcaatgcaccgcataccatcacatattcagaaagaacaacaggtcatgaagtatttcactactgacacgcatttcgggcactaccatatgtcactcacatgcagtcatgcgcacaactatatttttgtattatccatgattttatagttgtttattgactcatttccttctctatcttatactttttataattaaggatgctctttgggaagtgagtctctctcatggatatgaagtatagaagtttggcaaggctgttccatgccgacaggtcagtcgattccttcaataaccatgcggcactcgcacggcagcggcttgaggcagattccacattcaggaccggggtcatcacgccattgggcgagctgttctccgccacgccacgcgagacgaccctgctcatggaaaatatacttctcgccgaaaggcgcatatcacggctatggaacctgattcccggcgtcatgcgctgggactacatacggcattccatcagtgaggaactgttcgccaccaacgagatggaaggcgtgcgcagcacccgcaaggaaacccaggacgccgtggacgcggccgacaaggcaaggagggacggcgacgactccaaggcgcggttcagcgaatttgccaagctgtacctgaacctcacggacaaggactccgcgttgccggcgggcatcgccgacatccgcgacatctatgaccaggtcgtgctcgacgaaatcgatgagagcgatcagccggacggcgacctgttccggaaaggcgatgtggaaatacaggggccgcacggcctcgcgatccataacggagtcaaaggcgaaggcaacatcggcgcactcctcaccgatatgatccatctcgcgacctccgacgagattccccggctgcagtcggccatcatgtcgcacttcctgttcgaatacgtccacccgttctacgacggcaacggcagaaccggccggtatctcctggccctgtacctgaaccatgacctgactatgcccaccgtgctatccctgtcccgcaccatcgcggagaacaagaacgcctactacaaagcattcatggaggcggaggacaagctgaactgcggcgaactcacgctcttcgtgaacaccatcctcggattcatccaacaagcccaggatgagctgattgacgaactcagtatcaaggtcgatcagctcgacaaaggtcggatactctgtacacagcttgaaaagaggcatgccctatcgcgcaatgccgtctcggtgctctatggcgtgattcaggaagagctgttcgactcgtccaaatccatgtcgttggacgaagtggcccatcacatcggactatccaaacagagcgcaaggaaatacgtggaagagctcttggccgcggggctggtcgtacagaccggaaaacgtccgctgaaaatacaggtggcgaaatcattgaggaatgttctcgccacaggagccgacgagaacgcggaagcctaaatgaagaaaggtggacgcaaacatctcaacgaggcccatactacgtggaaaagtccgggcagccaacactgctcggacctctctttcatcgctttcctcagtcgccttcagcgataacttccctcgccgaggggaagccacggaaaaaactttctttctgaacatcatcactacgacgacggcatacatcatccattgcattgggaataagccgtcaccgaatacagaatctaatgagctcggatcactcattcacgagcaccagaattcgtttcatgaattaccacgtttgtgtctttgaaaggcatgcggccgaatccaattcgaatcgcaactcgtgaatatacaggcggcggcaccgatgcctctcacatcaccgggaaacgatgacgacaccgggaaaaccatcagcccacactgcggaaaaacactgccgaacccgcccaacaaatattgaagcagtacacaccacgtgcaggccaacatcctcgaactgaccggcaggcggccccgcctggaggccggcagacggctgcgcgcgattgccgccgccctggcacgcgtcaaggaccgggactccgccacggcgtggctcgtctcctacagccggtgggagcaggactttgcctcgttcctcgacgagaagagcgaatacgccgacggcagcgtgaacggcatgcaccaaaggctcgtcaaggcgcggcgcatgatcccaggcgcatccgggagggccagccgttcgcgttcctcgacgaggggctcgcggccaacgcgatgaccgacgaacgactcgagcgccggacacacattttggcctataacccttaattttctaatcaggagcagggagaacaggaattcgcctatgaaatactggatgcacgcagacagtccgctgtcagtgtctttgcattttgaagcatctcctccggtgtccctgtaaataccacttctcccccgttcttccctccatcggggccgatgtcaataatccagtccgcctgcttcatcacgtccaggttatgctcaatcactaccagcgtatttccgctggatacaatcccatcaaacagattcaacaaattatctacatcggacctgtgaaggcctgtggtcggctcatccatgacaatgatgctactgctcttccccaggttctttgccagcttaatccgctgccgctctcccccggacagggtgctaaggggctgccccagcggcagataggataatcccacctgctgcattacgctcaggcgtttcctgatcctggtatcctcaaataattccagtgcctgggaagcggtaagccccagcaattggacaatattcctccccttgtaggtacaggcaagggcctccctgttataccgcacaccgccgcatgcctcgcattctgtaacaatcgggtccataaaggcaagttccgtaacgagaacacctttgccgccgcagattgggcaggctccggcggaattaaaactgaacaggctttccggctgattgttctcccgtgccagaagttttcgtatctcatcaaagaagcccaggtaggaagctggtgtagagcggctggtagctgtaatcggcccctggtccaccatcaccacttcattctcatatgctctcgcaaatacctgggaaatgagggtactctttcccgaaccagccacaccagtcaccaccgtcatgactcccagagggatgtccacatccacatgctttaggttatgaaggcaggcatcccttaccggcaggctgcccgtggctttacgtggcgtatgttttatggggaacaacttttgcatggattttcccgtcagggtatctgccctaagtagttccggatagcttccctcaaacacgacttcaccgccgttttgtcctgccgcaggccccacgtcaatgacatggtctgcaatggagattacgtctttatcgtgttccaccacaaggactgtatttcctttatcccgaagcttcttgagaagatgattcatacggtagacatcccgtggatgcatcccggcactgggttcgtcaaagatgtaggtcatcccggtcaggctgcttcccatataccggaccagcttcagcctctgggcctccccgccggacaaggagggtgtttcccggttcagatgcagataagggagtccaatctcgatcatccggtccaatccctccaggatggtatgaaccagcagacccactgtctggtccgtgatctgtgtcaggacttcccgcaggagagtcagctccatctcgcacatgtctgcaatagaatacccgtttattctacagttcaaagccgcctcattcagccttcttccatgacagtcgctacattctatttccgtaatcagcttttttgacttctctttggtgtgtctgcttttgctgctgatatcccggtttaagagggccttcgtatacttatggtacagtccagttactttcgggttctccggctctcccctaccatcacgggcaccatagacaagaaggttgtattcctcttttgtgtaatcccggatgggtttatcaaggtcgaacagccctgactcagcatactgcttccaataccaggatcctggacggtacagggaatccttcacacagccctggttccaggatttattccggtccaggactgcttccatatccacttttgtaactttcccgagaccggaacaggtcttgcacatcccgttggggtcattaaaagagaaataagacgcagttcccacaaagggctgcccaatcctggaaaacaacagccgcaggctggcatacagtccgctgatggtccctactgtggagcgtgcatttccccctaaggaggactggtccaccacaacggacggtgtcagattgtcaatgcgctccactgccggtctggggtatttgggaagcctggaccgcacaaatgccgggtaggttaagttcatctgccgctgggattccgctgcaatcgtgtcaaagacaatactggatttcccggacccggacaccccggtaaatactgtgattttttccttcgggattctgaatgtgacgtgtttcaagttattctgggtaagcccatgcaccataatgtctgccatatgatcacactccttttctctttttcctgctgtcatatccaaccaaacctgctgcaatcagagccgtaaggatgtctgcggtgggacctgcgtacagaatcccgtccattccccagatacccgagaaaatatggatgagcggtaccatcagcagaagtggccggaggatggaaagcagcatcgctttcactgcctgtccggctgccagataatactgggctgacaccacctgaaatccagtaaacgccagtccggacggaaaaatgcgcatacacttgataccaaatgccatagatgctggctcattcatcccaaaaatctgcagaatctccgccgggaataactcacagataagccagccaatcacagaaaccaccgtagctgcgccaaccgcctttttataggtttctttgacccggtgttcgaaaccagcgcctttgttaaatccgatgatgggctgcatcccaagtgcaatccccacacagatagaaaccactacagaactgatccgaagcacaatcccaagactgctaagtgccgcttcgctgccaacgcctgccatttcacagctcaccaccgctttgttcagttcaatctgcagaattgctgccgccacctgaatcatgcaggatggaagcccaaacgcaaatatctgaccgcagatgggtaatgtagggcagatatttttttttcttagccggatatgccctttctttaaaaagtaaaccaacagtatgaccgcggacatgatctgcgaggttacggtagcgattgctgcacctttcactccccagttaaaaacaaatatatagattggatccaaaaccaggttgattaccgctccgaccaggaagcatcccatagccaggatggggctgccacacgctctggccatactggacagggcaatagctgccatactaaagggtgccccaagtaaaatgatgggggcataatccagcacataggacagtgagccctgcgccccctttgtagcccaaaagctagtgccagcggtttcaggaaagtaaggcatataacggtgaacagaatacctatggcaacagacagagtgaataccgttccaagggttttttcggcttctgcttcttttcctgcccctaagttcatggacgtatagacactgccgccaatccccagcagggtggcgatggataaaagaatcgtgacgaaaggaaaagtaaccgtggttgcagcaatgccaagatatcccaccccacgcccaatgaatatctggtctacgatgttgtaaagtgcatccaccagcatggataagacagatgggattgcaaattttatgagcagcctgccgagaggttcggctgcaagagggtttcccctcactgttttaatagtcttgtccatctctttttctcctttggtttttcatcatttacgctggattagcgtatcaaaggagcgcaaatcattcatgatactttttgcggttttttcatccgaaggcctgacggcaaaccatgcctcctgaatcggcgtctccatgcccccgccttctatagggtatacctcgatatccggcagctctgcataaaaaaggcctgatgatggcagaacttctaaatgcagataccggaacatattatcggaagtcacatggcagcatggatctgctgttaccatgcaccaggtggcttcagatatccgaaactcttccattcctgggggcattgcttggtttaaatagaactgatataatgtggataggaaaactgtgaacatctgggaggcaatatgaagaatttatcggaattacctaacataggaaacgctgtagctaatcaattaaaacaagttggtattttagatgaagacgatttgaaatccataggagcagaacaagcatggttgaaaatacagcaaattgataaaacagcgtgtatcaataaactctacgcattagagggtgcaatcttaggcataaaaaaaaactttgttgccaaacgaaagaaaagaagcattaagagaattttataacagatataaaaagtaatagtaaaaacggatggaggtgcctgtttgaaacgatatcccctttagaaagggccattacctatatcgaagcacatctaaatgaatatatcggtctgaatgaagtatcaagagaaaccggctactcctactactacatgacccgcctgttttcttctgttttaggtgaatccgtgggacactatatcaaccgtcggaggctttacaatgcgtccgaaaaactgattcattccgaccagaaggtcattgatattgcacttgactgtggttatgaatcgtcagaggcgttcagcagggcctttaaagctgtttttggatacagtcctgtagcttaccggaaagccggacttgatttggtgataaaagcaaaaaaagaactggcgccggaagatgtgtgccatattgccaatcatatttcacacgctcccaagatcatcctgctaggtgagacagaagtagctgggcttcgggggactacttccctgtccgacaatcagctgcccggactgtgggaacagttccatggtcttaacaaagattttttcaccacatctgcgggatatggcatctgtgaaacgcagaagacggcttatacaaaagacggcgacgcgttatattccgtcatgatcggcggtccggtgaaggattttgattgcctgccgctggaactggcaaaaaagacgctgcgtgcaggaagatacgctgttttcacccaccggggcacacttggaaacttatataaaacatatcagtatatcttcggaacatggttgcagaccactagggaagaactggatgacagggaagattttgaagtttatgagcatgaaattctatcctttgatgatccagataatgaagttaaaatttttattcctatcaaatgacaggacaccattttgcgcacgggcgctgacggtgttttacatatcaccgggtatttagggtgtgtttacactatctaggttttgtgtgataattatcgtatgtgtacgccagatatcacacaaaacctagataatgtaaacacaccctagaattcccagattttcagcactaccaaacggtcacttcttagacgttggggagaacttgaactccacaatatctccgtcggccatgacgtagtcgcggccttcctgacggagcttgccttcctccttgatcttggccatggagccgtcggcggccacgaaatcgtcgtaggagacgatgtcagccttgatgaagcccttttcgaagtcggtgtgaatcacgccggcggcctgcggggcggtccagcccttgtggatctgccaagcgcgcacttccttgacgcctgcggtcaggaaggtctgcaagccgaggatgtcgaagccgacgcgggccaactggtcaagaccggactcactcaagccagcgtcggccagcatttcgcgggcgtccgcctcgtcgagctcggtcaggtctgcctcgaactgagcgttgaggaacacggccggagccggggccacggatgcggcgagctttgcctgcaggttcttgttggccagctcgttgtcgtccacgttgaacacgtagatgaacggcttggcggtcatcagatgcaggtcgtagacggaatccttgtcgaagcggccttcgcgtgcggccttgtcgagcgtctcgccggcttcaaggatggtctttgcctgcttgacagcgtccatgtaggccggctcgatcttcttgccgcgcagatccttctccagcttgggcagcgcgttttcgatggtctgcaggtcggcgaggatcagctcggtgttgatggtgtcgatgtcgtcggccggatccaccttgccgttgacgtggacgatgtcgtcgtcctcgaaggcgcgcacgacctcgcaaatcgcgtccgcctcgcggatgttggccaggaacttgttgcccaggccttcgccctcggaggcgcccttgacgatgccggcgatgtctacgaaggtcaccgtggcgggcacgaccttttcggtgtggaccagcttggccagtaccggcaggcgcttgtccggcaacggtacgatgccagtgttcggttcgatggtggcgaacgggtagttttcagccagcacgttgttgcgggtcagtgcgttgaacatggtggacttgccgacgttgggcagtccgacgattccgatagtaagagacatgattccaagtctagggagaagctggacaccttgaacctgcatgtggtgaaccggccatatgcaaaggcctccgagcatacggttcgaaggctttgactgtgatatgcgaatatacgcgaactctgattggcagtcagccgacgatggcgtctacggcgtcgatgaccgagccgcggaacccgtccttttcaagctgggcgacgcccttgatggtggtaccaccgggcgagcagacggcgtccttcatggcaccgggatgggtttcagtggccatgtagagcgcgccgacaccttcgaccatcttggcggcgagccggtaggcggtggctcgctgcagaccgtactgcacgccggcgtcgcccaaggcctcgatgtacatgtcagtgaaggcgggcgcacagccagccaccaccatggcgatgttcatatgcgcggtgtccacgcgctcgatgaggctgatggggccgaatagctgctcgaaggtttcggtttcgtcgtcggtcagggtgttgacggattcggtgacgagcacgcccttgcccacggccatcggagtgttcggaatggtgcactggatatggatgtccggggagtcgacggattcgccgtcttcggtggcgaacaggtcctggtacttcttgagattccagccggcggcgatggagacgacgatcttgcccggcctggcaagttcgtcggccagcggcttgacgacggcggcgatctggtagggcttgatggcgatgatgaccacgtcggcggccgtcaccacttccagcgcattgcgcaacgggcgcacgccaagttcggcggtggtcttctcaagcttgtcgtagtgggcggcacaggcgaccatctggccgccggtgaccacgcccgcgtcgacgacgccttgggcgatggcctgggccatgttgccatatccgataaaaccgatggtgaggttctgagtcatacgttttcctttcgtgcatgtatacagagctccctcatcagagggagcttgcttccttgagtcagaacaatgcttcaagatcgccccggttgagggcttcgtcatagagatgcttgaagacgagcgggccgtgcagaccatcatgctcgaattcgttggtggtccagtagtggctgttacccacgcggctcaaggtgtcgagctgcaggccggaatcgacgtacatatcgtcgaaatagacggcggcctgcaacggcacctcattgcgggccagctgttcttcgtcatagatcacgccgaagtgcgtgtcttccatgagcaggtccatggccggcctgaacgggcgtaacgcagactcctgttcgaacatccacgggaacatggcctcgccggtgaagttgagcggacgcgcaacggcatcgaattcgggcttgccatcgcgcacgcgctgggcggcccagcgaatgggctcgtcaagctcgccgttggcgtagatgaattcctgcaacggccaatacagcgggcgcgacgacgtggcggccatcaccttggacaggaattcgtcggacagcggcgatccgtcacgcacggtgccgtcgccgtcgaggaaggcgtcgtcgagaatccagtggacgcgctcgaagctgggtttcatgccgaagtcaccgccaaggcactggaaccgttcgacggtgagtgggtcgccgttcggcagcagcgggaagccgtgggcggccatgccggcgatcacgccaagtcgatgctccacatcggtaccagccatcggattcagtacggaatcggtgagtttgccaacgaattcggcgacttccgcagtagtcggcagcttgtcggcgatggcggccacgcgctccttgtcctgtgggtagcgctcgtagaactgagtcgtcttgcgcaccatgcgcgggaaggtatgctcgtacacttcagcggcgtcggccggcacgtgcgggatgccgccggtggtgaagctggcgattacgccggccgggaacagggacagtgtggtcagggtcaggaagccgccgtagctttggcccatcgtcacccacttgcggccaccgaattcggtcaggcgcagatgttcgaagtcacgcacgatggaatcggcaaggaacttcttcaggtagtcggcctgggctcgggcgcctgccacggcatcatcgtcgtgcgcggcggcgatgcgggccatggcgtgcgtgtccacgcgcgaggagcggccggtgccgcgctggtcgggcaggatcacccggaagtgcctgatggcctcctcgatccatccgtcggaggtcgggctgttgaggcgcgggccggcaccgccgggaccgccttgcaggaagatcagcaggggcaggtcgtcatgcacgtgttcgggcgcggtgaccacgcgatagaacagtttgatggtttccccgtcgaatgcccgtccgggctcgtggccggtccagtcgagcggaacatcgatggaatggtcctctatggccagtccgggcacgtggtatttgctcagcattgtcatggttcaagactctagtccacaaactctagtccacaaatcctcctgaagagtgataccggttcgtctccggacacgctagccttgtgcgttatggagatgatggcgcgcgtgagggcatggtgcgcacgggagtcgacccgcacactgctatgggacacgttgctcgccgcggcgctgatcgccggttgcgtgccgttcaacgcctccaccaaccctgatgccggcatattgtttcccgcaactcaggcgtcgatgacgctgtggtcgctgccggtcttcgtgccgctgatgctgcgcaggtatcgcccggagccggcggcctggctgttcgtggcgctgaccatcacgcatcttgtgttcggcccggcgatcacgtatttcgatttctacgccctgatcatggtgtattcggtgattctgtacggcaatccccgacattcctggcggttcatcgtcacggcgttcgtcatgggactggtcgcggcgacggtctggtcggtgtctttcaacgtgggtccgctgttcgccggaccttcctccggttcgcgcgtcatccgcgacggctggctggccgatgccatcacgatgcccgcatgcccggcggtcaccggcgtcgtgggggcaaacggcgccgtcaactgcggggccaagatgctcgctgacttcggcatggaggcggcgttcatcgaatcgagcgtgctgagcgtcatcatcatggccttgtggcagcgagcgcgcaacgccacgctggcggccatgcgcgagcgcaacgcctccattgtggcgaaagaggccgaggagacgcgcatcgcggcgttggccgaacgcgcacgcatcgcccgtgatatgcatgacgtggtggcacatacgctctccacgattattgtgcagtcggatggcggccggtatgcgggtgcgcatgatctggccatcgccaagcacacgatgggtacgattcggcatgaggccgaacgcgcgcagcatgatatgcagcgtctgttcaatgtgttcggtgcgagtggcagtgccggatatgccgacatcgattcgctgtttgatggtcatctggtggtgtcccggcatatgaccggcaaagcgcaacctgaccggctgtccgccgacgcggaaaccgccgtgttccgtcttgtgcaggaagcgctgaccaatacgcgcaaacatgcgggcgagggcgctaaagccaccatcgatgaaatctggtcaaacgatgtgctgtcgattaccatatccgataacggccgtggcgcggcgtctgcagcagacggtcataagcccggatacggattggttggtatgcatgaacgcattgagtcgttgggtggcagcgtgcaggccggcccagggccgaatggtggctttattgtggcggctacgattccgctctcccctgccgccccacagtctggcaccgatacggaggatccggtgctaaccgttatctcgcgtatacgaggattgatggatcgggcgcgccccaaagtactcgaccaaggagatacgcgtgagtcgaactgggtgggtcgatttgcgcagtggaccgagcggcactatcttctgatggacgttatcgccactatcgtgctgattgcgctatttgattccgccacgtatggcgatttgcaaatgatcggcaatgccccgtattcgccgaaccgcgtgccgactataacgctgacgattattatgctttcacctttggcgttccgccgccgcttcccagagggcagcgcgctggcgatggcggtgctgtctgctgtgcaactgttgttcttgccatcgatcttgaccatcaatatgtatgcgatggtatccgtgtattcggcggtattgtatggacgagagtccgcttggcgctgggtgagcgtggcgctggcagccgattcgtggcttgcgggcatcaaggtgatggctgggtggaatggatacagtcagctgttccatctgtttttgcccgatggtagttccatgctctcaaaatggaggctggttttgtccggcttgctgccgggcgtgggaatcatgttggtcggttttgcctgcattgcgatggctcgatggagccgttcgcgtggcgcaaacgctctggtgctgttgcaacgcgaggaggcgctgcgagccgagcaggagcggcaaaaggtgctggcggccaacttagagcgcaaccgtattagtgcggcgatgcaaaccgaagtactgaccacgctggaatcggtgatcgcgcaggctgatgagggactggtgatgctcaacgccgaacctgcgcctgatagtatgcagattgcagaggcttttgccgcgattggcgctcgggggcgtgccgcattggctcgtatgcgtcagctgttgaaagtgttgcgtgaaaccgggttcagcgacgagacccatgagggtgtgcagccggatatgcagttgcgaccggcggcttcgttggatagtcagatgcaacacgcgggaacgttaccccgatgagagccttgcccaataagaactcagggaacaatcagggtgtttatggagcggcgctccgataggaaacggatacagtggagagcatgaacgagagcagaagcattcgcgtgattattgcggacgaccaggagctggtgcgtgccggttttgccatggtcattggttcgcagccggatatggaggtggtcgggcaggcgtccgacggcgcccaagccgtggcgttggcggaatccttgcatcccgacgtggtgctgatggatgtgcgcatgcccggcatggacggcattgaggccacgagccgtattacctcgctctccgccgcgccgggcgacgcgaccgtctcggccgaatcggctgacgaccggccgacgcgcgtaatcattctgacgacgttcgatttggacgagtatgtgatggcggccatcaatgccggtgcctcgggcttcctgctcaaggacaccgaaccggaaacgttgctcaattcgattcgtactgtattccaaggcaatgcgattatcgcgccttccgccaccaagcgactcatcgaaaagatgatgcaggacggttacgcgcagcatggttcgctgaccggcgatgtcgcgcgctccggtgccgtgtacagttccgccgtcggcgtctctggcggtgcggccggcaacggtgccggctcgatgaccggcatcccctcccctgccggagccgcttccgacggttccaatacgtcacgcccagcatacaccgatcccgaactggatctgcttaccgaccgtgaacgcgaggtgctggtggagatcgcccatggtctgagcaatcaggagatcgcggacaagctctttatctctcttcccaccgtcaaaacccacgtggcgcatatcctcgccaaaatcaacgcccgtgaccgcgtacaggctgtagtcttcgcgtacgataacgggctggtgtaacaaaaaagctccctctgatgagggagcttattgctctacgcttcggccaaggcttcaactggtggcgttttgacggctcggcgggcgggtgccacgctggcgaggagagcggcgagcgcggcgacgccgagcaccacaccgttggtggcccattcgaacgggaacacggtgtcgccatacaaactaaacaccatgtaggatccgagccagccgaacagggtacccaataccactcccaccacgccggagacgagcgaaagcagcaacgcttccaccgccagcgagcgccgcagttggccgcgcgtcatgccgatggcacgcaaggtggcggattcgcgtgtgcgttcgatcaccgacagactcagcgtgttcgctacgccgaccaaggcgatgagcacagccaccgcaatcaaaccgaccaacaatgccatcatgccgttgatcatggtctcccattgcgtacgttcggccaccggaccggtcacggtaacaccagcactagcggagaacacattctgcacgttggtgaatacgtcgttcagcgcaacacccgcgccttcggcgtcaatacgcataagcatgatatgcccgtcggccttgattccaccgttggtgaagtggctggcggccacgaaggcgaccgcggcgtagttggaggcaatgcggcgatagtccaccttccgcggtttgagcgtcagcgtctgtgtgccgccggattgtccattgccgttttcggcgctgccgttcgcatcattaccggacggaccattggtggcatcggcttgtgcttcggccgctccagccgtgaacgtaacgctcttgtccagcggaatatccttgcctgtagcggcggaatacttgggcatcagtacggaatcgccatcaatggtcacaccggacaaatcggagcgcaccaccttgcgcagcgcgtcgacgccatccacgcccacgaccagcacactcagactcttgccgtcggcatccttcatggtcatcatgcgggtcggcgcgtagatactgctctgaacgcccttgactttggctgcctcgctggcctgtttgccagtcatatcggtgccagcggcaatcatgtcgacgctgtagcgcgtggtcagcgcctcgttcatggtttgcttggcactggcggcaccggtggcgatggtggagaccagcgtcacgccgataagcagtgcggcaccggtggcggccacgcggcgcgggttcttctgaatgttcgcatgtgccactttggcggacggaccggccagtgcaaccagcgcgcccacgccgcgcatgagcaccggcagccagaacgtggcggaaagcaccagtccaaggaagatcaatgcacatccgatgatggcggcgagcagcaccagcggatactgcttgtcggccattgaatcacgtccggcgattttctcggacatctgccatacagagaatgcgcacagtgccacgccggccgcaatcagcagcatggaaatcacggcgcggaccacaccggcccgtcgcgtgtcggtcagttcgatgggtcgcaacgcttccagcggggtgacggcggtagcggaacgcgcggagcctagcgaggcaatcaccgtcataatgatgccgaatgccaccggtacggtgaacgccgggcgggacagcaccagtcgcatgttcatgtcggtggcctgcatgatgccggaccggcacagcgcttccataagggcgatgccgaggcccacgcccagcacggaggcgatcagtcccagcacgccggcttcgaacagcacaccggcatacaactgtttcttgttcgcgccgatggtacgcagcagcgcgagcgtgcggcggcgttgcgccacgaggacgcggaaggtgttggcgatgaccagcgaggccaccagcatggcgagtatgccgaaactcaacaggaatatggtggtgatgctggtttcgcccgcgctcatgctcgcgatggatcgttcggcgtatgaggctcgggactggacgctgaaatgcttggggagcagggcgttgatctgtgcgaccgcggccgtcgcggccgcatcgcccgcaccatcgatgtcgaggtagatcatgctggcgggcagttcgttgaaatcgtcgccgcctcccatcgcggcgatcacgttgtcggagagcacggaggcgccgccgtagtaggggtaggcaccgttcggatcgtcggtcaggccgaccacgcgcacggtcatgccggagtcggcggccgtgtcggtgccgtcggatggggcggacgcgccggacgcggcatcggaatcaccgtcgtgcgagctcgcgccatcggcgttctgggccgactcatcaccagcgtcaccggtattaccggccgaatcgccggtcttgcccgcatactgcgccgcctgcgagttgacggtcacacggtcccctaccttgacgccgagctggtcggccacggacttggtcagggcgatctcgttgctgtccgccggctggtctccttgcgtgatggtgaccggcagcagcgtgcgttttgtggcggtggtgatgacgtagctgttggcatgcttgttgccacgggttacggtcacaggacccgcgtagccggcacgtgcgtccttgacgcctttggtggcgcggatgcggtcaagctggaagtcgttaaccgtgcgcgtgtagatgtagtcctggtccttatcggtcaggtccttgccgctatccgggctgatcacgtagttcgcgccgccgagctgggcggtgttctgggcggcaagcgcatcgttcatcgcgttgccgaataggaaggtagcggcgatgaacgcagcgccgatcaggatggcgatgcctgccggaattagcatcctggcgcttttcttcataagtttcagagtgatggaaaacatgggggtgtcctgtctctcgctttccggctcagcgagcgtgctgtacgacggcgcgggcatggcgcatggtgccggttctcccagctgggggcaatggagcgtcggtgataggcaggttgggcacatcctttacgccggcaagacgggcgagcgtgtcggcgcgtgtgctggtgacggcagtgcgcgcggcacgttcgcgttcggacataagcagctcgttcatcgtttcggcagtgggattcgcttcgtcggccacgatctgtccgtcggcgaatacgatggcacggtcggcgtaggaggcggccaccgcatcgtgtgtgaccatgacgatggtttggccaagctcgttgaccgaacgcttcaggaagctgagcacttcggcgctggaaacggagtcgaggttgccggtcggctcgtcagcgaacaccagcttcggcttggtaatcagcgcgcgggcgatggccacgcgctgctgctggccaccggacagttcattcggtcggtggttcaggcgctgcttcagtcccagggtatcgacgagcaggtcgaaccaggcgtggtcgggcttgtctccggcgagagtcagtggcatgaggatgttctgttcggcggtgaacatgggcaacaggttgaagctttggaagatgaagccgatcttgtggcgacgtagcaaggtgagctgcttgtcgtccatgcgggtcaggtctgccccgccgaaaagaatatgcccggatgtggcggagtcgaggccggcgagcgtgtgcataagcgtggatttgccggagccggaagggcccatgatggcggtgaatttgccgcgttcgaaactcacgttcacgccgcgcagggcatggaccatattgctgccggtgccgtagttcttgaccaagtcgacggcctgaatagcgatgccgcgcgatgcggccgggttctgcacgttcataatgtctctccatatttggccgggccttatgcccggatgacgattccaacttatgaagaaataacggcgcgccccatcgtgcgccagactgaattgggcggtcggccacgcgccggccctcatccttgaggattatgtcgtctcaggtctcacactattcatgcctctgcgcaaacagtgtgaggccaaccgaatataaaacgaacaacgacatccgacaatcggcgaaatatcgcggattgtcaacatgtgtgattgggtgatgatgtgcgtttgcctcacacatttttttggcgacggtcatttttgtgtgaggcatacagacgcaagaaagcccgcactgcatgacgtcagtgcgagcttcctactccttgggtcaagcgatcaggcggaaggcaccccatgcggctcgatgattcgcgatgcaccccattagcatcgcgccccttctcatcgggctgtcaacctttctgtcgacctcacttggccaagccggaagcgcgaagggcttcgaagccgcccttcaggtcatcgaggatgtcctcgatgttctcggtgccgatggacaggcggatggtgccctggtgaatgccctggtcctcgagctcttccaaggtctcctgggagtgcgtggtggaagccgggtggatgacgagggactttgcgtcggccacattggcaagcagagagaacaggtgcagattgtcgatgaagacgcgagccgcatcctttccgcccttgatatcgaaggtgaagatggagcctgctccgttcgggaagtacttctcgtacaggtcgtgatccggacggcccgggatggacgggtgggaaacggactcgacttccggcacggtctgcaggtactcgacgaccttcagcgcgttctggacgtggcgctcaacacgcagggacagggtttcggtgccctgcagcagcaggaaggcggcgaacggggacagggtggcaccggtatcgcgcagcaggatggcgcggatacgggtcacgaaggcggtgccgccgagagcctcgtagaagttcaggccatggtaggaggggtccggctcggtcagggtcgggaacttgcccggaaccgcattccagtcgaagttgccgccttcaacaatcacaccacccaaagtggtgccgtggccgccgatgaacttggtggcggattcaaccaccacgtcggcgccgtgctccagcgggcggaacaggtacggggtggcgaaggtgttgtccacgatcaccggcaggttgtgcttgtgggcgatttcggagattgcctcgaaatccggcagatcagcgttcgggttgccgaaggtctcgaagtagacgagcttggtgttctcctgaatggcatcctcgaactcctgcgggttctcggcggagacgaaggtggtggtgatgccgtcgcgcggcagggtgtggcgcagcaggttgaaggtgccgccgtagatgttcttggcggcgacgatgtgatcaccggactgggtgatgttgcgcaccgcgtattccacggcggctgcaccggaggcgacggcaaggcctgcggtaccaccttcaagggcggcgatgcggtcctcaaagacaccctgggtggtgttggtcagacggccgtagatgttgcccgggtcggcaaggccgaatcgggcctcggcatgatcgaagttgtggaagacgtaggaggtggtggcgtagatcggcactgcgcgggaatcggtggccgggtcggcctgctcctggcccacatgcagctgcagggtttcaaaacggtacttcttgttgttctcgaccatgggtatttctccttggttatgctaggtcgcgaggatttttccttgccgcccgcctgccgtgttcgggtggttggcgaggtgttggttatgaagttacgacgcttgggccgcgcgacgcaagccgaacgttatcgggcttgcctataggggcttataaagccttggaatcattgacgtgagaaactgtcaagagtcacggaaaagtcgttgaaattatcgcgacacgccgggccgcgcgcatgcgctttcacgttcgactgcggtcacggtgatatcgctaccatgcctttcgcgcatggctcaagtgtccgtgatgattgcttgttccacccgtcaccaagacggtttgcccgctcggcgatgacgtctgtttcatttttccgccgcccggttacatggtttacatgacgaacgactacagtcaaacatcgccaatgaattattccgccaacatggtgaaggggttcgaacagacatgaccgatgtaacactgtatgaccgtgatccgagctatattccgcgcgtggccgccgtgcacgacatgtgcggctacggcaagtgctcactgaccgccgcgattccgattctctcggccgcaggctgcgatgtgtgcccggtgccgaccgccctgttctcggcgcacacgcgctatgcagtgttcacgttccacgacaccacggatattctctccggttacttggatgcctggcagaaggaagacgtggaactggatggcgtgtattcaggcttcctcggctcccccgatcaggtggcgatcattcagcgtctctaccgtgaatatccgaacgcgctgcgtctggttgacccggtgatgggagacgccggcgaaatgtaccccacgtatacaccggagctgtgcgaggcaatgggcgctctggccgatggtgccgacgtgttgatgccgaacctcaccgaagcgagtattctcaccaagcgtgactatcctggccagaatattgatgaggccacggttaacgagctgcttggtgctctgctgaagttgggtgccaagaacgtggtgttgaagggcatcgaccatggcgatggcaaaatcgtcaactatgtggccagcgcttccaccggtgttgccggcaagatcgagctggctcatgaaaagctgccatacatgattcatggcacgggtgacgccttcgcatctgccctgtgcggcgcggtgatggccggccgcggcttggccaagtcggccgaaatcgccggcgagttcgtgcgacacgccatggtcagcacccgtgaccagccgcatttcgaggatcgtggcgtcagcttcgaactgaaccttggcgaactcaccgatttggtgaagtgaccgcaccttggctcccctctccgctcactgggtctgacgtattcagcgaacaactcggcgggttgtttgtcatcacaggtaagtcggctggggagccttggtaaaccttctgaactaatggtggataaccgggttttcatccacacgttatccacaacacgccaaaccgcgtcatagtatccacatttgccggttgcgcttgtgctcttacataagtaacccgcacagtggaatcatgaacgctctaccacctacccagccgacgacgaagtccggcatcgacgccggtcttgcctttcaccagcccatgctggcttcacctgatccgcaggcaacgctgccttcggaacggattgcggccacgatgggcgaccgcaatctgacgcccaaacagttcggggcgctcggcgagcagtatgccgccgcgtggctggaggaacacggttggacgaccttgagccgcaattggcatacccgttacggcgaattggacatcgtgatgctcaatcccgagtacacggtggtgttcgtcgaagtgaaatcacgccggtccatgcattacggatatccgcaagaggccatcacgccggcgaaacagcacaatctcaggaaagccgcctgcgattggctgcttgaccggcgtaatcgtgtgccgcatacggcagtccgtttcgatgtcgtcaccatcgtgcttcgggtgggcagaccgctcgtgcatcacatcgaaaacgccttctgaattcgtccccaaaaaaacagccacgttgcgaaacacattgcgaaaggagtagacatggctatcggcagcactctctcagtcggactgatcggccttaaggccttcatcgtccaagtgcaggctttcatcagccctggcttgccatacttcagcatcatcggattgccggatgcatcgttgtccgaagcccgcgagcgcgtgaaatcggcgtgtcaagccactggattcggttggccgcaaacccgcgtgaccgtgaacatgagccctgcggccatgcccaaacgtggttcgtcgcatgatctggccatcgcggccagcgtcctatgcgcggcgggttccatagggcatgattgcttggaagataccattgtgctcggcgaagtgaatcttgacggctcggtgctgccgattcatgggctgctcccgatcatgctgcatgccgaggaacgtggcgtgcgcaaaatgattgttccccatcgcaatcttgacgaggcttcgatggtggatggactggatgtagtgggcgtgaggcatgtgggtgagctcatcgaactgatgggcggcgatgccacctatacgattactgatacaccggttgccgacgagaccaccatggatcaatcgcccacaagccatcccaacgattgtggcgatatgaacgaggttctggggcaggaacatgccaaatgggcgctgcaagtggcggcggcaggcggacataatctcatcatgaccggcccgccaggcagcggcaaaaccatgctggcctcacgtatgcccggcatcatgtgcccgttgaacgaggcggaacaactggaggtggcatcgattcggtcgctgtgcggcatactgcctcagtacggcatcaccgacatgccgccgttcgaggcaccgcaccacaccgccagcacggcggccttggtgggtggtggcagcggcatcgccgttcccggcgcgatcacgcgcgcgcatcgaggcattctgttcctggacgaggcaccggaattcagcgcacgcgccctgcagacgttgcgcgaaccattggaatccgggtatgtggcgctttcccgttcaaaaggcagcacctattacccggcctcattccaactcatcatggcggccaacccctgcccgtgcggatactattacggcaccggcgaacgttgcgcttgccgggaaaaagaccgtatacgttatttctcgcgattgtccggaccgatattggatcgtgtggatattcagatggcggtgccaccggtctcgcgcattgccgtgcaaagcgagccaatcggcgagtccagtgccggaatacaagctcgtgtgattcgcgcccgtcaagtggccaaagaccggttcagacagtatggatgggtgtgcaacgcgcaagcttcgggcaaatggctgcacgccaatacgtcgctgaaagcgatggaattggtcaatcgggccctgtccaatcatcaactcacattgcgcggggccgatcgcgccatgcgtctgtcttggacgctcgccgatctggccggccgcgtatcccccaccgagcaggacgtccatcagggcatcgaaatgagaacgaggatgacatgagtaacgctactgatatccgacaatctggcggcaccgcaggcagtgtggatcacaccgatacgggcctcgctgtttcgcgcaccattcccatgcctcccacggatacgttataccgcgccgcgctcacgttctgtcttgatggggcggatgtgatgatgtacgccacgctcaaaggcgcggaaagcgccgaatccctctggcacgcgttggcgcaatcccatccaagccagccatctgaaatctgcggcccggcgctgtcacgtattgaccgcatgttcgtggacggcctcactcgatggggccgcaaggcgtcggcgaacgcgatgcgctccttccgcaatgcactggccggctggcataaccgcatgatggacctgccctcgcaagacatcatccaactggctgactggttcactatggatggcacgcaatggattatcggccctggccatccatgttggccctcgcagttggccgacctgtccattcgctccgattgggcgccaccgctgtgtttgtggatcaaaggcgatccacgcgcattgaccagttgcgccaaaccggtcggcatcgtcggttcacgggacgtgaccgaatatggccggtatgtggcgcacaccgtagccgaacaggcagccgttgccgggcatctggtcgtgtccggaggcgcgatgggaacggatgcggcggcacattggggagcgttgaatgcgctgcacggcagaatgcccgccaatgtgggcagaaccgttgccgtattcgccggcgggctcaaccatatcggaccgatgcgtaaccgcacgctgttcgaacgtatcgaggcacagggtggtgcactgatcagtgaactgtgtccagggacgattcccgaagcccgtcgttttctactccgcaaccgcattatcgcggccatgtcttccacattgattgtgacgcaagcccggttgcgttccggagcgctcaacaccgcgggatgggcatgtgaattgctgcgcgaagtgtatgcggttcccggtgacatcaatcagccttgcaacgccgggtgcaataagatgatcggcgaccaccgagcgatgattctgtgtgccgccacatccaccgaggatatatgccatgaacggcacaaacccgttatgggagcatgcccaggcatatcgaaatccacaggtcaggactcgtccgaaaacgaggaggccatggaagtgccggcaacgactccgttatcgccagcatcctcggaatcatcggcgtcacaggagtcgtcacaagatccaggccattcgaaacgtcttaagaccaagcatactcagcctacactcgttcaatccaaggatgggccggcgagcgcaaccgccgggaccggtgccaacaagagcaagggtgaagagctgccctcgtcgcatcagatgccggatcttcgtgtcaagccgaagcccgatcccgagaaggaagcccaacaacgtatcattatcgccaagctgccggaaatggagcgcacattagtggcattgattcgtgaatgccgtaaacgacatctcatcgtcactccggacgcactattgcgtgtggcgcgagagacggtacccgacgagattcccaatatcggcaccatacttgagctactcggcgcattggagctgaagggagtgatcgagcgggatgccggcatactcaagctgagcagccgtgtcggctaatcggcttccatgacacggctcgaagactgttcggcgggtgtgcgagaatcgaacccatgagtccgaaacgtttggaagatatgtatgatgcggtgatcgtcggcgccggagcggccggcctgtcggcggcgttgggactgctgcgctcccccaaaatcaccgagctcaaggaacaaggcgtggacccgaagatcctcgtggtctccaaactgcagccgctgcgttcgcacaccggttcggccgagggcggcatcgccgcgagcctgggcaatgtggagtccgatgactggcactggcattactacgacaccatcaagggcggcgactggctcgtcgaccaggacgcggccaaactgctcgccgaatacgcgccgcagaccgtgatcaacctggagcgtcagggcgtggccttctcccgtaccgatgacgggcatatcgcccagcgccggttcggcggccacacgcgcgagttcggcggtgccccggtcaagcgcgccgcctatgcggccgaccgcatcggccaccagattctgcacgccttgtggcagcagtgcgtggcggcaggcgtcgagttcgccgaggaatggtatgtgaccgatctggtgctcgccgacgacggcaagcaggcggccggcatcgtggcatttgacacgcattcgggcaagattcaggccatccacgcgcgcaacgtgctgcttgccaccggtggcgcgggccgactgttccataccacatcgaattcctgggacctgaccggcgacggcatggcattggccttggccgccggcctgcagctggaggacatcgaatttgtgcaattccaccccaccggactcgcgcacaccggcatcctgctgtccgaggcggcccgcgccgaaggcggcatcctgaggaacgccgacggtgagccgtttatggaacgctacgccccagagcatagggatctggccgcgcgagacgtggtctcccgctccatcatggcggagatcgacgccggccgcggcgtcgccgacccgaaggacccggatggtccgaaggactgcgtctggctggacatgaccggcatcgaccccgaacgtatgaaggaagtgctaccgcaggtggtcgaaaccatcgagcagtacgcgaacctcgatccggccaaggacctggtgcctatcaagcccactgcgcattacacgatgggcggcatccccatcaccaccaatggcgaggtgtaccgttgggccgacggtgccgtgcaggtagtcgatggactgttctccgctggcgaatgctcttgtgtctccgtacatggtgcgaatcgtctgggcggcaattctctgctcgacgcctgcctgttcggtacacgtgctggtcagacgatggccgcacgcatcgtcgagaacccggttgactcccctatggccgaagattcggccgatgacatgctgaccgatgccgccgatcaggctgccgattcccgcaaggcagagcttgacgaactgctcgccggaccgatggacgattcagacgatggcgggcccaccgccaatccttatcagctcatagcccaactcggatcagtgatggagcaggctctggccgtacgttgcaccgctcagaccatcgatacggcgttgactcagatcaacaacgacatcacaccggttgccgataccttgcgggcccatgacaagaccgccgctttcaatcaggaggtcaccgccatctgggaagtccgtcatctaatcgaactggccgaggccatgctgcacgcttccgaatcccgtcaggaatcccgcggatccatgcaacgccttgatttccccgaacgcgacgatgagcatttccttgctcactcgatggtcgccgatgatggtccggcaagtttcaagccggtgcacatcaccgactatccacccaagaagcgcgagtactgatccgctggtggtaataccaagccgcctagggcttgtggcacaataggttggctgattattggacttgacatcccactgtttcatggaggcagaacatggctgaggcgagcaacacgacggttaccctgcaagtgcatcgtttcacgccgcgacccgagcgcgccgaacgtgcacgcggcggcagcccgttcgccaagaaaaactccccgttcggcggcggctcggattcggcggcacgccgtcgtccgcgcggcaagcagtgggtgcaggaatacacgattcccgcgcgcccctcggacaccgtgctcgactgcctgctgaccatcaaacgcaccgtcgacccgacgctggccttccgctattcgtgcggtcacggcatgtgcggttcggacgccgtggccatcaacggcacccccaccctgctgtgcacggccaccatccgcgattgggccaagcagcccggcgccatccccgaagtcgatgacgaagggttccggcacaccggcaccgagtccgaagaatccgacgattccgcggaaaacgacgcaaacgcggcagccgaccaggactcggccgcaaacggctcgctgggagtcatcgaactggcatccctgcccggcttcccgccgcagcgcgacctcatcgccgacatcgacccgatgctcaaccaaataaggaagctcaccccatatcttcaggcggacggcgtgctcgccaccaccgccgaaggcaaggtggacgtgttcgaatacctgcagaaccccgaacaactcgccaaatacgagctgctgagcaactgcatcgcctgcggcgtgtgcgaaggcgcctgcccggtgtacgccggcggcgacgctttcatcggcccggccgcgctgatttgggcctcccgtttcgtcaacgattctcgcgacaccaaggccatggagcgtatggacgccatcgacaccgccgacggcgtggccgcctgccagtccgtgcgcgcctgctcccgccactgcccgcgcggcatcgatgtgggcgaggagatgtggcagatcgtggccaaggtccgcgagcgctaagccgcgccgcggctggctgcggcgatcgtctaagcacatgcgtcgatgcatccgccgggtgcccgcacgagagaagacatgaaggaacgaattatggacagaacgcagtacaccaacctcgccaaggcatgggaattcaccgaggaacacgcgcgcgaacgtgaatccgatgcgttgaccgacgcccgtacggccgccgacgagtccggccagttgcagggttcggcggcgcaggcccgtctgctgggcatgctggtgcacatcaccggcgccgcttcggtcatcgccgtgggcaccggctcgctggtggaaaccttgcagctcgcccatgcgctggatagcaagggcctgctgactgcggtcgattccaccgctcagggcatcgcgctgattcgcaaggcgttcgccgagctacaggatgagaccgacaccacgttgcgtgcggtgaatgctccggccagcgtgtttctgccgcgcctcaacgccaatgattacgatctgatcgtggtggcgggcgacgccgagaactatgccgccacgttcgcccaggcctcccgtctgctgcgcgcgcacggcgtgatcgtgttcaccgatgtgctggtgttggaggacggtcagggcggcgtgatcaatccggccgaccgcagcgacaaggccatcgccatgcgtgaattgctcgccaccgtcgaagatgacgaaggtttcgagtccacgctcacccctgacggcaccggcctgctcatcgcctacaaaaagtaactctgtccttggctcccctcggagaggggagccactctatctcgcttatctcacgattgcgctgacggccacgtccacggcttcgtcggcgtcgtcggttacggtgaccagtttcgggtcgatcgtcgagatcatgccgtgctcggccaccggaccgttgagccagtcaaagagcccctgccagtattccttgccgtagagcaccaccggaatattcgccaccttgtgggtctggaccaaggtcagcagctcgaacatctcatccagtgtgccgaagccgcccgggcacacaatcacgcccgaggaatacttgacgaacatggtcttccgcacaaagaagtaccggaagctcatgccgaggttcacccactggttcaccccctgctcgtgcggcaattcgatgccgagtcccacggatttgccgccggccagtgccgctcccctattcgcggcttccatgatgccgggaccaccgccggtgatgacggcgatgttgcgcttggctatctggctacccatgcgccgtgccgccttgtagatcgattcggtgcgctgggtgcgtgcggagccgaaaattgagactgcaggtccgagctcggcgagcgccccgaagccgtccacgaattccgattggatgcgcagcacacgccatgggtccatgtgcagccagtcggtgtcccggtcgggtttcagcaggttggcggtggtgttgtccgagggaatcatctggccgcgtagaatcaccgggccgcgatgataggtgtcgcccagcggcgaagcctcctccaagtcgaccgggttcaccggtgtggccgcagcctcagttgccgtctcagcctccaacgttgccgtatcattcgcagctgtggcttccagtggttccatatcgtccacgactgcgggctgggacgcggcctcggctggattctttgcttcaacggcctttttgccgccgttcttcttggatttcttctgcttctttgccatccaatgtcctcctgtacggtgctatcgactcttcgcattctagcgcctgaagctctgcgtacgttttccgcgaaacaaggccaacaacggagtagggaccgtcttagccatcagtggcggaagtcgatttccacactggcggtgccgtcggcgagggtgccggggtgttccgtgggcgtggtgggctttgtggtgcggcttggctgcccggtgccattgccatcaatcgattcgccggcttcggcatcggccaacgcctcggcggcggcagcctgcgcggctgcggccttctcgaatctcttggactgacggctcagcagcacaccggaaatcgcggcggcgatcagggaggccaccagcacgccgaagcgcgcctcagcggaaagttccgcgttcttgtacgccagcgaggcgatgaggaaggacacagtgaagccaatgccgcaggcgacggcagcgggaatcatgtcgcgcacgcgcagccccttggccatcttgagcccgcccacatgcgtggccagccatgcggtggtgatgatgcccagaggtttgccgaccaccaaagccacaatcagtgcaatgaccaacggcgaagccaacaacagcgggctcaccgactcgaagtgcacgccggtggcgaacagggcgaagatgggcagggccagcagtgcggagaatggctgaagcttgttggcatagcgttcggcacgcggtgaaagttcgccgtgcatttcacgggagggggtcagcaggccaaccagcacgccggccagtgtgggatgcacgcctgcctcgaacatcatgatccaagcgaggacgccgacgatgccgaccgcgatccacggcacttttttcagtcgtacgaggtatgcccagatgacggcgcacacgacgatgccgatgaaccaataccaggcgttgatcgaggagaagaatacggcgatcaaaataatggccagcaggtcatcgacggtggcaagcgtcatcaggaacgcgcggatcgaaccgggtagggccttggcaaacagggcgagcacggccagtgagaacgcgatatccgtggcggtgggcactgcccagccgtgcgacatctccgagaacgggatgctgctgccggtggtggtcagaatcagcgtgccgggttcaccaggcccgatctgagagaacaatgccgtgacggccaggaacaggatgggcggggcgatcatgccgcccaccgcgcacagcatcggcacggcggccgctttcggattggcgagcgagccggtggtgagttcctgcttcagttcgaggcccacggtcaggaagaagatggtaagcagaccatcctgggcccaatggccaatcggcaggtcgagattggtgtaggggatgaacagatgcgtttccgctacggtctcgaacgcatgcgcggtggcgggcaggttcgcgagcaccaggccggtgagcgcgaagccgagcatgatgagtccggaaatacggtctgaggcggcgattcgcctgatggtggaccaaagtcccttcttcgcgccggcggtcgtggccatcgcgtctccttgctgtactctcttggatgaaccgtatgtaatagtacggaatatctcaggacgttccgctccgggctgagtcgcgaagggcaaccttaccccacccttgtgtggccgactcaaacgggccaatacaattggaaaagcctcggaagcatttcgctttcgaggcttactgtgcgccagacaggattcgaacctgcgacctgctgatccgtagtcagctgctctaatccgctgggctactggcgcataccactgttgtccccgtggttcgggagtgcgccagacaggattcgaacctgcgacctgctgatccgtagtcagctgctctaatccgctgggctactggcgcatgttgtcttttcagacaactcgatatataatacacgccgttcagatgaatgcaactcggcgtgttgcggcgagtcgcaccatcctaatcgccaccgcaacggcgtatttactggcctcacgccgcatgtgtacggactcggtcaagcaaaaccgactacgcaactttgaggcgtccctgcggcacatccacggcttcgcgcaggagtttgggcgtactggaaccctctacggacgccttgtccacaatcacctgcttcacatcatccaaactcggcaactggaacatcgtgtcctgcaacgtacgttcgataatcgaacgcaacccgcgtgcgccggtcccctgcttgatggcgatatcagcaatcgcccgaatggcctgttcggtgaactgcaggtcgacgccgtcgacggcgaacagcttacggtactgcttgatcagcgcgttggctggctgggtgagaatcgccgtcagatcgtctacggtaagttccttcagcacactggtgaccggcaaacgtccgatgaactcaggcaacagcccgaactcggccagatcatcggcattgacctgttcgagcaattcctcgtctttcatgtcggcgtcgtgccaattcgcgccgaagccggtctctcgacggcccaatcgcttgcgaacaatatccgtcagtcccacgaacgcaccgccgcagatgaataggatgccgcgtgtgtccatctgcgcagtgtcctgctccttatgcttgcgcgtgccctccaacggcacggaggcgatggtgccttccaaaatcttcagcaacgcctgctgaacgccctcaccggacacgtcacgggtgatggaggtgttctcacctgatttgcgcgcgatcttatcgatttcgtcaatgtagatgatgccgtgctgggctcggcttacgtcgccatccgcggcttggagaagacgttggagcacggtttccacatcgtcgcctacatagccggcctcggtcagggtggtggcgtcggtgatgacgaatggcacgttcattacgcgggccaacgcctgtgcaagataggttttgcccacaccggtggggccgagcaacagaatgtttgatttggcgacctcaacgtcagccaaagggtcactgttgcggcgggtagcacgcgtctgggcgggagcggattgcttggcttgttcgccggtctggccactgtgcccgttattcccgtcgagctgttcagcggactcctgaagctccatattgacgcgcttgtaatggttgtatacggctacggacaatgcgcgcttggcattctcctgaccgatgacgtagcggttgagataatcgaagatctgggcgggcttgggcaggctcagcgaattgacctcggcatctttgacacgctcctcggagatgatgtccacgcacagggcgatgcattcatcgcagatggaggcgttgggaccggccaccagttttctgacctgacgttcggttttgccgcagaacgtgcaacggggtacgtcctcgttgtagctcaccacacgtcccatgattctcctttgccgactgcgccgcaccgtcgaaccgccacgctgcgcattatcattgtcatccttgaaatacaatacccccggtcgttgccgaccgagggtattgcaatgtccggaagttttactggcggtgttccagcacctcgtccacgatgccgtattccttggcttcaggagcggtcaggaaagtgtccacttcgatgtcgcggcgaatcttctcgacgtcctggccggtgtgcttggcgagggtctcctccagccattcgcgcatacgcagcatttccttggcctgaatctcgatctccgtggccttgccgaagccttggtcgatggccggctggtggatgagcacacgggcgttcggcagcatcaggcgcttgccctcggtgccggaggccagcagaatggcggcggcggaggcggcctggccgagacacacggtctgcacgtcgggcttgatgtactgcatggtgtcgtagatggcggtcatggccgtcatcgaaccgccgggtgaattgatgtacatcatcacgtcacggttcggatcttgggattcgaggaccagcagctgggccatcacgtcgtcggcggaggcgtcgtccacctgcacgccgaggaagatgatgcggtcctcgaacaggcgggagtaggcgtcctgggtcttcatgccatacggggtcttctccacgaactgcggcatgatgtaacggttggtcggcgcgggctgggctgcgcgggcggcgtccggcatgaaaccggctacgccctgacggccggccaagcggtcggcacgggcggcgaactttgcttcttcacttgccatgagtctcactccccctgctggttgttgccgatggtgtccggcgtggtcacgagcttgtccacgaagccatagtcgagggcttcctgggcggtgaaccagtggtcgtattcgttgtcgcggtagatttcctcgagggtgtggccggtctgttcggcggtcagctcgctcatggtcttcttcatgtccatgatgagctcggcgttgatgcacacgtcagtggcggtgccgccaatgccgccggagggctggtgcatgagcacacgggcgtgcgaggtcaggtaacgcttgcccttggtgccggagctcagcaggaactggcccatggaggcgcacatgcccagacccacggtcgccacgtccggctcgatgagctgcatggtgtcgtagatggccataccggcggtgatggagccgcccggcgaattgatgtacagccagatatccttcttcgggtcttcggcggccagcatcagcagctgagcgcagatgcggttggccatatcgtccttgacctcttcacccatccagatgatgcggtctttgagcagacggttgaaaatcgggtcgacggggccggccgggacgtcatcgcccgccatgaccggcaaggtcgcaaaggtattgctcaccttgattctccttctaattactcgaacattgttcagactaccgccttgaagcgactgaagtcggcttttcgcgtgctttttggcgggtagcgtaggatatctctccctccgtctcgactttgtcgagccacctccctcgtcttttgttgacttctctccctccatctcgacttcggcgagacacctccctcatcagtgggaggttttattcaagggtatcgaggacgtcatcaatgaggagacgggtctgggaggcggcatcgtcgcccagacgcgggaagcgacgggcggcattggcggggctggcaccggcggctcgcgctacgttggacttgctgacaccatgggccacggctttttccgcgagccgatcgaccagtgaatcggcgacttggcgcatctgttcggccacccataattgggccatatccgcaggtaagtcgtagtcttcggccacatcgctggctgcctcctgaatggcggcccataacaccatgaatggctttcgatagtagtcaatctgctcagtgagcggctcggcggcaagcaattcaagtgccgagcgaatttctgtattttctgacatagctttctttacctcggctcccctcagagaggggagccagaatatatgtatctacttacttacgactcagcaaccactttgatatcaacgacgacgtggccacggccatgccgaccggcacaaagaagctaatcggcgcttcgctcagctccatcactaagcacatggccataagcggtgcctgctgtgaagccgaaagcaacgaagccgcaccaatcaaggcacacgcggttaccgaatcggtcggaaacatcagtatccatacgaggccgagcatcgcacccagcgtagaacctaatgcgatgccgggctgcagcacaccgcccgatgcaccggagcgaatggtcatcagcgtcaccagcgctttggtgacaaaggtgagtgccaacacacccagcaacatccagatattggactgggacagcgggaaaccggcgttcatcccggatccagaagagccgctcccaccctgaagcatggcccagaacgaggccattccagagcccgatcccccgccagaggccgaatcggatacattaccgccgcccgtaagcaagttccatggagaggcggccgatgaagatgccgactgcatggcaccagcagtgccagcggtttcaggaatgaacgtgctgaatccaagttgcgctgcggcacggccgttgcccatcacctgcggcacaacaatcgccaccaaaccggtgatgaaaccagccagcggcatctgccacagaatggccttaccggtcggcttgtgcgcttccgcccattgcgaaccttttcggaacaacgcgccgcccactccacatgccgcaccgcagatcagagcgaacagcattaacgttggcgtggattccggttgcatggcggtaatgtcgtagaacaggcaatgccctttgatcgcaaccgccacgaatgcggcaatggcagacatgcccagtccaaaggcaaccttttcgatcgtcacatccaccaataggatttcgacggcgaagaacatgccggccagtggcgcgtcatagacgcctcctagaccggcaccggcagccactgccaccaccatgcgccggtcgatgccgtcaacgccctcgatatggaacaggtcgcagaaacgttgcgcgatcatggtgccgagttcgcgtggggcgacttctcggccgatcgaggcgccggagccgacgatgaaaatctgcaacaccacatgcacaatggtctgccagaaaggcattcgctcccctgccacggccttcttgactgaagataccgcagtcgttttgcggcgtaacagataccagataatgcccgcgatgccgagtcccacggtcaccgatatcgcacggcgtgcagcgggcacgccgaatggaccagacaattctgggccttcgatgtagccgagcagcacatgttcaacgccgtagagcaacagggtcagcagacctgctcccacaccgatgagcacgccgagcacaatggtcgccgcagcgagccaaccaaggcgtttgatagtaaccgttggctgcatgtcaacctccgcaccctatgcaacgagtatgccttgggaactccccctcagtctcgctacgctcgacagctcccctcaaagaggggagccaaagaaatagtccttttgccagaatatgaagagcccggaaccgtgaaacacgactccgggctcaaacaatcacgctaacgcgatgaggctatgctcactcagcatccttggcgtcatccttggcggacagttcgtcggccacggcggcagcagcggaagcggcctcgacggactcggactcttcgtcctcagcggcctcgcccaggaagccggagaggtccacaacctcgccatcagcggtgaacttgacggcgcgcatgccggcgagcagacccttggagcgggcgacttcctgcacagcggagccaagctggccgttcttgatgatggcctggatgaagttgttcgggtccatgccgtactgctgggcgatggaagcgaggaagttgaacacgtcggactgggacacctgaacgtccagcttctcggccagagcgtcgagcaccatctgatcgcgcagatccttctccacggtctcctcggcctgagccttctgctccttggtggccttctccgggtccggggtcaggcccttgagctgctcttcgaccatgttggccttgacgcccttcggcaccgggatctcgaggccttcctgcagcttggcgatgaaggcatcgcgggcctcggtggcctgacggccttcggcgtcctgagcggcagccttgcggatgtcggccttgagctcgtccagggtgtcgaactcggaagcttcggaagcgaactcatcgtccagctccggcagttcctcagccttgacggagttgaccttgaccttcacggtggccttctgaccctcgtgctcgccggcttccagcgtgccttcgaaggtggtctcctcgccggcggacaggccgtcaagggcctcgtccagaccgtcgagcatggtgttggagccgagctcgtagctcacgccttcctgggagtcgacggtctcgccgtcaatctcagcagtcaggtcgatgttggcgaagtcgcccttggcggccgggcggtccacgccgaccaaggtgccgaagcgctgacgcagggtctcgaggcgcttgtcgacgtcctcatccttgacttccggcttggagatggcgatctcaagaccgtcgatttccggcagttcgatgtcaggacgacgctcgacggtggcggtgaacttcagcttggtctcgtcgttggcggactgcggaacatcctgcacgtcgaactccggctgagccatcggacgaatcttcttctcatccagggccttggagtacagctccgggaccgcgtcgttcacggcctcaccggcgacggcggcgaaaccgatgcgctggtcgatgatcttgccgggaacgtggcccttacggaagccgggaacgttcacctgcttggcgatttccttacgggccgcatccagatacgggttgagctcttccggttcaacagtgacggtgagcttcaccttggtgggctcgaggttacgaacgctgatcttcacgctaatgactcctcaaaagtcgttatttcttacagttctgccgtaaggcaacctctacatgataacgccacttacggacggtgcaatgagtttcacctgccagttccttgcgccctgctcgatcaggaacgcctcgacgtccacttccaccgggtcttccacccagcacaggttgcgtagggcctgtggcttgatgatcatctcggccggcgtgcgggtgtcttcggcgatgcggttgatcacacgccgtacccgttgcagacggtcataacgctccggatggcgctgttgccacagtcgcatggatcggggcgcgttcaccacaccgttttcgccctgttcgggggcaggcatggtaggccattgggtgggcttcagggccatggctcggtcgatggcctgcttccagaccttcggtttgactgtacgctgaatcggcgcgtaccgctcgaacattttgtcctgctcggtaccggtatggatgcgcacacgctcgttcagggatcggagcgcgcggaattgggcggcattgtgcggcttgttggtcgcggcctcgatgattgacgaatcggtcaataacaggctgggggcaatatcgtattgccgggcgagccggtcgcgctcctcccatagggatttggcgatggccaagccccttggatcacgactcagctgggtgatgcgcgagatacgcagccaaggaatcggatgcagtttgcgcggggcaaggcccgcaaccaaagcgtgagaaaactcttcagcggcccactcatccttgcctgcggctttcaggtcacgacgcatcaaggtttcgagttcgataagcacctccacgtcgagcgcagcatagttgcgccagtcgcgcggcagcggacggtaggaccaatcggcggcggaatgctctttggccagcgtgatgccgaggtaatgttcggtgacggcggccagaccgaagcggtgcaggccgagcaatcgcgccgctatttccgtgtcgaacaaggccttgggtttgagtccgatttcggcgaatccaggcaagtccatcagagaatcatgcagaatccacgtagcgtcgcccacggcgtcattgaattcattccagtcagctccggcccgtgtcagggcgacgggatcaagcaaggcgatgcccgcgccttcacgtttgaactgaatcagccaatcctcatgtccatagcggaatccagacgcacgttcggcgtcggcggccagcgagcccgtcgcctcggccagcgcatcgcaggcacgatgatagccatccagcgtcgaagtgacatcgggcactcccccgcgaggctctttcagcagtcggggttcggtgtcacggacgtcactcaactggcgtcatcctcctcaaaacggatggtggatctgatgaatgcggcccacgagcggatttgtgcgccggcgtccatagtaccgtccggtccggtcccgtcaagcggggtccatgagacgcgaatctcacacccggcgctggtggagccagacatcgaaccaaaagccgtgttttgggtcacggtgactgtgccggataccgaatccggctcgatgccgtcgaaatagtcgcacatgtcatcccagtacatgccgggggtcagagaatcgttttcggcggtttccagcggcagccgcgcgaacgccacgcaacgccagttggaatcccagtcaatgcgcagctcatgagcataaagcatcatgatccagcctgtggcgattcgtgattcggcatcgttgccaagaccggcggaaaaggcatcgccgagggcacactctcccgcttcgaattccacgccgataccataatcggccaaggtggaaggcacgggaatctcccgatagcgcacgtcatggatgcgcttcatggtgctgacggattcgacagctgcccatacttcatccggcacaccctgagggcgtacggggcgtccgtcattggacgctcccataggaaatgcgtagatgtcggccatatctctagggtatgggcgaacgggccgaatcgtggtatttacgcgcggttcggccctgcaatttaaaacacggtgaagccgtggtccttgaactggttggccacccgttcgcgagtggcggcgttgggtcccttctggttctccagcgggtatgggatgcgcagttcgtgccacttcggccggcccagctggtggaatcccagcacgtcgacgtgttcgatggcgtcgccgaaggtctcgcagatccgcgccacgttttcgacgttctcctcggagtcggtcaaccccgggaccagcacgaaacgcacccagatcttcttgccggccttggccaaccgctgcccgaagtcgatggtgggctgcagggtgccgccggtgacctcgtgataggtccgttcgtcaccggatttgacgtcgagcaggcataggtcgatgtcctcgagcatctcgtcggtgtagctcgtgttgaggaagccggacgtatcgaggcaggtgtgcacgcccatctcccgggcggcgtggaacacgcgcgagacgaaggcgggctgcatcatggattcgccgccggagaaggtgataccgccatgcgtggccttgaacaggtccttgtaacgatcgaccttcttgatcatggcgtcaaggtagacgggcttgccgtcgcgcatcttccaagtgtccgggttctggcagtactggcagcgcagcgggcagccggacatgaatacggtcatgcgggtgcccggtccatccacggaggtgttgatgtcccaagagtggacgaagccgatatcgccggatttcagggcggaaaggcggtcacgtcggtcgagtccgattggggattcaaagccggaaaggccgcccatcaaagtctgcgaggcataggtcttcgattccttgagcatatgcctggtcgtggtgcggaacgtgggtgttgcgggcatagttgtcctcctgttccaaatgatgcgaaagtctgtggaaaataaggaaggggtggagccgtgccccaccccttcagttagtcattgccgcggttcgcggggttggtcatcagtcgacgacggcgccctggtggaaggtacgggagatgacgtcgagctgctgctccttggtgagcttgacgaagttcaccgcgtagccggagacgcgcacggtcaggtgcgggtacttttcggggtgctcgacggcgtcctccatggtctcgcggcgcagaacgttgatgttcgcgtggtagaggccgtggccgttgcccgcgtccaggatgccgaccaggttgccgatgcgctcggcttcatcgcggcccaggccatcgggggtgatggtgttggtcagcgagatgccgtcgagcgcgtcgttgtagtcgatcttgccgacggagaacatggacggcaacatgccgtgcgagtccatgccgttctccgggttggcgcccggggcgtacggggtgcccttcttgtggcgggacgggaaggaaccggtgttcttgccgtactccacgttggaggtgatggtcaggatggactgggtcgggacggcgccacggtagacgggcaggcgcttgacctggcccatcacggtggagacgacccacttggcgatgtcgtcggcgcggtcgtcgtcgttgccgtagaccgggaactcgccctcggtgcggtagccgacgaccagatcgtcgtcggcgccttcgacgtactcgtactcgtggccttcgaggttcttggcttccttgttggtgatcgggtacaccttggcgtacttgatggcggacagggagtcggcggcgatggacagaccggacatgccgcaaccgagggtgcggtacacctccttgtcgtgcagggccatctcgatggactcgtaggcgtacttatcgtgcatgtagtggatgatgttcagcgcttcgacgtaggtttcggacagccactcgagcgccttctcgtagttgttcttgaccttctcgtagtccaaggtgccgtcggcttccggggcgatcgggtcgatgacgcccttgtcgatgacctgcatgccggtcatctcgtcgcggccgccgttgatggcgtacagcagggccttggcggagttcactcgggcggcgaagaactgcatctgcttgcccacacgcatcggggagacgcagcaggcgatggcggcgtcatcgccccagtggttgcggatctccttgtcggactcgtactggatggcggaggtgtcgatggagatcttggcgcagaagcgcttgtagccttccggcagcttcggatcccagaagatggtgatgttcggctcggggccgggcccgaggtgttcgagggtcagcgtgttgagcagacggaaggaggtcttggtgaccagcggacggccgtcgtcgccgaaaccggcgtcggaccaggtcgcccagtacgggtcgccggagaagatgttgtcgtagtccttggtacgcaggaagcgcacgatgcgcagcttcatgacgatgttgtcgatgagctcctgggcgtcggtctcggtgatcttgccggccttgaggtcgcgctcgatgaagcagtcgaggaaggcggagttgcggccgaacgacatggcggcgccgtcctgggacttgatggaggccaggtagcccatgtaggtccactgcacggcttccttggcggtctgggccggacgggtcagatccaggccgtactcgttgccgagggtgatgagctgcttgagggccttgatctgctcgtcgtgctcctcgcggaagcggatccagtgctcgatctccggctcggtgaagtcgttgcggtacgggatggagtccttatcgcgcttcttgaaggcgatcagcttgttgacgccgtacagggcgacgcggcggtagtcgccgatgatgcggcctcggccgtaggcgtccggcaggccggtgaggatcttgttgtggcgggcgatcttgatggccttggtgtagacgccgaagacgccgtcgttgtgcgtcttgcggtacttggtgaagatcttcttgatctccggatcgggctccttgccggcttccttgatggcctgctcgaccatgcgccagccgccgttcggcatcatggcgcgcttgcagggcacgtcggtctgcaggccgacgatcacgtcgtcgatttccggagattcgatgtagccggccgggaaggcgtcgatgcctgccggggtgtgggtgtcaacgtcgtagacgcgctgcttgcgctccacggccagatagttgtcgtcgaggtacttccacagatgcttggtcttctcggtggcaggcgccaggaagctctcgtcgccctcgtacggggtgtagttcttctggatgaagtctcgaacgtcgatatccttctgccagttgccctcggtgaagccagcccacgccttggcgtcgagctcctcctgggagacagctgcattttccactgcggtcatgtcactccttacatggggttgtaggtttcgcatcctcacggaacccttggttcacaagtgtagttggcacttgcttgagaaaagccgaaattgggggtgagctatctcacattgtttttgcgaacgctaccattccaatggtttctaggtattgatgggactattgcacatctccagatatgggaaaccgctcatactgtgatgttcgtatgagctgtttgatgagcagctcggtcttgagcttgacagcagaaccgtatccgccagttttcgaccgtcaatcctcggggtgagcctgtgcgggtttcgcgccgtagttcttccagcgccggttctcctcctcccatctggcattgcggtccaccacgatgtcccacgcatgttcggcgtcttccttggtcttgtacggacccatgcgctgttcgaccggtgagaccatgcccagctcggcctgcttcttgacggtgttgaaataccactgcttcttgttatcgtctgtcattggtacctcctcaacggtattacttgctcccgctggcgggagcaatatatgtttattccctgaatgcgttggtgacgggcagtcggcggtcacgtccgaacgcgagggccgtgaccttgggacccagcgggtattggcggcgcttccattcagcgcggtccaccaatcgcatcacggtgtctacggtggcctggtcaaagccgtcggctaacaggtcggcacggccgtgcgcgtgctcgatgtatgcggcgagcaccttgtcgagcagcgcgtattcgggcagggagtcggagtccttctgcccggggcgcaactcggccgagggagccttctcgatggatgagaccggaatcatcacgccgtccttgagcgggacgccggtgttgccgtcctcgttgcccacgatcttgagcccaccgatgccgacgcccgcggccgcggccttgttacgccaacggctgatctcccagacgcgggtcttgagcaggtccttgatgggtgcgtaaccgcctaccgcatcgccgtagatggtcgagtagccgcaggcgagctctgacttgttgccggtggccacggcgagcagaccgcgcgaattggaactggccatcacgatcacaccgcggatgcgggcctgcaggttctcggcggagacaccatggagatcaagttgctgttggtaggcgttgaacaatggctcaatgggctgaacctcgtaatgggcgccaatgttggaggccaggtcagcggcgtcgtctttggaaccatcggaggagtacatggagggcatggagataccccagacgttctcgccgccgcatgcgtcggccgccatggcggctaccagtgcggagtcgatacctcctgagaggcccagcgtcacgccggtgaagtggttcttggccatgtagtccttgaggccgagcacgcaggcggtgtatacctcttcgtccgggtcgagttccggaacgatctcggccttggcctgatgttcggcggcggaatcgaagtcccagaacgtcaggttttccatgaacatcgggctgcgttcgataagcgtgccgtcggcgtcgaccacgaaactgccaccgtcgaagacgaggtcgtcttgaccgccgacctgattcaggtagatgaccggggcgttaacctcggcggcacgacgctgggcgagctcaaaacgggtgttggtcttgccttcctcatacggcgatccgttgatggtgagcagcaggtcgatgttcttggtggccaggtcggccaccgggccgccgtcctgccagatgtcctcgcagatggccacgccaatggtggcgccgtccacgtcgagggtcacggagcggtcgccggcggagaagatgcggaattcatcgaacacgccgtagttgggcaggaagtgcttgtcgtagccggcccagaccacgccctgatgcaagaccaccagtcggttgcgcggcttggaggtcttgcggtcggtgcccacggtgccgaccaccacgaacagatcgccgaggccgtcgtcgttgagctgggtggcgagttcgttggccttgtcccatgcggcttggcggaaggtgcggcgcagggccagatcctcgatggggtatccggtgagggtcatttccgagaagactaccacctgggcgtttcctgcggcggctttacgggagtagtcgagcaccttggcggcgttgacgtcaagcgcgccgacgcaggtgtcgatctgggcgagtgcgaagcgaagctgtgtcatagcttcttagtgtagccgcgtatggcgtcggattgcctgttcttccggcttggcgtcattcattaggtcgtttttgcgttcattaggtcactgcaatgcgatatcagtcgttgcaatggcgtgattccaacaaccagtatcaccgttcaccgacctaatggacgatgaatcgacctaatgaacgaatgtcactcccctcagtcagcttcgctgatagctcgtcctgcacttatggacgggcgaggcccgcgcatatctggttcggctgtcgcctcaccttcggctacagaggggagccagaaaaggatttacctcagctcgttgagcacgcgcagagcggcgttgacgtagaagttgacgaaggtgggaatggattcgtcgagacccacgaaatgcgggctatgccagtcggcgcaaccttcttggccgtttgacccgacgaacgcgaacaccggcaacgtcaccttggcgaattcgcagaagtcctcccccgccatcgactgacgtatcggttcgagctgcgcgtagtcgttgacatccgccgccacggccttggcaagacctggatcggagaccagcgggtcttgaaagtcatcccagaccacgtcggcgctgatgccgtatgcctcggcggtgtgttccaccacttccttgaatcggcggccgaccagattgccatccgacttgtggaaatagcgcacagtcccttggaatccggcttcggcgggcaccacgttccacacatggccgccgtgcacttcggtaacggacagcaccagcgggtggaagggcgtgacgttgcggctcacgatggtctgcaggctcagaataatactggagagcgcttcgatgggcccggtgcccttgtacgggtagccggcgtgggtgccttgggcgtggagggtcacgcggaatttcacgcagccggccatcatcggctcaacgccgatggccagctggcccggcgcatagttggggttgttgtgcgtgccgataatggcttcgacgtcatccacgagtccggcgtcgatcatggcgcgagcgccttggccggtctcctcactcggctggaacagaatcttgattgagccggcgaacttgtcacggtgttcggcgagccagaacgcggcgccgagcaggccggtcatgtgcaggtcatggccgcagccgtgcatcacgccttcattgacggagctgaactccagtccggagtcttccacgatgggcaggccgtcgatgtcggcgcgcagcccgatacgcggcccgggaccgtcctcgccctgaatgagccccacaacaccagtctccagcgggttgtgcaggatctcgatgccgtgcgccttgagctggtcggtcagatagatgctggtgtcgaattcacggaaactacgctccggatgggcgtgcaggtagtggcggatggtgatgagttcgtggtcaatgtcgatgtgttcgctcatggttctcgattctagtagcgcgaagaatatattgcggccctcgcttcatattggcgagggccgcgatctatggggtcagtatgccttgttattgctggcgtttgagcagtcgtttggcgatggcgttggcgatgccctgcaccacctggaccagtacgatcatgatgatcacggccgtccaggtgacggtctggtcgaacttctggtagccgtaggcgatggcgaagttaccgagaccgccaccgccgatgtagccggccatggcagacatgtcgagcacgccgatgaacaggaaggcgtaggccaggatcagcggtgccagggcttcggggatgagcacagtgcggatgatggtgagcttgccggcgcccatcgaacgcgcggcctcgattactcccgggtcgaccggcacgagattctgttcgaccagacgagaagtggcgaaagtgcacatgaccgccatcgggaagatggcggccacggtgccgatggaggtgccgaccacgacgatggtgaggggctgcatggctgccaggaaaatgatgaacggaatcgggcgcacgatgttgacgatgatgtcaaggatgcggtagacgaccgcgttctcgaacaggttaccggggcgggtgccgtagagcaccactccgaggatcagaccgaggaatccgccgatcacgagggtgatgagcaccatggtcagggtctggccgatggattcgaacaggagcgggcgcaacacgttccagtcgctgcgggggttggcgaggatgatcatgcgttgtctccttcatgtgcggcggcggatacaccgggcgcggtggatgcagaggcagtatcggccgccagcgggtcatgggatcggtcttcggcgtaggtggcatgtccagcgaccgcgtcggcgtacgccacaggctttgcggcggtgccgaagtcgatgacgtcgctattgacggcgagctcgcgcaggaattcgtccacatgccagccgggcccgttgaattcgtaggtgatggccccgatggcggcacctttgaccgtgtcgataccgccgtagagcaggctggattcaacgccgtatttggcgatgagttcggagatattctgtccggatgccttgagttcatggccttgggtgccggaaacgtccttttgtcggataagcacggtgacaatgcggcccgaccattcgtgatgcaatcgctcgacccgatcttcctcgggcaggccggacaatgcggtggcgatgaatcgcttggtcaccggctgctggggtgcagcgaacacgtcgtatacgtcgccggattcgaccacgcgtccggcgctcattacggccacacggccggcaatctgctggaccacgttcatctgatgggtgataagcacaatggtgatgccgaattcctcgttcacacgcttgagcaaggccagcacttcggtggtggtttccgggtcgagcgcgctggtggcttcgtcggcgagcagaatctccggattagtggccagtgcgcgggcgatgccgacgcgctgcttctggccgccggacagctgcgaagggtatttgtttgcgtgctcactgaggcccacgaattcaaggagttcgttgacacgacgatcctgatagtccttgcgccagtgatcgagttgcagtgggtaggcgatgttctgggccacggttttggtggagaacaggttgaactgctggaaaatcatgccgattttctgacggatgggtcgcagcttggtctcactcaaagaggtgatatcggtaccgagcacggtcacagtgccggaggtgggtcgttcgagcgcgttgataagccggaccagtgtggatttgccggcaccggaatagccgatgatgccgaagatgtcgccgcgatcgatggtcaggctgacgtcatccacggctcgtgcgatgttcgcgccgcgtccgcgtgttctgaattccttcacgacatggtcgaaggtgatgatggggtcgctcatagtgctccctgatgctggttgttggtgtccggtcacggaagcggagcgaatcccgatgttggctcgggtactcgctccgcttggtggtaatggctatggataggttagtcgtacgctcgtatcagccacggctcactgctgggccttggcatccttctcgatgtcggacaggaagccttgcagctcgctggcgctgaacttgtcggcgaagaccgcggtaccgccggagttctcctgcagggcgtcgagcacgtccttctgctggaagatggagacgagcttcttgtaggtctcattgttcacgtccgccttgcgggccacccacacgttgatgtaggggcgggcttcttcggattcggcgttgtcctggtagatggcgtccttcgggttgagtccggcgtcggccacgtagtcgttgttgatcacgccggccgcgatggtcgggtctttcagagtggtggccacctgttccgccttcaacggggtgaccttgaccttgctcttggcttcatcgatgtcggccggggtggagaaggcggtccagtcgcccttgagcgtcacgagaccggcggccttgagtacgccgatggcgcgggcctggttggtttcgtcgttcgggatggtgacggtgtcgccctgcttcaggtccttgatgtccttgaccttggtggagtacacgccgagcgggtagatggcggtgccgccgatgggctgcaggtccttcttgttgctcacgttgtagttggccaggtaaagcaggtgctggaattcgttgaggtccagctcgccggagtcgagggccgggttttcggaggtgtagtcctggaagtcgacgatgtcgacgtagatgccggccttctcggcgttctgcttgaacttgacccattcggggttggtggcaccgaccacgccgatcttgaccgggttacccttgctgcccttggcggacgactcgttggcaccggcaaacgcgcggtagccgaagaacgcggccacggcgataatcgccacgaccacgatggtgatgattacgttgcgggcggtgtggttcacacgcaccggctcgttattgttaggagcggccggggttgccggctgggttgctgctgtcattggatttcctctctccaaaattgatgtcgggtaacaccataacgcgcttgaaccgcgaaagtgtcgaaaaatggccgattgccgtataagtgtcttttatggcgcgcatgcaatggccgggattcgtgcgtttggcggccgggcggcacagccggtgccgatatgcgaacagggcccgggacggatcccgggccctgtttcgtcagcggtctaacgacaccgtggaggtgttatcactcgttgtcgccagcggtagcggcggtagcggtgacggcacccttcttgccggtgttcacgccggagtacacccagtcggtgtagtccgggtggtcgtagcccttgtcgacggcgaactggaaggcctcatcacggaacttctcgagctcgtcgatcttgtcggcgtacttgtcggcgtcgatcatgcgcagagcctcagcggtcagctcgtagcggtcgatgcggttgacacgaaccatgtcgtacggggtggtggtggagccctcctcctcgtagccgtggacgttgaagttgtcgtggttcggacgatcgtagatcagaccgcgcacgtcgtgggcgtaggagtggtacgcgaacagcaccggcttgtcggcggtgaagatgtcggcgaactcctcgttggacagggcctcgtcgttctccttggcggactgcagggagagcaggtcgacaacgttcacgaccttgaacttgatgcccagttccttcagcttgtcggaagcggccatgatctcctgggtggggacgtcgccggcggcggcaagcacgatctcggcttcatcgttggtcttggcggtggaggcccagtcccaagcggcggcacccttctcgagctcggcgcgagcctcgtccagggtcagccaggtggcggcgggctgcttgccggcgatgatggcgttgatcttgttggtggacttgtagcacttctcggcgatggccagcagcatgttcgcgtcggtggcgaagtagatgccgatgacgtggtcgttgtggaagcacttgttcagcaggacggaggtgacacccggatcctggtgggagaagccgttgtggtcctgacgccagacgtgggaggagaccagcaggttcatggaggcgatcggcttgcgccacggaatctcgcggacggtagcctcaagccacttggcgtgctggttcagcatggagtcgatcacgtggacgaaggactcgtaggagctccagatgccgtgacggccggtcagcaggtaggcctcgaggaagccttccatctggtgctcggacagctgctcgacgacctggccggagacgcgcatgtgctcgtcgacctcgtcggagatgtagccggcatcccactgcttgttggtgacttcgtaggaagcctgcagacggttggaagcggtctcatccggtccgaagatgcggaagtcacgcgggttgttcttgatgatgtcgcgggtgtaggcgcccagggagcgggtggcctcgagctggccccagccgtggccgaactcggccacttccttgacctcgtagtcctcgaggttcggcagcttcaggtcgtcgcggatcacaccgccgttggcgttcgggttggcaccgatacgcagctcgcccttcggcatgaaggcgaggacgtcgtccttgacggcgccgttggcgtcgaacagctcttccggcttgtaggactcgagccagttcttgaggacctcgaagtgggcctcggtgtcgcgggcggaggccagcggcacctggtgggaacgccaggagccttcggtcttcttgccgtcgatgtacttcgggcaggtccagcccttcggggtgcggaagatcagcatcgggtagaacggacggtgcacgttgtcggtctgagcggtggccttgatgtcgcagatctcgtcccagatggtctcccacagctcggcgaagcggcggtggatggacatgtggtcctcatcatcgaagccagcgacgaactcgtagggctcgtaacccatgccgtggaagaactcgtggagctcttcgtcggagatgcgggacaggatggtcgggttggcgatcttgtagccgttgaggtgcaggatcggcagcacgataccgtcggtgcgcgggttcacgagcttgttggactgccaaccggtagccagcgggccggtctcagcctcgccgtcgccgacgatggccgggacgaacaggctcgggttgtccatgatggcgccgtaagcgtgggacagagcgtaacccagctcaccaccctcgtggatggagcccggggtctccggagcgaagtgggacggaataccgcccgggtaagagaactgacggaagaacttctgcagaccagcttcgtccttggtgatcttcgggaaggtctcggtgtaggtgccgtccaggtaggactgggaggtaccggccgggccaccgtggcccgggcccatgatgatcacggtgttctggccgtggtcagcaatgaaacggttgatgtggccgatgaggaagttcaggccaggggtagtgccccagtggcccaccagacgatgcttcacatcttcgcgggtgaagggctccttcatcagcgggttggaacgcagataaatctggccgatggaaaggtagttggcaacgcgccagtacttgtcaacgccttcgagggcttcctcggaaaccggagcgctgagcttcttccaaggggtgccaataacaggactcgtcatgtgtactcctgtactcctgcacgtaatcgtgcgattgattatttctgttcggtcacggtccctgacccttgcggtgccaaggttttccgttcccagtcaatcgtcatggtacgaggacaacgcgacttttgaacgatttcttgcgggtgtgttcgaaattgttgcggaaatttcagtatttgtgcggttcaactgaccgtttgtcaacattagttttttcaacatactttttcaaaacggcggaagcatgcggaaatccattatctggctagaacagcgcacgttcgatttcccatgtttgaaatcggcgtgttgtccgactacaggcatgtagtttgttcgatttacgcacatggtttctgcgtgtcggccttgtcgccttgaccagtgataatcagtggtgttcagcccacgtaaaattccaatgaacgttaggggaatatcaatggcaaacggtcctgtgcttgtcgtcgacttcggcgcccagtacgcccagctcatcgcccgccgcgtgcgcgaagcaggcgtgtactccgagctggtccctcattccatgccggttgacgagatcctggccaaggatccgaaggcgattattctgtccggcggcccggcctctgtgttcgagcccggcgcgccgaccatagatactaaggtattcgaatccggtgttcctgtgcttggtatctgttacggcttccaggtcatggcctatgagctcggcggcaaggtggataaggccgctctcggcgaatacggcaagacctcagccaccatcgatgacgccgacggcatcctcgccgactcccccgccgagcagaccacgtggatgagccacggtgtggcggtcgaacaggccccggccggcttcgaagtgctggcccacaccgaaggcgcgcccgtggccgccatggcggacgaatcccgcaagctctatggtgtgcagtggcacccggaagtcaagcactccccgcttggccagaagcttatcgaaaacttcctgcaccgttgcgccgcgctgcccaacgactgggatgcctcctcgattatcgaggatcaagtcaagaagatccgcgagaaggtcggcgacgccgaggtgatctgcggcctgtccggcggcgtggactccgccgtggccgccgctctggtgcacaaggccatcggcgaccagctcacctgcgtgttcgtggaccacggcctgctgcgtaagggcgaggtcgagcaggtcaagcacgacttcgttgccgccaccggcatcaagctcatcaccgtggacgcggccgacgacttccttgaggccctgaagggagtctccgagccggagcgcaagcgcaagatcatcggtgagaagttcatccgcacgttcgagaaggcccagcgccaagtgcttgaagaggccggcgcgcgcggcaaggaagtcaagttcctcgtgcagggcaccctctaccccgacgtcgtcgaatccggcggcggcgacggcgcggccaacatcaagtcccaccacaacgtcggcggcctgcccaaggacatcaagttccagctcatcgaaccgctgcgcactctgttcaaggatgaggtgcgcgccatcggcaccgagctcggtctgcccgacgaaatcgtctggcgtcagcctttcccgggcccgggtctgggcatccgcatcatcggcgagatcaccaaggagcgcctcgacctgctgcgcgaggccgacgccatcgcccgcgaggagctctccaaggccggtctcgaccgcgacatctggcagtgcccggtcgtgctgctcgccgacgttcactcggtgggcgtccagggtgacgagcgcacctacggctcccccatcgtgctgcgcccggtgagctcggaagacgccatgaccgccgactggtctcgcgtgccctacgacgtgctcgccacgatctccacgcgcatcaccaacgagtgccgccagatcaaccgcgtcgtcctcgattgcacgagcaagccgccggccacaattgaatgggagtaattgctctctgtgacgaatgggattctccatcggggaatcccttttttgttgccgacgatgcccggtataatttttccgcttacgacgtcgtccggaaagggatgccgacctctttgcgccagggattcgacaacgaaaaatacatcgaactgcaagccgccaacatctcaacagcgtgaaccgacgcttgcactcggatgaaacgctgattgcattgtcaatcaccagcgccaccagtcctgtggccgctcgcgtcatcgacgggctcaaacagttgcagggctgcgacgcctttttctccgttatcatctcatccacggacgaggcgctgtatcgcaaactcggcatcaacgtgtgctgcgaaccgaagtacgaacgggtgagtctgtatcaccggtaaacgccaccgataagcgcggtatgccgcgaatcgtcaagccggtaatcatgcagcatgcggcctgacgattcgctgctgtcgcattgtctctcccctctaccatgctgggcttgttttccgtttgttggagagaacgggggatgccatcagcactacggtgagagaaggattatccgtgaagcggttcgtgggtctagacggtattaaaggactggcgctgctggccatcgtgctctatcactgcatgcagcagcgtctgccgggcggattctacggcgtggacgtgttcttcaccgtctcgggattcctgaccgccacaagcctcatacggtccctgaacacgaccggaacgctcaacctcgtgcgattcatccccaagcgggcggtgcgcctctaccccgcgttgctcctgctgatcccggtcatcgtcagcgccggctggctgttcgatcacgatatgctggtgtccatccgcgatcaggtcatcaccgtgctgctgggctgctacaactggtacgccatcggcacgggacaaagttacttcgaccagatgaatccgcaggtgttccgtcatctgtggttcatcggcgtgcttatgcagttctacgtgatcgtgccgttcatcgtatggctgatgtggcggattcggcgcacgcggtatgcctcactggtccctttgtcgctggcggcggccagcggccttgccatgggactgatgtatacgcccaagggcgatcccacccgcgtctacttcggcaccgatacgcacggcatgggtctgatgctgggcgtcgccctcgcctggtgggtcaccgtggccccgctgggcaacgccgaccaggagcccgaaccgacgccccgcatcatcagttcgggtgatttccccgtcgcacgtgagacgccgacgcctcacgttccggcatggaggcgcctatgggacgcggcggcaccctcgatggcgttcatcagcctgatcgccttggtgagcatgacggtcgtgggcaggcaggacgccttcgccttccgcgggggcatcatgctgtccagcctgctgtccgtgctgctgatcgccggcaccatcgccgatgactcctggatgcaaagccttatggtgttcaagccgctggccgcactcggccggtattcatacggcatctatctgtggcattggccgttgtggatcctctccaccgccctcgccccgaagctcttccggtccgccgccccctggcccctcgccatggccgcgctgctcaccgtcgccatggtgacgctctcctggcagatggtggagaagccggcggcgctctcgccgctgtccatcgtgctgcccccgcacatgcggccgccgccgggccgtgcaggtcatcgtcttcgacctcattgcggcgctctcgctggtcggctgcgtgcagggcatcgtccatgcgccggcgaagaccgccatgcagattcagttggagcaacaggccgcgcaactggagcgcctgcagaagaccgaacatgtgctgctgcgccgcaacgtgccggcaccgcccaagcccacgcatacgatgcccaccggagaccggatcaccgccataggcgattcggtgatgctcgcctcctcacaagggttgtcggcagtgtttcccggcatacagatcgacgcgagtgtgtcacgatccatcatggccgcgcccgagctcatcgacgatgatctcgccgccgggagcctacggcaatgggtgctggtgggactggccaccaactcgcagatcagcgccgatcagcttgaccgcattctcgccatgatcgggcgggaccgtgtgctggtgctggtcaacgcgcatgctgatcgcgcatgggtcccgcccaccaaccagacgctggccgactatgcggccgcacatccgagcaacgtggtgctggtggactgggatgccacggccaacgcgaacacgcaggtcttcggccccgacggcatccatccgagcctggacagcgatatctacgcgaaagccgtcgaacagacgatccgtcaatgggtcgcaagcggcaggtgaacggcaggcaacgctgagttgtccaaccggtcgtgaagaacggctatgctgaagactgcatcaacgagaccacacgttgggagacatggtgagcgcaatccttgaagggaagcccgataagaatcttattctcgttacgggaaggattcatccgaagttggctgaggatgtcgccgagcagctcggcatcgacgtccttgaaaccaccgcatacgatttcgccaacggcgagatgtacgtgcgctacaccgaatcggtgcgtggcgccgatgtgttcgtgctgcaaagccattacaagcccatcaacaaggcgatcatggagcagctcatcatgatcgacgcgctgaagcgcgcctcggcccgttccattactgcggtctgcccgttgctcggctactcccgtcaggacaagaagcaccgcggccgcgagcccatctcctgccgtctggtgttcgacctgctgaagaccgccggtgccgaccgcatcatgtcggtcgatctgcatgccgcgcagtcccaaggcttcttcgacggcccggtcgatcatctggtggccatgccggtgctggtcgactacatccgtgatcgtttccaggaccatctcgacaacgtcgccgtcgtctcccccgacgccggccgcattcgcgtagccgagcagtgggcgcagcgtctcggcggcggtcctctcgctttcgtgcacaagacgcgcgacatcacccgcccgaaccaggcggtcgccaaccgtgtggtcggcgacgtcgccggcaaggactgcgtgcttgtcgatgacctgatcgacaccgcgggtaccatcgcgggcgcatgccacgtgctgcaggacgcgggagccaagtcggtgaccgtggtcgccacgcatggcgtgctctccggcccggccatcgagcgactcaagaactgcggtgcgcgcgaggtcgtgctgaccgacaccgtgccgattcccgaggaaaagcgctgggatggcttgaccgtcctgtcgatcgccccgctgctggccagcgccatccgcgccgtattcgaggacggctcggtcgccgaactgttcgacacctaccccgagcaccacggtcaaggcttcctgttcgcctgattacgtgcgtgtttgttcgcggaaagcacacaatgcgagacgcgacatggcgtagtctttcggtaaataccgacagtatgatataaatgaacacttgtgggccgaaagcccacgactcccccatggtgtaatggcagcacacgggtctttggaaccctttgtcttggttcgagtccaggtgggggaacggctgacggccgctcgacatccgggcggccgtctattgttttgaggtgtttccgccctcaatagacattccaatcgaagggaatacgtcagttatggcattatccgcagccatcgtcctcgccgccggcgagggtacccgcatgcgttccaacaagccgaaggtgctgcatacttttgcaggcaagaccttcctgaacagggtcatggattcggtggccgccctgaatcccgacacgctggccgtggtcgtgcacttccaggccgagcgcgtcgccgaagccgcccgctcctatgacgagcaggtcaccatcgtgaaccaggacgacatccccggcaccggccgcgccgtccagtgcgcgatggcccagctcaccgaatccggcaagatcgacggcccggtgctcatcgccgcctccgacatgccgctgctcgacagcgagacgctgcaccgcctggtcgaattccacaccgcctccggcaatggcgccaccgtgctcaccaccatcctcgacgacccgaccggttatggccgcatcatccgcgaccgcgaaggcaacgtgctgcgcatcgtcgagcagaaggacgccaaccgcagcgaactcgccgtgcaggaggtgaacacctcggtctacgtgttcgaggcctccgtgctcgccgaggcgatcgccggactgaagtcgaacaacgcgcagggcgagttctacctgaccgacgcactggaaaccgccaagtcggccggcaaggtcggcgcgttcgccgccccggacccgctcaccgtcgagggcgtgaacgaccgcgtgcagctggccgccctgtccaagacctacaaccgccgcgtctgcgaacgctggatgcgcaatggcgtgaccattctcgatccggagaccacctggatcgaggacgacgtgcggatcggccgtgacgccaccatcctgcccggctccttcctgcaaggccatacggtgatcggcgaggacgccgtcgtcggcccgtacaccacccttatcgacgcgaccgtggacgagggtgcggtggtcgaacgttcccgtgtgcaggaatcgcatatcggggcgcgcacgaacatcggaccgtggacctacctgcgtgtgggcaacgagttcggcgaggacgccaaggccggcgcattcgtcgagatgaagaagacgcacatcggcaacggcaccaaagtgccgcacctgagctatgtgggcgacgcccggctcggcgaccacaccaacatcggcggcggcaccatcaccgccaactacgatggcgtgcacaagaaccgcaccgtgatcggcgacggctgccatgtgggcgccggcaacctgttcgtggccccggtcgaggtcggcgacaacgtgaccaccggcgccggctccgtggtgcgccacgccgtgccggacgacacgatggtctactccgagaacacgcagcacaacgtcgagggctggaagcccgcctgggagcgctgaaccatgcccgcacttcaggattccatcaacgccgtccgcgtggccgccgaggccgcagaccgtctcaaggccaccgatatcgtggccttcgacgtggccgacctgctcggcatcaccgacatcatgatgatcgccggtgcctccaacgagcgccaggtgctggccgtggccgaggaaatcgaaaaggacctttacctcaagtgctccggacgccagccgcgctcgcgcgagggcctgaccgaaggccagtgggtgctgctcgactacggcgatttcgtgattcatgtcatgcacgaggaatcacgcgaattctacgggctcgaacgactctggcgcgactgcccggccatcgatcttgaactcgcacacccggaaacggcggagcatgcggacgttgctgccgtcaccaccgcgtaacgtgcgaatcacataacgctgatatacgctgatattcgcgtgtcgggctgcctgttgccgaacgtcattgacggggccaggcagccctccccttttcctgtttcctcactggaaccgaaaggatcgtcactatgaccaatcatgttcgttccatttttcttattcgtcatggacgcacttcctataacgccgcccacaagctccaaggccaggtcgatattccgctggacgccgtgggtgaatggcaggtcaagcagaccgccacggccttgaaaagcctgtacgtcgatcgtcggccggaaatcgacaatcgattcattgtctgctccgatttgaagcgtgcgcacgccaccgcgcaggctttcgccgacgtattgggtggaatcgagcccgtcgatgatcctcgcattcgtgaacgcagcttcggggattgggatggccttgccgtggctgaactggccgaacgctaccctgaggacttccgttcctggatggagtctcggggcggtgaactgaagtatggtgccgaacccaaggaagccgtaggcaaacgcggtatggaggctcttgaggactggtccacgcgtgccggagacgacacggacctgttcgtgttctcgcacggcgcatggatcgcgcagacattgcagaccctgttgggcatttccgcgatcgatccgaccttctccacggtggtctcattgcgcaatgcgcactgggtgtgcttggtgccgatggacaatcctgatggcactgtgcgctggcgtctgctggactacaatcacggtccggccatcgccgacaccgacgagtgggagcgcgaacgctgatcgcgtcacggctcccctgctgatccaacaggtccggtgtattcggaaccgttcaagcaataactgaatgactcaatgtctgaataatggcggaaacaagccaaaaagtgtcgccaaatcacacttctgtcatttggcgacacgccgagtgttgccggaatcggcatcccggcgtaatgtatacgaggtccgaacgacgggccaacaattaaagaacggggctatagcgcagctggtagcgcatctccatggcatggagagggtcgggggttcgaatccccctagctccacgatgaagccgtcaggttgcatgatgtgatggtttctccgctggttcgtggtgggtatctcgactcccatgaatcggatagcttcactcggggctatagcgcagctggtagcgcatctccatggcatggagagggtcgggggttcgaatccccctagctccacaatcaaggccggtgcttcacgcaccggccttttgcgtctcccccaccacgacactgcgtgaacggtaacggtgatcgccactacaatgaatgatggtccctatcatgctgatatcaaaggagacatcgtgaccgtcacccgtgtatacatcgccagccccgaaggcgccaatggacgcaacgtcgtcgcctatggcgtgctcaatgcgttgacctccaaatacaagaccatggtgttccggccggccgtgtcgaaccatgacgaattcacccccatcctgctcgccgcctccaatgcggggctcggcgtgtccctgtccaccggcctcgacgtgcataaggtgcgcgccgacaaggacaccgcccgcggagacatcgtcggcgagttcaactacgccatggaggtctcccgcgcgaacgccgccctgatcgtcggcaccgacaaatcccacgtcaacgacccgaccacctacgagttcaacgcggacgtcgccgccgatctgaaggccggggtgttcctggccgtgtgcaccatggaccgatggccgcacgagctcgacgaaaccgtgcaactgtccatcgagggcatgcgcgccgcgggcaatacggtgctcggcatcttcgtgaccggctgcgagccgcgccacgccttctccgtcaaagagaccctcgccaaatacggcctgccggtctggaccctgccgcaggtgcccttcaccgacgaatccaccaaggatctggcccttgagaccttccgcaagcacgctcccatcgacgaggtgctcgccgcgctcgatgtggacgtcaccgcgccggtcacgccatacgccttccaattcgacctgctcggcaaggccaagagcaacaagaagaccatcgtgctgcccgaaggcgaggaggaccgcatcatcaaggcggccgattacctgctcgaacgtgagaccgtgaacctcatcatcgtgggcgacaaggacgccatcctggcccgcggcagggaactggggctgaacagtctggggcgcgcccgattccaggccatggacgacgagaacgtgctcaagccgatggtggccaaactgtgcgagttgcgcgccaagaagggcatgaccgaggagcaggcccgcaagcaactgaccgacgccggctacttcggcaccatgctggtggtgctcggctatgccgacggactggtttcgggttccgtgcattccaccgccaacaccgtgcgccccgccctgcaggtcatcaagaccaagccgggccagaaactggtctcgggcgcgttcctcatgtgcttcaaggaccatgtggccgtgttcgccgactgcgccatcaatctcaacccggacgccgagcagctttccgagatcgcgctgcagtccgccgagaccgcccgcgccttcggcatcgacccgaaggtcggcatgctctcctactccaccctcggctcgggcaagggcccggacgtggatctggtggaggaggccaccaagctgctcaaggagaaggcgcccgatctgccggtggtcggtcccatccagttcgacgccgcctggtcgcccaccgtggccgccaccaaggccaagggcaacgacgtagccggacatgtcaacgtgttcgtcttcccagacctgtgcgccggcaacatcggctacaaggccgtgcaacgctcctccggcgccctggccatcggcccggtgctgcaggggctcaacaagccggtgaacgacctgtcgcgcggcgcactggtgcaggacatcatcaacaccatcgccctcaccgccatcgaagcgcagtgagcccggcttagctcccgccagagggagctgtcacgcacagcgtgactgagggtggtcaggcgcgaagcagaaccaccctcagtcggcttcgccgccagctcccgccagcgggagccactgtaatgcttattttgtagcaagcaacgagtaatctagtcaacggtaacccgtgtctcacgggaacattcaatcacaatggaggatgcccacaatggcgaaaaccgtccttgtcatcaattccggctccagctcgatcaagtaccagctggttgatcttgaatccggcgaaggcctcgcttccggtcttgtcgagaagatcggcgaaccggtcgacggccactacaagcacgagtacaacggcgaaaagcatgagcttgaagagccgattcacgaccacgagcagggtctcaagcgcgtgctcggcttcttcgaggagtacggcccgaagctgtccgaggccggcatcgtcgccgtcggccaccgcgtggtgcagggtggctccatcttcccgaacccggccctcgtgaccgacaagaccattaaccaggtcaaggatctggccgtgctcgccccgctgcacaacggcccggaggccaagggcgccgaggtcatgcgttccctgctgccggatgttccgcagatcttcgtgttcgactcctccttcttcttccagctgccgaaggccgccagcacctacgcgctgaacaaggagatcgccgaccagtaccacatccgccgctacggcgcccacggcacctcccacgaatacatctcctccgtggtgccgggcgtcatcggcaagccggccgaaggcctcaagcagatcgtcctgcacatcggcaacggcgcctccgcctccgccgagatctccggcaagccggtcgagacctccatgggcctgaccccgcttgagggcctgatgatgggcggccgcaccggcgacatcgacccggccgtggtcttccacctgatccgcaacgcccacatgaacgtggacgagctcgacgccctgttcaacaagcgttccggcatgatgggcatgaccggctacggcgacctgcgcgaggtccaccgtctggtgtccgagggcaacgaggacgccaagctggccctcgatgtctacgtgcaccgtatcgtcagctacatcggcaactacacctaccagatgggcggctgcgatgtgatcaccttcaccgccggtgtgggcgagaacgacgatgtggtccgcaagatggtgtgcgacaagctcgctccgttcggcgtcaagctggacgaggcgaagaacgccgtgcgctccaaggagccgcgcatcatctccaccccggactcctccgtggtcatcgccgtgattccgacgaacgaggagctggccatcgcccgcaagtccgccgcgatcgccgaagccggcaccgacacctacggcaacaccttcgccaagtaagtaaccgccgttaggcatctcactaatctctagttgcaacactatgggggctgactccgattggaatcagccccccattcgtatatggtcatgagaccactacccctgcgtcatactcccctcagtccgcgtagcggactgaggggagttccaccagaacacaggaccccttactgcctcagcatgccgctccacataccgacgaaatcaggcaaggtcttgcgcgtggtggccacgttgatgacctcgatatcgggaatacgcagccccagcatcgcggcgaacgtggccatacggtgatcagcataggtttccatcacggcaccgtgcaacgtctccgccggcaccggttcgatacgcaatccatcaggcaattcctcagccgctcccccaacacgacgaatctcgttgaccaatgcctccagacgattcgtttcgtggccgcgcaagtgaccaataccaaccatgtctgtcgacttatcagcaaacatcagaatcgccgccaacgagggcgcaatctctccggccgccgtcaaatcgaacgtacccagcccacgcacgatgccgtcaccggtcacctcgcaatagcgcacgccatcgattgtcgggaacgatactttggcacctatctgttccagatagcccggcaacaaaccacccggctgggtggtggtctcaggccaatgaggcacccggaccgtgccgccggcgatcaatgccgcgccgaggaatggcgccgcgttcgacaggtcgggctcaacggtcaccttgctcggcagttgcattgcgcacggttcaaccgtccatgtgcgggcggattcatcggcctcaaccgctccgccagcaccggtcacatcagccacagtcatgcgaatgtgcggcagactcggggtcttctcccccgtgtgcgtgaggtgcagaccgccaggcagtttggaactaatcagcagcaggccggagatgaactgggaagaaccggacgaatcgatgctgacatgcgcctgggcagccggcaaggttgcaggcggcgtaatagtgaacggcagacggccaatctcgccgtgataatcaaccgttgcacccagctgttccaaaccgtcaagcaccggcttcatcgggcgtgcataagcctgttcgtcgccatcaaaattcactgggccatctgcaaacagggcaaggccgggcacgaaacgcatcaccgtgccggccagtccgcagaacacattgacgttgccatggaatcggccggatacgggaggagtaaccgttacggtggtgtcggttgcggaatccacgtcgcagcggacaccgagggcttcgagggcgttcatcataaggtccgtgtcgcgcgaacgcagcaggccaatcagagtaacgggcttgctgccgagggcggcgagaatcaggtagcggttggatagggacttgctgcccggcaccgttaccgtagcgttcaacggctgtgtggcgagcggggcaggccagagattcgtaagttgttcaggcataaggccaaatctatcagtatttggaggctccagagcgtccgctgtcattcatttggtcgatttgtcgttcattaggtaggtcagcctccgcacccacctttgaaatggcgcgattccaacatggcgtaggacaccgaacctaccaaatgaacgataaatcgacctaatgaacgagatatctatcaacggtcggcggcgatgcgggattcgatctgctggtcgggctcgtcatgcggctgttcgaaaccgccttcgatggcctgcgcgtgcagcagctgggcggccacacgatcggcttcgatggcggcgatctggcgcgaaaacacgatgaaccagccgaggaaggccatgccggccaacgcctccacattggtcagggtgttgtggcccaacatcatattggcccagaacgcggcgcacacgagcgcggtcaggtcggaagccaccatcacggctttggagaggcgcggcgccagccacggcaggagtccgaacagcagcagcatgacggccggcagtcccttggcgcacacattgtgcaggatatggtgcggcgtgtatcggaagacgccgatgccgataaacgctaggccggacaccgtcagcaggagggacagcacggcgatgcgtgccgcgaaatgcgggatctcatagccgcggttcgggtcgcttttggtgcggtcatgccatagacgctgcaaccgttcggtggccaccagttcggagatggcgaagtagctgacgatgatgatgcacgagccggcaagaatcagcgtggagttgaacatgcgtgccgcgaacgtggagcggtcgccaagctgggagaaattgttgagataccagtacggatcatcggtggtcatgccggcggtggccacgccggagacgacgaagaacggcaacaggccggcgatggtcttggcgttcatcatctccgcctgcacgaaggtcatgtatcccaccacgccggcgaacgccgcgcagacgctggagatgtatccggagaagatggcattgcccatcatgtcgttggccacgccgacgagtgcgaacgacgacaggaaaatggtcgcggcatacaccacggacagggacgcgatctcgaagacgcggcggatcggcgcgaaccaaccgtgcctgaggttcagggagcgggacttgcgcccatagccgatgatgaaggagaagacgccgcataacgccacgatgcccgcgcacaccatgaatcggcgttgcgtcagctgccagatgggcggagcgtattccatgtacaggttcattgagatggcgccgatgacggcgcaaaccaagaaggagaccagacccgaagtctccgcacgttgatgacgtcccatgcgcggccccctgctcactcgttcgcatgcattcctcgcaccaccatacatacaaggcgctaccgccgtgtcggcgtagccgggtgcgatgatcgtcagtccgaggcggattcgttacggacgtcacctcgggcggacccttcggcgtgtcgcccggcaatccagccattgttgttctgcataagacagaagaaggcaaaagcgggtaaccccaccaacgaacagtcaatccatggacaatacgttgacagggcacccgcctaccgtcggtgaaaggcgttagatggtccgacgccgtctggtgatgattagaatcgccacagcaaccgccaagaagaccactacggccccgccgatcatcatgacgtccacaccaaacagcgaaaggcctaatgttaaaagtcgaagataggagttcattccagcaagtccatcctctacgtaggcttccgaccatacaattggaaacaatggtttgtcactttgaaggagaaagtcatggccaaaatcgatgccgatgcgatgtcccacagaacattggagaccgttgctgcgctggcgaaattgcctgtagttcgcgttaatcgtgaagcattcctcagaaaacagttcaaggattccgaatacttgaaccagattctgcaggatggtccgcaaagcgtgtacacacctgagtcactgaggaaaaagacagataagattatcgccgccagcgcgactgcgacttcgctgacctcgtttgctgcaggattacccagcaatcccacagtcatggctgctgctgggggtgcagatgtcgtccagtacttcggctttgcactcaatatggctcagcaacttgcttatctgttcggcgatgatgaattattctccgacaatatggataacctctcggagcaaactcaaaatagaatcattgcataccttgctgcaatgctcggagtcagtggatccgcaactctcgtgcttctcgtatcaaagaaggcaggaggaaccatcggcaagaaagtcgcagccaaggccctaacaaaaacggtctggtacccgttgctgaagaaagtgacagcggctgtaggcgtcagaatcaccaaacaaactgtagggaaagtagttaccaaggccgttcccgtcatcggtggagtcgtctccggtggcatcacttatgtcaccttcaaaccaatgggcaaaaggttcgcggacatgcttgtcaaacgtgccaagggcgagttgaccgatgatgatgggctggaactgaatccagagttcaaggaaaggctcaggaacgagcgatccgagattgaaaccattgacgatgaagatgtcattgtagagattcaggaagagggctcctccacctctgccacccagatcaacgaatcctgatttgggaaaacggcggggagggatttggccaatacttcggggtagccgaacgccagaccagtaggataccgttcccagacctgttaccaatccgaactcttgaacgggacggcggtcggtttgagggccggagagcctttgaccttctgccttgcccatgcaaggcttttgtcgcttttgagttggttgcagcagcgatgcaccttctcaaggttgcgcagatcagtcgcgcttccgccgtgactcactggaatgatttcgtcaacttcgacgctcattggatcgagccatgcgatcgcgtcgtctatcggcctgtcgcagatggcacagggcacttgttgcgcgagcacccgctgtctggcgagattgcgggcctagcggttgatgcgccgtggatccctgtagttcctaccgtggggcatgttggtcggcctacgagtgaagggtgccgtgatgcctgtatcgcaagcggaatcttcaattatgcgtgaggcttggcggccttcacggcactcgtgggtatgaatatgccccaccagagaaaggagcaaagccggcggggcggggaaagtcttggaagattgccttggtgttccctgcattgaacgacaacactatcattttcgccgcgttgcatttcccatgcaagcccccacagggccttgcgtctaccagatattcgatatggcggaatccgttaccgaaggtaacggtatcctcggtcttcctgttacagccggaaatcattgttggcgttggcttcctagccccttatgtattcctctgtaacaggtgcaacgggtgtaacaggtgaagtatcggagtcgtgtggtgaatgagggtgcatggggtcggttgcatcagttacatgtatcacagattctgtgagggctgattcacgttctcataacatatttgacaatgatccgctgaagttgtaaactaacagtggtttgcatactttgggatgccagtgtgggggttcaactcctcatcatcgggatgccatacggtgcgtttctcctgttgttgagagtgatggataaatatctcggcaagaattccgatgaggaaggaaagggggagcctatgagcaataagactcatgaacatcgtaatggagtatggttgatgattgttacggtagtagcaagtatgctagagggaaccaaagaagttctattgaactctctagctggtctcttaggaggcttcatcagcaacggtattgcgcactggcgtaccaaggcacacaagctttttctttggattaatttgtgcagggaattgaccgtggacaggcttcgccagctccttcctaatgcttggagggtttgttaagctcttacgccactgcggcggtttcactcgtcttgcctgtatcgatggctttgagccgcatctggtccacggcgttggcgacttcgttgagtcattcgggccagagtccggcgtatacgtcgagtgtgatgctcgccgtggcatggccaagctgtttctggagggtcttgacatccgcgcagcaggcgatggacacgtaggtgtgacgtaggctgtggatgttcacagcctcgccctccatccccgcattgcgcacgccgggataccagatgcgtgtcctccagctctggtcgtggatgcatccgccgcgtttggcccggaacaggaactcgttcttgctttgtccggcgttctgctcctccagttggggaatgagagactgcggcagggcgatggtcctcgcctcaccgtttttttgcgtgccgagttgcatcctgccttccccgtcatcggaccatgtgcggcggatgcgggctttgcggttcctgaagtcgagatcctgaatctgcagggcgagcactacgttgatgcgcacgccggtgtaagcgaggaatcgcaccagcagttcgacttccagcacggtgaggaacaccatgtcctcgtccttggacacaatctgcggtattgtgaccagcttggccgggttctccggatccacttgttggtgatggcgtattcgaacaccgccgccatgacgaccttgacgatgctatgcagggactcagcgaccgcggcttcttcttgccggacagctgggccttatacccgcccttggagagtttgttcacccatgattggagttcgttgggtgtgatttcgagcagcgtcttataggtgtcgtcgaatccgccggtggcggcgatggcgatgataccaaacaagacggatgcggaaaggtacacgggcccgacgcatccgccgggaatatacttcttgaacacccgaacgaacgcgggcacgatcaacgccacgaacccggacccgagcgtggtcacggtgccgatatccgcataatcctcc

SEQ ID NO: 4 - DNA, 2858892 bp, Bifidobacterium infantis WBS-01 (residues 1,429,447-2,858,892 of 2,858,892)
ttggacgatgtaggcggcctacggcatcgacgcctacgaaagcgggttcggcatcagaaaaagactgggccggacgccggcgctaacccatcaacacgcgcggataagacccacgtttctttacttaacccagaagccccactccccgagcggaagtagggctgtcggtcgggctgacaggatttgaacctgcgacatcctgctcccaaagcaggcgcgctaccaaactgcgctacagcccgatgtgccacatacggcacaagttcatactataagcgatgcccggtacatgtcatggcgagcaagcggccgaccaaccaaagccagccaatctggaacggcacagaccaacccggaacagtccgaaccaacccgaaccggcccagtccgatcccgccagcccgcatcgctcccgccggcgtcacgcccccatgggcttcttgggctttttgtcgctcatgagcatgaggaagctgcgggactgggcggtgatcatgaagcccgcctcatagctcagttccggcccatccgggttgtgcgtatccacgaccagctgccatttgcggccgtatcgctcatccggcagggtgaacataatcggttcgtaatgcgcgttgaagatcaggatgaagtcgttgtcgaccatccggttgccgtaccagtctacctccggaatatccgaaccgttcagatagatcatcatggagaacgcatgcgtgttctgccagtcgtccatatccatgatcgaaccggtgtggtcgaaccattcgacctgcggaatcatgttcgaatcgtcgccgggctcacggcctgtgaagaagcgacggcggtgcaacaccggatgatccaaacgtagatgaatgagtttggaaacgaaggcgagcagttccttgcgtcccttgtcaagatgccagttggtccaggagatctcgttgtcctgacagtaggcgttgttgttgccctgctgggtgcgggccacttcgtcgccgccgcaaatcatcgggataccctggctgaacagcaacgtggcgaacatgttgcgcatctgacgctgacgcaagtcgttgacgtccggaatattggtcgggccttcaacgccgcaattccacgagcgattgttgctctcgccgtcgcgattgccctcgccattggcttcgttgtgcttttcgttgtagctgaccaggtcgttcatcgtgaaaccgtcatgcgcggtgatgaagttcacggacgccaccggtcgacggccgttgacctgatacagatcggagctgcccatgaggcgtgatgcgaattcgggcaacgtggagggctgcgagcgccagaagtcgcgcaccgtgtcgcggtagcggccattccattcggaccagctggacgggaagccacccacctgatagccgccggagcccagatcccacggttcggcaatcagcttcacgcgcgagatgatcgggtcctgctccacgatgtcgaagaacgcagacagcttgtcgacctcctggaactggcgtgccagcgtggcggccagatcgaagcggaagccgtcgacgtgcatttcggtaacccagtagcgcagcgaatcggtaatcaactgcagcgcgtgcggcgagcgcatgagcagtgagttgccggtaccggtggtgtcgaagtagtgctgctggtcgccttccaccagtcggtagtaggaggcgttgtcgatgcccttgaagctcagggtggggcccatatggttaccttcggcggtgtggttgtacaccacgtcgaggatgacttccatgccggcgtgatggtaggccttgaccatggacttgaattcgttgacctgctcgccgcgttccccggaggaggagtaggcgttgtgcggcgcgaagaagccgatggtgttgtagccccagtagttcgacaggcccttctcctgcaggaaggagtcgttgacgaactggtggatcggcatgagttcgatggcggtgatgccgagcttcttcaggtattcgatgacgctcgggtaggccaggccggcgtaggtgccgcggatgtccggcggcacgtccatgttgaggttggtcatgccgcgcacgtgcgcctcgtagatcaccgaatcgtggtacgagatgtaggggtgctggtcgttgccccagtcgaaatacggattgatgacggccgacttcatggtgtgggcggccgagtcaaggtcgttcatcgccgaggtgtcgtccgggcttttgaaccagtaggagaacaggctttcgtcgccgtcgatgttgccttcgatggccttggcatacgggtcgagcagcagtttgttggggttgcatctgaggccgtgcatcgggtcatagggaccgtagacgcggtagccgtagcgttggccgggctggaggccggggatgtagttatgccatacgtatgagttctgttcggtcatttcgatgcgcgtttccgcatcgtgctcgtcgaacaggcatagctcgactttctgcgcaacctgtgagtacagcgcgaagttcacaccggcgccgtcatagctggcgcccagcggatacattgatccaggtctgatctgcatagttttcagtatcccactttcttgtgtcactgatgtgccggggagttgaacgtcaggagaacagcgacggcttgtctttgtcggagttcctggcgatgagtctgcgtaacgcctcatgctggatggcgatcatcgaattggatgaggtgatgcgcgtggcggcaaggtcgctccacggaatccacgcggattccacgtgctcgtccgcgtcgaaatggcgctgctcccgcctgaacgggcccaaatgcaacaccatgatgtgggccagttcgtcggtcatgccttcggacgagtagaaatcgcccacgaagtcaacacccatggtgtcacggtccggcaccacgccggtttcctcggccagttccctcagggccgcgtccatgatgtcctcgccctcgtccatgagaccggcgggaagcccgtaggcgaacatgtccgatccggcacggtattcgcgttcgatgaggtaacggtcggtggacatgtcgtgcacgagcatgaccacacagggggcgtgacgcagcacctggcggccgatctcgtgttccttgccctgcttgtcggtcagagcgatgcgcatgtcgtccacgtggaagatgcgcccggtataaacggtttcgctactgatcactttggcgggcacgtccatgtcgatgccgtccgaggaggcgttcagcttatggtcgagccgatgctccagttgttcctgcttgcttcccccaaacatgtcatctcctcggaaaaatcgttttcgccacgtcactatagcgtcttaatctcgatgcgcggtaatggacagcgtccatggatcggtcgtgtcgtggaaccactcgacttcaggccttgctccggtcgcttgttcgatggcggctggcacgtcatcgatcgcgtaattgaaccacatggattcgatggcagcatgaggggtgttgatgaagcagggacgcacatggctctcccccgccattccatggccgagcatgatgccttgggccctcatacgggcttcataccgagcttgttcgatggcgtcggtcaccgggtggtgacgcaaatcgctggttacgtacacgtccgcaccggtggcacgcacctcgttgaacagggagtcaccggagccaggcagaatggccacatactgaacaaaagtgtccgaatcgccgcatacctggatgccgagcgcggtggtcatgccatgatcggacacttcgtcgaatacacgctgagcgaaatccttcagggcaacaggcttcggcaaacgacccacacgccccaagccgaccggatgagaggcgttggcatcgtcaatcggcacgagtggtttctggtcgatgagtccgaagtagtcggccgccgcctgccccacgccgcgatacgcagcgtcagcattggtgtgccctacccacagcccgcagccttgctggtagagcctgcggacgatgtcgccccggaaaccgagtccgctcgtctcgtgtacggaacggaagaacaacgggtgatgggtgatgagcaggtccgcgccagtagcgatggccttgtcaatgatggcggaggtcgggtcggcggcgaacacgatgcggtgcacgtcgtggctcagatcgccgacgatgagacccggctcatcccattcctcggcgtagcgcaatgggtacagggtctcgagaacgtcgatgacttgcttgagattcggcatatgtcccattgtagtgggctattgcggcaagggactcattctgcaattgcggacaagccatgctcgtgctcttcgttgctcgactatcggctcgccttcgcctacaaacaatccactggactgtttgctcaacggctcagcctcctcacccgaggggagctagaaattgtcagtgtgcagcgagctgccagtcggaaccgatgccgcacgatacgtccagcggcacggcaaggtcgacggcgtgttccatggcgttgcgtaccagttcggtgacctggtcgccttctcccggcgcaatttccactaccagttcatcgtgaatctgcagaatgatacggctcttgacgtgggcctcggccaaggtctgctcggcgcgaatcatcgcgatcttcatgatgtcggcggcagatccctgaatcggtgcgttgagtgccgcacgttcggcggcctcacgcgcaacacgattggtcgagtgcagggccgggaagtagcgacgccgtccgaaaatggtttccgtataccccttctctcgggcattggccaccagcgattccaggtaatcgtgcaccttgccgaaggtatcgaaataccggtttttcaacgcttccgcttcacgtggcgcgatcttgagctgctgggcgagaccatacgtgctcagaccataggccaatccgtagctcatggcttttacgtggctgcgctggtcgccggtgatctggtcgaccggcagcttgtagaccatcgaggccacgtatttgtggaagtcggctccggagcggaacgcttcgatcagcgcctcatcaccggacagatcagccatgatgcgcagctcgacctgtgagtaatcgcagctcatcagggcctcgtacccctcccccggcacgaacacgccgcgaatctcacggccggcggcgttccgattggggatgttctgcaggttcgggtccacggagctcaatcggccggtggccgcgacggtttgctcgaaagtggtgtggatgcgctcatctgatgtattggtggcatcgatcagcgtttgaacgatctgcttgagcttgttgatctctcggtggcgcagcaacgccccgaggaaaccgttggcccgctcattgtccactgatttgacatacagatcctgcaatgcggccgcattcgtggtgtatgagccggacttggtgcgtttggtgggcttcaaacccatatcttcgaacagcaccttctgcagctgcttgggactttgcaggttgatttcggtgccggcatactcccaagccatttcctgcgcctgacgagcctcggcggcaaactggtcacgcatggaaacgagtcgaacgctatcgactttggctcctgtgtgctccatgccgtgcagcacgcgggaaacaggaagttcaatcgcgcgcatcagccagcattgttcacgctcgtcgataatcggcccgagcgtgacggcgaggctgcggataatggccaaatcgcgcagacgatgttcgttcggatcttcttcgacctgatcgtcatcgaagtccaacgtgccttgcgaaggctgttcggtttcggtgaagtggatgtcgaggaagtgctcggccgcctgcttgaggctatcggcgtggaaatccggttgggtcagatacccggcaagcttggtgtcaaacatcggcaggtccatgtcaagatctaccgcgcccagaagatgcagcaattctttatatccatgcacgatggtgcgggagtgttcgcttttcaggaaccgcgcaaactgtgctcgcagggtatcggtgattggaaggggcacaatggccgctgatgttgccgtggcaacggcaacggcttgtgccgtggcgcgccccggcctttcgtcgccccatgcggccacggtccaagcgtggccgaccgcgtcgccgcagacggtatgccgctgcgatccatcgccatagtcggaaaccgtgaaatcggcgatttcaccgggaactttgacctcggcgcgatgggccttgacccattcgtcgaactgctccggagcagtgatgctcgtgggttccggcaggttcagatcgaggttgctatcctgcttgtcctgttcattattcgtagactcgccggctccggatgtgttggaaaccttggccccggtattgaaggttttcagtacacgactcctggtacgcggtccgaattcaagctccttgaacagggcgtcgatttgtgccacgtccacggtgccgaatgtcagatcctcgatatcgacgcctagatcgacgtctcgtaccagtgcgttgactttgcgattgagcttgacctggtcgatattggccctcagcgattcgccttttttgccgccgatttcatcggcgtgctcgcaaatgccgtcgagggaaccaaattggttgatccacttggccgcaaagccgtcgcctacgccgggcacaccaggaatattgtcggcggtttcgcctcggagtgccgccagatccggatattgtgcgggagtgactttgtatttgtcgacgatggactgcggcgtcatatgcttcaggtctttgaagtgatggcccgggtacaacacggtgacgttgtcatccaccagctggaaggcgtctcggtctccggacaataccagtgtgtggtagccggccttatctcccatggtggcgagggtggcaatcacatcgtcgccttcgaatcccgacttctcgatgtaggtgacgccgagggccgtgagcatgcgttgaatcaatggcagctgggtgagcagctcttcgggagccgcctcacgggtgcctttgtattgcggaagcatctcattgcggaatgtgccgcccttcacatcgaaggcgacgcccagatggtcgggcttctccgcatcgatcacctgcgcgagcatggtggcaaaaccccagacggcgttggtggcttggccgctggaggtgctgaagttgtcgaccggcagggcgaaaaatgcacggaaggccagcgagtggccgtccaccaccagcaacgtttcattggtgggtacggtcacgctggcctctcccatagtgtgtttgtgttactttacgactcagcacggcgacgccgataatcagcgttcgcccgaatcagaaggcttcggatcgccgtacttggcgatgatggcctgagccaggcgcttcttggggatgcgctggtccatggaggtcttctgaatccaacggaaggcaccctgctcagagaagtccgccttgtccatcagcagacccttggcgcggtcgacgagcttgcgctcctcaagcgtgtcttcagccttcttgagcttctcttcggtttccttgagctggtcggtggtttccttgagcttgcgttcgctgcgctccacgttgtccagcaaatcgttgatctcggcgaaacggcccatggccacctcgagggtcggcagcagcttggattcctcgtacggcttggtgacgtatgccatggcgccggcgccggtggccttcttcaccagatcggtctgggagaatgcggtgagcatgacgacgggggcgatgttctcatcgcagataatgccggcagcggcgatgccgtccatacgcggcatcttgacatccatgcacaccacatcggggcggtacttgcgggtcagttccacggcttcctcgccgttggcggcctgaccaacgacctcataaccgttgtcttccagcatggcgaccagatccatgcggttcacggcttcgtcttcggccacgacaacggtacgcggaccgtcctcgggcttgaccttgcgctcagcaggttcgctttcatcggccacggccttgagctcttcgtcggtcagcacctcatcgacgttgatactcggttcttcggacttcttccttgcagccatgccaacctctttcttgaattacccaacagtggggttcgtaataatttcagcgaactcctaactaaagtgccctcggtgggactcgaacccacactgcgcagattttgaggctgcttcctctaccaattgggatacgagggcgtgccaaagcactctgaagagagtagcataccgattcgactcccgccacacaagacacgcgcaccgccacggcatccccgccggacgggcgttctgcggcgttcggacgggccgcgctcccgtgtgtcgcccacgcttgcgcccatggcccacgtcccgaaggcggcgtgtgcgatcgaccgttgcgaggatcgcgcatcccgcacccggcgatgccgccgtccgatacgcgaaggcccccaccccgcagcgggatgagggcctttacgtaccgcacatcagcggtcagcggctacacgacatcagtcgcaggcgccaacggtgtgcacgtagatggagtcggtgcggcccggctggtgatcgccctgggcggagctcaggatgacgatcttgtcgccgtcgacgaccttgccggcgtccttgaggatcttgtccgtgtagatcatcagatccttgcgggacttgtcgtggtagtcctccttgagcaggaaggcttcggtgccccaggacagagccagccagtggtaggtgtgctcgttgctggtcagaccatagatcggggcggccggacgctcacgggagacgcggtggacggtggcgccggtctgggtgtaggcgacgatggccttggcgttgagcttgtcggccaggtccacggcggcggaggaaacggcgccggtggaggacatgtcgaggttcttgagctcggggatgcggtcgaagccgtggtcggtggcgtagccggagatacgcgacatggtggccacggtcacatccgggtacttgccgacggcggtctcgttggaggtcatggtggcgtcggagccgtcgaggacggcgttggcgcagtcggaagcctctgcacgggtcggaaccggggagttcaccatggagccgaggacttcggtggccacgatgaccggcttggcgtactggcgggccagctcgatgatgcgcttggtggccagcgggacctcttccagcgggcactcaacggccatgtcgccacgggcggccatgacaccgtcgaaggtcttgacgatctcttcgaggttctccagagcctgcggcttctcgatcttggcgacgatcgggatgcggcggccttcctcgtccatgatctcgtgggcgcggtcgatgtcggtggcgaaacgcacgaaggacatggcgatgatgtcggcaccggtgcggatggcccaacgcagatcggcctcatccttctcggtcagggccggcagggagacggcgacgcccggcaggttgatgcccttgtgggaggacacggggccggccacgacgaccttggtgtacacgttgttgccctcgaccttggtgacctcaagacggaccttgccgtcatcgatcaggatcgggtcgcccggatggcaatcgcccggcaggcccttgaaggtggtggaggtgatatgctcgtcgccctcgacgtcatcagtggtgatgacgaattcctggccgagctgcagctgaaccttgtcttcgccgtcggcgttcttcttgaaccaaccgcaacggatcttcgggccctgcaaatcaacaagcgcggcaacgttgcgaccagtggcttcgctggccttgcgcacgttgttgtagaccttgaggtgatcctcgggagtgccgtgggagcggttcagacgagcaacgtccataccggcttcaacgagcttcaggaggttgtcgtaatcctcggtggaaggaccgatggtgtctacgatcttggctttacgcatgaatgcctgcctattcttgttcaatttggttcgaggcgcgatcgcctcacttgccgaaactcagtctactagcgcgagccgactcatgacaagttttcttcacggtgtgttgtgagcgctcacattgttgtgttgactgggtttaagggttgtattctctaacgatttcaggccttctcggcgctttccatgctcttcatcttgatcacggaagccacggatgcgccgccaattgcgaccacaatcacagccagcgacagccatgtgggcacttccggcacccaatggatgccttcgccgccgttgatgaacggcaaggtattgccgtgcagggcctccatgatgagcttgacgccgatgaagcccagcaccacggacaggccggcaggcaggtagacgagcttgtcgagcagggcgcccagcaggaagtacagctgctgcaggccgagcagggcgaacacgttggaggtgaacaccaggaacggatccttggtcaggccgaagatcgcgggaatcgagtcgaaagcgaacatgacgtcggtggtgccgatggtcaggaacacgatgagcatcggggtccagtaacgcacgccgttcttggtggtgcgcagcttctcgccgtcgtagtcgtcggtgatcttgatgatcttgcgcagattacggatgatgccgttctcgtgatattcctcgtcttcatcgccgccgagcaccagtttgacggcggtgtagatcaggaaggcgccgaacaggaagaacacccatgtgaagcgggtgatcagggccgcgccgatcagaatgaaaatgccacggaagatcaaagcgatggtgataccgacggacagcacatacttctgaacctgcttgggcaccgcgaagttcgacatgatgatgacgaacacgaataggttgtcgatggacaacgagtattcggtgagccagccggaatagaactcgatggcgggcttggagccggcgaagaaccagatgcatccgccgaacatcagcgccatgaccacgaagaaggcgatatgctgcacgcattccttggtggagggcacatgcggtcggcgcccgatgacgaacaggtcgacgatgaagaacagcgcgagcaccacgaaggtgatgatttcaaatgcgagtggggtttctgccatgattccctacactaacccatgtatgtgacgggtcattgccccgcctcggtcatctgccggagctccttcttgagatcacggatctcgtcgcgcagacgggccgcaagctcgaactggagctgctcggcggcggtgtgcatctgttcgctcagctggcgaatcaggtcggcgaggtcctgcgcgggcaggccggccttcaggatctcctcgtggcgcttgtccgcctcgttgggatcgagtaccggcacgcccaggtgtgtgttgccggccttgcccgcgttgcggtagccaccttcaagcaaggtctgggtgtccacatcctccttggcgagcatgtcgttgacgtcgctgatcttcttgatcaggggcttgggatcgatgccatgctcctggttgtaggcgatctgcttggcgcggcggcggtcggtctcgtcgatcgcctgtctcatggcttcggtggtctcgtcggcgtacatgatcaccacgccggacacgtttcgcgcggcacggccgatggtctggatgagcgaacggtaggaccgcaggaagccctccttgtcggcgtcgaggatcgccaccagtgatacttccggcaaatcgaggccctcacgcagcaggttgataccgacaatcacatcgatcttgccttcgcgcaacatgcgcagcagttcgacgcgccgcaacgtatccacatcggaatgcaggtattcgaccttgatcccgcgttccagcagatagtcggtcaaatcctcggccatcttcttggtcagggtggtgaccagcgcgcgctcgttcctggccacacgggccttgatctcggcgagcagatcgtcgatctgccccttgaccgggcgcacgtcgatcttcgggtccagcaggccggtcggacggatgatctgttcgaccaccccgtcggacaagcccaactcgtagtcgccgggcgtggcggacagatacacggtctggccgacgcgctgcaggaactccggccatttgagcggtcggttatccatcgcggagggcaggcggaacccgtgttcgaccaacgtgcgcttgcgggaggcgtccccctcgtacatcgcgccgatctgcggcacggtaacatgcgactcatcgatgaccagcaggaaatcatccggaaagaagtcgagcagcgtatgcggcggcgtgccggccgcgcggccgtcgagatgacgcgaatagttttcgacccccgagcacacgcccacctgggtgagcatctccaggtcataggtggtgcgcatgtcgagacgctgcgcctcaagttccttgccctgtttgcgcagttcggacaaccgtccgtcaagctcctcgcggatggttttgagcgcgcgttccatacgctccggcccggccacatagtgggaggccgggaagatatggacctgcggttcatgggcgatcacatcgccggtcagcggatgcagggtggagatgcggtcgatctcgtcgccgaagaattcgatgcggatggccagttcctcgtatacggggatgatttcgaccgtatcgccccgcacgcggaacgtgccgcgggtgaaggcgatgtcgttgcgcttgtactgcatggccacgaaccggcgcagcaggtcgtcgcgattgatctgctggccttccttgagaaacagcatacgcccggcgtattcctcaggagtgcccaggccgtagatgcaggagacggtggccacgaccacgcagtcgcgtctggtcagcaggttggccgtggcctgatggcgcaaacgttccacatcgtcgttgatgttggagtctttctcgatataggtgtcggtctgcggtatgtaggcctccggctgatagtagtcgtagtaggaaacgaaatagctcaccgcgttgtcgggcatgagctcgcggaattcggcgcacagctgcgcggcgagcgtcttgttcggctcgatgatgagcgtgggacgttgcagccgttcgatcagccatgcggtggtggcggttttgccggtgccggtggcgcccatgagcaccacgtcgttctctccgttctcgatgcgcgtggccagttcctcgatggccttcggctggtctccggatggttggtacggcgatttgaccacaaacggcttgtccacacgttcgatgttgaatcccatgcgctgtttccttccgattcacgctgtatcccgatgatatatcggaatatacgctaggcaactccaatacccgtcttcctcttggacgcgcagccaaccaccgctccgcgtaattgattgacgcagatgagacattccaaatcccatgcccaatgttctcggagattccgtcaatgctccatccgccatcttggcgggaacgtcagccaccgatacgtacagtccgtcttgccgcacttgtatggcgagcacatacccttgttcgcgatccgcgtgcttggcgatattggcaaacgtctcttccagcaacgaccgcgtcaactggatagtcttctcgtcaaaccgactcaggagatcgaagggatcggacacaaccacctcgcctcggaaaccaagcgctgcgagttcccgccggtgccgttcgatctcggcctcgaatcgacctgcaccgatcggaacgatggcttctccggagcgacgcgcatggcatcgcgggattcgcgcagtgccgacattgtgctttgcgagaaccgctatgacatcatgcgtctgatcgagcgcccgttgagccacttcgcgcaacagtggcaagtccatcgactctccttgcgaagggtgttccgacatgatcctgtcgatgctcatgatgagatatgagagatcattggtcgtcgcatcatgcagccttgccgccagatccaacgattcggccctgccacgcgcttccgactccctctccccctcacgatgatgccaattcagcagcagaccgattccaacgcacgccaacgccggcatgacggtccaaggcacaacggacaccaacgccccggcatcccaatccatcggcaacccatactgccatatcagctgcgccacgcgagatacggtcacagccaccgccaacaccacgccgcaccatatgcgttgataggagagaacgattaatggctcggctatcaccacgctcaccgacatggacagatccaccggcaaggggaacaccacgcaccatgagatcgccaacgcgatattgccgccgaacgggaatgccacgcagagcaacgacaggatgacgaacaacagacccacccacagggtccacgcatcccaaaccggattgatacacgattcgatgaccgtatcagcggctatgcacaaggcgcaggctagcgccgcgatcttttcgccatgccaagacttcccgaaatcgcggaagcggcgtctaagaaaacggctgccgtcacaggacatggtatcgctcacagtaatcaaggagttcgccgcgcctcgtaacaccgaccttgcgcatggctcgtttcacatagctgtacacagtttcgacaccgattcccaagcggcgcgcaatttcaacggtcggtacacgatgtgcatagagacgcaacaccgccagctctcgatcggagaagagcctggcaccatccgcttccggctgtgcggcatccaccgtatgcaatgtctcttcaaggctatgcaaaccccaaccatgagggtatgttcccccgtcaaacaccgatttgaccgcctcgcgtatggtcgctgcgaaatctcttttcgaaatcaacgcttgggctccgcaacacgcgatatcctcaccataggttgccaggtcatacgaagtgactacgatgacgccaacctgcacgttccgctgtcggatacgttccgtcagccgcactccgttcagcccgtccatcatgagatcgcaaataaggatgtccggcttccgcggatcgaacagacaacgttccaaggcaagactgggattatccgtaacccatagcatgtgtgcctcgggaatcgtcctgccaataagcaaagccatcatctccgcagagcaacgatcgttgtccaccaaggcaagccgaatcgggcgcccgttcttcataagtaccccctccccaaatcgcctccgtcaaacgcaatcgtagcactgtgacgattcccgtcacacagacttcgttcgctcctcattggcgtcttaccgtgttatatgcggcaaagcagccgcgcaatgaagaacaacaaggagcactcatgatcgcaaagaaaatcaccggaggcctactggcggcaacgcttgctctcggcgcaagcggaacacttatcattcccgcaaacgccaatgaagtcggtacttcagtaaaagtctcctgcagcgttcccacagatagggatgctggcatcagcaccgttgatgtttcatatccccatggaggaacatggcaatatggaaccaccttgtggggcggatgtggagatgtctactccaatttcctccacaattcccgtcggcatcattcctcggttttgaacgccgataatgtatacgcatacagcggcgtcaaggaagcgggaatctgggcctccgcaaggacttacgcggtatgcggcaaagtggatcaagctttctatggatttgatgctgaataatttcgcagcatccacaccatttattgaatgtgcggcgagcgaacttcctatcgtccgccgcacaaacacattgttaccgggaataaggtgtatcatgcactggacttataaaatcgccagtatattggccgtggctctcatcactctcgcagcaggattctatgcgcaaaataacgaagaaacctatccctccggccctagctacgatattggaatttccgacgcgcacgggcagcctctatcgacattgaccggtctcgcagcgacccatcatgtcgtactcgcgagagtctcctatgagccggacggtcacggtaccaacagacgcgtaatttctattttcggcgcattagacggcaacggcatgcatgcgaattcgccatacccggattatgggttcgggccgcgcacacgtgtgcaacgcggagacagattcaccgacccattgggaagatggcttctctatggatcaccacgggataccgcttcagtagccaaatccatacggcgccaaggattcgaacttaacagagcaacccccatcggcatcacacaaatcaccaaacaattcttctccaattccatcgcccaagtcatattcgccggacttgctgtagtatttgtgtccggcgcgctttccgtgtcgacagcttcacgcgtttgcgcgatacaagccttgcatggcatgagaacaaccggcattattatgaggcaattcctgcggcatgcgttctttttcatcatctgcgtctgcatcggatggatgacttggatttccattggtgcgatcttctggcctttcgcttctcccttaggattcgccggtcaggtattcctctccatcatcatcgccacaacgtgcatggcattggttgccttgtcattgtcgattgctctagtaagggttctggtgccgaacgcactcaaattaatccaaggaaagcgccctttacgttttctcatggcttccggctgcatcatggcaatcatcgttctcgctctcagctctgccagtttgaacgttacgaacttcaaatggcggcaatcccaaacactgaaaacaacattggagcatcaattgtcatccaacgacggattccaattgcaactgtggtatagcagcgatcaaaaccgagctcgttccatgccctcatggaacgacttcgtcgaacaaacttcccaatcagaacatacgcgattcgcctcattccggctaggatgcacgtgggtggatagctcgcaagacccacagccctgcatcctcatggattcccgtacggcaaggcttcatcatcttatacgaaacaacacgacacttgcacgaatcagtgtgattatgcccgagaatgaacaatggaacagcgaatccattacgaacaatgtgcttcgcgcatactcattcgagcaaagtttggcggcagaagagggaaagagtctgcccgccatcaatcgcacgagcatctccattgaatccagaccaagagatgctgtcttatcggcatttgacaccccttccaacaccgatggcctttcctctgttcctgttgttgtcattgacccgtcactgctctctggcgataccactacatcgatggtgtccaccggcggcatgaccttcgattacagctcccgccatcagctgctcgaaatcctacgggaaaagggcgtggactctttggtggcttcggtcgtcaatcggcacgacgagatacaaactcgtttggcacgaacaactcaggaaatgaactatttttccatcacagcttgcatatccataatatgtctgctgggcggcgcaatcatggtggctttgacactatgcacactccgacgtcaaattatgttcgtggaatatatgcatggagcgccgtcatatctccgttttcaatcgatactgttcctagcagcggcgttatgcagtgcatctcttccgatccagttgctcataggaggttacaacgccgtttccatgacctcggtttccttactattcatcgtcgtttcgctggcaaccacagcgctttacgattcgcggctgcgcgccgacagtatcaaacatccctgatcgccatccacaaacctgtatcagcaatcacttaccacgtaaggaacatcaagcatgagcgccttattgatcacgcataatctgacatatcgaatcgacgaccgcaccttatgggaaggactgaacctgacattcagtcccggtgacatggttgccctgaccggagaaagcggatgtggcaaaaccactttgttgaatgtcctaggtcttttggaagagccaagttcaggaacaattacctatgatgggcaaacaattgcctccagaaagggccgacggctcatgcaccgcaacgtcatgggattcatgttccagaattacgccctggtggagcaatggacggtgaacagaaatctgattctggctctgcgcagcgtcggaataccatcggcagatagaagtcggctcatcagacgcgcattgcgggccgtgaatctgacgggctacggcaatagacctatctacacactcagtggaggcgaacaacaacgagtcgcaatcgcgaggcttctcatccgtcaatcgctgcgcgtcatactggcggacgagccaacagcggccctcgatgccgacaaccgcgccatggtcatgcgtcacctgcgtgatttcgccgacagcggagcgatcgtgatctacacgacgcacaacgaggagaccgcggctctcgccgaccgcatcatcgcattatgattccgccagccactgttcgtacagcgcatcgacggcttcgagcattcgacccatcggctgcgtggaatcgatcaccgcgtcggctatgacacggcgttgttccgggctggactggtggcgaatgcgcgcaagcgcatcatctcgcgtcatgccgcgggtcgacaccattctgtcgacccgcacttgttcgggcgcttcgacggtgacgatatggtcgaatcgcatgggcatggcgtccaggacttccgccaacagcggaacatcatgcacgaccacggcatccggattgtccgcgaccgcctgccgctcccgagacagcgcaagatcatagatcaacggatgctcgatatcgtccagtttcctccgcatccgttccgagtcgggcccggcgaacacgtgctcggcgatccatcgccggttgagccgcccctgatcggtcagcgcgtcggggccgaaacattccgctatacgacgaagaccgacgccgcccggttccaccactcggcgcgcgagctcgtcatagtcgataagcgccgcgccgagctcccgcagtcttgtggacaccgtgcttttgcccgccgcaataccaccggtcaatcctattcgaatcatgctcccccatcatggccatgtttcgaggttcatgcacacaacggcaaaacccggcccgccgaagcgagaccgggttttgactatacgtcaggcgtcagtcgcccgatggcgaactcacttgccgagcagctggtcgcgcagggcggcgagctgatcggagtcggcgagggtaccggtagccggagcagcggaagagtagttggaggtctcctcgaccggcttctcttccttcgggccctggccgtcggcggctgcggattcggcagcgttctccagctccttggccacgaactccttgtgctcctcccacagctcgtgggcggcggcgtactgggactcccactcctcgcgctgcttctcgtaaccagcgatccactcgttggtgttcgggtcgaagccttcggggtacttgtagttgccctgctcgtcgtactcggccggcatgccgtagatggccggatcgaagtcctcggaagccgggtcgacggagtcgttggcctgcttgagggacagggagatgcggcgacgatcgaggtcgacgtcgatcaccttgacgaacacggcctcgcccggcttgaccacggtctccgggttctcgacgtgacggttggcgagctcggagatgtgcaccaggccctcgatgccgtcctcgacggagatgaagacaccgaactggacgatcttggtgaccttgcccttgacgatctggccgggaacgtgggtgcgagcgaagcgctgccacggatcctcctgagtcgccttcagggacagggagatacgctcacggtcgagatcgacgtcgagcacctcgacggtgaccttgtcgccgaccttgacgacctcagacgggtggtcgatgtgcttccaagacagctcggaaacgtggatcaggccgtcaacaccgcccagatcgacgaaagcgccgaagttgacgatggaggacaccacgccctcacgaatctggcccttcttgagctgggacaggaaggtctcgcggacctcggactgggtctcctcgaggtactggcggcgggacaggaccacattgttgcggttcttgtcgagctcaaggatcttggccttgatcttctggccgatgtacggggagaggtcgcggacgcgacgcatctcgacgagggaggcaggcaggaagccacgcagaccgatgtcgacgatgaggccgcccttgacggcttcgatgacggtgccctcaacgacgccgtcagcttccttgatcttctcgatgtcgccccaggcgcgctcgtactgggcacgcttcttggacagaatcagacggccttccttgtcttccttggtgacgacaagggcctcgatggtgtcgccgacctcgacgacttcgtcaggatcaacgtccttcttgatggaaagctcgcgggaggggatgacaccctcggtcttgtagccgatgtccaggaggacttcgtcgtgatcgatcttgacgacagtgccctcaaccagatcaccatcatcgaagttcttgatggtggaatcgactgccttgatgaagtcctcttcggtgccgatgtcgttgatggcaaccttggtgacttcagtgttgttctctgccatgtaaatatatggtttctaatagtggatggataatttctcgatattcagttatacgcacacccttacaggcatacggatattcacaatacaagcaactctgcccaaatttcctaggaaactctaggcgtgtcgttcggccatttccacgacgttggccaggagcatggctcgggtcatagggcccacgcctccggggttgggggtgtaggcggatgccttgtcatagcaggccttgtccacgtcgcccttgatgcggtagcgaccggcttcttcgtcgtagacgcggctgatgcccacgtcgaccagcacggcgccgtccttgatcttgtcgggcgtcacgaatccggccgaacccattgcggcgacgatcacgtcggcgcggcgcatgtggtcggccacatcccgggtaccggtgtggcacagggtgacggtggcgttgacggcgttgcgcgtgagcatcaggccaatcgtgcggccaatggtgatgccgcggccaagcacgcacacttccttgccgttcagatcaatgtcataggcgtcgagcagctcgagcacaccgcgcggagtgcaaggcagcggtgtcgaaatgtcgccgcgcacatgcagcaccagttcgccgaggttgtacgggtgcatgccgtcggcatccttggccgggtcgatcatgtcgatgatcgcgttctcgttgatgcccttgggcaacggcaactggacgatgaacccggtgcaggccggatcttcgttgagttcgcgtacggtagcggcgatgtcgtcgaagctggcgtccgccggcagttccttcttgactgaggtaatgcccacttcctgacaatcggcgtgcttgccggccacgtacttcatcgacccggggtcttcgcccaccagcagcgtgcccagccctggttggatgccctgcgccttgagcctgttcactcgctcggcaaggttggtcttgatttcggccgcaatctgcttaccgtcgatttttgtggacatcaacgccctcccctgtagtttcggtgcattctatcgaaacgataggctatcgttggaacaagtcaggattatatatcgttcgctctcacgaagaaggcgtgccatggggactcaaatcacacgacttacgcgactcgccgcagccggcctgagcgccgtcctgttgttcgcgaccgccgcatgcgcagccacctcccccgctgaaaccgagccggacaacaagaccagtgttcccgcaccgaccgggccgatcaatgtggtcgcctccctcaatcaatggggctcgctggccgccgagctgggcggcgatgatgtggaagtcacgtccatcgtgaactccaccaatgtggatgcccacgatttcgagccaaagacctcggacgtcgccaagctgtccaaggcacaaatcatcgtggccaacggtgcgggctacgattcctgggccaccaaatcgatggccaagaccacgaatatcgtatccgccgcttccgtcatgggtgccatggaaggcgataacccgcatctgtggttctccaaagacgctcgatccagcatggccacggccatcaccgatgcatatgtaaaggcactccccagcaagaagaaggccttccagaagcggctcaaggcatggcaggcgggtgagaaatcgctggaaacatgggcgtccgagttcaccagatcccactccggcctcacctatgcagccaccgaacccgtggtctattatctgatggccgatctcgggttcaagaatcagacgcccaaggggtatatgcaatcgaccgcttccggcggcgaaccggcccccgcggacctgcagtctttccagaaactcatcgaagacaagggcgtggatgtgctggttaacaacacgcaggaagccagtgacgcgaccaatatgatcactggcgctgccggtcgtgccgatgtgccggtagtcgacgtctccgaacagatgcccaaggataccgacacgctgaacgcctggatcaaccagctcatcaacaccatcatcgacgcggtggatccgagctatggctgcgaagacgccacggacggcaacgcgaattccgatgattccagcgccgacggcgccgccacggatgatgccaatgcgcacgattccaaggccagcaccggttccagcacggagcccaagtacatccgtcagtgcaaggcggccacatccagcgactcgtctcaggattcggcaaaggccgatgcctccaatggcgattccggcgatgcctccggcaacgaccagaccgactccggcaaatagttagaagcaaaggacaccggcatcggatccatgcaatgccgatagacgccttgcacgagaagggttgtgcgaccattgtcgagatggccgcacaacccttttctttggttgtcaccatccgtacacgatattgagaacgattgtcagcatcgtttgccacaatcgggcgttatgagtgaaacttccgattgcatcgtgttcagcgatgccgccatcaagcgtggtgaccatatcatctggcagcatggcacctttgccattcccaccggttcggtcacggccatcgtcggcaccaacggcaccggcaaaaccacgatgatgagggccgaactgggacttttgccgctttgccatggcagcctgaccgtactgggcaagcccgcaggcgagatgaacaaacgcatcggatatgtgccgcagagctatgtggcgaatgtcgattccaatctcaccgccgaacaatccgtgttgctgggtctgaccggcacccgattcggcatccaccccatcaccaaggcccagaaagccaaagcgctcaaggcgatggagttcaccggcatcgccgacaaggcgcagtaccgtctgtccgaactgtccggcggtttgcgccagcgtgtggccatcgcccaggcgttggtgtgcgatccacaactgctgatgcttgacgagccgttggccaacctcgatctggccagtcaacgcgccaccgtacacgtgctggccaagctgaaccgtgaactgaacatgaccatccaggtggttgcgcacgatctcaatatgctcttgccgattctgaccggtgccgtctacttgctcgacgggcacccgcactacgccgatatgcacaaagtgctcgactccgacctactcacccacctctacggcacacaggtgcaggtggtcaccactccgcagggtgacatgttcgtgaccccgacgccggatgagccccaggaccagccgcaggatatgcacacggcagccgaagtggcgcaattgcaccatcacgagcacggcaacgccaccaatggcagtgccgccaacagcgccgagaatcgataacatcaagctagccgatccacagcccgtcaacgggctgcagctcaggcatggagaaaatacagggacatgagcaccatcaacttttcgtatgatcccgaatggctggacacactgtccgctccattcatgaccaacgccttcatcgccggcctgtgcattgccctggccgccggtgtcatgggatacttcaccatcgcccgtcgttccaccttcgcggcccatgcgctggcccatatcggtctgccgggcgcgaccggcgcggtgttgctcggcctgcccgtgtcactgggcatgggcgtgttcgcactgggcggcgcactggtgatcggtgctttgggcaagcgcgtttccgagcgtgaaatcgcaaccggcaccgtgctggccttcgccaccggcttgggtctgttcttcgcgcgattgtcgagttccgcctcccagcagatgcagtcgatcctcttcggctcgatcctgaccatcaccaccggccagatcatcggcttcgccgtgttcgacgtattgctgctggcattgttggccatcatctaccgcccgctgctgttcagctcgttggatgagcaggtggcacaggccaagggtgtgccgatcgggctgatgaacgtggcgtttatggcgattatggccggtgtaatcaccattgccgtgccggcagtgggcaccttgctgattttcgcgctggtgatcacgcctgcggccaccgccaatattctggccggctccccattcaaggcgatggtgatcgccagcgtgctgtgcctggtgtcgatttgggccggactcgtgctgtcggcgatgttccccgccccccgagcttcattatcgtgacgctttccaccctgttctgggctatcgccaaggccgtggagacagtgcggaagtaatctcattcatttttcttgcccccgctggcaaattcatagcgggggctttgttatatcttttccaccaaggcattggcgatggcggcgatgccttcgccgcggccagtgaatcccatatggtcggtggtggtggcggtaaccgataccgggcaaccaaccgccgcagacagggcggcttcggcttcagcacggcgtgtgccgattttcggacggttgccgatgatcgccactgaggccgatgccggcgtatacccgttggatgccagatgcgccacaacttcttgcagcatatcgatgccatgccttccggcaccatgcgcgtccgcaccgacaccgaacagtgaaccaatgtctcccaatcgggcggcggcaagcaacgcgtcaatcagggcgtgcgcggccacatcgccatcggaatcgccttcgataccctcgtatctggcggcatcggcctcgctgcatgaatcaggcaccggccagtagagcccggcaatccacagttcacggcctgaaccggcaggcgcaaaacggtgagcgtcaaaaccttgccctatcagcactcctgcagcccccatgcagttcccttcgatggcattgcccagatgaacggcagcaaacgattatgaatcacgaagccccggcgcatcgcataaggacacgaccgaggcctcaaaacaatcaaatcacttcttcttggacttcttctcggcttcgacacgagccaaagtatcggccgcggcctcttcgggctcggcggtgtgatgcttgtcgtcaccgggctgagcgggctcgtagcccaggttcacgtcgagcagacgctgggcttccgcctcgtcgatcttctcggacaaggcgatctcagaagtcagaatggcgcgggccttggtgagcatacgcttctcgcccgcggacaggccgtgctcgtcgacatcgcgctgggcgagatcgcgaaccacttcggcgatcttgttgacatcgccggtggcgatcttttcgacgttcagcttgtaacggcgagaccagttcatctctttctcgatgatcggggtccgcaggatgccgaacaccttggccacttcggatgcggagacgatgtcacgcacgccgaccttcttggcattgtccacgggaacgttgatgaccaaaccatcggaagagagtacggacaactgcagatattcgcgcgtcactcccttgaccgtccgctcggtaatggcctccaccttcgctgcaccatgacgcggatagacgaccatatcgccgactttgtaagacatgtaccctccgagaactgacggcttacacacaaaaactcgaataattatgccatgcggtctggaccgcccctatgagagcgctcacaaccacgaagacacaccgaaaagggcaagaattcgccattttcgacgcgccaatgtagcgttttcgactccaacgcacgtaaactttgggtcatggctaaagaaacgaagatcaaggaagataccgtcaccgtgcctgtcgcccaaggcgacctcgatgcggtgagcaatgctgaattctacaaccctcacggagttctcggcgggcatctcggcatcggcaagcatgccgacaccgccacaatccgtgtgctgcgtccgcttgccaagtccgtgaccatcctcacccaggatggtgaatacccgatgacccacgaatacaacggcgtgttcgtgactaccgtgccggcttccggcaccaagaagcagcccacgattcccgactaccgcgtcaggaccgagtgggaaagcggcgcagtgctcattgaggacgacccataccgttatatgcccacagtcggcgacatggacacctatctgttcggcgagggccgtcacgagaagctctgggaggcgcttggcgcgcatgtgctgcgctatgacgatccgatgggcggcgtagacggcacgcctggcgaacaggtggtaggcaccgcgttctccgtgtgggccccgaacgctcacgccgtgcgcgtggtcggtaacttcaacgcctgggatggccgtcgtcatgccatgcgcgagctcggctcctccggcgtgtgggaaatcttcatccccggaatcggcgcgggcgagacctacaagttccagatcctgaacgccaattacacgtgggagatgaaggctgacccgatggagcgtcagcacgaggttccgccgaacaccgcctccatcgtcaccgaatccacctacgagtggaacgatgacgcctggatgcagcaccgccgcaccaccaacccgcatgatggcccggtctccatctatgaggtgcacgccggcagctggaagcagggactgacctaccgtgacctggccaagcagctcgtggactacgtcaggcaggaaggcttcacccacgtggagttcatgccactggcccagcacccgttctccggctcctggggctatcaggtcaccggctactatgcggtggactcccgtctcggttcccccgacgacttccgttaccttgtcgaccagttccatcaggccggcatcggcgtgatcatggactgggtgcccgcccacttcccgaaggacgccttcgcgctcggccgcttcgacggcaccccgctgtacgaggacccggacccgctgcgcggcgaacaccccgagtggggcacctatgtgttcaacttcggacgccgcgaagtacgcaacttcctggtggccaacgccctgttctggctcgaggacctgcacgtcgacgcactgcgcgtggatgccgtcagctccatgctctacctcgactacagccgcgaacccggccagtggcgtccgaacatctacggcggacgcgaaaacctggaggccatcgacttcctcaaggaagccaccgccaccgcgtacaagaacaaccccggcgtcatgatgatcgccgaagagtccaccgcatggccgggcatcaccgcccccacctccgccggaggcatcggcttcggcatgaagtggaacatgggctggatgcacgacaccctcgagtatctgcacgaggagcccatcaaccgcaagtggcaccacaacgaaatcaccttctccatggtgtacgcctactccgaacactacgtattgcccatcagccacgatgaagtcgtgtacggcaagggctccctgtacggcaagatgccgggcgatggctggcagaagctagccggcgtgcgttcgatgttcgcctatcagtgggctcacccgggcaagaagctctccttcatgggcaacgagctggcccagtggggcgagtgggatcacgacgcctccatcgattgggattgcctgaactggcaggagcaccgtcaggtccagaccatggtcgccgaccttaacgccttctacaaggcgcatccggcactttggagccaggacttcgatccggccggcttccagtggctgaccagcgacgatgcagaccacaacacgctgagcttcctgcgcatcggcaccaagggcgagaccttggccgtggtggtcaacttctccggtgaagcctggtccgattaccaggtggcgctgcccaccggcggcaagtggaccgaagtgttcaccaccgatgacgccaagtacggcggctccgacatccacaacggcacctttgaagcggtcgagggcgaatatcattcgcgtccgttctcggcgaagatcaccgttccggctctgggagttgtattcttgaagccggaagactgaactggtcaacaggctgaaaggtaaccggtttatttatgctcaataccacagcgcgtcagaatacgacaccgcgcacggtgctggtggtcgaggacgagcccacgctcgccacggccattgcccagcgcatcaccgctgaaggatggaccgctcgcgtggccggggacggcgcttccgccgtccaggccgcgtcccagctacgccccgatctggtaatcatggacatcatgctgccggtcatggatggtcttgaggccaccaaacgcatcgtcgccgaacgtccggtgccggtgctgattctcaccgcgcgtgatgacgaggccgacaaggtcatcggtctgggagcgggcgccgatgattacatgaccaaaccgttctccatgcgcgagctcatcgcccgctgcaaggcgctgctgcgccgcgtggagcgtgcgaaggtcatcgccaagaattcggagaacgagaagctgctcgacttcggttcgatagtcatcgacccggcacagcgcatcgtcaccgtgaacggcgagcaggtgcatctgacccccaccgagttcgatctgctggccacactggcccgccgcccgaagtcggtgctcacccgcgaaaagctgctcgaagaggtctgggactgggtcgacgcatccggcacccgcaccgtcgacagccatgtcaaggcgctgcgccataagctcggcgccgataccatccgcaccgtgcatggcgtgggctacgctttcgagccgccgaccgcgtgatggcatccaaaaaacaacagcaatcccggcttgatgcgatgaaacatcgcatcaagccggttgatttgttctcctctctgaagctggaactcagcgcactgatcgttatcgccacggccgtcgcgtttgccatgtgctggttcctactgaaattcggctggtccggttggatcgccatgccgctgaccttggtactggcattgggcatcacctatttcttctcccgcggcaccaccgctcccctacgccagatgcgcgatgtggccgaagccatggcggatggcgattacacggtccgcgtggatatcgatcagaatcgtcacgacgaggtcggccagcttgcccgttcgttcaacgagatggccggcgaactcgagcatgccgataaaatgcgccgcgacatgatcgccaacgtgagccatgaactgcgcacgccggtctccgccctgcaggcgatggtcgagaacatggccgacggcgtcaccgaacccacccccgccaacctggagggaatcctcactcagacgcaccggctttccgacctcatcgcctttctgctggatctgagccgcatcgaggcgggtgcggcgagtttgaatatcgagaagttcaatttcgccgactttcttgacgaaaccatcgagccgttggaaatcgccgatggcggtcacgcccacgacatccatgtcaccgtgccggccgacatctcgatggaaggcgatcaggaccgcctgcgccagctattcaccaacatcatcgccaacgcgctgaaacattcggccgacggcaccaccgtgctggtcgatgcccacgaggacgaaaaccaaggcaccatcgtgaccaatgtggtgaatttcggctcacagattgcgctttccgaccgttcagacatcttccggcgctttgtcaaaggcaagacaggtcccggcaccgagtcgggcggcaccggtcttggcctgtccatcgcgcgctgggcggcacaattgcacggtggcaccgtcaaagtggtcgatgacacgcgaggggccgatttcgaaatcatcctgcctaaatatcacatcgccgaacgctgatattgtccgacgtcctaccgtatactgtattcgaacaaatgttcgaatacagggtgggaggcacagcatgacacagcaatccgagtcacgaaccatgccgcacgaggccacgctgtttgttatgcagatggccggcgattccatgatcaatgcgggtattcataacggcgatctgctgattgtcgaccgttcgttaacaccagtccccggagatgtggttgcggctgtcatggatgacgaaatcgccatcaagcggctggtttcacgggccagcaccaccatattgcacgccgagaatccgcgataccccgattacatgccaagcaacggcgcttcgcctgctatctggggcatcgtaaccgatgtcattcacccactgatatcgtcatcggaccgtcgcaccacggcatccgccaataccagcacgcccaccactttagtaccggcctgctgaaatgtctgaacgcattgccgcacggtggcacctgtggtgacgatgtcatcaatgagaagcaccacgtcgccatggccgatgagatcacgcttcaccgtgacatgaccggtgatacggcgggcacgctgtgccgaagagacctgctgcacggagcgtgccttggtggaggagctcagggcattgcatggtcgcgcatcgacgccgtacccacgcaatgcccctgccaccgatttggccaacggtgccgtgtgagcccgtcctcttcggcgcattgacgcccgcgatgacggcaccggaaccaccaatacgcgatgacccaagcatgatgatggtattggcgtcttgttcagcagcgacaccatgatgcggccgaacgggccgtcaagctcggtatcgtcgtggtccttccagtcgagaatggcacgacgcgccgctccctgatagattgacgcggaccatatacgggctccgccaccactgtctgcatcccgttcccggcattgcgcgaacagggcccagcatgccgcacacaatacctcatccggcgcgtcacacccagcgcagccgcgtggaaacagcagattgcaggcctgcgcccacatcacatgccaccacttgtatacgctcggcccgtccataacgcgtcaccatcaagctgaagtatcgaatcgcgcaagcagtgcatccagcagttgtaccgtatcttgcggattctccacacgaacaccgatcgcaccggcctcaaccgcgggatagtcattacccgtaggcgtcatgcgatcacccacgaacaccatttcatcggcccgtatgccaagtgtctgcgtcagcttgcgcacggcataggccttatcgatgccgcattcgctgacatccacactggtgtatccgccggccctgacccgcatatgcggcagatcggccttgaccgcttcgaccagcgcctgtttcttcgtgttatcgcgatcccatgcctgcttggccgctacggatgcgaactgtccaagagcggagaaggtaatctggctgcccctgttctcgattcgaggcccccatacctgctgttcccacaatcccagttcccgggcatgtcgctcaagactttccgagacagcagccacggtggcttcggacagatcatgcgcatacaccaaggcccattgcgtgccatcccaccggtaataccgggagccggaggtaggcatgacatgcagattgccgcgcctggcattcggggtgagcacatccagcacctgcgaggtgaccaccgccatgccgccccctgagatcagggccaccaccgtatggtcgagcaacgcacagaaccgttcgatcatcgcgggcttcatcggctgttttgagctggccagcgtgttgtccaaatcgaaaccgaacaccttggcgttggagcagacattatcgaaatcaagttcggaccacgaacgtaccaccatctgtcgcgcctccctcgttgacgaatgttcacaaccaatgaaccaatcctaacgcatgttgcctccgccatgccctatggtgggaaccatgcttcagccaccttggaacgcacgaatctaccgtaaccgccacggtcgcggcacacgaaccccgatgttcggcacccgtctgccccgttaccgcacccgaaccggcatgttcgacgatatggtggcggcccaggttcgcaggctcggccaagcgtggccggaactgatacgtccgatccagttcgcggtggaggatgtgccgccttcggatccgacgccttggcagaccgagccgaatatgacgtcccagtgcttccccgccagccacggcattcccgcacgagtcgtgctctaccgtatgccgttgcagaccgaggcaccttccaagctcgaattgcaattggccgtcagggatgagctggtggcccgcatagcggaattgtatgggcgcaggccggaggaaatcgaccctgactggggcctgtgacaacactgcgggccgtgtcacttgtaataagatagtggcacggcccgcagctatatcgccgccgaaacatcatcagactgacgcttcggcgagcatacccttctacttgacgatggaggaatcattccgagcccagacatgaaccgtggcgggcatcagcgttgaagcgtcgacgacagacaatccggcgatgtccttgtcttgcaacgaatcgtgactgaaccgcgctccccagcccactttcttggatgagtcctccaacatcagcacgaccgcggtgccatgatcgccggaaagtttgccggtctcaatcgtttgcgctgcgttcgcatccagtgtgatttccttggaggttaccgaagcaccggcatcatcgtaggcgtgcaaggtgaccgtcctgcgcgcattggacgtattggccagcgtgatggaggcctttactccgtcgggaagggccaaccccgagaattcggatggctcgccggcattgaccaatgcgaaatcggcttggccggagtcaccggagcgtgtggccttgacggagaacgacacggcatcctctgcggtggacatcacgcccaacgccccatcaggagcctctcccaagtcgatcgccgtcactttatcggcagtgacggtgacatctttggcgggaaccaagcctttgtcggtaatccatgacagcccggtgctggtgtctgccttggcgaacagataagcggtgaccgcatcgccggcagtgatggacggcgccaccgatgcattggatgcggtcggcagcggcagcgcgaaatcagaacccttcggtgtcagaccatccatggtcaccgtacgtaccacggacgcgataggagtctccttgctggaaacggtcacgaacagaccatgctgcccatcgaccgcggcggacagttccatcgatgactccccctcggctggcacagacagcgtggattgggtggacaatgccatcttcccggctgtctcggaaccccagacggcaatgtcgacggtggtcggcttggtggagggattcgagacgatgagctgctgtgtggtaccggtcgtgccgccggagagcaggaacgactggctgagcgaggtcgatacgcaggatgccgccgatacgcctctcacatcgccgtcatcggcccatgatgcgatggtgccgacggcgccggtgccggttgcggcctgcagcatacgggtattgatcaggcgagctccctgattgatcttctgagcaccggttttcaccgaggaatcgtcggtcggatcggcgtctttcaaagttacgtcatctgaactggacttttgcccgatcgccgagacagtggcgctgtagacggagccgaacgccgcatagcgcgcctgtgtgctcagattgccgacagtggcctggaaggcgctgtcgccgtacgtgccggtatcggccaatccgacaggtgccgggcagtaggtttcggactgggtcggactaacggtctggtcgatggcattatcggaagcggccaccttatccacccagatattggggataggggccatgacgagaacgacgaacagcgcaaccaacaccagcatggtgatcacaccgagcacgatgccgatcgcacgtttgaaaccagaagttgtgttgctcatgcctgctcctccaatccgtaggacggtcgtctgcgaggcatggcgaccaagcagtacaacgccgtgatcacacctaggcatatcagccaggcgtgcctccagacactatgctgtgcacgttgctgccatgaggtatccaccttctgtgaggcgctgctgcgcagcgtcagacgatagtagctgccgctatccgtggataccagggactgggtgccgttcgatgcggcgatattcgcgctcaactgttcatacggcatgtcgttcgaggaatcgccggtctcgggaaccacgtagatgccgccgaatccaagcgcgctgatggccgcgatagcctcttcgtcgggattggacagcagcgaggcacaggcctgggccagctgttcgtcaaccgcatcatgcttgccggacagcaggcgcgcccgctggaccggagagctgtcgatcagatcgccgcgcgaggtgcgcatcaccgcatagttgacgatgttgcgggtctccgcgctcacggcaagcacacgatgatcggcactggcctccagataatcggtggtgaccatgggcaggccgttttcggacacgcccagtcccgcatccttatgacgttcgatgccatacatgcattggatgccaatgcagcacaccagtatcagagcaagcaccacacggccagacacgatgagcacatgcagacggtcccttttcggtgcgggatcactgccagacgcatgcaacggttggaatcgcttcaccgccccaccggcgacgagacacacgcaggcaaggaagcccaatatcatcatcgcgatgcccggctgcgcggaaccggccacgacaccatcggcatccacggttatggccacacggctggagaccagggcgagcgcgcctccgcagacgattaccacccacatcagtcgcgaggtccgcaacgcgaacggcagcaccagcgaagcaagagcgagcagcgtgatgacgccaaacagcacagtgaccgccaaatcggcataatcggtcgaccccattcgccatcccagcgcacgctgtacggcctcaagcagactcagcgacgccggcgacccgttggcggatgacgttggcaccgtgatgtcgccgaacagttgacgccacatgcccaaaccggcgtaacgcaccgcattgacgagcgtaggagccaccgcaaaggcggcaggaaccggaataagcaacagcatggcgcgcttgcgacgcacgaatagcaggaacatcaggaacactacgatcagcgcgaacagcagctgcggttcggcggccaccacagggatgaagcacagtgcggcgatggccgcggcctgaacggatgtgcgcggtttgagcgggtcttcggtatggtacatgcccacggcacggaacacgaatgcgaacgcggccggcaggaacaccattacggtgagcatcggcatattggcctgcgcataccagccgaacataatgccggtggatgcccacagcagtcctcccagcacacgaaccacgtccgagcgggtgaatacgcccgccagcgcccagaacgacaatgcgctcagcggcgcggccacaaacagtatcatcgccaaagcggcgggcacatggccgagcgtgaccagcgaggccagcatcagcaccagcagccacggcatgggcggcgcaggaatgccggtgccgctgccaaacacccacggcgtggtggcggactgcaccagttgcgtgaagctggcaccggtgggaagcaacacatcggaatacaacgatccgccggagaatatcgaacggaacaccggccaatacatcaccgcgatggccgcaaagcacaccagcgccatcaccacggccgcactccagcgatatatggtgcgtatccgtagatgggcacgttccagcggactgagcagcactctgtcctgctgggattggaatgcgtcccgacgatcgtggaactgcttgatctgccgactgtcggcgaacaagacctgcagggacgacgcggtgaccttcgactgtctggccaccagcctgcgtgatttcatgtttcccgcgatatcggccaaagccagccatggcaggcacaattgcacccatgcttcatacggcttcttgccgaacatcatggctatggccatgccaaaactgcggagcagcctccacagccagacgataaaccaggacgacatggccagatccgtgtacagataccgctgttgggaacgatgcaccgtcattgcatgattgaccgtgtgatcgtctttaagcggctccccgcctcgcgtacgaatgccttcataccgtgcacgacgatgtgatatctccgcttgcgggacaaccaccacgcgtccgccgctcaggcagacgcggcggcagaaatcaaccgattcgctgtaggtggtcagccaggcattgatgccccgcagtcgcgtgaattgcgacatggacaccagcgcgcccgccagcgacaccgcaaacacatcctgccgcccgtcatactgctcctgatcgggttctccatcgaccaccagggagtgcacggcgtggagacccgcatacataccgacatcatgcagatgggagccttcccaatcgcactgcttgcatccaagcacactggcacccggcgtattgcgccatgcctcaagcaatcgttcaaggcatgaggcatccgaggggcgggaatcatcatggagcagccacaatgcgcggggaacatcatccagatcggcacggtccaatgcccggctggccgcatcaccgaaggagcgtgcacccttggccgagacgatgtgaatggtcacatgcttggactgcggcacctccatcaccggccccgacggcgaggggatgacctcgaacgaggtggttatcctcgaactggtgcgtccggccgcgtcggcgatgatgacaactcccgggagaacattctgtgtcaataccgaacgcaatgtagaccggaggaaacgcatatcctcctcaacggtgatcacagccgtaatgccggtatccacatcctgcctatgcgtatacggtcgagaagacatggcgtcagccaacgcctcatgaatatcgctattacctgtcggactcataaattcccagtgtacgcaccagacttgaagggggtgtgtggaactacgcctgctctcggtgctctcgcttatatcggcgacgttcgcgctcgctcatgccaccccaaataccgaaccgctcatcatgatcgatggcccatttcaggcattgctcacgcacttcgcattttgcgcacacacgtttggcatcacgggtcgagcctcccttttccgggaagaacgcctccggatcggtttgcgcgcacaacgccttgtgctgccaagatacatcgccatcaggtcggaatagtccccacaattcatgccatggctcttcggctgaatcgtcgaccacaccccacatgcgattctccttgcctattgagcttttcatacggactaaattacacacatgcaatttcggttttgtcaaattctttctcgtgtcattacatcatttttatggaactgtgtgctatggcgtgaacgcgatgccctgacgccgttgcacatgatattgtgccgttcctgcgcaggaacaccatagcgcaggaacacccggcggatgctgtgtcaaagtgtcattcagacaatcgacagtttcaggaggggttatgacgcaggaatcaggtggggcagatccgcatatcaacccgccaagcttcattcctgcgggaaatcgacgcccccggccttccgggcaggtgccacgctccttcgcccctgcccgcgcctcgcgtcagtcagggcaggctccatcggaccgtctgtctgtcatgggaaataacgtagaagagctccaaccgaacgccaatgccaaggcaagcaccaatgccgcggacaacggcaggcggactccgcccagtttttctccgaaaaccggacgtgccactcgcagcgcggctccggatgccgccgcgccgcgcagtattccgccgtcgcgagcgcggatgtcttccggctcatcccgcaacgccgtgcgcaatccgtcggatatgccggtttcccggccctcatcgccagcagcaaacgtgtccacgaagttcagccatattggccggccggcggcggcaacggcgaaaacggtaacggcacaccggccgcgcgccttgcgcatcatcttatgcgcgattgcggtgctggtggcggcgttgattctttccgttttcggcgcctggcaatgggtggacagcaaactgaatcggagcgactggctgaccgacacccccaacacgccggcctcgacctggctgattcttggctccgatgagcgtgacggttccaccgattacggcggcgtggacgatatctctggcttcaggaccgatacgattctggtgctgatcaagcccaaaagcgggccgagttcgttgatttccattccccgcgattcgctcatgaacgtcgataaccagtacatgaaaatcaatgcggtggcgcagattgcgggcaagaaggctttgataagcaacgtcgagcaaatcaccggccagaaaatcgatcatgtggcgcagatcaagttcggcggtctgcagaacgtggtgaacgccttgggcggtatcgaactgtgctatgacgaggatgttcaggattcctattccggactgaactggaaggcgggatgccatacggcggatggttccaccgcattgtccttctctcgtatgcgatacgccgacgcgcgaggagacttcgggcgcaacgaacgtcagcggcaggtcatctcggccatcgtcaagaaggcttccagcagtgggaccctgaccaatccgtccaaagtcgtggcagtgtccaatgccgcgatgagcgcactcaccgtggacgagaagaccaacccttacacgttgctcaccatggcgttggcgttcaaaagcgccaccggctcgaatggcatctccggcagcgtgtactggtccgacccagattattacgttgatggcgttggctcctcggtgctgctcgatgacgccaggaacaccgaactgttccgccagattgccgacggcacgcataaggccggcgccgtgggcaatctggcggaaggctgaccgacgctttcccggagcccatcggcttcatcgtcggcgcatgatcgccgccgttgcccacgcagccaatcatgcactggcaagatgtcatgtggataactcggcaagctggaaccacataccttgattcgacttgcgctttcggcacgcgctcccccacgctggaagcatgacatcacagcagaacgattcgaagcgacattccgcccatacggcatccgccgtatcccgggcgaagcaccgtttgggcgcgccgccattgcgcgcccgcctggccatgcttgccgcggcgtgcccgatgatcgcgcaggcactgatgatggtcatactgctgttgcacgggcaatggctgttcgccgccatgatcatgccaggcatatttgcctgtctcgtgtccctgctgctgacgctcccctcgtctccgggtccggagaaggctcccgccccgcaacaggcaacgatcgatgtcggtatcgcggacgacgccgatgaccgcgccgcagacctccgtcatgcgccgtcgcagtcgatagaatcgctgctgcacttcacacacctgccatggcgcaccattgtgggccactggcttgagccccttgaccttgcggtgccgattggcatgaccggaagcgagccgctgatgctcgacctgaaccgtcagggaccacatgccttggtggccggcaccaccggttccggcaaatccgtgttgctgcaaagctggtgtctggcgctcgcctcgatgaacgggcccgaacatctgaatttcgtgtttttggacttcaaaggcggttccgcgttccgtaaactcgaacggctgcctcataccgtgggcagcgtatgcgatctggatctggcgcatgccgtacgcgcgttgcgtgcgttggaagccgaactgacacgccgtgagcagctgtccgccgctatccgtgcttccgatatccgcgatatggtcaatccgccaccgcgcctgatcgtggtcattgacgaattccatgctctgaaggaccagctcccggattatgtgaatcgtctggtgcgtattgcctcgctcggcaggtcgctgggcatgtacctgatcgcctgtacgcagaatcccatgggccaggtcagcgccgatatgaaggcgaatatgtccgtcagcatttgcttacgggttcgggaccgtctgcaatcatgcgagctgcttggcgatggtcgtgccgccgacctcagtccggcaatgcccggtgcggcgttctgcaacgattccgaacaggtgacggcattccgctgtgcaacggcacgcgatatcgatgcggtgtgccgccagatcgcgttcgcatcgcggttcgtcgcaagcccgccgcaaccgcccctgtttaccgcgccactcccccggcacgtaaaagaccggactgtggccgatcacgcaccgcaacgcattcgatttggacttgccgatgatggcatcaatctgcgagaggcgacagtatccctcatcggcggcaatatcggcgtcatcggcccgcaggggcgtggcaaaaccacgttgctggaaacattggctcgacacgccagcatggccgatgggttggcggtacgtgtcagttccccgcatcgccgggtatggagctcgcaatggcttcatagcggccgtcgcatgccgtatgccagctcggatgcaccaccgcctccgcatatcgtgtggtttgtcgacgatgccgatgaattgttcgatccattccgcaccgacgaacaggcgctgtctttcacgcatgcgttggctgatgagtccgtcagcgtggtattcgccgtcagcacgattcgaccgatacgcataccggagcattgcaataccagaatcgtgttcccgtgcggggagagaacatccgatcttatggctggaatccccgctcgcctattggatacgatgaatcttatcgatgccgacaacgcgggccgggccgtgctcatcgagggcacatcggcatgtctggtgcagtgcgcttcgtgagaacttcggttttttctcggcgaaacctcttgaaaatcaccacggttcgtggttaccttggtactggacttaaggaacaacaccagtcacggggcttttaagggaggcaagcaatgagcagcgcttttgattggcgagccaaggccgcatgtcgcgacaaggatccggaactcttcttcccggtgggcaacaccggtgcagcttatcagcagattgaggaggccaaggccgtgtgccgcacctgcaaggtgattgacgcatgcctgaagtgcgcactggacaccaatcaggattacggcgtgtggggcggcttgagcgaagacgagcgtcgtgcgctgaagcgccgcgccatgcgcgcccgccgttctcaggccatgcagatgcaaatctgatgttttgattatttcttcgttatactaggaaaccctcccactcgggagggtttcctcatttcgggcttctcgtcactcgtcctgagcagccctgagcttcatatcgagcaccacacgggtgccgccttcgcggcgcggctctcaatgcacggaaccaccgaaatcattggtcacgaaggtgttgatgatctgcgtgcccaaaccggaaccggaagaacgagccaatccaccctgctcttcggagccgagaccggaaccgtcgtcctcgaccaccacattgaggttcgggccggagcggcccacggaaatcgtgatatggccatccttgcggccttcgaacccatgctccaccgaattggtgatgagctcggtcagcacgagggacagcggcgtggcatcctgagcgggcatcatgccgaacttgcccatgtagttgatatcgatatgctggtctttcatcgtggccaagtccacggccatgcgcagcaggttggcgattaccttgtcgaagtcgacgacttcgtcggcggtctggctcaatccctcatgcaccatggcgatggtctgcacgcggcgttgcgcctcctgcaattccttcttgacctcatccgacttggtcttacgagcctgaagcctcagtagcgcagagacggcctgcaggttgttcttgacacgatggtgaatctcggaaatcgtggcgtccttggtctgcagctcctgctctcggcggcgtagctcggtgacgtcacggcatagcagaatcgctccgatacggccgttgttgtcatacaagggcagcgagcgcatcgaaacggcggaacggttggcgtcaagttcggagtccaccgcggccttgccggtcagcaccaacggcagggtttccggaacggggtcgttctccttcagcagctgtgtgccaagttcgctgaggtaatggccaggcatggtggtcagcagaccgagacgcctaaagcagctgatggcgttcggggctgcgtatcgaaccacgccgtccatggtcaggatgatgaagccgtccgccacgcgagcgatatggcgttggctcatcaccgaatccttgtaggggaattggcctcgcggaatcatctcgtacagctgcttgccggcattgatgctttccgactcatatcggccgttggattctcgtgtggccatattggtctcacgcacgaccaagcccaaggtcttgccattgtgccgaaccggcgcgtacacgttgcagacggtcgacttgcccacggttctcaataccgtggagcggaacaccacgctggagagcatggcggcgtccaattcgccgaccatgtcgtccggcatgacgtttcccaccacgtcttccgcccgcagcgtcatcacggtggatggacggcattgctcggccaccacgtatttaccatcgccattctgtaccagcagcagtagatcggcgaagctcaaatcggcgatcacctgccaatcggcgacaagatgatgcagccactcgcggtcctcgtcgtcgaagtcggggcgcgttgcaaggatatgtgaaaaatcagccatatccctatcatacgcagatgcgacgtcgcatcgcccgacggcgaggaagaagcgcggtgtccacatcggcgtccgcatcgttgaccagcatagatgttacgctgacgtaggttacggcagcgtaagcaacgtatcgccaactcgtgaaacgggggaaccatcatggcatcagcggatgacgacgcaacggcaacgatgcgccatgacactcgcgacgattcgacggccacgccggacgccgccatcgaatccaagcgccaggcggccgagcaggcgctcgaacaggcgacgcgggccaaggcggatacgatacgggccaaagcccggttcaaggccgcgtccatacgggccgcagccgaggagcgcgcccgacgcacgctcgccaaagcggagaaccgtgcgctgaaaatcgagggcattgcccctgcggaagtggaacgcaggattcgtctcgacgtgcacggacggccaaagccgttgatgcgcggctggattcacgcgattgccgctcccctgtcattggcggcaggcatcgtgcttatatgcctggcacatggcgcgagtctgaagtgggcgtgtgccgtgttcatgacagcgtctctgattctgttcaccaattcggcctgctaccatctgggcgattggagcccgcgcgtcaccgatgtgctgcggcgtatcgatcatgtcaacatcttcctgctcattgccggcacgtataccccggtctcgtttgcactggaaccgttctggcgcaatgtgatcatcatatcgatgtgggcgtgcacggccatcgccatcgtgattcacgtgatctggatcaacgcgccacgctggttgtatacggtggtgtacatcatcttcggcatctacggcctggcctatatggtgctgttctggaagtcgccgtatgcggggccagccgtggtggcgctgctgtgcgccggcggcgtctgctacatcctcggcgccatcgtctacgccttgcgcaagcccgacccttggcctcgcgtcttcggcttccatgagattttccactgcggaacggtggccggatatgcctgccatatggtggccatctacatggtgatcatctcactgtggcattgacgtctccaggcccggcgacggtgccgggccaacgaacggggaggggttccggaatcgtccggaacccctccctcgcgttgagacgacgtcaggccagcggcttggcggccttgaccgtcacggacagctcgcggccgttcggtgcggtgtaggagacgacgtcgcccaccttggcaccctcgatagccttgccaatcggggaatccggggtcatgatgtcgtagtcggtgccggccacgatgtcacggctgccgagcacgtaggtcatctcgttgccgttgagctcgatggtcaccacagagccctcgcccacggtgccttccggagcattctcgatgatcttggaatcgcgcagcttgacggtgagctcggtgatgcggccctcgttcttgctctgcgcctcacgggcggcctggtagccgccgttctcggacaagtcgccctcggcacgcgccacggcgatcttgtgcgcgatttcctcacgcagctcaccttcacgatgggcgagctcttccttcatcttgttgtatgcttcctgcgtcagcaggtagaccttgtcctcagccatatcgtcctcctgaaccgttgtcgatgctgaaacaatcttcgttatttatgacaaaacgccggctatgaccccggcgttcgtcatgtgctgacctgtggtcagcgggtggaaatgatgtcgatgacgaacaccagcgtgtcctcgccgccgatgccggcctgcgggatgccgcgggaaccgtagccgtattccggcggaatggaaaccaccagacgcgaacccacgttatggcccggcacggtctggtcccagcccttgatgacctgtcccacgccgatgccgaagctggcgggctgatgacggtcgaagctggagtcgaatggggtgtccttaccccacaccacgccgtgatagttcacggtgacggtgtcgccgcgacgcacgatagggccgtcgccctcggtcagctccacaaccttgaggcccttcggggcttcgggcgtcgggaactcgataacgggcgtggtgccgtattcggcgttcacctgaggcatctgatctgccattagtcctccttcaaagacacaatgcgccctaccttagcaccatcggcgaatcggcggtagtccttcatccctgtgcgatacgacacgccggccgtatacgtcaattccgatcatcatgctggtgaataccagacatgtcaatcagcattcgacgacattgacggcaagcccgcccttggaggtctccttgtatttggccatcatgtcttcaccggtctgcttcatggtttcgatggcctgatcgagggtcacgatgtgtgagccgtcgccgagcatggccatacgcacggcgttgatggcggtgttggcggccatggcgttgcgttcgatgcatggaatctgcaccagtccgcccaccggatcgcaagtcaggcccaagttgtgttcgatgccgatctcagcagcattctccacctgttccggcgtgccgcccatgactgcggcaagtccggccgccgccatcgaacaggccgagccgacttcgccctggcaaccgacttccgcaccggaaattgaggcgttgcgtttgaacaggtatccgatggcaccggcggtcagcagaaacgtgaccacgccctgttcattggcgttgtccacgaaatgccaataatagtgaagcacggcgggaatgatgccggcggaaccgttggtcggagcggttacgatgcgcccgcctccggcattctcctcagaaacggccaaggcgaacaggtccacccatgcggcgtccgaggattcgagcacggcgtccttgcgccggctgtcgcggcgcagcacatcggaattcaaggcgagacgccgatacattttcggcgcgcggcggggtacgtcaaggccaccgggcaatgtgggttccgccgaggtgcatccgtggtccacacaggcgcgcataacacgccagatggcatcaatatcggatcggacctgggcgcccgagcgtgaagcggtttcgttggcccatacaagttcggcgatgctgagatgatgttcccggcacaacgacaccagttcggtgcatgacgagaacgggtagggtgcctcgacgccgaaatcagtggatgatgattcgtccgcgtcggcaaaggaggtgccttccggagggcgttcatgaatgccgatcatcgggtcttcgggagcgcctttgcgcacgaatccgccgccgatggaataccagacctgttcgtcgaccaagcttgcggcggcgtcgaaagcctggaatcgcatgccattggggtgcgcggccatgcgcttccattgttcgaacaccacgtcgcggtcgtagtcgaaatggatgcgtctgaggccggcaaggttcagagtatcgtccaacgcgcaggtctcgcggatgtgcatcatgtggtcggtatccacggtggccggcagattgccttcgagcccggccattgcggcgcgatcggtgccgtggccgagaccggtcagcgccagagaaccgtaaagcgtgattttgacacgtgcggtgcgatcgaccaaatggtcggcctgcaacgaggaggcgaaggcatgtgccgcgaccatcgggcctacagtgtgcgaggatgaaggtccgacgccgatggtgaacatgtcaagcacactgaacatttggctccttctcccctgctggttcggcatgccggtgttgccaggcgtcacgccatcacgatatcgtattccagcctagcgcccggaatcgctttcgccttgtgcggtgatggccgcgcgcgtcgtgccggtgatcgataagtcagtcagtgagacagtgcggagaacatcataaccagtacgatgatgccgatgatggccaatacgatctgcaccaccatcagcccgatggtcagtcccttcttggtggcgattttgggcgcgtacgcctgtgccaacaggaaggcgatgaagccgaacaccgcgtagttgacggtcagggccatcacatcgctgttcgacaacaccacgccgttcagcggctggttcaacgtgttcatcatcgtgctcatcacgaacatgccccacacgccgtagccgattaatccgacgacgccgtacagccatggcttgagtttgtcgttggcacgcagggtcaaggcttcggcacaccacaacagggcgaagccgacgatgtaggtgaatgccacggcaatcagtatcacgatagtcgcccatggcaggagcgcggccacattgccgatcatggacagatagaatcccgagcaggcgatggcaccaacggtgagcgcagtgcccgcaatgacggcttgggcaagcatggtgggcagggcgccttgttcgactcgttcgacatcggtccagcgtgaagccatgtggattcctcgtttcatcaggtacaacgtcacaacgccacatagcctaacggccttttgtttcggccttataagctccccacatagtaagctgcgagcctcctctgacgagggggccgtcggcgaagccgactggggggagagaccgcggcacagccacaaaaaacgcatcggccacaggccgatttcaaggtgcctccggtgggactcgaaccctacggagaaaagccgcttagacctactcccgtctcgattatgcggctctcgaaacctcatttgcccacattttgcccacattctcgcgcgccagcatctcacccatgcgctccgacagctcgtccagatcatcatcgaaaaggtcggcgtacacgtccaacgtcatggccgcgctcttgtgccccaactgccgttgcacggccttcacgttcgcgcccgctctgaccatgagactcgcggccgtatgcctcaggtcatggattgtgaggtggccgggtatgccggcacgccgcaggccgaccgacagccaaccgtcatcgcggctcgcattaccccactcgcgtatcatcatgccctcgcgtcccggctgttcaaataacaggtcgccgggtttccggtctgcgcacagtctgcgcatgatcgggtccagcacgaccgggtacatgatggcgcgggccttgtaggtcttggtgtcatcggggatgatgacgccgcccaccatcggcgcgctcactcctatatatatacgatgcttttcaagatcgacgtccatcaccctcaggggtatgagttcaccccatcgcatgccgcatagtccaagcacgaggacgaggtctcgtctccatggggtgacgctgcctgccagccggtcaagctgttcggcggtgagatacacgtgcttcttcctgcgcttgcgtggcagttcgatgcccctcgctggattgtccggaatacgccggtctttcttcgcgtcgtccaatattccggcgagcacgccgtgggcgcggaggacgacgctagcgcttcggggtttggcgagcactatctcgttgccccgctcgtccttgacggtcttgccctggctgattccggtgacccattgttgcgtcgtctcgcgggtgactgcggataccggggtgttgccccattccggtttcacccacttctcccatgcgccttcgagggtacggtaatggctgggcttggtgctgagcttcttcttggccagccaggcgggccccagctcccccaccgtcgccttgccggcctgcgggtcgatgtacgttccctcggccttggctgtggtgacccttttcgccgcccaattctccgcatcgatttttctcttgaatccacgcttgtcagtctgcgtgccgtccggcttgcgatacctcacacggtatctggtttcacccttactggtcttgtatctggtgacgttcgccatgggtatgcttcgccccgtgtaggataaaagacgaagcgtcctcctttctgataagcaagctggtcgatgtttcacccgccctgttgatggtcaagatcaacagggcgattcttttttctattgcaggaattgcctgtgggccgtttctgacaatgaataccgtatcggccgtttgccgtgttcctgcaggaggccgaggccgaggagcgcgttgatggagctcatgagcctggtgttcccggcttcgagaaacgagcacagttccttgcgagatgccggttgcgggttgttgtcgaacagttcaatctgaagcaggtagagcaggatgtccttctggtcgccggacaggcgtttctgttcggcgtagtcgttgagcttgtcgtaggcggccttcagggagccccatttgttccccagatcggagatgatgtttttctgcgcggtgatgatgaacttcaccatccggtagcagaacagggacacgtcggagcagttcaacgggaactgggcgtcgtcgaacgccttgtagtactgacctttggcgtcggctatgacggggctgagcgatatcgcggtgggcacgctcagatgcttgctcagctgcaatgccagcaggaatcgccccgtccttccgttgccgtcgtagaacgggtggacgtattcgaaggcgtagtggcacatcacggcccggagcaccggcggtatgttcgagtcggtgagcagggttatccatttggtgagttgcacctggatctccgattcggggtatgcgccgtcgtggagtttgcgcccgttgccgtcgtcccacacggagaccgttccctttcggaacagtatgccgtccggtttgtccttgtcggctatctcgccgtcggtgacctggtcgtagatgttcctgatgtccttgagctcgtggggcagttcgagctgttcgccgtcctctccggacagtccgaggaacagtttcgcgaattcggtcagccgtttgtgggggccctcgcccgcggccgattccagtgcgtcggctatctccttgcgtgtggtgtgcacgccttcgatggtgttggtgctttgcacctcggctccgatgaggtcgaacaggtaggcccgtttggcgatgttcggcaggtcgttccacaatgattcgacgcttccttcgagttccctcacggtgtcgagggccgtgccgagttccctgaagcatacggcgaacatctcgtgtccgtcgaacgtgattccggaacggaacgtggaccatccgttgacccgtgactcgtattcgcgttgggcggcgtccgtgggtttctccgtggaccgggacatgttgatggtctgccggatgcttttgtagtccatctctcctatcacctcgtttcgcgttgtatcgatgtttggaatacgaatattactcttctatgtatcgaaaacgccggaaatcgatatatagacaatcggaatctgttctcaatgagcccaaaacggaagaaaacagattatagagtcagccctgctggcgttgcagcgccggcagggcattttttatctatctcttcagctttcgatccgcctgacctcgcttcgaatttcctcagcaaaggcatagataccattaagatcatcgattggccggcgctcgcatttcttttctgcgtcgaagagtccaatgtatttctgcttggtgttgaagaacaagcgcgcgaccggcttgcgattgttgtcatcaaggaaaatcgcgcaatacttctttgcgtcacgcatggtgattcgggctggatcaacctcgctgcaggcaatggcctttataattcggtatgccgcaatctcctcttcggtggtcacgatgccatcgtcttcggtgtcgtcgttctgttcatcggcggcatcgtccgtttcgtcttcggcggctggtccgactttgatgtcgtctgcgcccaatgcggtcttcagccggtcgttgacctgatcggagaggaaccttttcaacgccttttcgacgagcggcctgaacttatccatgacagtctgacggaatgcgccgtcatagacgtgggccgcaagcagcttcacgaagtcgtcggacggctccttgaattcatcggaaaccgcccgtttcaatgcgccgacgtatttcagttcttccgcgctgctggcgattgattcgatgtcgaatgccggtttcgtgagcttctttagttccggcaatatggtttcatcgatatccaacaggtcaagcacgaggaacggcttggaatccatgcggttcggctcatcgatgtccatatagaaattccatacctggccattggtgagtacgccgattcgtgcgcgtgtagtggcaaaataccgatatagctggctcgcgttttcgagagagagctgtgcccctacttttttgcattcaatgaggatctgcacctgctcatccagcaccaaggcataatcgactttttcgcctttcttcacgccgacgtcggcggtgaattcggggaccacttccgtggggttgaacacgtcgtagccgagcacttggccgatgaacggcatgatgaacgcagttttggttgcttcttccgtctcgattgagtctttgaggtctgcgactttcgccgcaacgctcttgaccgattcctcgaattccatatgtttcacctttctagtagagcactgtcgtgcagccagtttttgtatgcccggattacccagggcatgacgtttaattctcttgctatcgcgcattcgtcgttgccgtataggatttcggcagtaacgtagtcggcttggcttatgagcattcgagcagcctccacgtctgcgcgttgttctgtatatcggtccgagtgtcctcctttatcttggtgtttcgcgtggcttacttcgtgggcaagtacgcatcggtattgcgtcggcgtgagattgtccgctatgtagatggtttcagtgcgcgcgtcatatagaccttgataaccggattgcatcgcagtcactacgattcgggcgtaccgcctggcttcctgttctatgtttatcgtcatggcatctcctcgtaggcttcctgttcggcttcggtgtcgccacgtttcgccgccatctccaagatgttgttaatggactcctgcacttgcgcctgttctgcggcttcggccaatacgagcatggggtcgcgcccgagtgccctggcgagcttgtctatgtcgccggtggtgagttctgtgtctccgcgcattttgcggaaatagctggatctttttagccctgattttttcaaaagctcattaactgtcatatgcgcgtcaaggcgcgcgttttcaagcgcctgaattacctggtcggtgaatgctgccattttctcggtcatgtaataaaagtaccgttttttgggactttttgcactttgtgaccatattagggcgtgtcgcagtcccatatatggcactatttggactgtgccaaatatgagactcgatgaaacctccacccgaatcattcgggcagtgaaggccgaagccgcccgctgcggcaaagacggaagcagcctagctgaggcattgggccgcaatccgaagtatgtctacgaccgcttctctttcaaaaaggacttctccacccgagacctcggcgagattgccgattatctcggcatcacgactcaggacatcattcgctccgcggcgtttgacgcgcagattcatgcgaaggaggtggcgtgatggtgtggtggaagcacaatcgtcaggcatgccagtccggacaggccgaggggccgatgccgacaccgttgccctgtccgttatgcaacggccatgccgaggcggtgatggattcgtggacgtcaggcggatacggatacgacttcgaacgctggggctgccgttgcggggaatgcggatacgggtactacggcggcaaccagctctcgccgtccgacgaacggcaggccatcgaacggtgggaccagcaggtcgaggaagcgttgaagatcatcgcggaaccgttggaggaatgcccgtcatgccattgcgtcccgaaggtcgggaaaagcgacggcgaggcattcctccaatgcccgaaatgcctcaaaatcgcacgcggcggcaaccccatagagaccaaggacaagtggaaccgcttgtgccttcagcggaaggcgatgaggctcaaagccaaacgacaggccgcgcagttggaacgaatcatcggaaaggacgcggagtgatggatgcgaattcaatcatttgggtctgcgcgatcatctgcgtggtctgcgccttcatcaacgccagcattcggtgaatagtcatcggccggcagcatatcgtccaatttcttgaggaaggagggaacgtccatcatggcatcgtgtcttatccaatgcgcgaactgcagcaaccgtcggaatggtctcggcatatgcgagaacagggaagaccagcgcagcaaaggccgcgtggtggtatggatatgccttgatcccttcaacgggtcacgcattactggatactccttgtacaccacgcgtcccaatcgcgtgggctgcggggtccacagcaccttcactccgaaatcacatgacgaaacaatgctcatcatgtccaggacgacgaagaaacgctctcccggcatcaccctgttgatcttctgctgcaccaccagctgcttgaactgctgtccgggaaaatcgtattcgtttacgacgatgcccttcatgttgattccctcagccgtcacggagaacgctggaccatcaccactgttcgtcacaatcaccaccatcgtagtgttcgatttcagaatcctgctccccgctgcctgtacctgcgcgaccggtatcgggtcgatcatgacgtccgctgttgacgtgacgcttacggtccactccgcttcaactctgtttctcatcgaccaccagaggttgaagatcgtcagacagatcgttatcgcggtgaacaccaatccgatcagcactgacggggtcttgctcacctccatcatgaacgttccccaattaatcattcttccctccgttggccgtgttttgaatgtcgcagttccaagcctaccggcggagggaccttatacggaaagagaaaaacatgaacgccaaagagtatggccaccacgcgggtggctaccggaaggccgatggtggcccgtcacgcagattcatgcgcgggctagtggtttgcgccgtcgtgctcgccttctgcgtcggctggattctaagccatgcgggttgcgcgcatcccatcggcaacggtttggccgcgctcatgggcttcgggttcgttccactcagactgatcgcactggtgttgagcgaggcgggcatcgaataagtcttgccggacggcgtagaaaaccagccggccaagcggaaggaaaaccgaataaccctcgttgataactgaaaaaaacaactgacagatacggtgtcggttttcttggaccggcggggcgtcggctttggtctattctccggcgtcccgcttcgggcggtgcaggttgcccccagtcaagatcgcgtaggtcatgtatgcgcggcaaagaccgggaccacggttcgattccgtggccgtccacgaccgcaaggttacgcaaaaaaggaaagccccagcggctactggggcggaaagaaactccaatggaaaggataccccaatgagtgcgccattaccaaacctgatgacggtggaacagctcgccgaacactacgggaaggcgaagaagaccatccagaacaagctcacgcgaggctgggggccgacgccggtcaccgaccccgacaccatgcaggtgctgggcttcgaggtcgaggaggtggcccgttttgaccgcatcaacaagcagacgcgcaagcagcgcctctacgcctgacgtgccgaacgacatgcgacttgcggtcgcggaccggctgctcaccaaccttgacatcctgaccgcatatcccacccggcagtcgctggcgagcctcatcggattatccatccacgaggccgggctcacgctcacaccagagacgccgttatgagcacggcaacgttgaccgcgcccataacggacgaggggatgcgcatgacgcccggcgaactcatagaagaattctacaaacgtctggccgatttgaacacggacatgcgtaacccccgcatctatctggtaccgaagccgggtgtcatcacggtcgaccggccgtcgcgcagggtctcggcggtcgtggaatacgcagacaagaaacatttcagaaggagtaggtgatggccggagagacgacgctcaccattgtgggcaacctgacggcggacccggaaatccgcacgatcggcaccggggcgacggtcgcgaatttcacggtcgcttccacgccgcacgtatggaaccgtcagacgaaccagtacgaggacggtcaaaccctgttcatgtgctgcagcgcatggcgcgacctcgccgcccacatcgcccaatcgttgaagaagggcgtgcgcgtgatcgtgacgggccgtctgttacagcgctcctaccaggcgcaggacggggtgaaccgcacgatcgtggaactgcaggtggacgagataggcccgagcctgcgttacgcggtcgcggcagtggccaagcagtccaagcccaacggcttccaaaacaaccaacagggtcagcagtcgtattcgggtggctccacgtacggcaatccgcaacagtcgggctggcagcaggccgcgccgcaaccagccgccaacgacccgttcggccaaccgcaacaaccgcaatcgcaggagcaggatccgtgggcctccagccagcccgctcctccggccgatgggccggacgacccggaattctaaaggaggatcctcatgtcgatatccatagtggacattcccgtctcccaactggagccgaacccgcataatccgcgcagggacgtgggcgacgtaagggagctggcggacagcatcagggcgcagggcatcaaacaggagctgctggtcaccccgtccggcgaccgggacggcaggcccatgtaccgcgtggtcatcgggcatcgcaggctcgcggccgcgaagattgccggcctggacatggtgccgtgccgcgtggaggagctgtcggcgcgcgaggaacgcgagctgatgctcgtggagaacacgcagcgcgtggacctgaccccgttggaggaggccgacggctatcaggggctcctggacttgggtgtgaaggtcaaggagatggccgaacgcaccgggcgcagcatgagactggtgcgcggccggctgagaatagcgtccatcccccgatcggtgcgcgaggcgtcgcccgcgttcgcgcaactgtcgctctccgagttggaggacatcgcggaattcgacggcgacgagaaggcgcaggccaggctcgccgccaaggccggttccgatgatttcgaatggcagcgcaatcagctgcgccgcgaacgcgaccggcgcgaatgggtggaggccgcgcgcctgtgggccgaaagcaacgatctgcccatgctgcccgacaacctcaaaccggaggacatgtgggcgaacccgacaggctacgagaggcagcggcgtttcgcccaggattatcccggcccgttctccaagcagtggagggactggcaggccgagggcgcgcatcccggagtggtcatccgcttcttcgacgactcgggaagcgtcgtggcctacacgccggcgaagaagacagccgaggagagggaagacgggaaggccgaggcgaaacgccggatggaacgggagcgccgccacggggtgcgggagctcgcccaggcgtcggccgaactgcgctgcgaatggatccgaacaaccgttcccgtgttgaaggcggacgtgctgcgcgacatgacggaacgcctgaccctgttggagctgatgggtgccggcgattcgatgagaggcacgagcctggacccgaacgggtggatgcgcatggtcaaggcgtactccctgttcgccagaccgttgccggtagtggacgaggacccggagcatggcgtgtacacgctcaacatcgccgaaaacgcggcggaactgcgccgccgccagtcggttccctcccgtcggggcgtggagcttctgctcctgctgctggcccgccgcgagggcgcgatagacacggacacgtgggaccgtgaggcctaccagtgcgacctcaagggtttgaacgcctactacgaggtgctggaatcggccggctacgcggtgtcggacgcggagaggaaggggctggagcagtgaacacgaaagtggttatcagggtgcgcaacggcgatgacgcgccggtgagcgtggagcgtctcgtggtggattcacgcgccgaggtgggtgcgggggttacgccgatgctgctctcggacatgctggccctgttggacgattcgtgccatgtgaccgatgtggagatcaggagggcggagccgtgagcatcgaactggtggcgaaggccaagaagacccgattgcacggggacagcacggcgaaactgctgcttatcgtgctcgcggattacgcgaacgacgagggcatggcgtggccgagcgtgaagaccatggcggaggagacggagaagagcgagcgcagcatccaactgctgttgaggaagctcgaacagatgcgtctgatccgcaagggggaccagaaactcgtggccaaatacgcgaagggacgccgaccggtcgtctacaagctgtttccgaaggccaaaaagggcgaaaccccagtggaagcaacggttgagaggggtgaaacccattgcacccctgaaacaggttgcaccggtgaaacccacttcacccgaggggtgcaacccgcttcaccccacgggtgaaacccacttcgtttcaggggtgaaacccacttcacccaaaccgtcacaggaaccgtcaatagaaccgtcaagagagagtacgcgcgccagcaaaaccgaaaaacccgacaccacacgactccaggcgctcgccaacctcacccccgaccagtcgcaccggcagctcgccgacgaaatcggactcgacctggatgccgaactcgccaagttccgcgaccatgcgatagccggaggccacctgccggcagacccggcggcggcgttccgcaactggctgagacgcggccgcgaactcagactcggcaacaccaatcgagccgaaccggcgctcgcaggcggcttcgcccatcccacgccgccaccccggaaaccccaccggcacagctacgggtgcacgcacgtgctcaacctgctgaaccgtgacgcgccggacaacgacccgctggcattgcaagcggcggaactgctcaaccaaggaaaaaccgaaaccgaggcgctcgccgccttgggactcatgaaggacgatttggaggaaatcgcatgaccaggaaaaccgaagccctcttgtgggtggacatcgagaccaccggcacggatccgcgccacgacctgatgctggaaatcggcttgaggtgcacgagcatggacgcgaaaaccgagtacgcgcgttacgagtcggtgataaaacccggcgttctgcccacggacaggagtttcgcctacgcgcatcggatgcatgaggagaacgggctcatcgacgaggtcatcgacgcgagccccgaactgtgctccacggcgcgtgtggcgctcgccgtcatcgatttcacccagtcgatggcggaaacgcatgtgctgcatccggcgggcacgaacatgatgggcttcgacctgccgttcttggagcattacctgttcaccgaggaccagtgggggcgtttccaccgactgctctcctaccgcgcgttggacatgaccgccatccggttgacccaaaccgcgttgggagcagacccgtacgagcattacacgcagacgaaatcgcatcgtgtgacggactgcctggacatggacatcagcgaatacatcgaatggctggacctcgtcaaatgagccgcaccaaccccacacgggaaacacacaggctgaccgccagacgagaccactaccggtgcctgcgatgcggcaacgaattggaccacatctggagcggccacagcctccaccaccggcacatgagaagccacccgttccccggactgcattcgccagccaacctcatccatttgtgcggctccggcaccacaggctgccacggatgggtacacaaccatcccaaaacggcgatggcatacgggtggatcgtcagcggatacaacgaccaccccgaaaccgtccccgtatgggacgcgcaccaaggctggctgctcctcgacaaccagggcggatacacgctctgcgaccgggacggcaaccccagataacacacgcaagcaaaccgacacggaaacaagccggcgctcgccggctaagggaagggaagcatgacgttcgaacagacgaacgagaagcaacgccaacgcatgaaggcggacgccaggtcgcacatggaagcggcccggatgatactggccagcccgctctacgcgaggctcaggggcggcgaggacctgtacacggccgtctgggcgttgtgggaatcactcgccggcacgggattgtcgaacatgaaggcgggcgcggtatgccacgcatgcaagacccgtgacctcgaccaattggattgggcgctcacatcgatagccgaaaccgggtcgatacgatcatcctccacacccaccaaacacccattgcactgcaccaactgcggcaaggaatgcaggccgcacgccggcaccgcgatcctctgcaaacaatgcaaggaaaacctccgaagaagaaaaacaaaaccatgaacaacctggacaagtacatagcccgatgccggctcaacctcgaaccccaccacctccaacccgcagacgaaaccgacgacaaacattgcatcatctgcgacatcagcggcgctcgccggcatatccgcatggacggtctatgcatcaactgccacctcaaatggagacgcaaacacgatcccgcataccgcaaacgggtcaacgactaccagcatcgatggcaacaggagcatcccaacgaattccgcgaaatgaaacgccgctacgagcagaggaaacgagcaaaggaacaccaatgagcgtcaaaacctacacagactccaccacacgaatcatcaccaaaaccatcgaagaacacgtctgggaaatccactgcgacgccatcggatgcaacaacagcctcgaattccgggaaaaccaggacaccggagacatcacagcagacggcgactacaccggccccgacatggacaccgaatggctcgacgtccacgacacagacaccgccatccaaaccgcactccaacacggctggcaagaaggcaacaaaggcctccaacgaggccacctctactgccccacacacaacgaaaaccaataaaacaccaacaaccaaaaaagaaacaacgccggcgctcgccggcatagggaaaggagagccgatgaccgcactgcttgttggacgattgcgcgaactcgcgacgcagacccatctgctcgagaagaaagtggatgctctcggctggatggccgccaacggcccgcagacattgaaatcaatgccccgcgcccaggcgcatctcatgctcgccgaatgcgatctgctggacgcaatcgaaaacaacgaaaaggaggagaatgacaatgagtgagaaacccttctgggagggcaagacctgcgaggagatggccggactgcacgtcaaggccgtgttcaaaaacggtgtcacgattactggccagctcagccgtttcggcggtatacccatatccaccgaaggcatgaacagtcccatcccgatctcgtccaacacgttaaatttccgacctcacagggaaatctcctccgtcgaactgttggattccctagagtatgagcgtatcgacaatatcgaagacgtgcgcgaaggcgatattttcgttgccaaagacttgaaccgatactccgtctgctccgtcctccgcaaggaacatggcgaggacaatatcattcaagtgcatgtcgtaggtgtcggccagttcgctattctacgtagcgctttctcgtatgctctccgcccgaagcctcaacttcccaaccatggcggactttggttagacaaaaacgggaaaacatggattgtatccgatgacagcactatgctttacgaccccaaatccataacgtggctcggcttcatcagtccgaccagatcgatactcgggggatatcctatggaactcatggcgacgctgcaattaaactcgccccattccgcccggcaaaggcggtggaagcatgagcaatcgtatcgtgaaattgccctcggttgaatctttcggccgtctcacgcccgacaagtggcttttgttgaagacgcttgaggaggcggcggagatggtgcaggccggtgccatcggcaccgacagacccgagcggcattggccaggagttcgatgaccatgcgaattgcctcgcctgcttcggggtgaacgtgggcggcgagcttggcgatgaccgggacagggcgaaggtcggatggataggttacgtgcgcgaccagcgccgccaggccatgctcggtgaactggctgacgtgttgcagacggtcggcaacctgatcgccgcgttcggtatcaccgacgaagaagtggcacaggcgatggacgactgtctggaacgcaatcgggaaagaggtcggctgtgagcatcatcagtagtgaggcggaacgcctctatcccactctcacgatcgattccacgcatgacgcactggcacaggtctacaccagtgacgatttgcaggaggcgtacatggccggagcctcacgccagcacacggacgaggaaatcagggcggcttgtctggcaatcatgccctatgtgatatcccagccgtcacaacaggtgttcgatttcctcacgaaggcacccggcgcatatcccggccaggaaatcgtgcggaaggtcattgaggcaatgcaaagaaaggcaacggaagaatgaatcttttagatgaaaccaagagtgcgatctcacgaagcaagcattcggccgatgacgttcgattcgtaggctcccgcgacgagaagctgggaattccgtggagtcaggccgaaaaggtgctcgacatcgattacgacgacggatacggcagtcaggagatagccgccgatctggtcgtggcgttcactgatggcgggttcttgcgccgcgaggaatacgacggcagcgaatggtgggagtacgagcctccgttcagagtcccgacatcgcagaagccgttcaaactcgtgaagctgaccagctattccacacggttgcttgtggacatcaattacccgatggaggcaacggaggaatgagcgacatgaggagcttcatcaaggttgagcacagtcgtttcactcaaggaggaaccgtgacatataaggcgaagatattcacccgcgagcagttcggcaacgtgattgccgccgccatctacgactacgaacactcgcccgcgaaatgcctctacacgaccaatgacacggcagacaaactctacgaccggtacggcacggaaaccgaggcggaggaatgaacggagtacagcttaccaaccatctgaccgcgcaattcagggcatcagacataagccggtacgaggccagaatcaccgaggacggcggcttcagagactacctgtacgccatgagcctcaaacgtctcaaacgcaagtgcgagaggtacgcgaaacgtgaacgcaaggccatcgaatatgtcaccacactcaaggaggaatcatgagcgcgacgaacaaccagcgtgagatgatactcaaatggcataaaggcaaggacgcgacacccgagtacacggcgaaactcctcggtttgccgttgagcgaggtgctgtacgtgatcgagcatcccgaaccgccgaaatcacgcgcggacgcgtggacaccggaattcatcgaaccactggtctgaaaaataccgataaacacacgcgaatacatgactgaattcagcgtaaaaacactgaatccaacgaaagacaaaacgaaaccctccaccaacaggcggagggcacgctcaccaaagcaccatcatagccggaacgtggagggtttcaacataatgttcatcaccaccgaaccatgccaatactgcggcagccgacaggtcgaggcaccatggacgctctgccgggactgccgccgcgtctacgcgaaaacgctccaccggctccgccgcgacatgatgctcctgcaacaggtgtcccgtcacgcctacaagctcggagaacccggagcgggcggcaaaccgcaaggaggcgcggcgcccgcgcccatcaacctccacgcgcaggacatgctcgaccagatcgaggacggcttgcaggacatgtggaacgaaaccggcgtggaaagccgtccgagatggcagaccctgctcagggactcgccacgacgactgcccgacctatgccgcgccagccgttcgggacattggctgacatggctcatccacacctgcgagcgcatcgaaccgctcgtggaccgcaggccacgcacgcgccggataatcggcgtctgccccgaatgcggacgcgaggtcatggccgcgaaaggcgaatcactgctgctatgcaaatgcggcaacccaatcaacgtggtcgagctgcgcgagcagagccgagacaaggccgaggcaatccacctgaccaagacccctgcgggcatgagccagtggctcaaggacaactacggatacgaggtcagccgcaaagtaatcatcatgtggatacgccggggcaaactccccagcagcaagccaatagaaggcggatactacgaattcagcatcagggagatagtcagcatggcaatggcatattccagccggcagtaggctgttgccaccccgtggtatactccgtatcaggataagtgcgaaagcctctgggacatacatctcaggggctttactcatacccacctatgcgcgtagctcagcaggtagagcagcggtctccaaaaccgcaggtcgttggatcgaagccaaccgcgtatgccacggcttgcgtacggtagaggcctaaccggtcgcgctgggatagcgtgaccgggagtaaacaccgacactctctcgcgaattcgaatctcgcccaagccaccaaacacgtcccacacatcggagaacatcatgcataaaaacgaaaaagacgtggatacgcgaatcgaaaagctcgaaacacgcatccacgtcttggaaatgcaggtcatacaactgaaaaaagaactgacctgcgaccgtcactgaatgtcgatatcatcatccaacccgacacgggatgtcaacgaatccccggcttcacccggagtcgaaccgacccatatcgtcgaatcctgctgtgacagcgtgaactcgaaatgctcaagcaccccaacgacatgacttctgcccggcccgtcgtaggaaacctcgcgtccgagatccgcataaaccagatcacgaatcttcttcttcatattcacctccttaggtagtggatgtatatgaaatcctagttaccgtcccttattgcaaattccatagcctcgaggtgatcgcaatgcccagccagccgacaatcaacctccaaatcacagacgcccaggggcatgtgctcggcgaaatcgagtacctcaccgtaccgacgcgcaccacccccgacgggcacatcatcgtggacgacctcacacccgtcatcacggcctccgcccaagcctttaccgacacatggcaacgcctctgcgagggcacaccatgagccgcaacggatacaatccacgacaacgcaacgggcacaggcgcaggcagaacagggcgcgggtcaaagccgccaacacatgctgctacatttgcggcagaccaatcgactacacactgaagtcacctgacccgtggagctacgtgctcgacgaaacaatcccaatcgcacgaggcggcacgctcacctacaacaacagcggagccgcacaccgatggtgcaaccaaatcaaaggcacgcacacattggaatgggcgcgcagggaagtcgccaatattctcaacggcaaaggtaaaggcatgcaagcgcgaccaacttcaatcccattcacccggctcgacgtgtgaccccagggcggtacaccccaccccaccggcagtggctcccccggcgcatagagccgatatctccccacggtttcggtaacggtaacgcgttacggcatcggcaacgatttttaggaggcgtcatggcgaggatttgcacggtgtgcggctccccgctgcccaaggacgcgcgagagggtgccgaatactgttcctcgaaatgcaagcagaaggcgtaccggcagaggaaggccggcaacaggcctattgaaccaaaaccgaaggtgaaagcgaagcccgcgccgctgccgacgaaccgtgagctcgagcggatgatggacgagccgatggaggacgtgctgcgccacacgcgcgacgtgctgaagaaggcgttggacgatcccgacacccgcacatccgacctgccggcattgagccgccagtacatcacggtatgccgtgagctcgaggcactgtccggcggcaccgatctgttcggcgacgagtccgtggaatcaagcgaggtggatgatgtcggagcgtcgattgtctgagctcgcccgagtgctctcccaaccatcgggcatcgtctccagcgatttcccgaagctgcggcgtgcggccacgcgcatgggcatctcctacgacctgtggcagcagggactgctgtatctgatgctcggcaaacgggaggacggtttgtatgcgtgcggcgagggcggcactgtcatatcgatatgccgtcaggtgggcaagacgttcaccatcggctccgccgtgttcctcctgtgcgccatgcaacccaacctcaaggtgctgtggaccgcgcaccgcaccagaacctcggacgagacgttccaatcgatgtgcggcttcgcgaagaacaagctcatggccgggcatgtggagcatatccggcgtgcgaacggccagcaggagatagcgttccgcaatggttcgcgcgtcatgttcggcgctcgcgagcagggcttcggccgcggcttcgacgcggtggacgtggagatcttcgacgaggcgcagatcctcaccgtcaaggctttgaacgacatgatcccggccacgaacgtgagcccgaatccgctgatcgtgttcatgggcacaccaccgcagcccggcgacccgtcggaaacattcgccgacaaaaggcgtgacgggctcaaacacacggacggcatgctctacgtggaattcagcgccgaccccgactgcgaccccgacgaccgcgaacagtgggcgaaggccaacccgagtttcccgaagcgcacgtccgagaccgccatcctgcgcatgcgcaagctgctcggcgacgatgacaacttccgccgcgagggcttgggcatctgggacggggagaacagcatttcggccatagacccgcagcagtgggaggccggcaatatcgatcagccggacttggatggccggctcgcgttcggtttggatatgccgcccgaccgcagcgccctggccatcggcatggccgtacgccacgatgacggtacggcgctcatcaatctgcaggaataccgtgacgcgaaacagtcgggcaccgcgtgggcggtggactggcttgcggaacgctggccgaagaccagcgcggtggtcatcgacgcgcagtcgccggccatgagccttttgcccgacctgcagaaacgacacatcaaagtgatcgtcacccagtcacgtgatctgggggcggcgaccggaagggtgctcgacatgatccacgccggaaccctgcagcatttggacgcggagcaccagccgcaactgtccatggccgcgcatggcgtcacgttgcgtgacatcggccccaacgggctgaaggcgtggaacaagaaaggctccgacatcgacatttcgccgttgcaggcatgcacggtcgcattgcacggggcattcgtcagcaaacgcaaaccgggcaggaagcagagggtgatggtctgatggtcagcagtgaaatcgtgaccgccgcaggcggcaaaccgttcctcgccagcgaatcccttccctccattcgagctataaaaggcatcgatgaggctgattgggacatcatcgagcgtctgctgcgggtgtggttgcagaagcagaacggcaatattctccgctcgctttactattcggcgcacgaacgggtcaaggatttcggcatcagcattcccgacaagatcaggtcgaacgtgtccgtgatgattggctggccggccaaggccgtgcgcatgctcgccgacctgagcgcgttcgagggcttcagcgtcgacggaggctctgatgagggcttggctgccgacgtgtccggcgtgttcgagtcgaacgccctggacaccgtcgtctcgcaggcggtggtgagcgcctacacgcattcatgcgcgttcctcaccatcagccgcaccattggcggggtgaccatcattccccgttcggcggattggtcggcggccatatgggattcggtcaacaaccggatcggatacgcgctgaccatcaccgacgccgacgagcatggcgtcatcaccggtttcaacgtgtggctgccgaaccgcgtctacgtgtgctcgaacagtatgggcaagtggtccgcggaacgccaggatacgaattacggcaggcccacggtggtctccctgtgctacgacccgcaattgaaccgaccgttcggccgttcgcgcatcacgcgcccgttgatgtccctgaccgatatcggcgtgcgcaccatgcttcgaatggaggcgaacgccgaattctatgcggccccgaaactctggttcctcggagccgaccgcgacgccttcagcgaaaacacgtggaagagcctgataagcgccatcaacgcgatcagcaaggacgaggacggcgacgtgcccaccctgcagcaggtgcaacaggcctcgatgcaaccgcattcggacatgctcaagaccatcgccatgctggtggcctccgagacgaacgtgcccgtcaacgatctgggcatcacgatggacaatcccgcatccgccgaggccatggccgccgcggaacgcaagctcagccgcgaggctgaccgtcagaaccggctgttctcccgcgccctgaaggacgcggtgggcatggcgctggacttggattccaccgagctcgcgcgcatcaccccggtatgggcaccgacccgcgaggtgtcggacgcggcccgcgccgactcgttctcgaagatagccggcgtgcagccggcgttcgccgaatccgaggtcggctggcggtacgccggattcccccaaagcgatgtgacacagatcatgaatgccgtcaatgcgaacaaggccggcagcgtgctcgaccgattggtgaacggaggcgtcgatgacagacagcagcagccgaacgcccagccgcaaccaagtggacaaactcagccaagcgaaccagtcggtggtggcccaggctcagagcgagcttgacaaggtgttcgagaccgtcatcaacatgtatgacgatcccgccgaccagcgcgacgccctgctggagctcgtgcccgccatagcccgcaaatacggcaacatcgacagcgtggccgccgccgaatggtatgagaaggtgcgccacaagtggatcatagacgacgactacacggtagacagccgctacgacccggatgatgtgccgatgaggaagacggtgcgtcgtctcgccggccacctttgggacgacgaaaaaaacggccgcggccccgattacgacgccgcgaaacgcgggctgcacgccagcatggacagctgggtaaaggccggtggtcgcgagaccatcatgcgcgcctccaaacacgacccgtcgaagccccggtacgcacgagtaccgtccggtgcgaagacgtgcgcgttctgcgccatgctcgcctcccgtggctttgtttacgctagcgaggacaaggccggggcgctcggccaatatcataaggattgcgactgcgagatcattccgagctgggacaggaagaaccccaaaatcgagggctacgacccggacgggctgtacagggagtatctcgaggcccgtgattccatggaatccgaacagcccacgctcaaggaaatcatcacggccatgaaatcccagcccggccggtacaacgactcgtttgcgccgtacaaaatcagtgtcgccaaggagtcggattttgccgcgaccataggttcgcggcatgtttcggcgttgaacaagctgcttaacgattccaagcatcacgacacggccgagctcttctccagaggcacgaacgagtacaggatactcgacacgaaactgcccaatgacaccgaagcccatttcagcccctcggatggcggcatatatctgaatctcgccgccgtaggaaaacaccagccgggccacccgccatacaacacccttgtccatgaatgctcccacatgctggattggatacttggcgacgataaggcccagatgtatttctccgcgctgtcacgcgaagggcagtccttcgccctcatgctcagcaccgatgcgcgccaagccttcaacgagcgtctggcgaaagtccagggaggcagcctcaaggccagacgagaggccgcacttgggcaactctatatggacgtcgccgcggacctcggaaagaaaggggaccactccatccacgacatgttccaggccggccttggaagccaaggagacgactacgcctatctgctttcccgtttcgggcacagaaaagggtatttccaatccagcgggaaccaggaggccgaagcgttcgccgagatgatggcggcgcagataaccgatgagcattcatgggagataatggagaagtatttccccaacgccacgaaaatgttcaacgggatggtcaaggaggcgctgaatggcaaagccctggagtgacgaagtcgatgcgctgctcgacgagtacgcccgcagattccacgatatctatttccacttcggcgaaacatatccggacgatgacgaaaagctgaaatccgacatccagcattggctcgatatcggcaaaccgcgcccatggacggatttccccggagacgttctcatttaagcgagagcgacatttttttgtgaccacccgcacgggtggtttttttatgcccgaaaagggcccgtcaacccataaggagaacaatcatggccgaaaaccaacagtccggacaggagccgaacggcgaatcgcaggacatcgactacaaggccaaatacgaggaggccatcgcccattcacgcgaatgggagaagcgtgccaaggccaacaagaccgccgccgacgagctggaacagctcaagcagtcgcagatgagcgacgcggagaaggccgccgccaagaccgcgaagctccagaaggagctcgaagagctcaaggcggagaagcagtcgaacgcatggcgttcgcaggtcgcctccgaaaccggactgcccgcgaacctcatcaccggctccacgttggaggagatgcaggccaacgcgaagtccatcagcgaatacgtggccgctcagaccggcaggaagctccccgaggtcaagaaccccggcaagcagccggacgtggcgccgaacgacctgctgcagttcgcctccaacgtgttctccaactagcaaccaaccatttcacagtaaggagccaatatcatggctattttcggtaccggcggcatcgccgccatgcccaaccagatcgcggacggcatcgtcgaccaggtgcagtccggcagcgccgtaggcgtgctttcccagcagaaggcgatgcgcttcggcgagaccagcatcgtcacgttcgagaaccgtccgaaggcggagttcgtggacgagggcgtgcagaagtccagcaccaccggctcgttcggagtggtcaagaccgcaccccacaagacgcaggtcaccatgcgcttcaaccaggaggtgcagtgggccgactccgactaccagctcggcgtcatcaacaagctcgcctccgagggtgccaaggcgctttcccgcgcgctcgacctcggcctgttctactgcctcaacccgctgaccggcaagcctatcaagtcttggacgaactacctgaacaagacgaccaagcgcgtgacccgcaccgccagtccggacaccgacatcgagaccgccatcggcctgatcctcaacgacaaggaaggctgggacgtcaacggcatcgccatgagccgctcctacgccttcgacctcgccaccctgaaggacacgcagaagcgcccgctctacccggagctgggctacggcgtgaacatgaactcgttcaagggcattcccgcatcggtgaccaccaccgtcaatgccccggagttcgtcgcgccctcggccggagatgactacacggtgccgaaggtcggcgcgatcgtcggcgactggaagaacggcatctattggggcgtgcagcgcaatctgccgttggagaccatcacctacggcgatccggacggccagggcgacctgcgccgcaacaaccagatcgcgctccgactggagatcgtctacgcctggtacgtgttcaccgaccgcttcgctgtggtcgagggcaacgcacccaccagcaaggcggccaagtgatgagccaggcagtcgaattccaccacctgacctcaggggtggcgaacaccgcccgccaggcggtcatcgaaacccagttcgtcgacgataagggcaaacccatcgacctcaatggcggttcttccaccccatctgctggcagcgtcacgccggccagcctcggcggctattcctccggcaccggtcacggcaaggtcgtgcaggtcaaggccgatggcagcggcttcgacttcgtcgccccggtcacggccccgaccgccgacacgcttaccggtgccacggatacgggcaagagtctgctcaaggcgactgacgctgcgacggcgcgcaaggccatcggtgccggcaccagctcgttcagcggctcgtacgacgatttgacgaacaagccggcgaaccctgccgcctacacgctgcccgccgcgaccgctgcggcgttgggcggagtcaagcagggtgcggccgtaccggacctcgccaccgacgcgaatacgacgaccgcgaacgccaagatcaacgcgctgctcgcccaactgcgtgcggccggtgtgatcgcggcctgagggaggcgcgctcatggccgatgacgctgatccgggcatgaacgtgcccgctcccccgttcgccagcgccgatgatctcgcctcccgttggcatgagctcaccgacgccgaacgggccaaggcggagacgatgctggccgacgcgagcgacaagatcatcaccgactgccccaattgggctcaggcctcggagaccacgctgcggcgtatctgctgcgcgatggtcaaaagggccatgctcaacgaggacgtcgccggggtcacccaatccacgcagaccgcgaacggtttcaccgaggccaacagctacagcaaccctgacggggatctgtatctgacgaaatcggagaaacgctcgctgggttgcggcgtgcaacgcatgtggagcatcgacctgtccgacgggagcgtgaacccatgagactgcatggcgaaaccatcaccgtcacatggcgcgtgccgaccggcgaggtggatgggggcaacaagcccgtctgcaggacggaaacggagaccatcgacgacgtgctggtcaagcccggagccgacgagaacgccgccaactccacacggccggccggtatcaccgccgcgttgacgatcgcaataccgagggtctggacgtaccggagcctcaggaatgcgctggtcaccatacgcggccacgactatcgggtgataggcgacccattgccggtcgacggcgggattacccccacccggtggaatttgagcgtcgaactgacggatacggagggatgacgcatgtcaagcaacgtgaaactgaatctgccggcgttcaccgcgttccgccagtcgccgcacgtgatcggtgccgtcaatgcggaggccgaacgggtcgcggcgagggcgaacgcgctcggccacaactcgcatggtggcaaaccccagtacggggtgctgccggcgatcccgtcgaacgtgggcaccatcgccctcgtgcaggccgagaaccatcaggcgtttgtcgacaactcggcccacaacacgttggccaaggctttgggaggtggcggctgatggcggtcaacgcggaaaaactcgtcatggactggatcaacgccgacccgacgatcaaggccgaatatccggccagtttcgacgtgcccgccgaatcatcggccacgcacccgatgccgttcgtcaccgtcgaacaggtgggaggctcggacgaacggttccgttcgctgccgcttattgcggtgcaggtgtggggcgagtcgcgctggctggtctccgaagctgcggcgaaacgcatcctcccccggttgaaacgtatcacggaactgcccgaggtcgccgccatcgacatcaccggccgcacgcatttccccatgccggacgggcggccccgttatcagatactcatacgactcaccgtcaaatcggacgactaacgaaaggtctaaatcatggctgattccacaaccaacgattccaccatggtgtcgttgggcaagttcaaggtcggcggctacgcctactgggcacccgccggtaccacgccgccgaccaatgccagcaccgcattgtcgagcgccttcaaactgctcggctacctgtcggaggatggtctgaccatcacgaccgacacggacaccaccgaggtaaaggacgcgaacgggcagaccgtcatgaaggtcatcaccagctacgcggaatcctaccagttctccatgttggaggtattgcgcgtcgaggccgcgaaactgcgctacaacgaggacgcggtcactggcagcgacaagagcatgaccatcaagcaccagatgccctccgacaatggcttcgtgctcgtgttcgagatcgcgatgaccggcaatgtgaaggaccgcctcgtgatcggcaacggcacgcgcgccgagttcggcgaccgacaggtgcatgcgggcgacgctcaggtgtacgacgtcaccgtgtccgcaaacgacatgggcaacggggtcaccgccatcgaatacatcggcgtcgcggccggcgcgtccgagaccaggtcaacgccgaggccctgaccggcaaggtcgtggaccaggtcaacgccgaggagaccgccgaacccgccgaggagacgccggccgccgagtaacggttcttcccgcgtcgcgcttcactcgacttcacgcgacgcgggtccccatgatttttgaagtcggttcatttttggagaagtcatgtcacgaaaaagcaaccgcaaccgcaaccgcaaccgcaatacaaaccatccggctgtgccacaggatcacaggcccgcgcaggacaagccgcgtaccatcaccgtcaagggcgtggacctgaccatcgacccccggtcgttggacgactgggagctcatggaatccctctacgacctgcagtccgacccgcagaacaacgcattgagcgtcgtgccgttcatgcgccgtttcttcggcgacgactaccagcgagtcaaggacgcgttgcgcgaaccggatactggcgtgatcaccggcgatgccatagccggcttcgttcaggagctgctggagcggctcaacgagacgctcccaaactcctgatgctcgtatacctgctgcacgaatgccccgaccagttggcggcggacatgcggcgggtatacgggctcggcatatacgagctggatccgttggaaacggccgtgttggccgtgcgcctgccggccggctcactgatctggcagaaactcgacgttcccatggcgtggacgctcgaccagtatctggcggccgtgcgaatagaccagatgaacatgtggatgtggggcaacagcgacccgaagaaacgcgggccacgtcccgaacccctgccacgccccggcaacggggcgacggtgtccgcgtcgaacccatcccagacggccgacgcagacaccgcgaaggcgcgaaccatcaagcccatgggcctgaccctcgaccagctcgaggcgttcatgagaattgacttcaccgacaggcccgacgagctcgtcgtgcaccgcgaataaccgaacagagaaaggcataggaccatggcctaccagctcgcccaggcatacgtgcagatcgtgcccagcatgaagggcgtgggcaaggctatcgaaagcgcgtttgccggtccatccaaatcggtcggccagaaagccggagacaccgccggcggcggcttctccaggggattctccgcgaagctcggcatgatcagcggcatcgcccaaagcgtggccggcaccgtcatccaaggcttcgccggcctgtccagccagatcgtcgaagcctccgactccacccagaaattcgccagcaccctaggcttcgccggagtctccgacgccgagatcaggaaactaaccaaatcgacgcaggactacgccgacaagaccgtgttcggactctccgacatccgcaacaccaccgcccagctcgcggccaacggcgtacccaactacgacaagttggccgaggcggcgggcaacctcaccgccgtggcaggcggcggggccgacgcattcaagagcgtggccatggtgctcacgcaaaccgcaggggccggcaagcttaccacggaaaactggaaccagctctccgacgccatccccggcgcttccggcaaactccagcaggccatgctccaaaacggcgcatacaccggcaacttccgcgacgcgatggccaatggagagatcacagccgacgaattcaatcaggcgctcatgcagctcggcatgagcgacaccgccatacaggccgccaccagcgccagcaccatggaaggcgcgatgggcaacctcgaagcaagcgccgtcaaactcggcagcaccatgctcgacagcgtcaaaccagcgctcaccggattcatcggctgggcgtccgacggcatcagcgccgcaacgccggtcatccaagccggaatccaaggcgtcatcggatggatgcaggacctatggaaggcgctcaacgacaacggcgcagtcaccgcgttcaagtccgcttggaacgcgatcaggaacgccatcatgggcgtcgtcaacatggtcatcgactggagcaaactcgcccctcccgacaccctcgccaacgccatcaaactcgtcgccgacgccctgaactggttcgtgcagcatggcaacacgctcatacccatcatcatcggcatcggcaccgcgttcgcggcggtcaaaggctatcaggccctcaacaacgggctcaccgcgctgaccaacaccatgaacaccgtcacgaccgccgctcagggcgtcagcaaaggcgtcatgctcatgatggacatgggaggccccatcgccgccatccagcagctcacgagcaaaatgaaactcgcccaggccgcgcaggaagcatggagcgccgtcaccaagaccgccaccgccgtgcagggcgcgttcaacgccgtcatggccgccaccggcggccccatcgtgtggataatcggcctcgtcgccgccatagtcgccgcattgacattgttcttcacccagaccgaggtcagccggcaattatgggccgatttcaccggcttcctgcagacagcttggcagaacatcaccgatttcttccagaccacgtgtcagaacatcacgcaatggttctccaacgcggccgcgaacattcagaacggatggaacgcgctgaccgcgttcatcggttcggttcccggcaggatacaggcgttcttcgcaggcatcggccaatggttcgcaaacaagttcaacgaggtccgcaacggcatagccaacggcttcaattcggcggtctcgttcatcgcctccataccgggccgcatcctcagcgcgctcggcaatctcggaggcctgctgtggaacgcgggcgcaagcatcatgcagggcttcctcgacggtctgaaaagcatctggcacaacatcacgagctttgtgggcaatatcgccggctggatcgccgatcacaagggcccgctcccctacgaccgcaagctgctgattcccgccggcgaggcgatcatgggcggtttccgcaagagtctgaacgccggctggcagcaggtgcaggcggacatcatgggcatgaacgtgggactttccaacgggttcaagaccccggcctacgtgtatggcggttccggcatggactacacgcccaacaccggttccgcgtcgaacgtgcatatcacgaactactatccgcaggccgacccgtggcccctgtccacgaacgacagtctcgacaaaatgaccgtaggcatctgaatgaggaggcgtatatggccggtgtcggctacgcgttgaacggcgtcgccctggattcgcggtactgccgggtcacgctcggcagcaccctgttcgccggcgtctccgtatcccgcagcaaggtgtccgcgccgttccggcatggcacgatcccctcgggggtgacgccgacgttcggagaacggtcggcgaccctcaaggtggccgcgttcggggcgggcgcgatcggccatgacacggggcatggcatggattcgagccgtctggcccgcctgtgcacgacgccgtatccggtcctgtcgcgcaccgtcaacggtcaactccagcaggcggtcgtggagctcgccagcctcgaggcggacgacgggggcaccgtgttggacaggctcactccgttcacggcggtgttcgccatgcctcaggtgtggtggcgagacccggtcgcgtatgaccgtccggtcgcggcgaatggcacggcgttcctgtggcccgccgcatgccggtgggcgcagccttattggacgcggtgggaggtcgagccgaacaacagcacgtcgctgctggcggatttcgtgaccatgtggattggtgagccgaacaattcgccgtcgctgctgatcccgttgtcgtcgggcataccggatggcatgttcggtgacgcgcccgtcaccgatccgataatacggctgcccaagggcgtgagcagcgcctcggtcaccgaccccacgtcgaacacgggcgtcatctggcagggtgcggccaacgcgaacgcctacacgtatgtggacgtgggcaactgcctcgcatggcagtccacggcggatcatcagtggacgcaatctggcacggacgtgaccggcggcttggattatccggcgggcggcctgctgcaatgctggccgaacccggtggacaacggctaccggctcacgtcgaagatcaccggcagcggcgagccattgctcgtgcacgtgcgccgcgcatggtggtagaccccgtattccccttctatgcaatttccgcgccggttttcaacgtctggagtccccttatggtcaagacactgcacgcccgcctcgtcgcctacctgcccaacggcggcaggctcggcaacctgcccgcaccgctctcatgggacacgagcatcgtcaacaacgacctcggagcactcaaggtcgtctacagccgtcgtaccgtcggcggcggaatcctgaaacgcggcctcgaacaggggctcgagatcgggctcgaggtcagtgacggcggaacatggagcgaaccctacaactgccgctacctgctcataggccgctcccgcaacgccgaagacgtgtcggacacggtgacgctcacctgccagagcatgggctggctggccaacaagattctgaacaacgacaccgcgcatctgatagcggacggcgacaacaagggcaagcgcgcgttcctgtcgaagaaccccggcaccatcatcagaacgattctcgatgagaacaaggcccgcaagggtgccggcctcgttttggcccccggtttcgacaccggcaaggacgcggctggcgcgaactggaagagcgtgtacacgctctactactcgttgggcacgagcctgaacagcatgctttcgagcatggtgggcggcggtgccatcgactggcgcaccgagggccgcaccctcagaatctggaacgccgacagcaccagtctcagccgtgacctgtcgggccgcgtgcacatcagcatggcgcacgacatactcgaggcacccgaagaggaaagcatcgaagacctctccagcgatatcctcgtggagggtgacaacgggctaatcttccgcgagtcgaatccggcggcacccacgccgtggggtggctgggaatcctatgtctctcagggtggagtctcggacgaggccaccgccaaggcgttcatgcagaccacattggccagcgcggcccgtgtgcgcggccagtacacccgctcgctgctcgtcaccaacgccgaatcattgccgttggtggactaccggcccggcgactggatcaccgcgcccacagtccagcacggcgagaaggtgcgaatccaacaggtcaccgtttcgcttgactccaacgggctcaaggccagcatcacgctcaacgacaaggtatacgactcgcaggtgcgagccgcgaagaagatcgccggcatcaccggcggcgcgcaactggccggcagcgagggcgggcgtcccgccccgagaaggaccatcgtgtgccgaatgctccgactggtctggtggtgcagaccgacgcctatatctcctcccgtggtacggctttgggtctggctaccctgcagtgggccgcggtctctcaggcgacggatgacaccgccatcgacatttcgggctaccgcgtggagtatcgcaagaaccttgccggtgcgccgtgggtttccggtggcgtgactgacgcgcagcggctcacgttgggcatcggcgggctcgaatgcgggcaacgctatgagttccgggtcagggccgtgccaacgtattcagacaaattgggcgactggtcgaacgtggtcgtggctttggtggcgtcggacgtgacgccgccgagcatcccgtccaagccgatactcacctcgaaattgggtgtggtggacgtgcagtgggacggcaggaacaatgccggcggcggcatggagctggacttcgaccacgtggaggtcggcatcagcgactccaacgggaactggaaataccgggatagcgtggcgcgtgacgggcattgcgtcgtcaccggattggagtatcgcgcctactggttcgctttgcgttcggtcgatcattcgggcaacaagtcggattggggtgtgggcgcgtcgatcacggtcgccagcgcggtgtcccagaccgacctggacaggctcgacaaggatctgcgggacaacaagaccgccatcgacaacgcgaacagggaattgtcccaagccaagcaggatatcgccggcaatacgacggcgataggcaacgcgaacagggaattggctacggcgaagtccgacctgacgcaggcgaagcaggacatcgccaacaacacgacggccatcggcaacgcgaacaagcagatcacgtcgaacaagacggccatcgataacgcgaacagggaactggacgcggctcagggcgacatcgcgcaggcgaagaaggacatcacgcaggccaagtcggacgcggccaacgcgaaaaacgaagcgggcaaggccagcgcggccatcgagtcggcgaagtccgacatcgcgaacgccgcgtcgaaggcccagtccgcgttggacaaggccaattccgtgggcaagagcctcgacggcctgcacaacgtgtacgaggggcccgacgacccgaccacgctttccggcgtgaccgtgcgtcagggtgatttctggtacaaaacccaaaaatactggacgcgctggtccggcgctgcgaacgacagcacgtccctgctggccgacttctatacgggttgggagggcgagccgaacaacagcgcgagctggctcgtgccgttgtccagccgtttcatcggcgtgtacgtcttcgacggttcgcggtggaacgagcgcaacatcgtggccgcgaacattctcgcttccggcagcgtggtcgcctccaacatggcggcgaacagcatcacgacggagaagctggtggccggcgcgatcaccacggacaagctggcggcgaacgcgatagtcgccggcaagatagcctccggtgccatcaccacggacaagctggccgctttggcggttaccgccgacaaactcgccgccaactcggtggtggcgggcaagctcgcggccaacagcgtggacgcgggcaacatcgtcgccggcgcggtgaccgtggacaagctggccgccaactcggtggacgcgagcaagatcgtggccggagccatttcgacggacaagctggccgcgttggcggtgaccgccgacaagctcgccgcgaacagcgtagtggcgggcaagatcgccgcgaacgcggtcaacgcgggcaacatcgtctcgggggccatcaccaccgagaaactggccgcattgtccgtgaccgtggacaagctcgccgccaacagcgtgaacgcgtcgaagatagtcagccagtcgatcacgggcgacgagatcgcgtcgaacacgatagtcgcgcgcaacatcgccgcccagtccatcacctcggacaaggtggcggcgggccagttcgtcggctacgtgttcaccggcagtatcttccaatccagcactgcggataacacgggttggaagctcaagggcaacgcgctggacatgtgggactcgaagcggaaccataccgtgcatctggacggcgagggcgcgaacaacctgctgaccggcacgttccagacgagcctcaccggctgtcgagtcgtaatatcaccgacgttccgacagtcgacgatcaacagcgatgaaaagaccgaaggctcaggcatcgaattcaggcacgggcgcgacggtcacgacgcctacatcgcgtcggaatcccggaccaactataagggcgaggtctccgccatcgtaatcaacggaggccggttgaacgacaccgatccggggtcgttcatgcgtgtgggcgaatacaaggctacggacaacgccaccaaaaccggcgaagtcttcctagccgcttaccgtgattattccaaaggcagcaagagcggtaaagcgcaactgttattgcaggccgacccgacgtccaaataccatacatcagccgaactctcagcgagggacccgaacggcagtgtcggcgtggaggcggacatcaactccgggtatctgtacctcggcgggttcctcggcctgtttggcgcggggcgcggaacgttcaggacggcctattttcgtaacgggataatgagcggcgaagggtggctgacgcagacgtacacgtatgcctccccggccaaatacggcttataccatgcgcatgtctccgccgacgcaatggggtcggtcatggtcggttcgaacaatgattcggcgagcggctgcggcctgtgggcgcgtggcgtcggcaacggcgtcaacatcccatacggcactcagctactcgccatcctggccgaacagtaggaggtgccaatggaaacggaaatcaacggcgacgtgttgaccgtgaccggtgacgacgggacgggtcatctcatcccgttggacgcgatcgcctcgtggggcgagctcctcggctgcgacacggacatggaagcggtcgcggcgatcatacgggtccggacgaacaggtcagacccgggcgtcatcgacccggccaccggacgcaacgcttggaccagcgcctacgagcagttggagcatgacgcgctcgtcgacctgaatcaggtgcgcgccgcatcactgcaccgcgcgttcacgcccaccggggcgctggccgccgacgggcgtgcggagacccgccggctgttgggcttggatgccacgaccatagtggactcgtacgaggcggacgcggctctcgccgccgcgcgggcgttggacgaaccgaacgccggcgagccggtggagccgtcgatacggttgcccgccggcgtggacgccacgagcctcgccaccctgctcgccgaacacgcgacggaaatcgaccgggcgcgaaccagatttctgaacgacgtcacaccaaccatcaccgataggagataaccaatgacagacacaaccgaaagcctcgtgcaggcggacatcaacgacgtgctcgacaacatgagcgcccgtaacgccaccctgacccgcgaactcgccatcagccaagcacaggcaaccgcactgcaacgcagggtcaaggagctcgaggccaagcaggccgaaaacaagtaatcagccaaaccattttcccgaaagccaccccacggggtggcttttctcatacccgaaaacagaaaggggccggaatgacgtatctgcgcaacctcacgtatccgagaatgatgctcggcaaccccaacaacagcacggtctccatgatcgccggcaaccagaagggcgtcaccataaccgcccaggaaggccgacaggactgcttcacccaaatgtggttcaacacgccacgggacacgagcctcgtgttccagacggacatctggaacgtggtcggagaccagtccaccgtgcgcaacggctacgtcctcatcgccgagatagacccctggaattcactgtgctccgccgcgtctgcaggcagaacatccctcaagttcacgccgaccagagacttcattatccggctcgcctgccccgattcgggcagcgccaacttcacacagcccctgctcatgacggaagccgactggaaccagatgcgcgcactcggcgaaggctacttcgacggcgacctcatgccattaaccaatgggggggtgtaacaatcctcatcccgttcatgccgcccaccctgatcattgggggttggccgcatgacgctgataaccaaccattaccccaacccgttgttcaactcgcgtggggcattgccctccccgagtggcggttccggcaccataacctgcatcgacgcgcagcggcaactgcgactgcagtcgaccgacgctggaggcgtgcaggcggcacaggcgttgaccggactgccggcatcgacgcgcatggtgttccagttctcctactggacgtccgacaagtcgctgcgcaacggatgcctgtgcatcatcggccgcaacgcctccggctggacggagctggcccgtggcggcaacccgcagtccaatggcgtccacgacacggtgacgatcgagttcaccaccccgcaggatgccaatggaacccagatcgtgttcgacagtcccctgaaaacgggcgcggtgacggtgttcgaccggcccacgctcatgaccaaaaccgactgggactggtggcagaggaacaatcacggcaggctgctctccggcgatctcatgccactcagctgaccgctccccgattggcggtggcggcatgacctacatcaccaacctgtacaccgacccctcatgccgcaggaacttaagcacgtggtccaacggcagtggcgtgaatgtcgagcacatcgacgggcacttccgctacacgaatactggcaacaatagctggtcgataatcgactggtatagctggcgtgaattgatgagactgggccgtgtcgtggtcatcgcctacacggccaccagcgggctgagcgtggcagtggagagcggcatgacactcgtctccggcacgaccccatcgggtgccgcatggacggcggcgaagatcaacagggacggcaaccgcagcatctactgccgtggcagtggcagtttgacgttggaggccatggccgtgtacgagggcgacgattggccgaccgtccaacaactcctcccccggttcccgtggttcgacggaggctcgatgcccctccggaacaattagcgaaaggaaagaaggtcatgacctagatgaccgagacgatacccgtatgggcaacgatcctggtctccgtgatcaccacgtgcggcggcacggtcgccggatggatactgcgccgcatcgaccaggcgggcaaaccggacccggccctgtcgcagagactcgatcaggtggacgcgagcctgacccagctcgaccagcgtctcgacccactgcaggatggggtgaaaaccatgctcctgtgcaaattggagcagatgcagcgtgagatggtcgacgctggcggtatcgccgacaacgacctcaaaacccgcgccgaaggcgtctacgccacctaccacgcgcttggtggcaacgggcacggcacccaagtcaatcaggacatacaggacgcgccgatagccccgagaaaaccacaggcttagcccccgccgaccccgacgggggctatttcatgcccaccccacacataggaaggaaaacgaatgggcagattcaaaaacagaagcaagccgctgcaggccctcatcgcggcactgttcgccgtgctgctcgcgtgcacgccggcgatcgcgatggccgacatggtcggcatcgacgtgtccggctggcagggctcgaacgtgacctgcaccgccagctacgacttcgccgtagtcaaggtgtcccagggcgtaggcttcgagaactccagttggcgcacgcaggccaagtgcgtgacagaccggggcaagagcctcggcctgtaccactacgccggcggcaacaacgccgaggccgaggccgactacttcgtcggccgggcgcgcgactacatcggcagggccgtgctcgtgctcgactgggagtcctatcagaacgcccagtggggcaattccgactgggttcgccggttcgtccagcgcgtgcacacgctcaccggcgtatggccgatggtgtacgtgcaggccagcgcgctgggccagatacccggcgacgtgcgcgccaactgcggcctgtgggtcgcccagtacgccagcaacgcgcccaccggctaccagagccgaccgtggaactacgcggtctacggcgaggccatgcgccagtacacctccaacggctggatcagcggctacaacgggccgctcgacctcaactacttcagaggcgacgcaagccagtggcaggcctacgccaaccccgccgacgcagccaagcccgcaaccccgccgcagaccgagaagccgccgacccagaccatcgacctacaggcactcgcgaccgccaccatccgtggcgactacggcaacggccagcagcggcgcgacgcgctcggcgcgaactacgacaaggtcatggcgatcgtcaaccagcgcctcgccggcaccgcgaccgtagcgccgcagcaggccgcgcaggccaacacgacccgcgtggccgtccgctccggcgacaccatgagcggcatcgcctcgcgcaccggcctgtggccgctgtccaagtggagcgtgcccagcggcaacctcaacctgatctaccccggtcaggtcgtcacctacaacggcggcggcagcgtcgccaccggcagcaacgccccaccgtcccgtaccgtgaccgtccgcgcaggcgacaccctcagcggcatcgcggcacggctcggcatcggctacacgcagctcaccggctatcgcagcggcaaccccaacgtgatctaccccggcgaagtgctgcgctactgataacccgacctacctaggaaccctgcacccgacaccgggcgaggttcctaggttccaaatcacagaatcgaggacaatatgaccgacgaaaacaccgaactgaagaccgccggcagcagccgaccgtgcccgattggctgctgccgaaccgagcctatgacgtgctcaaatggctcgcgctgatcgtgctgccggccatcggcgtgctcgtgcagaccctcggccccgtatggggctggacatgggccgatcaggccgcgacgaccatcaacgccgtcgccctggccatcggcgtcgtcatcggcgcaagcaccctcaaggccaaggcatccaaaaccgaataaccataaaaacaccgcccctccatccggcataacgctggacggaggggcggttttcacgttttgggagtagctttccgaggctcattttttgcccacattttgcccacattattccgggaaaccgagggaatacgagggaatcaccgggaatagaaaaagccgctcagccctactctcgcaaggcaaaacggctattttccacagtctagcgaaggtgcctccggtgggactcgaacccacaagccgaagcgatcgattttaagtcgactgcgtataccatttcgccacggaggccaacttttctattataagctatctcctgccctgagcgttgcttgcgggttgctgcacttcgtgcagccgtcgcggcatagccgctcccttcgcctacaaaccgcccagtgtgctgtttgtagcagccggtagcgatagcgtcgccggcgtcgcatataaagcaaacagcccagtgggctgtttgctgaacgactcagcccactgggggtacttaccacttacgctattgagccagcaaccggcgaccataatcgagcacaatgccgtccagcagcccgtgctcgctggcgacgaacgaatcgatggcttcaccatgatcggccttggcggcttcgctgacacgcgccagcacacggctccacaccacagcgccgccgccgaccacatcgatacggccggggtggatggtcttgtattcgcggcgctcggcgcgcgtcatcctaaggaacttgtcgtccacggcataggcgtcttcaaagctcaaccgatgcccgtcgaccacggtgtgatcgtattccttcaatcccatggccaaggcggtcatcgtggtcaccgtgccggacacgccgatgatggtacgggccttgcctgcgtccacggtgcggaaggcctcatcgatatgttcatcgacgtccgcaacggcctcatcgatctgtgtctgggtcggcggatcgttggtcagatgacgttcggtcatgcgcacggaaccgatgttcatggaaaacgcgccctgaacctgggtagtgggcgcactgacgccgtcgccaccgatgaccagctcggtggacccgccgccgaggtcaaccaccagatagggggcgggcagatcgtcgcgattgaccacggaagtggcgccgaggaagctcaggtcggcttcttcagtgccgggaatgacttcggggcgcacgccgaggatacgttcgatctcatcctcgaactcctcacggttttccgcgtcacgagtggcggaggtggcaacgaaacgcagaccgtcgatgggatgctcggcaatcacaccggcgaattcccgagcggccacataggcgcgttccaacgcttcgtcggcaaaacgatgggtcttgtccacatcctgaccaaggcggatcacacgcaggatgcgcggcaccacctcatgcatgccatcggcatcgacacgtgcgatcttcagtcgaatggagttcgtgccgcaatcaatgccggcgacggttacggattccttgctcattgccttctcctcgtatcccttagtgcgtatgaatgggctgttcgcggtggctcatctgttgatcaatcgtccagtgtgcaacggcagacggtcggatcgaactcgtctttgacacgttccagcaccaaatcgccaatggggttggcacccggtcccataaccagggattgggccagcagagcgtgcaggcacttgacgcgcactggcatgccgccggccgaaatgccttcaatatgcttctcactgtcgccaagacgtcctgccagttcgtggcggaatgccagatacagattatgggcctgctcatatgcggccttgagctcctcatcagcggccagcatatcgttgtattgctgcatcacgccggcggcctcgacatgggaggcagccttgacggcttccggaccggtcagatagcacgtggtggggaaagggattccgccgggcaacaccgggcgggtgattacggcaagtggcctaccgcagacgcatcgcgctcccacggcgaccatgccgcgcgggtatcggccgagctgacgctgcaccaggtcgatgtcatggtcgttggcgggctcggcaagcatggtgtcgacaagggccttggccttggcggcgatatcgatggtcactgttgggttccctcccctgtgttctgttgggtgttctgatcggatggggtgttctggtctgacttatcggactgcttggatgagtcgttggatgacgagtcagaggaaccggaagtatcggatttgccggactcgctatcgttcacaggctcatcggcctttttgagcgagtaagacagttcgctgtaccatggcaggacttttttgttgctgctactggaatcttccgttttctgggattcgctatcggatccggtcacggcttcgggatgcagcacacgcacggcctgttctcccgggaacacgaagccgagtcgttcgcgggcctgtgcggtgatgtacgctttgtcatcccaacgcttgatgtcgttctccaactcctgcttttgggcgatcagcgaggcctcctcgcgcttgagaccgttgagttcggccagattcagggcataggtgtggaaggtggagaccagctggatggtgccgagtgcgatgatgaacagggagacgaagaacgctatgggccccgctgacctttttctcctgacttgtgctttgccggttttgccaggtttgccggtacgggacgacttgctcatgtcacatgaaaatacccgccgcattcgacttgacgaacacgacgggtatcgagcttcagtggaaactcacgcctttacgggcgtttcagctcacttggccaggtacttcttgcaggccttgaaagcggtgtagccggcgtactgagcggtggagccgagctcctcctcgatctcgagcaggcggttgtacttggcaacgcgctcgccacgggccggggcaccggtcttgatctggcgggtgttcttagcaacagccaggtcggagatggtggtgtccggggtctcgccggagcggtgggaaaccatggaagtgtagccgttggcggtggccagctcgatggcgtcgagggtctcggtgacggaaccgatctggttcagcttgaccagcagggagttggcggcgccgaggtcgatggccttctgcagacgggccgggttggtgaccagcaggtcgtcgccgacgaactgcagacgatcgccgaggcgggcggtgatggcagcccagtcttcccagccttcctcgttgaacgggtcctcgatggagacgatcgggtactcgttgatgaggttctcgtagtagtcgagcatgtaggcggagtcgcgctcctcaccgtcgaagcggtacttgccggtctccttgttgtagaactcggaggaggcgacatccaggcagatgccgatctgcttgccgggctcgtagccggcggcggagatggcgtccatgatgtacttgagggagtcctcgttggacttcatcttcggagcgaagccgccctcgtcgccgaggccggtgttcaggccttccttcttcaggacgttcttcagggtgtggtagacctcaacgccagcgcgcagagcctcggagtaggtgtcgaagccgtacggggagatcatgtactcctgaatgtcggtggcgaagtcagcgtgagcgccaccgttcatgatgttcatgttcgggaccggcaggatgtgtccgttggtgccgccgatgtagcggtacagcggcaggccggcggactcggcggaagcgtacagagcagccagggagacgcccaggatggcgttggcgcccagcttgcccttgttcggggtgccgtcgagctcgatcatcaggtcgtccagagcgcgctggtcagcagcgtccatgccgatgaccttcggagcgatgacctcgttcacggccttgaccgcgttaagaacacccttgccgccgtagacggacttgtcgccatcgcgacgctcccaagcctcagcttcaccggtggaggcgccggacggaaccagacccttgccctgagcgccgtcttcggtctccaggtagacctcaacggtcgggttgccacgggaatccagaatctgacgcgcgtacacgctttcaattactgccacaactactccttaaaacggttgtgtatcttgaatgacattcttaagagtagtgcgatttgtggacgttgtgaacaacacgcccaaaatttagtgttagcgctcacaatgccagtgtgccgcctgattgcaaggcagtacggacgaaatcgctcagtcgatgtccttgccattgaggtagtcgatttcactgtcggacaatttcagttcgccggctttgaacgagtcctgaatctcctgcgggtttctggccgagggaatcgtgaacagatattggtattgcgcaagttcccacgcgagcgtgacgcgctggtaggagcagtcgtgggacttcgcgacttcgcggaaccggtcgaacagatgcccgttgaacgggtcaaggaatcccccgagcggcgaccagcagacgaaagccaaaccgagtttttcgcaggtttccaacgtgtgttcggggtcgcggtggaccggggagaactggttctggacggccacgagacgatcgcccaaaatgttgtgggcggtttcgatgtctgtgttgtcgattctggagataccgaccgctttggccacaccttcgtccacgagctgcttgagtgcgcccatctggtcttcgtacggcacctgcggatcgttgcagtgcgagtagagcagatcgagcgtatcgacaccgaggcggcgggctgattccttggcattggcgatcatggtttcaggtcgggcgtcggcctgccagccgtagttgccgttgccgtcaagcgtacgcagccagccggttttggtggccacgagcacctgatctttggggccatgccacgagtgcagagcatcacggaccagatattcgccatagcccatatcctccggttcgccggtgccgggcgcgctgggcagataataggaccaagccgtgtccaaataacggactccggcatcgagcgcggcatggatggtctcgattgcctgatcacggttagaggggcgcccctcgatggcgagcgccatcgtgcccatgccgaggcggggaatctcatagccggcaagtgttgccgtggtcgcgctctggttcgtacggttcgtagtcgtttcgctcatagcagtcacttaatcccgctcgctggacagccggaacgattccgtctgtagcgaatcatcgtcacaaacgacggcccgaaaatatgaatatggctcaccggaggttgcccggtgagccatagctggctcgactgtcgcctcgcaccccgcctacaaacggctctgccgtttgcttaacgacggggtccatgccaaatcatcaagcaactggttggtccagaggactacctggtcggagctcatggggccttggcccagggagccggtgaacggggtggggacgatgagctggtgtgtgaccggacggtattgggtgcccttgtaaatacgacccatacgcatctggatggattcgggcgggtcgatacggccgatgcgcacgcggttggattgcgcgagaatctccgaaatgccgatcttgcgggccttgaacttcagacgggccacatcgaacaaggtctcgaattcgaccggcggcttgccgtaacggtcggtgagctcctcttccaaatccttcaaatcggcctcgttgcgggcggaggcgagcttgcggtacgcttccagacgcagcttgtccgaatcgatgtacccgatcggaatcgacgcctctatgggcaggtcgatggatacggccaccggctcgacgttctcttcgggctccttgtacttctccacggcttcggacaccatgcgtacgtacaggtcgaagcccacgccctcgatatggccggactgctcgtcgcccagaaggtttccggtgccacgcagctccagatccttcatggccacgtcgaaaccggagccgagcgccgtgttctgcgcgatcgtggcgagcctgtcgtgggattgctcggtcattggcttggacgggtcgtacaggaagtaggcgtacgcgcgttcacgtccacggccgacgcggccgcgcagctgatgaagctggctcaggccgaaacggtcggcatggtcgacgatcagcgtgttcgcgttggatatgtcaagacccgtctcgatgatcgtggtgcacacgagcacgtcgatgtcacgatgccagaagtcgcggatgatctggtcaagctgcttctcacccatcttgccgtgggcgatgccgacgtgcgcttcgggcaccagcgtatggatcttgtcggcgatggacgcgatgtcctgcacgcgattgtgcacgtagaacacctggccgccgcgcaacagttcgcggcgcaccgccgcggtgacctgcgcgtcctcgtaggctcccacataggtcagcaccggcaaccggtcttcgggcggggtggccagcgtggacatttcgcggatgccggtcacggccatctccagcgtgcgcgggataggcgtcgcggacagggacagcacgtccacattggtgcgcagtgccttcagcgtttccttgtgttccacgccgaaacgctgctcctcgtcgatgatgacgagccccagatccttgaacgtgatcttggggttcagcagtttgtgtgtgccgatgaccacgtccaccgtgccggaccgcaggccctcgacggtcccgttgatctccttggtggtctggaaccggctcatggccgccacattgaccgggaacccttcgaaccgttcgctgaaggtctcgtaatgctgctggaccaacagcgtggtgggcacgagcacggccacctgcttgccgtcctgcacggccttgaaggccgcgcgcaatgcgatttcggttttgccgaagcccacgtcgccgcagatgaggcgatccatcggcacgggcttttccatgtcggatttgacctcgtcgatggtggtgagctggtcggcggtttcctgataggggaaggcgtcttccagctctttctgccatggggtgtccgggctgaacgcgaagcccttggcgcgctggcgggcggagtacagcttgatcaggtcgtcggcgatctcgtggacgtgcttgcgggccttggctttggtggccgcccagtcggagccgccgagcttgttgagcttgggggcttcggcaccgatgtatttgctgacctggtcgagctggtcggtggggatgaacagtttgtccgccggggcgccgcgcttggaaggcgcatattcgatgaccaggtattcgcgagtggttttgttggcgccggtgccgatggtgcgctggcgcatttcgatgaaccggccaatgccgtgctgctcgtgcaccacgtaatcgccttttttgagttccaccaagtcgatggccttgcgccggcgtttcggcgttttggccacggccacggctgaagtgcggccggtcaggtcgcgttcggtgagcagggcgattttggcggctttgtccacgaagccgtcgatggcctgagagcggatgacgttgaaattggcgatgccggtagtgttgatcgcgcgcttgagtctggccaaggtgccggccgcagcggcggtgatggtgacgtggaagccggcatcgagcaggccttcgatgccttgggaggccttggcctcatcccctcggaattcggccgggttctgggcgtcgagctgcacgtggccggtcagcgtggtgtccacgccgaaactggtgaggcgaatcaccggatgttcggagtattcgagggagctgatggtttccgcatagtcgaggaagctggcttcgtcgaagctgatgggcgcgccggagccgtggccggaggcggccacatgccagctggcggccaggaactcgttcgcggtttttgccaagtcttcggcggaacggcgcagtttctccgggtcgctcaggaggatcacggcatgcttgggcagcatggagcccaccggttccagatggtccacgagtgcgggcatcagggattccatgccttcgaccggaatggcgttggcgatggattcgagcatgtcctcagcattgggaatcgaaccgaccaaggctttggcgcgggcgcgcacggcgtcggtcagctgcagttcacggcatgcggtggcccagatggtcttgaggccgtcgccgtaggtacgctggtcggaggcgtggaattccttgatggtgtcaatttcgtcgccgaagaattcgatacgcaccgggtgcggtgcggtgggcgggaatacgtcaagaatgcctccgcgcaccgcgaactcgccacggtccatgaccaggtccacgcgcgtgtaggcgttttcgatcagacgtttggcggcttcgtcgagtggcaggtcctcccccacggtgaacacgagcggctcgacgtcgcccagtccttggacgaccggctggatgagcgagcggatcggcatgacgagaatgcgaatcgggccgaacatcggatcggtatcgctcggatgcttgagtctgcggaacacggccatgcggctggccacggtgtccgcgcgcgggctcagacgctcgtgcggcagggtttcccaggcttcgagctgggcgatgtcgttcgggtcgccatcataccaggagcgcagcgagcccacggtctcttcggcttcgcggccggaggccacgaccagcacgaccggcttgccgggtttgccggccacaccctggcctatggcggcggccaaagccgggcgcaaaccttcggggatgccggccaggacggagttgtcgacgtcgtccgaaacctcgatgtcgccagtggcgagcctaaggaaggtcttgtcctgttccagcccggacaggatgcctaccagtgagccgttgatcaggtccgggtgcgtcgcctcaccggccattgaacttctcctgggtcttggcaagaccgtggaagatgatgtcctcggcggcgtcagcgccgtcagccaggaattcgggcagctgcttgcgctggtccgggccgaagccgcccagtacccagttcaccgtgttgtcatgcgcgttcgcaccgcgcttggagtggccgacgcccatgcgcacgcgcgcgtatttcggcgtgccaagggaacggtcaatcgacttgatgccgttgtggccgcctgcggagccgcctgccttgaccttgatacgaccgaattccaagtccatgtcatcgtgaatcaccacaatatggtcgggctcgatctggtaataggcgctaatggaagccaccgcattgccggaatcattcatataagtcagcggcttggccagaaagaacttgacggtgcggccgtccaggttcatcacgcttttaccgagcatggccaagcccttgtgatcggcgaagttcaccgtccaacgttcggcgagcacgtcggcggtcatgaagcccatgttgtgccgcgtgtcctcatattttttgccggggttgcccagtcccgcaatcagccagaaatccgacgccataatccgctcctcgtccgtcttcctatattcccgtatgcacgttccgtacgttccgtacgtcatgcgcgcgttcgcctcgcgcactggcccatgcccggccggattcaaccgtcaagattgtactcaacgccgccgtcaagccttggaatcggcaagcagcagggcgcggcattgctcggcatccatcgatcggaccgatgaatggtgaaacgcttcgacgtcacgagtcacgatgacgtcggcgtcattgtcctcggcaacggcacggatgatcccgtcctcgaagtcgggctcatcggaccggtacgacatacacgcatggcgttccataagtggacggatgtcgaacaattccatcagtccaccgatatcgtctcgcgccgcccgctcctcaccataatgcttgcgcaacacgcaatacacgtcattcaatgacgataccggcgccatgatctcaatgtttggctgtgcaacggcttccatgagcaaatcaacacattgtttatggaaaggcgctcgtttgtcattgcacaaatcgagcagaatattcgtgtcaaacagcagtttcatcccgttccccaaatcgttccatacgtgcctgcgcgagaatctcctcatccgaaagatcgccttccgcctccggcaaattccggtcggcgaaacgttgaatcagctcctgctttttcccacgctcccgctcctgaatcagggagagcgtcagacgctcgaattccggcagtttccccgtatccgcaaggtagtcggtcagatcacgaatcaggtccgccgaggatattgccgagcgtggctgcggacaggttatagaggattcccgatggtgtcttcacctgcgcaaccaactagcgatggattcaacgcgacatcagccgtatctcccctgcctgcgccgtcacctgaacatattgcaaagcgctattgcaccaattgcggcacgccttgccgagtctccgcacgattctgcccaaactgcggcaaacagttggactgatatgtccgccaatgccgtatatcgggcatcggcgacgagccttgattgtgcaacgccccacgcttccctgcaaccggatgacatattgcgggacggcagcggattttgggcgtttctggcgtggcatcccgcaagcgttatcgcacgttatctgcaccgaatcataagaatggcagaattccaatgatttcgcaggcagagttgcgggacgctagctatgtgcatcgtttgacgtatgtggcatcccgcaatcacgtgggacgccacgtcaaaacggacgaaaatcgcgtgctgtcccgcagtttgccgttatctgggataagcgcgtccgatatatggcgttcgaggaaaagagctgatccgatacaactttttagtgttataggacaccggaatccatggagagcaagggtaaaccgcctcggggctacaggtccaaataccagtaggacatgtctcgcatggtgccggtggagtcggtggcagcggcgggcatgagtccgaattgggtgaagccgaagcggtgcatgagggcaatggagccggcgttatcggcgaaaatgatgccgcaggccttgcgcatgtggcgggcccgcgcctcggtgagcagcctgtcaagcatgaacgtgcctactcccctgccttgccatgccggatcgatgtaataggccaaatcggtgacaccgtcatatcccgcgcggtcatagaacacggagagcgcaccgaagccgatgattgaaccgtcttccgattccacaacaaaaacgccgtagggcggcgtatgggattcgacccaggcgcggcgttggtcgagggtgcgcggggtgaggtcggcggtcgcaccgccggccatcactgaggcgttgtagatgtcggtgatggcttggatgtcggattcgacggccggacggaaggtgtatggcatgaggttcctttgaatacgcaaatagcccgtccttatgataaggacgggctatgtcagttgaggtaaccgactcccttcagtcgccttctgcgatagctcccctcaccctgaggggagccggaactacttgtcgagctcgatggccttgttgagggcgtcttcaagctccttctgcgccttgccgtaggcggtccagtcgccgttcttcatggcggactggctgtccttcatggcttgggcggcatcgttcagcgcctgctggagttcggggctgcggtcggaagacgagccggaatccgacttgccgtccgtggtgccggactggccaccattgatatcggaaccagattggtcaccggatgtgccgccggaagcctggtcaccagacgatccgtcaccggacacgttctcagcatcgcctgcggccgcaccggaatcaccaccgaacacctgatccaaggcctcatccaacgtatccgcgaatccaacctgatcaccgaacgcgaccagcgtcttcttgagcagcgggaatgaagtcgcacccgaagacttgacgtacacaggctgcacgtacaccagtccgccaccgagcggcagagtaagcaggttgccgcgcatcacttgcgtgtcgccggattgcagcaggttcagttccttggacacgtcggcgttggcgttgaagttgttctgcgcctggccggggcccggtacgttcgaatccttgggcagctcctgcaatcggatggtgccgtagtttgaacctatcttgcccttctcattgccggcatccgagtcgaccgacaggaagccggtgaggatctcacgggtggactggccagccggaatgtaggtggaggtcagcgagaacaccggttccttggtgccaccggtctgcaaggtcaggtagtacggcggctgcaggatgtcctggtcctgctgggactgggattcggtcgggtcgaccggcgtctgccagaagtcctcgccggagtagtactggctggcggaggtcacgtggtacttggagagcagctcgcgctgcaccttgaacaggctttccgggtagcgcatgtggctcatcaggtcgccggagatatcggagagctggtggtactggccggggaagatcttctcccatgccttgattaccgggtcggattgatcccatacgtacagatccacggaaccgtcgtaggcgtccacggtggccttgaccgagttgcggatgtagttggccttctgcgagcccaaggatgagaccgttgcggaagagacggtggtggaatccttggtggcggagccgaggtcggtcatctgcgagtatgggtaggcatcagaggtggtgtaaccgtcgacgatccacttgacgcggccatcgaccacggccggatacacacggccgtcaagcgtcaggtacggcgccaccttggccacgcgctccttgggggaacgatcgtaaagaatctgcgattcgctggtaacacggtcggagaagagaatctgatcggagccgaagcggattgcgtagagaatacgggagaacagattgccaaccgaggggccgccgtcgcccttgaacgtggtcagggcgccttccgaaccggtcgggtagtcgaactcccaagcctgcgtgccctccggtgcgccgacgatcgagtattcggtggcgttcggcgagaagtagatgcgaggctcatacttttcggattcagtgagcttgccctgagcagggatgccggattcgaagaattcaggctggccgtcggcggtcaccttgttaccgtaagcggccaccacaccgtaaccgtgggtgtacacggtgtgatcgttgacccaattgcggttgtcgttgccggccaggtcaagctcgcgggcggcaatcacggtgtcttgggaaacgccgtcgatctcgtacttgtcgactgccaaagtgtcggcgaaggtgtagtactgcttggactgctgcagctgcttgaatgtggggctgacgacctgcgggtcgagcagacgaatctgcgcggtggtgtcggcctccttggccagagcgccctgctcgcccttgtcggttaccttgtattgctcggtcttgagcttgtcaagaccgtaggcggcgcgggtggcgtcgatattgcgctgaatgtaggtggattccatctcctgtgcgttcgggttgacgcggaagcgctgcaacagcaccggccatgccacggtgagcacgagacccaccacgaccacgacggcaatggaggtcaccggcacacgccaggccttgagcgcggcggaggcgcgcacgccgatggacgcctggccttcgagcgtgtgggagcgcatgagccagatgccaagcaccacgccgagaatggcggtcagcgcggccatgatgaaggtgacggggatgtgggcgtgcacggtggtgtaggaggcaccggtgatatgcgaaccctgcccggtgagctggtcgaatacgccgatcacctggcgcactgcccaagcgaacatgttgagcatcagccagatgccgagctggcggcggcaacgcttggtgatggagaacaggcctcggccgttgaccggcatagtgatgcggataccgcccatcagtacatgcgtgaccaccgagaacacgaggcccacgcccagcagcacggccacggcggcgagcacgagcttcaggcccggtagcacaaacacgtagaagccgttgtccagaccgaactgcggatcggtggtgccgaacgactgcgcgttgaacatgagcagaatctcgctccagttcgcgttgaactgggaaccgaagatgacgccgacgatcagcgaaatcaccacggccacgcggcgagcggttttcgagctgacggatttgcccacctcgaccacatcgccgttaatacgaatggtggatccgtctgccgaatcagggcgtgcccggatagccagccatgcagagacgaagccggtcagggccatgagcagcgcgtaggccacccacaggccgatcttcaccccgagctgggtccagaccacggactggaagccgagctggccgtaccacatcaggtcggtgatgaatcgggacaggccgaagaacagaccgacgatgatggccaaagccagcaccacgccgattagaatcttgctgccacggctggctcctgagccaccggacgctggcttacgggtgatacgcggattggacgggccacgtggagggcgggatgacccggaggggccggcgttggtgttgcgggccggaccgtccccatcggcctcgacatcgaggatgatcggatcgtcattgttcgcactattgcgtcgtgaatcgccgccattgccgaacagtactgagaaaggatcgttaaaagacataactcaagcctatcggaagggcgggaggtaggttatgccctgagcacagaatgaggcagcgttccgttctacgatctgttctacgcttgccggtatgaacagacaacggccacatcatatgcgtccctcagtacacgccatacgccaacttcggcacaggagcactccaatcgtggcgacaatatgtgctttggcagtggtgttggccggcgtggcagcctacgaatggcatgtcggatggttcgccaaatccacatcagacggcaacaccgccgctccccagacctcccggacaagtgtgttaccacgcaccgacgctccttccccgaagaagaacgacgccccggccgcacaagcccaacgtgcggtatccgccatgacacttgaggaacgtgtgggacagttagtgatggtgccgttgttcgccggttccgatccctcctcgttggcttcaacaatcgccgacgagcacattggctcggccattctcattggcaattggaataccggcgtcgatacggtcaagaccgcgaccgcgcaactccaaggatatgcgccggccggcaatcgtctcatcatcgccaccgatcaggagggtggtcaggtacagcatctgactggtaccggtttcgacacaatgcccagtgccgttgagcagggcacaatgtccgctgacgcattgcgtcaatcggcaggcacgtggggttcgcaattagctgctgctggcataaatgtcgatttggcaccggtgctcggcacggtggtgggcgatcgtgcctcgaatgctccgattggcgcgctggatcgtgatttcggattggatgcggccggtaacgccgagcatggcatcgccgttattgagggtttgcgaggcgctcaggtcggtgcggcggtcaaacattatcctgggttgggcgcggtaagcggcaataccgacttcaccaccgaaggcattctggatacgaccaccacgttggacggggccgaggcaggtgcctttgaccaggcgatcaccaaggccgatcctgcaatggtgatgatgtcgttggccacgtatcaatccatcgatccgaataatccggcggtgttttcttctacgattatcgacggccatattcgcaacgccctgaaatatacgggcgtggtgatttcggattcgatatctgccgaagcgttaagcagctacgatgtaagccaattgggagtaaagctcgtcgaggcgggcggcgacatgtcctgcatcggtcagacggattacgtaaagccagttgtggacggcctcaacgaacgggcgaagtccgatccggctttcgcttcgaaagtgacggcggcggcgactcgcgtaatgacattgaaaatcaagatgggactggcctgaccgttcatccctgtactggcgaggattcatgcgcgctgattcgcgctaatcctcaccagccctcgtacgaatgcacactagtcctcgtacgaatcgtcagtcctcgtatgaatacagaccatgcttgccgatgtattgcaccacgccgtcaggcaccagataccagaccggctcgtcgtgttcagcgcggcggcgtacatcggtcgaagagatggccaaggccgggatctcaagcgtatcgaccttgccttcgggcaaggtcacgccgtccgggctgaagtagccggggcgcgtgacggccacgaagtgggcgaggtcccacatgaggtcggcgtccttccactgcatgatttcggccacggcgtcggcgccggtgatgaagaacagctcggcgtcggggtgctgggctcggatatcgcgcagagtgtcgatggtataggtgacgcccggacggtcgatgtcgacacgcgagacggtgaatttggggttggatgcggtggcgatcacagtcatcagataccgatcctcggcgttggtgacgtgcttgtccagcttgaacacaggtcggccagtgggcacgaaaatcacctcatcgaggtcatacacccaggcgacttcagaggcggcgaccaagtggccgttgtggatcgggtcgaacgtgccgcccatgatgccgacgcgcaggcgcgtatgccaattgccgcgtgcggaaagccggcctttgccatggctgctggccccggccggtacggacaggtcggacatacgccgttcggtttcgccttgggtgacggcaatgatttcggcgggttcggcggattccactgattttccggactgaactgacgcagccgttttgtggctgccggcaatatcactcatgcttggccgccctcgctggcggcatcatcagcggattcggtttcctcttcgatttcgccggcggtgggattgtcttccttaggatcgatcttgcccatgtcttcatcccattcgtcctgaaccacgcggcgaatctcggcgaaggtgggcagcgggaagtccggctggtagaggcggcggacctcggccacacgctcggtgatgcggataagcgtgtcggtcatgccgtcaaggtcaccgtcgtgctccatctggctgtatctgccgatgtagccttccatgagttccatgtgttcgcgcacgatcttgagctgggcatcgttgaggtccacgacttcgggcgaatcggtctcgggccaaccgatgagcacggcgtccgcgtattcgagcgacgcacgctgggcggcggaggcgatgccatcctcgatctgcacaaggaacacgtagcggacaatgctcagacgttcggccgcgatcttcaggccgagcttgggatcgttgaggtcgatgtcgggccgcagttcgcttgccttgtttgccgtgtcagccgtgatgttcatgttgccgtcctcgttcatgcgcgcacctgtcctgttccgtaaccgatccacttggtggtggtcatctcccgcaatcccatgggaccgcgtgcgtgcatcttctgcgtagagatgccaagctcagcaccaaagccaaacacgccgccgtcggtgaagcgggtggaggcgttgaccacgaccacggccgagtcgatgcgcttggtgaattcctcgatggccgcataatcctcggcgatgatggattcggtgtggcctgtggaatgcgtgttgatgtggtcgatggccgtgtccaggtccggcaccaccttgatgcccattttgagggccaggtattcagtgtcccaatcctcttcagtggcgtggttgaggtcaaggccctcgattgccgcgccggagatgatgtcgtacgacgtggtgtcggtctgcagtacaacgttcgcctcggccaacgcggcggcgatctgcggcaggaattcggcggcgacatccttatgaaccaatagcttttcggcggcgttgcacacgcccacgcgctgggttttggcgttgatgatgatcgggatggccttggcgagatcaccggacttgtcgatgtagatatgcacgttgccggcgccggtttcgatgaccggcactttggagttgcgcacgacggcttggattagacccgctcctcctcgcggcacgagcacgtcgatatggcctcgcgcctccatcatggcggtagcaccggcgcgtccgtactggtcgacggactgcaccagtgtggattcgaaaccgtgggcttcaagcaccggggcgatgacgcccagcgtggcggcattggtgcgttcggcggcgtggccgcctcgcagcagcgcggcattgccggacttgaggcacaggctggacacgtccacagtgacgttcggccgggcctcatagatcatgccgatgacgcccatcggtacgcgcgtttgggtaaggcgcagaccgttgggcaggttgtatccgcgcacgatttcaccgaccggatcgggcagggtggccacatggcgcacgccttgggcggcggcggccacgcgcggcacgtcgaacagcaggcggtcgagcttgcccgcgtccatgccgttttccttggattcgagcatgtccagcgcgttggcggcttcgatgtccgcggcgtgctcgtccagcgcgtccgcaatggcgagcagcagttcgttcttggcttcggtatttgcctgtgcaagacgctcctgtgcgcgtgcggcctgatcggcctggcggcacaccgcgtcgaacacctcaggactcaattcatcgctcataacagtcaagcgtaactcacaacgcggctgattgcttactccgacccgcttgttatgggatgtctgacgttttgaatcgcaaacagaaccggctcccctccatctcaggcgggaagccggtgatgtgatgcgctccggtcagcgaatcatcactaaccggtacaccacgctggattagcgaatcagcaaatcagtgaatctggtccaggtcggggtagagcgggaagtcttcggcgagcttgtcgacgcgggccttcagcgcggtcacgtcggcggacgggccggcggcgagcgcggtgccgatgatgtcggccacctcctcgtattccttcggtccgaaaccgcgcgtggccagggcggacgtgccgattctcaggcccgaggccaccgaggccgggcgcgggtcgaagggcacggtgttgcggttgatggtgatgccgcaggcggcaagcaaatcctcgccctgctgcccgtccatctcgctgttgcgcaggtcgaccatcaccaggtgcacgtcagtgccgccggtcagcacgctgatgccgttggccttgacatcgtcggccaggagacgttcagcgagaatcttggcgccgtcgagcgtgcgctgcatacggtctttgaattcgggggtgccggccaccttgaagctcacggccttgcccgcgatcacgtgcatgagcggaccgccctgctggccggggaacacggaggagttgagtttcttggcgtattcctgcttggcgagaatgaaaccggaacgcggaccgccgaaggtcttgtgcgaggtggaagagaccacgtcggcgtatggcacggggctcgggtgcaggcctgcggccacgagtccggcgaagtgggccatgtcgacccagaatttggcgccgacctcgtcggcgatctccttcatggccttgaagtcctcgatgcgcgggtaggcggaccagccgccgatgatcatggccgggtgggtttcgagcgcgcgctggcggatgatttccggatcgatgcggaaggtcacggggttcacgccgtacgcctcggcgtggtagaaacggccagagaagttgattttcatgccgtgggtcaggtggccgccgtggtcgagggccagaccgagcacggtgtcgccgggcttgacgagcgcctggtagacggcggcgttggcctgggcgccggagtgcggctggacgttgacgtattcggcgccgaacagggccttggcgcgttcgcgggcgatggtttcgatctggtccacgtattcacagccgccatagtagcggtggccggggtagccttcggcgtatttgttggtcagcacggagccctggcattgcagtaccgctcgcggcacgaagttctcagaggcgatcatctcaaggccattgcgctggcggcccagttcggagtccagcagttcggcgatctcaggatcggtttcgcagatcggcgcgttgaaagcatcggtcgctttctgcgcaaggggtgaagcggtcatgggtgctcctttggtatgtgcgacaattgattcgccgctgtcgccttactgtatggcccgtttgtaaccggcctgtttcatgatatggccggtccccgttcgatggcaatggtgattttcgccggtgcgaccggtcggctacgcgagacggacggcccttctgcccacggcccacgctagactggtgtggattcatcatccctttcaggcagaaggattcatcgtgacaaccaccttccattccacccgcagcaccaccgattcgctgaccgccaagcaggcgattcgtaagggcatcgccgatgacggcggcctgttcgtttcggacgcgttgggcaagaccaaggtggacgtggcctccctgccgggcaagtcgtaccagcaaatcgccgccgaggtgctgggcgcgctgctgccggacttcacggccgaggagctgggccagtgcatcgccgacgcctacggcaaacagtggtccgatgagcgcatcaccccactcaagcccctgggtgacgattacgtgctcgaactgttcaacggtccgacttccgcgttcaaggacgtggcgctgcagatcctgccgcgcttcatggcgcacaccacgccggccgatggcaacgcggacgagaaaatcatgatcctcaccgccacctccggcgacaccggcaaggccgcgctggccggcttcgcggacgccccgggcaccgcgatcaccgtcttctacccggaaggcaaggtctcccaggtccaggagctgcagatgaccacgcaggccggcgccaacgtgcatgtggccgccgtggaaggcaacttcgacgacgcccagtccgcggtcaaacgcatcttcggcgaccgcgccctggccgagcgtctcgccggcaattcgcacgtggtactttcctccgccaactccatcaacgtgggccgtctggtgccgcaggtcgtctactacttctccgcttacgcccagctgctcgccgaccaggtgatcaatgtcggcgatgaggtcgagtttgtggtcccgaccggcaatttcggcgatatcctcgccggctactatgccaagctgctcggtctgccggtcaagcacctcgtggtggcttccgacaagaacaacgtgctgttcgacttcctgaccaccggtacctacaaccgccagcgcccgttcttccagaccatctccccctcgatggacatcctcatctcctccaacctggagcgcatgctgtactacttgtccgagggcgacacccgtctgatctccatgctgatgaacgacctcaacaagtggggcacgtacgagatcccggaagaactgctggccaagattcgtcagatcttcggcaccggttgggccgatgaggatcaggtacgcgagtccatcaagcactgctgggacgagaaccactacgtgatcgacccgcacaccgcctgcggctactacctgcttgagcagatgccgcgagacccgctgaccccgcgcgtgctgctctccaccgccagcccctacaagttcccgcgcgtggtgaacgaggcattgggcttcgacgccaccggcaccgacttcgagtgcatggatgtgctggcccacgagaccggcaccaccgccccggccgccctgcgtggtctcgagaccgccgacgtgcgtttcaaggacgtcgtggccatcgacggcatggaggactacgtggagaaggccgcccaggcgctgtaaacataccagcacattggctcccctcagagaggggagccattttttacatcagaattgcgtttacatcagtatcgcggcgactggcagtcctatggcgattgccaacagcacgatagtgccgatgatcacgctggggcgtgcgaggttgacggtccagccgacgccgaaacgtttaggaaccatgatggccggatcgtcacggttgatgtagatgatgccgccaatccagtgcaggtcatcgtcatacggcataacatcatcgtccgaatcgtcaccgccgtcactgtgccgaacaccggcatagacgcgcgccccgttctgcccgtaatacacgccgatcatcagcgcgccgaccagagccgccacagcgatgaacatgccgatgatgccgattagattgacatccagcacgccaatggcgacaagctgaacgcctaggcccaatccaccggctgtcagcagtccgatgaccagcacgtagatgctccagacccgcgagaacacaccataggcatacccggtggtggcggggtggtcgggatcaatcgggtgcttggcgtagatgatcgcgacatggctggccaccatcaccgctgccagcaccacctgcgcgagcacggcgtaccaaatcaccatcggactcttctcggcccagccgttcacattgccggcgatatccgcatgaatcggcacccgctccggcatccggtcatagcccagcagcccgaccgcaatggtgacagcgagacaaacgacttgcagcaattcccacttcaggctcagcgggtcgggattgtcccgctcacctatcaatgccgcacggcgagcactggacgcctcccatccctgattggttttgatggacagtactttgcggcgaaacatctgctgcagcacgaaaccacatatcgcaatcgccaccgctgcgatggacacagtccagaacgccgcgtcgactccgcagagttgccaaacggccagcgagaccagtatggcgcatacgccaagcgccaccgtaattcccgaaaacgcgactttaaatccgcgaatgcgcgtattgacatgggcggcggccggcactgtgacaccgaacacctcatgccggtcggtaacccatggaacccctgccaggccggcggtcactatcaccggcaacagtaaaaacgcacacaacgcgatgttcatcgacacgactgtattattcatcgttatctcccctgatttccttttgttgcaccgtcagtaacgctctgcgaggagcgcacgccgtatgcccgttcgcattgccgtttggtggcatcgaggaatgcggccgaatcaccgccgcgcgccctgtaggccaaggcaaggcgatagagttcctcgcccatccgctcatcctgtgcttcggcagttcggttcggtgcttctcccccgccgtcatgctcggcgacggttgcaccggcaccacgacgcataacgatgtatccctcgtcacgcaacagcgcataggccttgttcaccgtgtgcaggttgatgccaaggtccacggccagcgagcgcacggacggtaacgagtcacctggcgacagctcatcgcccgcgatggctgcgatgagctgcctgtgcagctgctcgtaaatcggcacgtcactgcgctgatcgatttccacaatcacggtcaattccacccctctcaagaactgttctatttgttctacatcaaatataacagttttgccgtatgagtcaagatatgcgaatctcggttgaacatccggcaatgggccaacggcgtgttgcttgaattttctaggaaggcgggaatcgccatgctgccggcgaatgggaaaatccatgtggcttgtcagattctgttcctgcaactgaatagtcccatgagggagtagacagcattgcggcgaagggctcggcccaaaccgcaataaagcgtgccgagcgccaaagccgccaacaccggtatgacgccgctgcaggagaagctcgcgaagctggacgaacttcatgggcggcaccgccgaacagcagtcgaccattctgttcacgctgttcgtggtattccagctgttcagcagtcgaccattctgttcacgctgttcgtagtattccagctgttcaacgccttcaacagccgcgagctgggcaacgccagcctgttcgccaatctgctacgcaataaggtgatgatcggcgtgttcgcgctgatgttcgcacttcaggtgctggtggtgcagttcggcggagcgatgttccgcaccgtgccgctgccgatcgacatgtggctgaagatcatcgcggtcggacagatgcgcggttagagttctttggctcggtagatgcggatggctataagcatggagccaaaatatgcgagcagacacaacacggcgagaacaagcgccgtatgccaccagatcgtcaggaaatcggcaatattcagcaatagccattgccagtcaacaggcaatcgggccagcagcgcaatgactgcatacaagccgacaatgaccgcgccagaggccatcatcatcttgcgggaggtgaaccggtatgcacaggccagcagcaccgacccaagaatgatagccaaagcgaagatggaagcacctgctgccaaggtaccaatccaccccatatctgctatatcgccaaagacaatgaagacgccgccgcatatcaccacgtccaaagcccagagcaggccaaccaccaacagaaaaaggtaccgacctacaacttgtgcagtgcgtgaaacaggaatcagccctcgcatggcactgtgccctgcagattcctcggatgacgcaggccccaatgcactcatacatgccatcgtcgatgccaaacctccgagtccgcccatcagaccactggcaacgtgttcatcgacgtgggtcgatatcatcaccagcgatatcacgatagacagcaccgggaaaaccagcagaaataccatattcgccacgctgaacagacccgtcccgacacaatcgaatcgacattgctttactacggatttccagctcatcgtcaccattcccttgaagcaaatatgcgagaggcaattacatacgagattccatatgccacaaccgtcgttgtcaataccgcaataaccagccacaatcgttgcgcgatgatggcattcgcggcatgggccaatcctttggtcaccgaagcaggcaaaatagatagcagtatggatacagccaatacaacgacataaatcaccatcatcgtgacttgaagaccgcctagtttggtccacagataacccgtgggcacgataagcgcgaccatcagcgcggtgcagaaacctcccaacggagccgcccacagattgcccgcgaatgaccaatccggattgaccagcacttgcaacccgtcaatcagcacgatcatcgctatcgacaatgcggaaatcaccaatccaaccacatatcgcgcggccacctgactcttcctcgaagccggaataatgccacgaagtcgatatccgttctgtaagtcagcaaccgccatggttagcacccacatggcgcaggtgaataccgtcatgatgacacccatgcgatagccgaagccatcaccataagcttcaccttgaaagatgacggagaacaacggtgccaacaacaacgagaacacagtccgttcgccgacgcacaggtaggccatatcgacgcgcaatgcagtggccaatgcatgttgccgagaccgcgacaccctcagtattgcctccatggccgctcacctcccgctcaagtcacgattggaatcatgggcattggtcagtcgaatgatgtcatcaatggaagccgattcaacgacaagccccgaaaccaccgacgcaacagcatcaagcctgtctgaccggaccagcgcatcgaatccggtggcatacgtatgtgagcccagcaccacgtccgcaggcagttgtgccagttcgtctggaccgctcttaatcaggcggaacgattcctcaaactcgtctttcggaccggtgtagtagaggcggccatcggtgatgtaggtaatgaagtcagcagcacgttcgaggtcggcagtgatatgggtgctgaacagtaccgaatgttcgccatcctcaatgtaggcatgcaggatatccatgagttcgtcgcgggcaagcacatcgagtccgctggtcggctcgtcgagaatcagcagcttggcatcatgactcaatgcgatggccagcatcagcttcatctgcatgccgcgggaaagatccttgatatgtttcttgccgttctgtgcgtcaccaaggccaaaagtatccagatacttgtgatagcatccaccgtcccatgatggatacagtggcgcgacaatacgttcaatgttcttgacttgccactgttcatgcatgtagctgaagtcgaacaccacgccgagttgttctttgacgggctcctcgttggcgatgttgtcgaagccgagcacgtgaatcgaaccggcgtcgcggtggatcatgttgaggatgagtttgatgagggtggatttgccggcgccgttcgggccgatcagtcccatgatgtagcccttgggcaggtcgaaggtcacgtcgtccagcgtgaagccggaatcacagtgtttggtgacgtcggtgacctgcaacgccatcgcgtcggattcggatatggcggtcatgtccatggtcctttcttgaggttattccttgcggtattcctcttcgagcatgcggtccaatgcgttcagcggaatgccggcggctttggcgccccggcttgcctcggccaggctttcgcgaatctgggtttcgagctgacgttgcatcagttcgttgcccttgtccatcacgaaagtgcctttgccttgaatgttctgcaccacgccctcatcggccagttcgttgtacgccctggtgacggtgagtacggagatgcgcagctccttggcgagtttcctcaaggaaggcagggcctcgcccgccttcaactcgccactgagcaccgccgaatggatttgggttttgatttgctcgtagatgggttcaccggacacggatgagatgatcagtttcacctatgcccctttcgattgtggttgactagcaccccagctgtttagctgttatacaacacagtataactgttctgcttaactgtcaaggtgtgttacataacagtcgaacagtgagcaacaagcaatgagcaggcaaatcctttgacaacggccgctttccattgaacagacacgccacgaacgctatttgtgcgttgtccaattccgatgagatcagacgggcggcctcacattccttcaacatgaaccgttagaacagacgatggaattcggctggttcgtcccccgctccatttcgtggagcgttgatcacggacagccgaatgtccacttggttttttctctcggggttctcagcgactttccatcaggtgaaaaatcgagaggagcaaagcatcgaagagcaaccgcaggagaaaaacgtcatgcgtaaagaacaaatcaaaatatgaccagcggctatctgtgcctatccaacgaataggtcgttgcaacctattcataaaaagagacataccataactatatattatcgacaagatgaataatgagccgagagaagaggactcttccgtggaatgctaccatagcacggcggttgcatcagccgccacccatattgcactgctggataatgacgcaattgtgttaaaaggattacaacagattatcgaatacaatcacttaggaagcattacgtggaccactcggagcgggagagaggctgtacaaagatgctcaagtgccgtagatacaccgcatttgctgctgttcgatatgtctcttgacggaatgtctggtatagacgtatgccgtcagattcgcaaaagaagcgcatccgtgctgctacttggcatcacggctttcccctagaacggtacatttctcggctgattcaggctggggcacaaggactagttgcaaaagacgaagaaagacaaatcgctgaagttacgcgttgggtattaaataaggggggctgcggaaatgggttcgaaacggcccgtaatgcgcatatgcgactgaaacacgagacaaatgacatccgcatgctgttatccgacagagaagaagaaatcatgattcttctcagcaaaggactatccatatcagaagccgcgaatcgcatgcaaattggacaggctagtgcagcaacatatcttaatagagctcgtcgtaagctcaaagcggaaacagtgcgccaagcagtagctatctggacaggtgattatgaacagtaacatcaaaaaacatccattcagattaattatagtgttactctccttatttttttcgataattgattggacagagagacccaccacatctgcgtatgaaatattatttggcttcatccacatcggattgctgttaatcgccctatggttcccacgcattagtttcgtaggattaatttttatggaatcagttgcgtgtagcttacctgtcctaaatgggccaagccgtttctggggcatctattgcactatcggactcactgcatatgaaacgggtatctctatcacgacagttttaggtatatttgtattcttaggaattcaatgctatcagatagcgcgatggaataatggcgagatagacataatcagcataacagtgtttctgatgtatgcagcagccaccgtgattgtcggatatggttttcattggtggaagacgacaaatgaacaacaccttcaaaattatcaaagcaaagagtacgaactgcaacattctttttctctgcaaaatagcgacaacgctatcatgcttcatgactccgttgcccagtgtttgacgagtatacgattgattgcgcaacggcaatcaaatgatccccagaatgatgcctgggagaagatagataaaattgcacgaaaaggattagaagcaaccagagatattatcgatacaatgattcaagataataatgaaaatggaatacccatagagtcgtccgaatggtggttagcggtaaaacggttaaccgacgaatgcgactatatactccaccaacatgggtttactggcactactgaaatcattaatggtgggtttacggtacagcaacaggtgaccgtaaagaatatcgatattctgcatgaagtactgagagaactatgctccaacattattaaacacgcgccaaagtatagcgaattccagtccagcatagccctgcagaaatcacaaacagaaatagtcatgtccaatagcatgtccacaataccggacgaagaaaggtcgggccgcgggctagagtcacgcaggcgcaagcttaacctaatcggtggtgaaattgatcacgaagtggatggcgacacatggattgtttatgcgcgtatacctttaactatggtttcaccggacaaagcagccacggaatccatggaggacaacgaacacgagaaatattcaccgaggaaaaggggaaagacgcgctctgttgaatgccaaagggaacagatggcacggaaggagcacaaagcgcaaaagtagtgattacagatataacgaagctcattaatactcctagaacaataacaactggtttaattgaaacctattatataggtacaatgaccgagtcgtatggaatcgtgtaatcgtcagaattacatcataattacctgagaggatgtcatatgtattgaaggtatttagcgacttacctctatatgcgcacgttctacaatcatataaaagtcatgtattctgcgaagacattaatggagagaaccctagcccaactccgcgcttcataaccgatttttagcatagcagcagagggtatccaagacactaatatttatcatattctaccatcaccagaaaaaaaaagggcttcctgttttccgaatgttcgactaaacaagcagattcacagcaccgaatggatacccaaccacaacaaacatatcaacacatccagccggataacaccttgaatcgttcactgtcagggagtactaaataccccataaactccatctccgttcatcgaaaaacgatgtttgtcacgggaaacccctatgcgaagcaatacgaaacggcatgttctagccgcctccaagaacgtttattggtcaaaagacgacgacacacctatgtgagcgatgacattaatgcccgaacatggcaactgttgagacgtaacgcgcaaagcgcatctggtaaggtcagttatcagctagttcacgatatctttgtttccccaaacgacgtagtatactgcttcaccgtccttggcgtttcgcgtaaacggaccttttcaggatgttcgaccttgcaccgtgtgggccgcaatcggctatatcgttgtgaacatcgagctaatggcgattaaacatcgctactattaataatccctgaggaattcgaacggtgatctataaggtaacaaaatgggaaaacaatgatgaccaggacaatcattattgaggaggatacagtaagtacgacggcagcatgaatagtgccagtgaagccgtataaaccgtaggcgagaggaattagaccgaagctaattgcataatcaattgaggaaactcgtcccatgtgccgcttatcgacgcatgtctgcatagtagatccccagaacacgccagacaattccagtccaagcccagcaacaaatgacgccacataccacagtacttggatgtccaaagtacctacaacaaaaatcggcataatagctaaagcgccaaataacactgatttagaaaacatgtgcctaggcctttccaactttaacgcgatgagactgccgcaaatgtatccagatgaggtgatagatgccatcagggaccatgcgccccggccactctcttgcacgacccacaagggcattgtgacgtctgttgccccggattgtacggcaaggaacaacgcccagaacggcactcccactgctaaccaaatataagtatggaacaaactgggaatagaacgtaatgcagaaatcatggaagcatcatcatcgttgttattagcctcgtcatcgcagctgggcatgagtttcaacgatagaacaagcggcatggagacagccagacacacagcaccatccagaaatagaaaagaaggtgatatcagttgagcaagccatgcaccaagaagtggaccgaccaccgagccggcattgcgaaacgtacgtatcaagccgttggcacgtacaatatcttcagggggagcaatcgaaggcaataaggcgaacaaggctggcgagccgaccgcaccaatgatacctgcggccaaactgattgcttgcacgggccatccaagaccactcaactgcacgacccatgttccgactccataggaaatagctagaccacccagcattcctgaggcaagagttttccgcggcaatcgatccgctaaaacaccacccagaaaagccatgaccaaggtgggcagcgtcttaaacatgagtaccaaggctaggcccaagctgtcagatgaagctgctccagtgaatacaacaccgcatgtgaagaacgccgaggacattgcttgcatgccctggaccaatgccagtttggctacctgccagcgtacgacactcccgacattcttcaccatgctcgaacagcctccttttgttttatcatgtatttaaaacgtaactatattgccttttattcaggccactaccgaaatatgctttggggattctaaaatattcacttcttcgcgagattcggcgaaaatatcgtgctcatataagacgggatctttaattccaagaatctcaaaagaagttcgtcgatcacgacacgggtcacatactccacaatgaactgtcccgcccaaggcacagctccacgtatcgccgaacggcacgccaagacccatacctttttgaatgacggcacacttattgatactaagataaggagtatggaacgttaccccgtattcatctccttcacattctacggtaaccgtatgaagagcttcaaaatatgatgcatgattatcgtggaacacagcatcgttactatgaactgcgtaataaacatcaacgatatcatgcttaagcgcccatgaagccattagcataagcgcaattgccgatccaaaaggctgaacatgctcttccttattaggggcaacgacaaatggcccaaatgctttgcggaggaactgaggctgaggcaattcatagaaacgcttaaattgctcggaaaaatcatattgataatgatggagtcgttcagagtggagatttgtaacgattctttgcgcatgttgactctcattacatccctcagtttcaccaaaattgaaagtaacggcatatatttctttcccctgatttaataggtcatacaagagagtagtagagtccgggcctcctgatagaagcaacgcgacacgattatgattctgaatcattgtttaatcctttgactttgtgaaattcagcgaatctgttgaacttctgtatagaagttattctgttaatcgacgtttgagaagtagtcatgtaaacgtcacaatgacaaatgcgcgacgattcctgggtctgatgaaagatcttggtgcttggctttcagagtctctcctcattttttcaattgttgtatgtcgtttccgtgcaacaatacagcaccgaaacacagccagcgcctacaatggcctcggaaaggggacttatgccgaacaacgccgttacgctacaccacaccgaaccgaccgattatccggaacaagggcgaggaactggagcggcagcggtttgaggcgcaacggcggtcggataggatcgcgcggcggtaggggcttcatatatggctcccctcagggaggggagccagttttttacaacacccgtggggcgttgtggaaatcgaagaggacgccgtcggcgagccggcagatttcgggccagtcggccgcggaggaatcgtcgtgcatggcccagaccgtcataccgaccgatttggccgatttcatggcgaccagcaggtcctcgaacaccgtgcaatcggtaggtttgacgcccagacgtttagcggcaagcagatagacgtcgggctggtccttgccgacgtcgttcacatcgtcaacagagacgatgtcatcgaatagcccgaacacgcccacatgccgcagcgccggttcacgcaggtgcgggggcagcgaggtggcgacgccaagcttgacgccggcggccttcaggtcgtgcagatagccgagcgcgcccggcttggcctccaccgtggtggagtaggcgacactggccatgtcatcccactcctgcataagctcctcggggtatctttcaggccgaatcgcgcgatggtgtattcggcgatctggcgaaactgcatggcggagaccgtggtcgtgtagtcgggcggaaccgcgatgccacgcttgttgaggaagtcgatgtcgacttggtcccagactcccatggagtctaggagggtgccatcgaggtcgaatatggcggctttggtcataggacactttccttcaacagttctcgggcgtggtctagtgaggcttcggattcgctgccggagagcatgcgggcgatttcgtggacgcgggtttcgccgttgacttcggcgatggtggtgaccacgcccaaatcgtcgtcatcggcatccggcggctccttggtgaccacgaactgcgcgtccgcccacgaggcgacctgcgccaagtgggtgacgacgatgacctgcgcgctgcgggccagccgtgccagacgtttgcccagttcgaccgcggccttgccacccacgccggcgtcaacctcatcgaagatgaaggtctggtcggcaccgccgcgcgtgtcggcggccaccagctccaaggccaacatcagtcggctcagttcaccgcccgaagcgcttttgcccatcggcaactgcggcgacccctcgaacggcgtaaacaggaacgcgatatcgtcgcgaccatacgggccgagcggatcatcggccttgtctcgcggcgtgacgcgcacttccaaggaggcacccagcatggcgagcgagccgagttcttcagtgacgcgcgcgcccaagtcggcagcggcagccacgcgcgcggcgctcagcacgtcggcggcggcgagggccgcatcgtacagcgtctgccgttcggattcgagttcggcgaccttttccggcgaggcgtccagatcctccaaatcgaacgccgccttgtcccgccaagcgagcacgtcggccaaggtggggccccaccgacgggtgaggtcgccaagctcgtggatacggccgttgatctggtccagatcctccacgctgccttcgtcgcccagctcctggctcagggcgaacaccacgtcgcccaaatcggcattgatggattcaagccgatcggcctgctcggcgaacgtgccgccgacgcgaatcgcgcgcaacgaggtcaccgcatgattgatgagttccacggccgaagcaccgtcggtggcgtccacatccacctgtgaggcgtccagcgcacccagcgccgaacccacgccttgggcgatgtcggccgcgttttcgatgcgttcgcggcgcgccttcagctcctcgtcctcccccggctgcgggtcggtgcggttgatgtggtcgatggattcgcgcagatagtcggcctgttggcgggcggaggattcctgcgagcgcaggcgttccaaccgctcatccatagcagtcaacgcatcccacgctttgcggtaggcggccagttcggcttcgtccccagccacccggtccagaaattcgcgctgccgtgcggaagccgcgattttcagctgatcggtctggccatgaatggtgaccagttcgccggcgatggcccccagcaccgaacgcggtacggacttgccgccgagcacggcccgcgaacggccggaggcgcgtacggtgcgggacaggaacagttcgccgtcttcgggatcgacgcctgcgtcgtgggccttggccacggccgcggcagcaccggtgagcccactgtcagaatcgtcagcgtcaccggtatcgtcagtgtcaccagaatgttcagaggtcacggcatcatccgcgagcgcgaaaatcgcctgggcccaagcctcgtccgccccggccgagacgcgcgaggattcggcggccccaccggagaccagtcggatcgcggagagcagcatggatttgccggcgccggtctcaccggtgatggcggtcatgcctgcggccggcgcaatggtggcttctcgaatcggccccagattgcggatatcgagttcttcgagcatcaggctcctgccttgccgtcgcgttcgcccggcttgtcgggctcggtaccagcgacaccagcgtcaccggcaacgccagccgcatacgcggccgccgggaacgtgtgcccgtgatgcagcggctggctcgaggcctcgttgcgcgcgtgctcgcgccaaccgaccacgggcagatcgaacttggagaccagacggttggtgaacggcataccggagagtcgagcgaggcgcaaggtatcgcgcgattcgcgcaccatgacgcgcgtaccctgcggcagggcgcgctgacggcgtccatcgcagcaaatccagccttcggacatggaatcgtccagaatatcgatggtaaaggtcgaaccggagccgatgatcagcggcctggcgaacagggcgtgcgcggccaacggaatcaactgcagggccttgacgttcggccacatgaccggaccgcccgcggagaaggcgtaggcggtggaaccggtgggcgtggagacgatgacgccgtccgcgccgaacgagttcatctccacatcgtccacgcggatggacagttcgaccatcttgccccggtcggcgcgttccagcgtgatgtcgttcagcgcccaatcctcaatgggcttggtggcgccaggcagccagacgtccacatgggcgatcatgcgttcgtcgatcgaatagtcgtgggtggcgacccggcggatcgcctcgtcgatctggaagctttcgaattcggccaggaagccgacatgccccatgttcacgccaagaatcggcacctgggtgcagtggacgagttcggcggcgcgcagtatcgtgccgtcgccgcccaggaccacgacgatttcggtgtcgtccgacacgcacggcggctgcacgccgaaatcgggggcctcggtgttgtcgatgatggtgacttcgaaaccggccactcgcagctggctcaccgcctcggccactacggttccggtctgcctgagcctggtatgcgtcaccaccaccgcgttgcgcttggccatggcatcctcctgtcgattcggtcgcactgctcattattctagccgcagacaccgtcatcagtcgtacaggtgttcgaaaagtgctgcttcgtggcgcgtcgccggcaacgttccacagagccgattatcgtaaggcttcggcatacaatggcatacagccgtgcaatcacccccatctgctcacatcgtgaccgatataacccctcaacatggatgcgctcattattgtggcaataagccataaagctgtacgtccatattgagggagttttatcatcatgggcaagcatacgcagaattgcacgttgataggcaaaggagtctacggcaccataggagtagaccaacgttcccgtcttgccgatggcgcgcattttcacaccatgattgtgaccagcaccctcgaggcctcagttatagaaggggacaacctggtcatcaagagtggcattgtgcggtgtgatggtgatattcgcgtatccggcatcagtggcagcggcgacatcgaagtcggcggcgacattatctgcgatgaagtaacctttaccggcaaactacgatgcaacggcgatatcgtctgttccggaaatctgtccgtcaatggctccctgcaagacccccgtcatattagcggtcagacagttcacttgaacggtgtgctgaaaggtcatgacatcaacagcagggcgctggaagttcatccactgcgcagtacgatgttttctcgttttgatatggatgggtatgaggatggcagcacggttcgccatatcacagccgtcacggttgaagccaaccatctgcaatgccagactttgacggcggactccgccatgctacgcaacggcagtgcggtggaaagcgccacgtgcgccaccgcaataggcatcgaccgtacctccagcgtgctgctggtgaacggagactgccaacgcattcatctcaagacagcgtaaagcaggtattcctcattaccgtgggtgccgatgatgggactatcggcagtggccaccacgtcaagtccgtgctgttcagcacaggcgaccacgtcgtgtaatgcccgctcccgcaatgccggatcttcaacgatgccgtgtttgccgagtcctgcccggccgacctcgaactgcggtttgaccagtaacacaatctgcgcaccgggagccgcgatgcgcgcgattaccggaatcacataggtcagggaaataaaggagacatcggagacgatcatcgccggccggtaaggcaggtcgtcggcctcaacttcgcgaatgttgacgccgctcatttcgatgacgtgctcgtcattggcgatgcgcgggtcgagctggccgtggccgacgtcgagcgccacgaccttggccgctcccccacgcaacagtacgtcggtgaagccaccggtggaggcaccgatgtccagacattccaagccttccggcccggtaaggccattgccggcaaaggtttcgaacgcgcccaagagtttgtaagcgcctcgggagacgtagtcgtcgcccttatccacggcgagttcgctgtgcccggctttgaccatgaacgatggcttggtgatggtctcgccgtccacgcgcacatgcccggctttgatgagtcgctgcgctttggcccgcgattcgaccagtcccgaagccacgagcatcatgtcgagtcggtcaagtggggttgcggaatcgatatgttgcttggtcatataccttccttccgacccaccatctaccaacggggtggctcggcatggagccaccatccagcacttcacgtcatcttccgctggcgggagaatgaatcacctctgctagctgcggctgttatcaagctcgtgttgtaacgattccagcacgttgcgataggtctcaagcttgcggtcattgtcttgttcatcgatatccgcaagttcggggtatcgctcggtgaccgtcgcgtgttcgctatccgtaggcataggactatgcctcgacggcgaacacaggtaccgtggcctcgctgagctgtgcgccttggtcggcggcttcccatgcggcgcatacggcggcgcgcaggccgtccatactggtggggtcgctgacgtgtacctggccgttttcaaaccaagcgctagccttgcggcattcccaagtaccgctctcgtcgcggaccggctccggttgggcttcgccgagttcacgcaaatcaagggcgatgaatgtgggcctcaggtgtgccggagccagcatcagttcggtcgggttggtgacaccggtcagcaccgccagcgaatcgtagtcaccgcggttaccggcctcgatatcggtgtcgaggcggtcgccaatggcgatggacgcctccttgggcaccagatcgtggccttcggcggcgttcagttcgcgggcctcatcgtacatgtacgcttccggcttgccagcggaggcgaccggttcgacgccagtggccgtgatcacggcgcgaatcatcgatccgcaaccgggggcgatgcccagttcacgaggaatcgtcaggtcgcggttggtcacgaaatacgtggctccggcctcgaccgcgaacgcggcgtcggccatcatctgccaggtcatatccggataccagccctgaatgacggcctgtgggcggtcctgaggaccgtccacgatggtcaggccgttgcgggtgacctcatcgcgcaaatgctcggcgcccaatacctgtacgcgcgcgccggcgggcaacgccttggccaccacacgggcggccaccaccgaagaggtgatgacctgccacggctccacgtccaagccgaagcccttgagctggtcggccaccacgtgctggaagcgcgaggagttgttcgtggtgtattcgatggtcatgccggcggcttcggccgcacgaatggaatcggccgcgtattcgaccggattcttgccgcgatacaccacgccgtcgaggtccagcagcgcaagctgataggcctcggcgagcgggcgatcggtgcctttgaggaaacgggtcattacgccgctcactcctcggtttcggttccgggttcggtggagtcggaaccggcggcttcggcggaatcgtcagcctcggcgtcatcggcggaatcggtctcggtctcgtcggcctcatcagactcggcatcgccgtcttcagcctcgtcgttctcatcgccgtattcctgctccggatccggggcgtactgcgcctcgtccggatcgatgccaagcttttcgagcacgtcggagtcgtcggtgatgtcttcgagatcgtggtcgatcaccacgtcgtcgctgttttcgtcaatctcctcgtcggcatactgatcctcaagacggtccagcaggtcgttgagctgctcggcttccttgctgcggccggcctcttcaaggaagtactgctcggcctgcacggcacgcatgcggtactcacccggcagaccctgagagcggccgacggtgtggaccacttcaatggccttgtcccacatctccaaatcgccaagggcaccggcgtacaccaggaacatctcgaccttgggagcgccatgcagctgcttgccctcatcggacagcgccagttccacggccttcttcggctctccgacgccacgctcgcagtcagcgatgaacggcaggtagtcgaggaagccgttcatacggtaggcggtgcggaactcacgcagggccagcttgtagtcgccctgacggtaggccacgaacgcgagcgtctcgcgggcaaagtcgatgcgggaggcctgacgggccacccacttggcgtgctccaaggcaagttcggggtcgctctcctccagtgcgaaagcggcgaggatgtgcagaccaatgttctccgcgtgctccttggacaggccgcgcagacgttcgcgctcatccttggacagcatcgaccattccatgcccttgggcatcttgggctcgtcgggacgacggtcggtgtacgggttctgcgaggggaagctcatcgtgccgtcggagttacggcgcggacgcctcatgtattcagagcgcttctcctcacggtactggcgcttctcttcctgcgaaaactcgcggaattcgccgtcacgacggttgttgtcgcggcgatcgtcacggcggaagtcacgacgatcatcgcggcggtcgtccctgcggaagttgcggcggtcgccatcacggcgatcgtcgtcgcggcggaagttgcgacgctcaccatcgcggtggaagtcacggcggtcatcgcggcggaaatcacgacgatcgttatcacggtgctggtagcgcggattctcgccgttctcgccttcgtgggaacggtagccgccttcgcggcgcggcttgaagccttcgccgtcacggcgcggaccattgccgcggtaaccgcccttgtggaagccgccggacttgccgtacgacttgcggtagccgccttcgccatcgccgtcgcggcgcggcgcgtagccctcgccatcctcacggcgacgtggcttgaagccctcaccgtcatgacgcggcttgaaaccgcccttgccgcgcggcttgaaacccttgccaccgcggttgcccggtcgacgatcgccataccccttatggccgccgccgtaggacttgccggaacgctcgttaccttctgccattgcttgttttccttaattcgttgttgattaacggttttccacggcgccgagcgccttcttgccacgacggatgagcgcgaagcgacctgccaggaagtcggcttcggccagcacctgctcctcatcctcgatacggttgttgttgagatacacgccaccggacttgatggcgcggcgtgcctcggaagcggacttgaacagtccggcagcctgggcggcgtcgattacgcgatcgcccggcttggagacggggaagacgtgctcgccgttctcgtcgaccaccttgaagccgtcgagcacggattccagcgtttcctcgtcgatgtcttcgaggttgccaccgcggccgaacagcgcaccggaagcatcgatggcagcctgggtagcggcctcgccatgcacgaagctggtgacctcccaggcgagggtcttctgggcctcgcgcttgccggggttggtcttggattcctcgaccagtcgttcgatttcggccttgggcaggaaggtgaacgccttcagcaggctttccatctccacgtccgggcggttgatccagaactggtagaacttgtacgggctgagcatcgtggcgtcgagccagacggcgttgccctcggacttaccgaacttcttgccggaagcatcagtgatgatcgggctggtgaacacgttgacgtccacaccgcgcaccttgtggatcaggtccaggccggaggtgaggttgccccactggtcggagccgccgagttccagcgtgcagtggtattcgtcaaacaggtggaggaagtcgttgccctgcagcacctggtagctgaactcggtgaaggagatgccttcctcagagttcaggcgacgggcgaccgtgtccttggcgagcatggtgcccagacggaagttcttgccgacgtcacgcaggaagtcgatgacggtcatcgaggcggtccaatcgtaattggacacgaaacgtacggcgttcgcgccttcggtgtccagaatgccgccgatctggttcttcagacgatcggcccagccggccaccacgtccttcgggttgagcgtgcgttcgccggactggcgcgggtcgccgatgagtccggtggcgccgccgaccagggcgattggatgatggcccgcaagctgcaggtgacgcatgttgatgagctgcacgaggttgccgatatgcaacgatgcagcagtggggtcgaagccgcaataataggtgatgggctcgccgttcagtgcttctgcgagtcgatcccggtccgtggactgggaaatcaacccgcgccattccagttcctcaagcagggtgttgaaacccgcttccttgaagtcggtgacgtgagccatagcttgtcgcttctccctatcgaattgtgaatgagactgcccaattgggcacagtcaagtttcgcagaacatggcgacagtgccgaacaccagccgagccgcgcgattcagtaaaacaccttattctagcggcgcgggcccataagttcgcgcaaagagtcgatgatgtcctgacgatccggcacctggaacttcgggaaggacttgagcatacgcttctgctgtgcgttgatgacgccattgacggcccagcgcagacgctcaaccgtatcctgcgaaaactcacgcatcctgtcggataccgcactggagccccgctgccacgtgccaccggcgcgtgccgccacatcctgcaccacctgagcgacggaatcgagcacctgctcgaatccgagcatgcccgtaaccgtgaccgccaagtcgatgatggtgatcagagccagtaccgtgaccagcgtatgcagcatcggcagcggaatcatatccgtgacccgctcgacatatggctgcgaaccaagtaccacgcccacgccgccgagaccgaaaatcaacgcgcccagcaggcagacgcggccttggaggttgaagcggaaattcgagtaatcccaccagcgggcgtggaacagctgctccatgacccacgaggttgtgtattcgagtatcgtggcgcccaccatcgaaatcaggaagatgatgatcgggttatgtacgttgccgagaatggcgacgccgagtatcgcgccggtgccgtagatcgggcacagcgggccgttgaggaaccctcggttgaccaagcggtgctgttggcaggagacgagaatggattcgtacatccagccgacgaaactgtagaacagaaaccagaggaaataatgttcgagtgtgatgatcatcgacgggcttcgatctcggcgtagggcttcgcggcgggcaacgcgcgcttgttgaaccggtcgagcgagaaggtctcggcggtggcggagcatttgtccgccaaggtgaccagatagccttcgatatagcgcggcggcaccagggtcatcgggaacatgtggttctcgatgctgttgcgttcgatatcgttgagcttgaagtccttcagggcattgaccagggcggcgtggccatgggtgaagccatgccactggtgttcgccgttatcccagtcgtgccagtcgtacaggaagtaatcgtgcaggagggccgcgcgaatcagggatttgaggtcgacgcggtaccacaggtgcgcgcggtcggccatccacacagccaggcaggcgacacgcacggaatgttcgaacgtggtgacgttgccgtgctggtagtagcagcgttcgatctgcatgtggcgatgctcgatgacctcacggccgtgcttggcgaccaggcgttgaatctgcgttcgggtgagcagatgtcccacggtttcgaccctccgttcgggttggttcagtgcaatcccttgttgtgaattacgattacccgacgatattcaagaatccatcgagtaataccgtgaccgattgtagggcacacgtatgtccgtgcacactcatccaaaagaacgacaacgggaaccgttaatcgtggtgggtttcaagatagtcgagataaccctgaaaaccgccatcgaggcttgctacatcgtaaccgcgatcggcaaggatttcagctacttcctcgctccaccatccttgagcacaatagactacgacagttcgatctgtgggcacggttttgagcacatgggccagagggtcgagtggtgcattgatggcaccttcgaccgggtgggcggcgaagtcggctggttccctcaagtcgagcagcgtgaccgtattcgggtcgagcttggcaaattccgccggcgtgatgcggcggtacgatgcttcactgctctcatcgtcatcgaccgcattacgcaaagcaataggcatgttcttcccctctcgttccgatcttggctcccctcaaggaggggtgccacatagctctaaatcgcgcaagccggctgaatatagttggccggatcaatagcagtaatggtcggctgctcaccgcacaccgggcagtcgggcacatggttcggcaacggcacacggcggatgttcatggtcagggcatccacggtgagcatgcgccccaccaacggctcccccacgccggcaatcaacttcacggcttcggtggcttccagactgccgatcacaccgaccaccgcgcccagcacgccggcttccttgcaggtcggaatctcaccggcggtgggcatgtcgcggaagatgcagcggtagcaggggccttcgcctgggatgacggtcatcacctggccggagaacccgaccacgcccgcatggatatacggcttgccggccagcacacatgcgtcattgatgaggaattttgcggcgaagttgtcggtggcatcgatcaccagatcgtacggttcgatgaggccggcgatgttgctggcatcgacgagctcgtagtaggtgtcgaccgtcacatctgggttgagcgcgcggatggccgtggccgcggattccactttgggcgctccgacacgtgcggtggtatggatgatctgacgttgcagattgctcatatccaccacatcgccgtccaccagtccgatatggccaacgccggccgccgccagatacagggcggccggagagccaagcccgcccgctccaatgatgagcacgctggaggccaacaaccgcttctgccctttgacgcccagccccttcaaaatcagatggcgcgcgtaccgctccacctgttcatcagtcaatgccatgttttctccatgtttccagctcccctcagtccgctacgcggccagctcccctcagagaggggagctaataaaagtgtcagtgcaaatatcccgtagtcggactggacggcacggcctgtccctcggtcaccttgcccagaccggacagatacgccgcacgaccagcatcgatggcgtgcttgaacgcctcagccatcagcgggatattgccagcagaggcaacggccgtgtacgccatcaccgcatccgcacccatctccatggcgtcgcatgcctgactcgggcgtccgatgccggcatcgatgatgaccggcacatgcgcattggcgatgatgatctcgatgaagtcacgcatgcgcaggcccatgttggagccgatcagcgaaccgagcggcataacggcggcggcaccggcctcctccagctggcgtgcggcaatcgggtccgggaacatgtagggcatgaccacgaagccttccttggccagcatttcggtggctcggatggtttcggcgttgtccggcaggaggtacttggtctcgtgttcgatttcgaccttgacgaagtcggtgtggcacacttcgcgtgccagtcgggcgatacgcacggcttcctcggcgttgcgcgcaccggaggtgttgggcagcaacgtgatgccttcgggaatgtagtcgagcacgctgttctcggtggtctgcgcgcggcgcagtgccatggtgacgatttgcgtgcctgcatgttcgaccgtggccttgatgaggttcaggtcgtagcggccggagcccagaatgaatcgcgactggaactcgtgaccgcccagggtcagcggcttgtcttccactggcagaatcggcgcggcggtgccgaccggattggtgacggcgggctgcggcggcagcggagtcgcctcaacagatgcttcagtaaccggattaatattgctcatagcttttcctttcatccaccctgtacaaactgcacaatttccatgacgcactggtcgtcgagcatggcgtcggcacgcttatcgcgcgggataatctcaccattgagttcgatggccacacgctcggcgcggaatccgtgcgcttcgagataatcggcgacgctgaccggcgtctcgagcgtgacctgctctccgttgacctgcataatatcctttcagatagtaaaaaagggtgcacgaaacgaaccgtaccttaagtggtgcgcccattcatgaacccaatcatgcgaccgttcgaccgctgtgatgtattggctccatcacgaccgtctcacggctgaattatgcaaacggaatgaaagctgtatcggagaacccggcaaatctgcaacaacgattccttacggcggcatgacccgcgtcaagttccccggtcgaagtctggcgacttcctctcagcctcacggctcccgttcgttacgatttctcagtgtatgccgttgcagtgacaacagcaaaatagagctccctctgacgagggagctctattgggactagaacgtgccgggggctttgtaggcggagccatccgacgtggatgcggggaagagcttgagttcttcgacctcggccttggcgtcggcgatctgctcgcgcacgcgaccgtaagcggtgccgcccttgccgttgcgggagtcgaccgaaccgtggctggagagcacttcgcgtactcccggagccttgtcggccggcaggaacgcggcgaaggtctcgatgaagtcattgtcggtcagatcccacagttcctggccgcggccttcggcgagcttgacgcaggcaccagagagctcgtgcgcgtggcggaacggcacaccgttcttgacgagccattcggcgatgtcggtggccagcgcgaagccggtcggagcttcctcttccaggcggtcgccgtcgaagtgcatggtcttgaccatgccggtgaaggcgggcagcagcacttcgagcgtatcgacctggtcgaacacggcctccttgtcttcctgcagatcgcgagcgtaggcggtgggcaggcccttcagggtggacagcagaccggtcagatcgccgatgagtcggccggacttgccgcgggcgagctcggcgatatccgggttcttcttctgcggcatgatggaggagccggtggaatagccgtcgtcgagcttgacgaaggcgaactcctgggtgttccagatgatgatctcctcggacaggcgggagatgtccacgccggtcatggcggccacgaacgcgaattcggcgacgagatcacgtgcggcggtgccatcgatggagttgtcggtcacgcgggagaagccgagctcacgcgccacggcctccgggtccaggccgagcgtgttgccggccagcgcgccggagccgtacggggaggcgttgatgcgcttgtcccagtcgatcagtcgctgcacgtcgcggatcagcggccaagcgtgggccatgagctggtgcgcgagcagcacgggctgggcgtgctgcatgtgggtgcggcccggcatcacggtgcggccggccttttcgctctgctcgatcagggcgttgacgaggtcaagcaggagtccggcaatcgcacgggagtggcggcgcagccacatacgaatcaggcaggcgatctggtcgttgcgggagcgtccggcacgcagtttgccgccgagttcgtcgccggcaatgtcaatcagaccgcgttcgagggcggtggcctcgtcctcatcgtcttcgatgggggcgaaggagccgtcatccacatgacgctggagcgtgtcgagcgcatcctccatgcgctgcagctcgtcggcggtcaaaagtcccgcacggccgagagcacgggcgtgggcgcgggaaccggcgatatcgtcgtcggccaagcgccagtcgaactgcgtggacttggacagtcgggccaattccggcgacggaccggacgtaaagcgaccaccccacagggccagatgttcgttgttctcagtcatgaaggctccttgaaaagtgaaaatagctgtgtttaagcgtagcaatgtgttcaaacatacagttgcccccgctggcgagggctgtcacatggagtgtgactgaggacagtcctttcaaagactactcccagtcagctatgccgacagcctcgcagcgggggcgactgagtaagaattactcgacggtgttcttcgggacctcgatgccgttgccgaacttgacgtcgcgcgctgcggccacgcgggacggcaggccgtagatgtcgatgaagccgttggaggacttctggtcgaaggtatcgccggaatcgtaggtggcgagcttgtagtcgtacagcgaggagtcggaacgacggccggtcacgacggcgcgaccgccgtgcaggaccatgcgaatctcaccggacacgtacttctgggtgtcttcgatgaaggcgttgagcgactgggttgccggggagaaccactgcgcatcgtaaaccagctcgccccagcgcttgtcgatgtcgcgcttgatgcggtgctgttcgcgttcgaggcagcagttctcaagctcctgatgagcggtaatcagggccacggcacccggagcctcgtacagctcgcgggacttgatgccgaccaggcggtcctcgatgaggtcgatgcggccgatgccctgggctccggcgcggcggttcatctcctcgatggcctgcagcggggtgacgtcacgtccgtcgatcttgaccggcacaccttccttgaactcgatgacgacttcatcttcgaccggcgggaaggccgggtcgtcggtgtaggagtagcagtccttggtcgggccgttccacggatcctcaaggaagccggtctcaatggcgcggccccatacgttctggtcgatggagtacggggacttctcggtctgggtgatcggcaacttgtgctccttggcgaacgcgatctcgacgtcgcgggtcagggacaggtcacgaatcgggctgatggccttcagcgtcgggtcgatggaggcaatggagacctcgaaacgaacctggtcgttgcccttgccggtgcaaccgtgggagatggtgtcggcgccgaactggtgggcggcgcgcacgaggtgcttggagatcagcggacgggagatggcggagaccagcgggtagacgccttcgtacatggcgttggccttgagggccttcatgcaatattcgttggcgaactcgtcacgggcatcgaccacgtaggattcgacggctccgcaggcgagggcgcgctgcttgatggtctcgaggctttcgccgccctggccgacgtcgagggacacggccacgacgtccttgccggtacgctccttcaggtacgagatggcgacggaggtgtcaagaccgccggagtaggccagaacaatgcgcttgttatctgccattggttccctttcgttcaaggtctaaaaaacaaactgatgcaagtatatacagaggactgtatatttatgcacggcgtgttggttatttggaggcgaggcttagtagccagtcggagcgggagacagcggtgtcgtcattggtgcaaatcaccatgacggtgtcgtctccagcgatggtgcccagcacgccttcgatcggctgcctgtcaatcaccgaggccacgtattgtgcggcaccggaaggcgtgtgcaccacaaccagatttccggcggcggccaccgaggtgaccagtccgttcagcacgcgggacatctgtgcctcaccgcgctcccctacatcctcaccttctgaagcaacggcgctgcgacccaccgtgtaggccaccgtgccgtccttcagccgggtcttcaccgcatgcatctcgtcaagatcgcggctcagggtcgcctgagtcaccgcaatgccctcgtcgataaggattttggacagctgtgattgcgaggtgatgatatgcgtggcgagcgcctgttctatggcactcagccgcgccgccctggtggcagggcgctgcagggacggaccggtttcactcatgcgagcaggctttcgtctccacgggccttgccggtcaaccaagtcagcaacgctttctgtgcgtgcagacggttctcggcctcgtcccataccacggactgcgggccatcgatcacttcagcggtgacttccttgccgcggtaggcgggcaggcagtgctggaagagcgcatccggcttggccaatgccataagttcggtgttgacctggtaatcccagaacggcttggaacggatggcgtattcggcctcctcgcccatggagacccaggtgtcggtgaacacgcagtcggcgtccttcaccgcttccttggcatcggtggtgaccaggatggagccgccggtctcggccgcgacgcgcttggcgtcggccacgatgtccgggcggggcaggtagccgtgggggccggccacgcgcacgtccatgccggccacggcaccgccgagcaggtaggagttggccatgttgttggccgcgtcaccgaggtaggcgatggtctggttcttcaggttgtcgacgccgcctcggtgctcggcgatggtctggaagtcggcgagaatctggcagggatggaagtcatcggtcagggcgttgaccaccggatgggtggagtacttggccatttcttcgacgcggtcctggccgaaggtgcgccacaccacgccgtaagccatgcggtcgagcacacgagcggtatcggccacgggctcgccacggcccagctgggagccggacttgtcgatgaccagcgggtagccgccaagctcggcaacgccgatggagaagctggaacgggtgcgggtggatggcttgtcgaacagtacggcgacggcctgcggaccggcgaacggctgcttgtagaagcggtcatggtggaacttgatggcaagttcgagcacctgcttctgctcctcatggttgaggtcgtcatctcgcaacatgtggcgaagttctggggtcatgatgatctccttggatcggtgggtcggcagtgacggcgagaaatcagtcgtcgggcaggtccgtaggcacatccttgaggatggcaagtgcctgatccacgtcttgagcggttacaatcagcggcggtgcgaaacgcagcgcattgggagccaccgcgttgacgatgagcccgtgttcgaggcagtagttcatcaccgcgtgggagcagggatgcttgagctcgacggcgtccagcaaaccacggccgcgtacggaaacgaacagcggattaccggtggccataatgccatcgcgcagctgtttgccgcgagcttcggcgttggtcaccagattctcgtcttcaatcacgtcaagagtggcgagtcccgcagccgcacccagcggattgccggcaaaggtggagccgtgggaaccaggagtgaacagagccgcaagtttctcaccaaaagcgatcatgccgcccatcgggaatccgcctgccacacccttggcgaaagtcaccatatccggcgtcacgccgccggacagatcgtcacgctggaatgcgaaccacttgccggtacgtccgataccggtctgtacttcatcgatgatgagcagcgcgtggttgatatcgcacagttcacgcacgaacttgacgtaatcggcgcccaacggctgcacgccggcttcgccttggataagttccagaatcacagcagccaccggacccttgccatagcgaccgagaccggtctgtgcaaaagcgtcgtgcagggcgaccttgtcgccggcgcgcacgaattcgatgttcggcaccagcggatcatacggcttgcggataccgggtttccatgtggcggacagcgcacccatcgtacggccatggaagccgtgagtcattgcgagaatgcgtgcgggcttgccgccgatggaaggcagggcatcaggcaaggtgcggccatacagcttggcgagcttgagggcagcttcattgccttcagcaccggagttgccgaagtagactttggagccttcaggtgcaccagccagcttgaccagtttggacgccaattcaatttgcggctcggacgcgaaatagttgctgatatgagccaccttggcagcctgatcggcaaccgccttgacccacttggggtgggcgtatccgagggaattgacggcgatgcctgccaggaaatcgaggtattcgttaccgtcaacatcccagatgtgggcaccttggccgtgatccatgacgcgcaacggcgtaccgaacacattcatgtggacctgagagtactctcccagccacttgctgtcttccgtacctagtttttcctcatgctcagtagccataagagctcctcatttccagtccttcatcgggcataaccatggtaccgatgcctgcggaggtgaatatctcattcaaaatcgaatgcggcttgcgcccgtcgatgatatgggcttggggcacgccaccgtcgatggccctgacacaggcctccatcttgggtcgcataccggattccaggtccggcagcatatcgcgcaggttttccacaccgatccggccaatcagagaattcttgtccggccaatcggcgtacagaccatccacatcggtcaagataacaagcttgcgtgcgcccacagcggcagccaaagcggcggcggcggaatcggcgttcacgttgagcacttcagtggcatcttcttcgttcggagccacggaagagacgaccgggatacgaccggcggccaccagatcctcgactgccgaggcatcgacggaaaccacatcgccgaccaagccgatatcggtgggcttgccatcgatgatgggcctgcgctgcatggccgagaacaggccgccgtcttcaccggacaggcctacggccagcgggccgtgcgcgttgatcaggccgaccagttcgcgtgacaccttgccggtcaggaccatgcgcaccacgtccatggcctcgggggtggtgaccctcaggccgcctttgaattcggatttgatgccgagggccttgagcatgtgggagatctgcgggccgccgccgtgcacgacgatcggatgcaggcccacctgacgcaggaagaccatgtcttcggcgaagcactgcttcagatggtcatcgaccatggcgttgccgccgtatttgacgacgatacgctggccggcgaactcctccagccaaggcagcgcttcaataagcacttctgccttctgatcggcgcgcaaatcggtgtgcacgtcgaaatggaacccaggtcccttcaattctgtagccaatttttctcttttctgcgacgccggcgacgctatcgctgccggctgctacaaacagcccactgggctgtttgcgttatatgcgacgccggcgacgctatcgctgccggctgctacaaacagcccactgggctgtttgtcagctttcgtagtcggcgttgatgtggacgtattcgtgggtgaggtcgtcggtccagacggtggcctgcgcactcgagccggtgttcaggtcgatgtcgatgtggacttcgcgcggggtcatgtcgacctcgctacggtcgcggccggcgccgccgttctcgcagatgcgcacgccgttgacgtccacggtcaccttgttcgaatcgtaaggcgcgacttcaggcggcacagtgcccagggagctgacgatgcggccccagttcggatcgttgccggagatggcgcacttgagcaggttcgaggcggcgacggcacgaccacaggcaagtgccgcgtcttcgctggtggcaccggtgacggtgatacggatgtcgtgggaggccccttcgccgtcgccgataatctggcgggacagggatgcgcaggcctcacgcaccagcttgttgaattcgtccttgtccggttcgacgccggaggcaccggaggcgagcagcaggaccgtgtcgttggtggacatgcagccgtccacgtcgatgcggttgaacgaatgttcggcggccacggcgagtgcggcctgcatctggccggcggagacgaccgcatcggtggtgatgacgcacagcatggtggccagctgcggggcaatcatgcccgagcccttgaccatgccgccgatcttccagccgttggagccggtcagttcgaccgtcttcggcttggtgtcggtggtcatgatggcgtgggaggcgtcggcgccggcttcggcggtggcggcaagagcctcatgggcactcttggcaccagccagcacgttgtccaacggcaatagttcaccgatgagaccggtggagcagacagccacatcattcggttcggcgccgatgagaccggcgaccgtttccgcggtggtgacggactgggcgtaaccggcctcgccggtgcaggcgttggcaccgccggagttcagaatcacggccttgacgtgaccgtcggcgacgaccttacggctccattgcaccggggcggcacagaaacggttcgaggtgaacacgcctgcagccgcgtcgagtgggccgttgttgaccacgagggccaagtccttcttgccttcgacggatgagataccagccgccacgccggcggcggagaaaccttgtgcaaatgtaacgctcacggtgctactccgatcttggtcaggcccgcgtcttccggcaggccgagtgcgatgttcagtgattggaccgcttgtccggcggtgccacggttgaggttgtcgatggcggcaaaagcgtagatgcggccggccttgcggtcggtgacgacctgcaggtgggctgcgttggatccgatgatgttgccggtggcgggcagtgtgccctcgggcagcagcaccatgaagtcctggccttcataggccttggcccatacggcgcgaatctcctcatcgctcagtgccttggccttgtccgtcatgcgggcggacacggtggcgaggatgccccgggacatgggggcgagaatcggcgtgaaaccgagcgtgaattcgctggcttcggccgcgcgcttgccggccgcgtgggcgaagttctgcaggatttcgggaatgtggcggtgcttgccgcccaccgaatacggcagggcggattgcagggcctcggcggcaagcaggttggtgcgcttgagattcttgccggcacccgagtatccgacgaccagatcggccacgatatcctgcgattcaaccagtccttcggcgatgccgggctggagggccagcgtggtggcggtgacgttgcagccagggcctgcgatgcgcttggtgccaggaagcgccgcacgctggcgggtgtaggagccgtccgcggctttgccggtgatgagctcgggcatgccgtagttccaatgctcatagaaatcgccgccgtagaactcatcccaagcggcctgttcttcgaggcgatggtcggcgcccaaatccacaaccacggcattcggatcgagctgcgaggcgagcttgcccgaagcaccgtgcggcagtgcgaggatgataacgtcatgcccgttcagcacttcgggcgtggtatcttcaacggacagattggccagttggggaatatgcggcatgtgcttggccatcgactcccccactgaggaatggcctgccacgcaggtgatgtcgaagtcggggtgcgcggccagaatgcgcagcgcttcaccgccggcatagcccgtggcaccggccacggccactgtatatttcgccatactcatctcttttcactgatgtgtcttcggatgagtatacgcgattatgcagactattgcatatttatgcagtgggtgtgttggtatgtgaacgccacttatgcggagatggagtcggaggaggagccggtgccgccggtgagttgctggagggcttcctggtagaggctcatggcgtcatagccattgaaggccatccagatgacggcgatggtgtatagcacgttgatcaccacggcggccacggccaaaccgaagcccttcatatggaaggtgcgcgtgcgccacattgccaccgcgcccatcagtgccgagagcaccggcacagggaagaacagggcgaggataaaggagatgatcgcatacgaatcccagtgcccgtagagcgggttctggtttggatcgttcagatcgatgccgtggtaataatgcggctggtgaggctgaccgttcggctgttgaccatacggctggccctgcatgcccgggtacccgcccggatatgcgcccggaccggactgttggccgccttgagcatacggccagccgcccgcctgctgattgccaggccacggcgtctgctgaccgtacggctggccggcctgctgggattgcgccgcgccaccgttgatgccagcggctgcggcggaatccttcttggtatcaggctcgggagcgccataaatatacgggttgtaattcggcccgtattggccagacatagcaccatattcaggctgctggtactgcccgtatttcggcttgtcctgctccggttggctcatgacgctcctcgattcggatgattggttgggtcaggcgcgcagctgggcgccgatttcggcggcctcagccacgatggccttgcggatggcgtcgctgtcttcggcggacagcgtcttgctcggcgaacggaacaccaccgcataggccagggacttcttgccctcgcccacctgttcgccggtgaacacgtcgaacagttcgatggattcgaggttcgcgccggcggccttgcgaatcacgttctcaagctggcctgcggtcacggtctcgtccacggtgaaggccaaatcctgcttgaccggcgggaacgtggagatcggcttggcctggacgggcttgccggtcagcgtggcgaacagcgcggtgaggttcagctcgaaggccgcggaatgggccgggaagccgagcgcctcgttgacgcgcgggtgcagttcaccaacccagccggtgaagacgtcgcccaccatgacgcgggcgacgcggccggggtgccattggacgggcacatcgtcggcggcgggctggtcgagttcgattgcggcaccgatacggccggcgatgcggcgcacggcctcgacggcgtcggaccagtcgaccgggcgcttgccgcccatccagccgtcgtcctcggccagaccggtcaggatgccggccacatggtcgggctgttcgggcagaccggcgtcaagcgcagcgagctgttcgtcggtggggcgcacgccaccgggcagtgccgggatggcgggcgcatccggatcccacaggtagacgtggccgagttcgtacagggacacgttttcgatgccgcggcggatgttgcgctgcacggtggtggccagggtcggcagaatctcgcgacgcaggtacggacggtcgccgtagagcgggttggcgatctcgacgctgaccttcttggtggcttccgggtcgaagccgaaggccttgtaatcgtcgtcgcccacgaacgggtagctcagcgattcgaccatgccgaactcggcgagctcgtccgccacgcgacggcgacgctgctggtccggggtcaggcccaccagaccctcgaccggtgccggcggcacggtaatcggaatctggtcgtagccgaccagtcgggcaatctcctcgaccaggtcgcacggctcgttcaagtccgggcgccagctcggcgcggttacggcgaactcgccgttgccgccgccggccaccgtgcagccaatgtcggtcaggatgtcggagatgcggttgatgtccacgtcgaggccggccacgcgggccacttcggaggccttgaagtggatgaccttggcgcgcggcgtgttgttcacgtcgttcgggtgttcgctgggctcgccgttgccgtacttggccatgagctcggcggccatctgggtggcggcgggctgcagcgcggtgtcgacgccacgttcgaagcggcgggaggcctcggatggaatcttgtggcgacgggccgaacgggcgatggtcacctgatcgaagtgcgcggcctccagaagaatgttcttggtgtcggcggtcacttcgccatacaggccgcccatcacaccggcaagaccgaggatgcgcgagccgcgttcgccgttcggcgaatcggtgataagcagatcttcgacgctcaggtcatgttccttgccgtccagggtggtgagtttctcaccctcgttggcgcggcgcacgacaatcgggccttcgagcttgtcgaggtcgtaggcatgcatcggctggccgaggtcaagcatcacgtagttggtcacgtccacggccaaggagatggagcgcataccggcgcggatcaggcgacgacgcatccagttgggcgtgtgggcgttggggttgaagtccttgacgatgcgcgcgtagtagcggtcgcaaccgggcacgccgtgaatcggattgttatcgtcgatttcaacatcgatgtccaccggggtgccgggctggtagtcagcaggttccggggccttctcgttgagtgccacggccggatcggtgtagacggcaccggtggagtggtggtattcgcgggccacgccacggtaggacagcgtgtagccacggtccggggtgatgttgatctcaagcagaggctggtcgaggtgcagcaggtgcatggcgtcctgaccaggcttcagagcctcgtattcggcctcggagaagccgtactgacgcagcaggatgatgccgtcgtggctgtctcccagacccagctcacgttcggaggcgcacatgccgttggagatgtggccgtaggtcttgcgcggttcgatcttgaagtcgccgggcagcacggcaccgggcagggtgacgacgaccttttcgccggccttcatgttgggcgcgccgcagatgatgccgcgcggcaccttgttgccgtcttcgtcggtctcgttccattcgtcgccgcagtccacgtggcaccagttgatggtcttgccgttcttctgcggttcgggggtggcgtcgaccacgtagccgaccacaatcgggccggtcacctgggaggagtgaatctcctcttcctcaagacccaccttgacaaggtccttggcgagctgttcgtaggtcaggccttcaggaacctcgacatggtccttgagccaatcgatatcaatcataggcatggctgaatcactcccccatcacaaactgttcggcgaaacgcacgtcgccttcgaccaggtcgtgcatgtcgttgatgtcgctgcgcagcaggagcgtgcgctccatgccgacgccgaaggcgaaaccggtgtagacgtccgggtcgatgccggcggacttcagcacgttcgggttcaccatgccgcagccgccccactcgagccagccggggccgcccttcttgtcggggaaccacaggtcgagttcggcgctcggctcagtgaacgggaagtagctcgggcgcaggcgcgtcttggcttcagggccgaacatggcgacggcgagcttgtccaacacgcccttcaggtcggccatagtaaggtgcttgtcgacggcgagggcttcgcactggtggaacaccggagtatgggtggcgtccagctcatcggtgcggaacacacggcccggggacgcgatgtacagcggcacgccacgggtcaggagggcacggacctgatcggaggaggtctgcgtacgcaccaccatgttggagccgacgaaaccggcggcgtccttggcctgattgcccttgacgtagaaggtgtcctgcatctggcgggccggatggtccgggccgaaattcagggagtcgaagttgtaccattcggcttcgatttccaggccggaggagatctgccaacccatggagatgaagaagtcctcgacgtcctccatcagcttaggcagcgggtgacgggcgcccagaggcttacggttcaccggcagcgtcatatccacggtttcggcggcaagcgcggccttctcggcggcttccttgagctcgacctccttgggaccataggcacggccgaagtcggcgcgcagcttgcccatgagcttgccggcttccttcttctggtcggcgggcagggagccaatggccttgctggccttggtcatcgccgaatcggcacctgcgtacgtcgtcttgatggccttgagctcctccaggttggaggcgttctggattttctcgatgccctcggcaacctcagcggtcacctggtcggcgtcgaacaccatttgttctgccacgagaaccctttcgtctgatgttttctcagcgtttcacagcgtttttaccggtttcacattctttcaacatgacccgacatagacagcgacatcagcatcaccgcggccgaggtgccgaggttcagcgattcggccttgccataaagcgggatggagacgatgcggccgcagcgcgtgaggatgtccggttccaagccacgcgcctcattgccgaacaacacggctttcggagcctcgaccgccgccttgtccgccagtactgcgggcaggctttccggcttgcgttcttcggtgccgtatacgtcggcggcccagacgtccaaattatggtcgcctgtccaggtgaagaattcgtcggtgctcatggcgagtaccggcagatggaacagggagcctgcggtggagcggatgaccttggggttcagcacgtccacgcagtcgtccacgaagagtacggcgtcacagccggccgcatcggccgcacggatcacggtgccggcgttgcccgggtcgcgcacctgccagaagacggcaatctgcggggcccgaccgttcttgccaagttcgacgtcatcggcaccggcgtgcatggactcggcattgccgacggccgcgatgccttgggcgtccggactgatgcggtgcatcacgtcgccggtgcagtagtgcacataaatcgtggcatcctgcgaggtttcgacgatcttctccaacgcggaggagatgatacgcggatgttccagcgcctgcgaaacctctacatacaggtcccgcaccacgtccggccgccaagtgacggcctcgcgcacggattgcgggccttcgataagaaaacggcccgaacgttcgcggcctttggtgcgggtcagatcggcgatgtggcgcacgcggtcggatttcggattatcaagaatctgggcgttgatgggcatagccactaccctactgccggggcattacgtcagtcgtggctcgctccccgctggcggaggcatcgtaagcctttcaagcaccctgaaaggcactgtgccagtctgccgcctttcaggcaccctgaaaggcgaagtgccaattcccggtgccgacggctacgcctatggaggccagcgggacggccagacagatgacgtagaagatccagtcgacaggcttcagacgcgagatgcgggcttgggagcgtggggcgccggagccgaagccgcgcgcttccatggcggtggcaagtttggtggcgcgccggatggagagcaccagcagtccgaacgcttgggagagggcacgggcgatggcgttaccgtcgccaaggccgcgcgaacgctgggacaagccgagtgcgcgccaatcttcctgcagcagcgtaaacatgcgcaatccagccaacccgccgtatacgaatcgcggtgagaagtgcagaatctcgaccaaaccgtccgccaaatcagtgggatcgaggcccagggccagaatcacgccgggtacggcaatggccgccaccctgatagccgtggcgatggccagattaacggatccctcgctgatcacaatccagccgccctgccacaggatctcgcccgaggtgcggccgtagagaaacacggagataaaactgccggcgacggcgatccataccggccaggtcttacggcatacggtccacggagccacgccaccaatccacagcagcacgaattcgatgccgagcgccgtagacgcggataccacatccagactgatgaacatcggaatacacagcaacagcgcaccgatgatgcggctgaccgcgttgatgcgcgcgataaaccatgagggcgatgaggctttgaccggctccacgcgcgtttcctgcggactgacgattaccacgtcactcatgccttcgcctcctcgaacatcacacgtcgtgcgcccagcgcatccaccagcgcctcatcgtgcgtcaccatgatcacgcacgagccttgatcgcggatggcggcaatcagcttgaccatctcattccacgtactgaaatcctgtccgaatgtcggctcatccatcaccaacactttgggtgcggcggccagcatggaagccacggacagtcgccgcttctccccgccagacaaggtatacgggttggctttggcgaagcgcgtgagattcatctgctcaagcatgcggtcggcggtctgataagcctcgtcttggctctgccccatcgacttggggccgatggcgacttcgtcacgcacgaaattggcagcgaactggtgctcgggctcctggaacaccatgccgatacggcccagcagttccttgcttttccagtcgattggctcacgcccggcatgcgcgggcttgaggttgtcggcgatgagcaccttgccggcgataggctcgagtagcccggccaaggtcaaggccaaggtcgatttgcccgcgccgttcggacccatcagagccgttacttcgccgggataaaaatccagattgacaccaacgccaagagcggttccacggccaaagcttaagttctcagtgctgagcaccggcgcatcgtgcgcaggctcctgcttcggtgagtaatcgggaatcgcacggcccggcacccacgcgccaccggcggccaatacgtcgcccatctcggcgaacacctcgtccggcttgccgtcggcaatgaccgcacccgtgggcgaacttgcatcgggtcggccgagcacaatcacgcgatcgaccagatcgagccatacatcgatatgatgttcgaccacaaccatggtctgtccggtgtcctcgatggcctttttgaccgcgtcatgcacttcgaccacgccttcggggtcgaggttggcggtcggttcgtccaacaacagcagaccgggcttcatagccagcacgccggccaacgcgagacgttggcgctgaccgccggacagatggcgggtggaccgatccagttcgagtccgccgagtcccaccatatccaatgattcgcgcactcgctgccgaatctcctcgcgcggcacgttgaggttttcgcagccgaaggccgcgtcatcgcctagtcgttcaagaatgatctgcgagtccgggtcctgaagcaccagtcccacgcggcctcgcgcctcgcgcgcatcgacgccatcgatggtgagcgagccctcctgctcgccttcctcatcgccgccaagtacgcctgcgagaccggccatcatcgtgcttttgcccgcgcccgaagcgccaagcaacagcacacgttcacctggccggatggtgaaatcgacggcacgcaacgcgaaatccttgcgcgtcgcgtgccgccagccccagccgctggccctgaccgcggccggatcgacctgcatcagacccgcgccttgccgcgtccggactcgaagcgctccagagcaccggtggcggcgagcgcgcgggacagataccagaccaccacgccggcgatcacgacgccggagatgatggagccgaccaagtaccaggtgacgcgcaggccgttccagcccgggttggtggcccagtagtaggcccagcagcccacgccggcgagcgcaccggacaggatggtggtgccgatgttccacttcttccaggcgaagacggcgaaggcaatttcggcacccagaccctggatgatgccgacgatcagcgagccgccgacgccccactggttgcccagcgtaagttcaaggaaggcggcgagggtttcggcgaacagtgcggcaccgggcttgcgcacgatgattgcggcgagcgggccggcgaacagccagaatccgttgagcagaccctcgaaaccgggggtcacgccttcgaacagggccagcggggcggagcagacaatgtcccagccccagaaaatgacgccggatgcgacggcgatgattgcggcgacgacgatatcgacgacgcgccacttgtaattggctttggccacagcttcagtcatgaatgcgcctttcttctgctcgtacgcaggccggacatacatggatatatgtacgcacatgatgcacatgttcgtggccacgcgcaggttggttcaggcacgggtgggtaagagcgacatttccgtgcgccggcattatccggtcacgttccatcggtcgagactatgtgtctcctctcagccgcctaacggcagctcccgtgtcaactccccgactataaagcaagccgccgtcaaaggcaatagccacatctgtgacctaccggacggcggctcgctaccattaccgatacggttcggctacttgccgagcttgtccagcagcaaagcctcggtgatcacgttgttcttgaggccgggcagggagatggactcattggggctgtgggcgttggccttcgggtcttcgggaccggtgaccagcacctgagcgttggggaaaatgcgctgcagttcggggatgaacggaatggagccgccttcgcccttgttgatgggctcaacgccgaaagcctcggtcatggcttccagcgcgtccttggtggccacggcagtcgggtccatggcccagcccatgccgttttcgccgcgttcgacagtgaccttggcaccgaacggcgcgtgggattcgaagaatgcagccagtgcttcctgcgcttcttcagggcgctgggtgggcgcggtgcgcagcgacaaacggaagcgggtctccggggcgatcacgttgaaggatccctcgaccgggtgggcgtcgaagccgatcacggtcacggacggcttggtccacaggcgtgaggccagcgaaccggtgccggcgaactcgtaaccggccaccacgccggaatcctcgcgcacagtggtttcgtcaaggtcgtgctgcaaaccgccgatcggctcttccgcggccacgccgggtacggccagatcgccgttctcgtcatacatggaagcgatgagcatggcggccaacgtattggagtcgagaatcgggccgccgtactggccggagtgcaccggatgctcaaggccctgcacggtcacgtccacacaggtgttaccgcgcagcgaggtggtcaaagaaggaatgtccgccgaccagttgccggaatcagccacgataatcacgtcagcggcgaattcgtcgcggtgagcctcgatgaagggaatgaagcttggcgaacccatctcctcttcgccttcgatgaacactttgatattgacgttgaggtcgtcgcccaaggccttcagcgcaccggagtggatagcgatgccgccgccgtcatcggcggagccacggccgtaaaggcggccgtcgatttcggtggccacgaacgggtcggtgtcccattcggccgggtccggaacaggctgcacatcgtgatgggcgtagagcagcacggtgggggcgtccggagaaacgatatgcgagccgatgacctcccatgcgcccggagtgccatcggcattggaagcctggaccaccttggcatccacacccacgaggcgcagttcgtctgccacgaattcagcggagcgcttcatatgttcggcggtgatgcccttggcggagatcgactgcagcgcgaccttttcggccagcaccttgacgatgcggttccaatcggtttcgacgcgcgaacgaatctcgtcagcggtgaacgttgccatgatgatcctcctttatatatgtgcgtgagcggcgtcattgcaatgactgcgccagtgtacaagtgtctgaacgtcaccgtaacctcaaagcatgacatggaatccgtttaagaaaaaagaagaggcccaagttcctgttgagcaggccccgaagaaggccgccgatccttctgagaaaaaaggccgtcctaccccgaagatgaagcaggctcaggccgccggtatccgtccgctggttccggtggaccgcaaggccagcgccaaggccgccaaagcccgtctgcgcgagagggagaacgccgagtacgaggcgatgcagaagggcgacatcaaccacatgcccaagtcggaacgcctgccgtggcgcatctacatccgcgactacgtggacgcccggttcaacctcggcgaatggttcattccggtgagcttcggaatcctgatcgcctccatgttcgccgcctcgttgatgcgcaaccagtgggcgtcggtcaccatgatggcgctgatgtacggctatctgatcgccgtgatcatcgacgtgtggctgatgtggcgcaggctcaagcccaagctgatcgccaagtacggcgaatcgtccgtggccaagggctcccgctccttctcctacgcctggagccgttccatccagatgcgtcgttggagacttcccaagccgcgttacccgaagcgcggtcactggccggcggactgatttttcatatatactccggctcccctcattgaggggctgagccgtaaagaaaacagtccagtggactgttcttaggcgaagtggcggcgatagccgcatatggctccctagcatgggagccatacttatatgcatcaaggaggcaaccatgagcgaacagtttgatctggtcatcatcggggccggccccggcggctattccacagctctgcgcgcggccgaactcggcatgaaagtggcactcgtcgagcgtgacgccaccgtgggcggcacatgtctcaaccgtggctgcatcccctccaaggcgctcatcaccgccacccacaccatcgacaccgtgcaccgtgcagccgaactcggcgtcaacgcctcggtgaatggcatcgacttcggcacgctgcgcgactatcgcctgcgcgtggtcaagacgatggtgggaggactggccggactgctcgcccatcgcggcatcaccgtgttccgggccaatgccgcgttccatgcggatgagattgctccagcaacttccaaccacatcgtccgcctcgtcccctccccggccaaagcgacatcctcacctatcacaaggccgatgtccccgaacccagcggcccaacgatggacctcacggccatgaacatcgtcatcgccaccggtgccaagccacgcccattgcccggcaacccgttcgccggcgccctcatcgactccacacaggcgctggaagtcaacgaatttccctcttcggcggtgattatcggcgccggggccatcgcccttgaattcgcctcgatatggaacgccaccggttcgaaggtgaccctgctgattcgcaaggaccgcgtgctctcagcctgggaccggagagccggcaccacgctgacccgtgagctcaaacgtcatggcgtgaacatcatcacccgcgccagcgtcacccacgtggacaccggcgcaaaccttggcgccaccgtgcactacacgcgcgaaggccaggatggcgaacagagcgtctggggcgaaatcgcccttgtcgccatcgggcgtgacccgatcaccgacccagcatggggcgtgacgatcgacgaccacggacatgtcgccacggatgcgtacggtcgcaccgacaaaccgggcgtatgggcggtaggcgacgtgacggccggtcacgcgctggcgcatcgtgcttttgagcaaggcatcgtcatcgcggagaccatcgccggactcaatcccaagccggtggacgaagccaccgtgccgcagatcgtgttctccttccccgaagcggcgtcggtcgggctcaccgtcgaacaggcgcaggcgagggaggatctcattgaaatcaaggagaccaactatccgatgctggcgaacgcgcgcatgctgatgagcggcacggccggctcattgaccatcgtctccggctgcgacgcggccaacccggacaccccgcgcgtgctcggcgtgcacatggtctccccgatggcctccgacatcatcgccgaagccgaacagctggtcggcaaccatgtgccgctcgccgacgcagcccgcctcgttcacccgcatcccacattcagtgaaacgctcggagaggcgctgctcaaggccgacggacgaccattgcacacacgctgagaccaaccagcacaagcaagttcggaccagcgcacctgataagatattgcccagtgtgtttcgtcccaacaaaggaagaagtgatggcggagaaggacgcgaagccgaagaagcagagcacaatcaagcagatcatccagatctacaagtacacggctaaggaagacaaggccctgccgtggcttgaggccggtgctttcctgctgcctgtagtcgtgacgatcatcatcggtctgattgtcaagtggacctggctgatctggatcttcaccatgatcaccgccatcatgctcggcattctgctggccaccatgatgctcacccgccgcgcggatgcagtcggctacaagcagattgatggcaagcctggtgccgccatcggcgtgctgagcaacatgcagaaagccggctttgacttcccgcaggaaccggcgtggatcgacccgaagaccaaggatgccatctggcgcggcacttcgatgaacggcatctacctgatcggcgaaggcgaatacggtcgcgtcatgaaggcgatggatcgtcaggaacgcgatatcaagggcgtcaccgccggctcctccattccggtgtaccgcatcgccgtgggccacggccccaagcaggtgccgctggccaagctgcgtagcacggtgatcaagtccaagagctatgagcccacgcaccacaagaacgcactgatcgccaagattcatccgcgccgtcgcttcctgctgaccaaggccgagatggaaacgctgaacgatcgtcttcgcacgctgcaggccaagaagggctatgccatccccaagggcatggatccgaaccgcccgcagaagatctcccgccgcgcgatgcgcggtcgctgatcggcagcacacaaccaaatcgcacagaagccccggaatccgttcaatcggttccggggcttcgtcatatgtctcataatcgcgtccacttacatccacctacgtcacctgtcaatacccactgtccacgttgcggacatctctacctacttccccgatagtctccgtttccattctgtaatgatgtttcgttgaaataacgcgcctgcgcgattgtcggccacagtcacgaaacattctcgtaacccaagtttcgagccggcgaaacgcgctattttacgatatataccgttatatctcatacgaaaggagcggtcccgtgaccgaactcaagtccaaggaagacgtcgaggcccttatcaacaaggaaggcatcgagtatgtctccgtccgtttcaccgatcttatcggcgttcagcagcacttcaccgtgccggctagcgaattcctgaaggacgctttcaccgacggcatgccgttcgatggttcctccgttcagggcttccaggccatcaacgagtccgacatgaagctggtcccggacgttgagacctctttcgttgacccgttccgcaagcacaagacccttgacgtggccttctccatcgtcgacccgctgaccgacgagccgtactcccgcgacccgcgtcaggtcgccggcaaggccgaggcctacctgaagtccaccggcatcgccgacaccgcatccttcgcccctgaggccgagttcttcatcttcgacaaggtgcgtttcgagaactccatgcagcgctccttctacgaggtcgactccatcgaagctccgtggaactccggcgttgactccgaagaggacggcaccccgaacatcggtttcaagaatcgcgtcaagaagggctacttcccggttccgccgattgaccacacccaggatctgcgcgacgatatggtcgccaacctgcagaaggtcggtctgatcctcgagcgttcccaccacgaggtcgccggcgctggccagcaggagatcaactaccgcttcaacaccctgcagcacgcaggcgatgacctgatgaagtacaagtacgtcgtccacgagaccgccgctctggctggcaaggctgcgaccttcatgccgaagccgatcgccgacgacaacggcactggtatgcactgccaccagtccctgtggaaggacggcaagccgctgttctacgacgagaagggctacgctggtctgtccgatctggctcgctggtacatcggcggtctgatcaagcactcctcctccgtgctggccttcaccaacccgtccctgaactcctaccaccgtctggtcccgggcttcgaggctccggtcaacctggtgtactccgctcgtaaccgttctgccgccatccgtattccgctggccggcacctccccggctgccaagcgcatcgagttccgcgctccggatccgtcctgcaacccgttcctggccttctccgctcagctgatggctggcctggacggcatcctgaaccacatcgagcctccggagccggtcgacaaggacctctacgagctgccgccggaagagcacgctggcatcaagcaggtgccaagctccctggccgaggctatggacgccctggaagaggaccacgacttcctcaccgccggcgacgtgttcaccgacgacctgatcgagacctggattggcctcaagcgcgacgagatcgaccaggctcgcctggccccgaccccgctcgagtacgagctctacttccacatctgagtttgagagcttagcaacgttgggatttcgccattgctcttctcttgtgggagtctaatgggagtcattcagcgtaactagaaagaacctcgtgaaattcgtttcacgaggttctttaggctggacataaagcccacggccgcacattcatcgatgaccaggaagccctcgcggtcagccatcctgaggttctcttcgctatacgggtagtgcgaggtacggaaggagttcgcgttgacccatttcatgagttcgtagtcgcgcttgatgacggccggattctcgccgcgaccgttgataatgctgtcttcgtggcgaccgaaacccttgagattatctttcggccagaacaacagaaaatggttcctgattcatggtaaaaagaatagccagcatttatttatgaatgagattccaagcgccggaggcccccggcattcttttcgtcgaaggggacaattcagaacacgaccgccgacacaatcgtcagggaggccagcgagaacagcgtgcttacgagcacgaagccgaccgcatactcgggcatgttgttcttgcgaccggtgaacatggcgatggtggtcatggtcggcagtccggcgatgaccgtgatcatcagcaccatgtcatgggtgatcgacagttgcggcgatgcgccggtcagcgcggtcagtagcgcgtagaaggcgagcgggaatgcgatcatcttggcgactaggccagcatagagttcgtagcgtttgaggacgccccaccacttggtcagtgcgaacaggccgcccaagtagattagcgacatcggtgtggccatattgccgatggtgtgcagcggcttcaggatgatgtccggcaccttgacgccaagcagaatcagaatcagggcgagcatcacgccaatgaaggcgggattgacgaatcgtttaagcaggccgaggacgcgggtacctagcgaggggcggacgacggccggagaaccaccgtttgcggcattgctcgccgaaccagcattgctcgccgaaccagcctcccccaccgaaccggcgccgttcaccgaaccgttcgcgaccgcacctcgcgcgccaatcgcgttgccgtcagtcgcttcgacgaccggctcgcacagccatacgccgtacgtccagagcagcgtctggtcgatgatcgacatcagcgccacgtaaatcgcgccgttctgcggccaaagtgccataatcaacggaatgccgatgaatccggcgttgccgaaaataagcgatgcctggaatacatggctacgcgaacctttgagccgcaacagtttggcgaccagccagaacaccaggatgagcagcgcgtacatcacggcggtcagcagcatcacgccccagttggcggcgagctgcgcgcggtccgcgccgtcgacggcgttcgagaacacgagcacagggatgagcacgttgagcagcagcgaacacatgccgtccagcgccgtctgaccatagaaccggagccttacacatccgtatccgaccatcagcatgatcaggaatccgaccaactggccaatcatgacaccgaactgccccatgcacactcctctcgtttgctctcccacgatttcctgtcactggttcatataggcagccatctggacaggctcggcggcacacgcatcagtatgttcgataccaccacatgccaatccacttctcgttcaaccgttccccgtgctaatgagccgcctgccaccccgtgttgccggtgctgcgcgagcaccgctacgtgtattgcattccggtggccctcgggcgcaacgtgtgggtcggcgcgaacgtgtcgatccacacgttttcgccgatgtggatcggacacgaatactgggcgccccggtagcgcaggtccggacgcacaggatggccggtggctacaagcgtgacgttggggccgagcatggtgtgggagccgatgaagatatcgccatcgtcgaccagcgtcaggttgaagttggcgtagcagcgctcgccccagtacgtattgctgccccagttcgcgtacaccgggccttcgaggtacaggccctcccccgcagcgccgaagaacgccttcatgagttcggtacggcgcttcgggtgggtcagcggcgtggcgttgagttcgagctggaggtgcgctgggcggcctgcaggtcgaagaagccatccacatcgtccggcagatagacttcgccggagaacatgagcgccattttctcacgcgtggcgtcatcgatcatcggcttggcgatcggcttgccttcggtcatcatcgtctcctgttagttgctgcggcgactgtgccagtcgaactattgtgccacagactcgtcttcgatacccagcattgagcgcaaccagtcgagctcggcggcgatttcggcgtcatgcacggcgatgatgccgcggcggtaggggtcgtcgatctgctcgatggagagcgggttgccggcgtcgcagtagaagaagtgcacgtcatggccgttcagcaggtcgtagcggcggcgcagcaccgcgtcacggtctgatttatccggaacaacaccaaggaaggtgagcacgacggtccagcgggtgatatcggtgaggttgaatccgccggtgttgcgcagttcctcgatgagtttgttgcggcccgcctcaagcagggtgaatacgcggcgctgacggccatcgcggatctcagactgttcggaaatcaggccggcttcgacgagtcggttggtcgccggatataccgtgccgtcgctgaatttgcgcgcgtagccctgcagctgttccatcttcttgcgcagttcgtagccgcacatggatcgttcgcttaagaaccccagaatcatcatctcaatcaagctcatgatcaccagtctacctcgtttcgacacgccacgtttcgatatgtgtcgtttcgatgtatagtgtatctcaacagcgagaaatacctcgaaacgagatatgcggcatatcgcagcgaatcattctcaataagaaaagtgtgaggcaaacgcacaataccaatcaatcgcacattcgacggaatggcatcagaccgccgttcccaggatttggatgtgcgattggcgctgtgcgagcctcacacttttcttattgagcaccattttgtgtgaggcttacacccaagaacgactcactctttgccgcgtcatcgcggtatgccttgccgaactcgtcgataagcccatggaactcctgcaaatccccaacgctgaggctcgtgctcagcaccacgggcgaataggccttgtggaatgccggatagccggccggcacgtcgaatccgaggaaggcgaacagccgccgcgcgtaggtatcggccacgaatgtgcggcgcgagaacacgtacagcatcagatcgtcggccgtctcgccgccaataccaaataatccaagcaactcggcccgtaattcggcatcggaaatagccgcggcaccctcgggcgcggccccgcaacgctccacataccaccgactcagcgactgtacggtcttggatttgttgacataaaagcctgacggtcgaatcagttcctgcaaacgctccggatccatggccgccaacgcatggggttcgagcacatcctccgctttcaacgccgcaagcgaacgatccacattgctccacgccgtattctgcgtcagcaccgcgcccaccataatctcgaacgtggtctccgccggccaccatccggtcgggccgagtgcgtcagccatggtgcggtacagcgattcgatgcgctccggtacaggccacttgtgtgcctggttggctttcatacgtttcatattctgcattcaggctccgtattagccatccgccattcatttattaggtcgattatgcgttcattaggtcacttgtgatgaacactgccttcaagaatggtttcattccaatgctcattatctcatgctaagcagggcaccgacctaatgaacgcataatcgacctaatgaacgcaacggtaaggaaaaactacagagattcagcgagatatgctcggtccacctggtctggaagtcgaaaatcttgatgacatctaccgcaattcgtgcaggattcgccgcatgaacgggatggtgaccacgaatgtcagcacgtcggacaccgattgggccatttccacgccgagcacgccgaacatcatcggcagaatcagcacgattggcgccaggaacaggccttgcctgcacaaggccaggaacgaggcgatgccggtgcggcccatggtctgggtcatcatattgcccatcatgttgaagccgttgagaatcaccgtgcagcattgaatatgcagcgctgccacgcccaccgccaccacggccgggtcggaacggaagatctcgaccagttgcggcgcgaaaatccacagcagcgctgccaacgccacgagcacgcaggtggtgagccgcacgcagaaccaatatccctctttgactcgcgcgaacaggccggcaccgtagttgtagccgcacaccggctgaaagccttggccgagacccacgatcaccgaattggcgcccaacatgatgcgcatcacgatggccatgccggcgatggccgcgtcgccgaacgggttggcggcgatgttcacgcaagtcacggaaatcgagccggcgccttggcggatcagcgaaggcaggccgccgccagccacttcgcgcatgagcagcacatccggcttgcaattgcgcagggacagtttcatcacgccgaatttgcggctcatcgtggtcagaatcgtaaagctcaccgtctggcagatggcggtggcgaggccggcaccgaaaatccccagaccggccacgaaaatgaacaatggcgcaagcaggaaattcagcaatgcgccggaaaccagcccgatcatgccgaacgtcgattgcccttggtatcgcagcagtccgttgagtgcgaacgaaccgcacacgcagggtgcggcgaccagcaacggcgtcagatattgcacggcgtatggggcaatcgtcgaggtcgagcccagcatgacgacaagtggccgcagggtcagcaacccgattgcggcaatcaccaaaccggagatcaccgcgcccgcaaagcccacggccagtagtcgggaggcgcgatcattgttttgcttgccgagttcgcgactcatcgagttgcccgcgccgttgccgaagaagaagccgagcgcctgcatcacggtcatgacggagaacgcgatgccgatagcaccggactgcgcggtgccgagctgaccaataaagaacgtgtccgtgagactgtaggcggtggtcaccaagttggagatgacggccggcaagcacagtttgagaatcagcggcttgaccggctgcccggtcatctgccgatatttcgcgtccgcgcttgcgcgtctaacgccatgaatctgcaccatggacggctatcctactcgcgcagggtcctatgcgaaggcgcgtgaccgccatacgagtcagcacagataccgcccggtgatgctgttcggattggccgcgatttgttccggcgttccggtggcgacgatgcgtccgccgctttcgccgccgcccggacccatgtcgatgatccagtccgcattggcgatcacgtcaaggtcatgttcgatgaccacgactgttgcgccgctcgccacgagccggtcgaacacgcccagcagcacgcgcacgtcgaacgggtgcagaccgatggtcggctcatcgaacacgaataccgcgtccgattgggccttgcccatttcgctggcgagtttcagccgctgggcttcgccgcccgaaagcgccggagtcggttcgccgagcgtcaagtagccgaggcccaagtcgtgcagggtggtcagacgtgcgtgaaccttcttgaggtcgctggtcacggccagcgcctggtccacgctcattgccatgagttgaggcaggctcagggaaatgttgccgccaccctgacccgtcgcctcactcaatttttccttggcagctttgcgcttatccgggaccttcatcttcgccgctttgcccttagccgctttaaccgcacgccgaatcgcgtcggcttcggacgcatagcgggagcctccacaatccgggcattcgatggtcacgtccggcaggaactgcacatcgagcgagatcgaaccggtgccgtcgcacgtggggcaacgcagtctgccggtgttgtacgagaaatcgccagccttccagccgcccgctttggcgtcgtccgcgcgggcgaaggcgcggcgcaattcgtcgtgaatatcggcataggtggccacagtggaacgcacatttgcgccaatcggcgtggcgtcgatgagattcgcgcgattgatgccctcggctttaagctcgagcacgtgttccggcaaccgctcccccgctgcctgcgctttgagcgcgggaatcagcgattcaagcaccaccgtggtcttgcctgagccggagacgccggtcaccgccacgagccggccgcgcgggatatcaacgtccagcggcttgactgtatgcagctggctggttgtcatgcgtatgtggccaaggctgaacacctgtgattcagccacacgctcacgtatacgcgcgctcacctgatcagataggaacggcgcaatgcgactactgggattcgccgccacctcgccgaccgtgccttgcacgatcacatgcccaccttcggcaccggcgaccagccccatttcaatgagatggtcacacgccttgagcacacgcacgtcatggtccacgaccaccacggaattgccgtccgccaccaagtcatacatcacgccgagcagcccgtccacgttcgagggatgcagaccgatggatggctcgtcgagcacatacagcacgccggtggtgcggttgcgcacggcccgggcgagctgcacacgttggcgttctccggtcgacagtgtggcgccggcgcgatcaagcgccagatagccgagccccagatccagcagtcgtcgggccacgtctaggaacgattcgcagatgttggtggccatcggccgcatgtcggggcgcagggattccggcactccgcgcacccaatccgccgccgcgtccaaggtcatcgcgccggcttcggccaagttcagcccgcgcacgtgcggagcccgggcgacggcgctcagtcgggtgccactgcagtcggcgcacggcccctccttgaggaaccgggccacacgcttcaggcccttctcgtccttggctttggcgagcgcattctccaccgtgtacacggcgttgaagtaggtgaagtcgagttcggcgaaatcgtcgcctttcttcggcttgtagaggatgtgctttttgacggctggcccgttgaatacgatgtcgcgttcttcgggcgtgagctcgctgaacggcacgttggtgcgcacgcccatcgcaccgcacacctgtttcatgaggtcccacatgagcgagccccatggcagcacagcgccgtcgtcgatgcgtttcgactcgtccgggaccagggccgcgcggtttacttcgcgcacgatgccgttgccggagcaggtcgggcaggcgccggccgagttgaaggcgagcgattcagcaccgggcgcatggaattccttgccacagctgacgcaagtaatgggcagtccggccgccacgttcagcgtgggctcgttgcgcgccccgcaatgcgagcacacgtgcgaggcgacgcgggagaacaggagtcgcaggctgttgagcaattcggtcatcgtgccgaacgtcgagcggatgccgggcaccgtgggccgctggtgcagagccagcgcggccggcacgtgcagcacttcgtccacctgggcgcggctggcctgggtcagtcgacggcgcgtgtacgtggacagcgcttccaagtagcgccgcgaaccttccgcatacagcacgccgagcgccagagagcttttgcccgaaccggagacgccggccacgcccaccagttcacacagcggaatgtcaatgtcgatgttcttgaggttatgcacgcgcgcaccgcgcacctcaatcgcctgcggccgttgattgttggtcatgctcggcactgctccgccgccgcgctatctgacctctgttcaagtgtcacgccgtcacctctttctcgacttcgcccttggctgccgccgcctgagcttcatggtctccagtatcatcacggccaacgacggcggccgaacgccggacgagaatctttcgtcttgggcaccgtccgccacctgcaattcgaactagctgaaccagcgtgacgatattgtcggctatcgatctgccgtgatcgtaatggacatcgtcgtccggaagcacgtcaccggttccgagaggagtcggcggcgcgctttcataagggcacacaatcccaagatcacacccacagatcaataccgatcaatactcgtacgtgatcgcggggtcgccgatggtcggcgtctgatccagtttgaggttggccgagccggccgcggtggtcacgtcgtattcgatggtcaccgtgtcctgaggcgccagggagatgtcgtccatgtaggtcatatggtccttggcctgcacctgtgcgaaggaactgccgttcgacgccgacacgttgctgacctcgcctccggccggcgtgtagatgaccacgcggttcaccgccacgcctcccttggcgttcgccgtgatgtattctggcagggatccggcctcgcccggctgcagggtgttggtgaacgaatacgtaacgtggtaggtgttgtcgccggtcctcttcaccgtcgacttgcgctggatgtaccagtccatcttcgaggcctgcatctcgttgaagtagacgccggtcaccgggttcttcgcgtcgttggtgatctcgccggtgacgccggcgctgcgcagcaccgcctgatcctcctcgtggaacgaccagaagtacaggtgccgctgctcggccatccggagcatcgtcttggcgacggtcatgagcttctgcgtgttcatgtcgctgaacaggtgggcgaccgcctgggcggcggtctcgctgaagtaccggtcctgagcggagggcgtcagttccttgtaggcgccgttgagcaggaattcggcggtgttcgacccgttgagcacgcgcccgtcggacagggtcacgtcgccggtggcgccgatcatcgcctgcagcgcgacggggtcgagcgacatcacgccgtcggacgatccgccgaacggagccgcctgccagaacttctgggccatggacgcgacgcgcgggaagtccggcgtagacgaaagattatggatgacttgaccgaagtacagtccgctgtacagcgtgccgtcaccgtcctggttgacgtcatccaacgcggcgttggaggggaactcggcatccgcgtggaactcccccaccgcgatcttgccgttgtccgcgctgaaggaaccggccgaaccgatcaggccgccggttccgcggatctcggaattcgtctgggccagcagcacgtagttgcgggcgccgttcgcaccgaggaagttcggcagcatgttgagcatgccgctcaggttttcggtcacctgcgccagggcggccatctgcgtcttgccgttctgcagcgcgttgttcaccacgccgagtttggcgtcgggaagatcctggatcgtcctggcctgcgattgcacggactggtcgaccgtggcaagctgctgcgccgcggcgatgatcggctccatgttgagctgcccatcgccactggagaggctggcaccggtcagtgtggtgacgaccttgcccagctggggcagcgtggtctgcgcgaagtcctcgatggtaccgatggcggtgcgcgccgtcttcacgtcaccaccgaccacgggcatcttctccgccagcgtccacagaccgccgctgacatcctgcttggcggcggccgcctccttctggatgtagctcacgtcggacagcgccttgaccatgtcgtcggtggaaccgtccttgatgaccttggccgcgttgacgacattgttgaggtgcgctttggcgctcatcgccgacttgtacagtttgaatccgctgaagccggccgccgcggcgcacacgaccagcaacagcagcacgacgagcagcgcgttgcgaacgcgatgggttgtcctggtgaccgtgcgtgcgtgtgatggcatgggctacttccttacgttatgacatgtatcgatactggctggctgaccgtttacgctttcgctggacgggtagcccggcggacggcacgtagcagtgcacgacgtgcacatcgcgtatgatgccgggggttgtcagcgcggctgactggggtggccgcggaccggtacctggacttgcagctgccctccggcgatgcatgtcacctgcagcggggaacgtccgctgcagttacggctattaccggccagccgacagcaatcgctggtttagttgttggtcttttccggctggtcacccgttcccatgagctggcatgcacctttcagcgagtatctctcctaccgcatgccagtctacccatgtccgcgggataacccaaaaagccttgcaagaataccgaatttctttacctttggccctgatcgttcgacggctcgcaagacggcgtaacctcatccaaccggccgatccctggaggcggaaccagacgtcgatctgatatccacggccttcgacaccggctattggaacgacacctgcaacaccctcgccctcgattccgagccactatgcgtggccgtgccacgcaatcacgcactggcgagacatgcactactcacattgaaagacctcgaaggcacacgcatccgcatcctcaaacgccatcgcggcgccaacgacacggcccgggacctgctggaacaatatccggccatcgatctgatcgacatcgaccattacgacctcgacacgttcaacgactgcgccgaatccggcgacctgctcatctccaaaccgatgtgggccggcattcacccgcagctcgtcaacgtggccgtggactggcccgaaccggtcgtcatgcactacggactgctctacccgctcgacgccaccccggtgattcgcgcgttcatctcccgcatcgccgcattatcctgcctcgtcaatggcccgccacgtcaagccgacatgatgtgagactgtagcccaagctcatacgagccggcccgcacggaggcgaaatgttcagaccggctcattgcctgtgcacccatacgtcgattacgttattcccactgttgcagctgatccagcgtaacgatgttgtcggctatcgattggccgtgatcgtaatggacatcgtcgtccggcgttatctcccgaacgatcttcgccgggcttcccatggcgatgacgttcgccggaacgtccttcgtgacgatggagcccgcgccgatgatcgcattgtccccgatatgcgccccggcagaacagtgacgttggacgcgatccacacgttgcggcccaaatggacgtgatgcccgccccacatcgcgtgatacggtgcctggatatacgcaccatcgtcgacttccgcaaacaggctgcgcaatattatttgctttgccgtctccgcttccggggaatagccgagccggttgtactcctctatctgctggagatactcccggtaatgcgggtcccgctcggtgaattccatcaccttatacagcttccccgaattcatggcctccttgtacgccgtcatcgccatagtgcctgcctcgctgcttatcgctctttccacacagctcactcaggccaagaagtaaccctctccatagcaaccagtgaggccaccattcaacgcgaacggtggccccatttattataggcgtcttatagagactgaaaaaaaggaagtatgccgataagacaagtcgaaaccggaacgcccggtcagtagccggactgcttggcagctggtgcgatggaccacacgaagtagccgcgcaaatccacgccgtcctcgatagccttgagtgcggcctcgaagtgccgcttcaggtagtcgatgcgcttggggtcgtgcacggccttggtgccatccgcctcggtgacgacccggtcgccgccctcgaccgcgatgccgttttcggtgaccatcagcggaatctctggataatcgttatgcacgcgcatcagcaggtcatataggcccttcggatcgatgttccagcccatgtcggtgtgctcgccgggcgtcggcagccagtcgacgtcgctggcaccaggcgcggtgctcgggcccgtggactgcgggaactgcgggcgtccgctcatcgtgaccaagccggaggaatagtagttgatgccgagcacgtccagcggctgatggatctgttcgaggtcgccgtccttgacgaactcccaatcgcagatgcccttggtgatggcgaacagctcgttcgggtagtagccgcgcagcatcgggtcgagccacacgcggttgccgatcaggtcgagacggtgcacggcgtcggcgtcgccacggttgaactgcaggttcagcgtgaccgacagctgcgacctgtcgccgacctcgctacgcaccgcctgggccatcagaccatgagccagattcagatgatgcacggccgggaaggcaccgggaccaaggcccagaccgggtgcgtgctcggtggcgccgtagctcaggtaggaggagcaccacggctcgttcaacgtggtgtaggtttcgacgcggtcgcccagacggtgagccacgatgcgcgcatagtcggccagtttgtaggcggtgtcgcggttgagccaaccgttcccatcgccgaggtactgcggcagatcccagtggtagagcgtgaccgtgggcttgatgcccttgtcgagcaacgcgtcgaccacgcgctcgtagtagtcaaggccctcctcgttgaccgggccgtcctcggtcggcatcacacgcggcatggccacagacagacggtaggagtccacgcccagatcggcgagcaaatcgatgtccttctgccacaaatggtaggaatcacaggccacatcaccggtatcgccgttcacggttttgccgggcgtgtgggagaacgtgtcccaaatcgatggcgcgcggccgccctcggtggcgccgccttcgatctgatacgaggccgtggccgtaccaaactggaatccttcgggaaatgtcatggtcatattgctcctttgtctggccatcatcggtgtggaggattaccctccacagcgagggaatatgggttatacgtcgggctctcaccgtgtccgcgatacgcgggtcttgcatatctcggatcgttgggcaatagtgtaccatgaaatctgaagcggttaagtcgctgtgttgtgtacggttctggaaccatgtcgaggagaacggactcgttctcttcccacgccaacgcctgccagacggcacctttccgctaagacccgcaccaagcaaggaagtagcatgcagcagatcactcccaacaaccccgtgattaggaccatgggccgcatcgatatcgacgtcccggaccgcccggtatgggtgttcccctacacgcaggccacgttccgctgcaccggcacttcggtgggtgtccgactgatcaatcgccataactatggcgacagcacgctcggcgcggtgatcgatggcgtgccttatcgggcgcgcatcaccgagaatgacgcagaaaccaccgtgatgctcgccgagcatctgccggacatcgaacatgaggtggtggtctataagcgtcaggatggcgagcactatctggagattaccggctttctcattgacgatcaggcccgggtgttgccgccggccatacctgctcccatccggcgcatcgaggtatacggcgactccgtatcgtgcggcgaacgcaacgaagccgcgctgtacaccggcaaggccgatccggatacggatctgagcccctacagcaattcgtggtattcctatgcggccatcaccgcgcgcaatctcggagcgtcagcgaacatcgtggcccaaggcggcgcttcgctgctggacggcatcggctggttctgcggaccggattacgtgggtatggaaagcatctgggaccgcatcgaatacaacccgttcctcggcgagaccaagccatgggatttctcacgctacaccccgcaggtcgttgttgtggcgctcggacagaacgacgcgcatccagtcgatttcatggcagcggactatcagggcgagcagtcggtccaatggcgggcgcgatacgtcgatttcctgcgaacgttacgaggcaagtatctccaagccaccatcatctgcgccaccaccgtactgcagcatgacgccagttgggatcaggcaattgatgacgccgtgcgtgttgtctcaaccggtgaccgcaacaacggcatcgccccggatccgaaggtgcaccacttcctgtattcgcgcaacggttcagccacgcccggccacccgcgcatcaccgaacatcaggagatggcggacgagctcaccaccttcatcgaatccctcggccctgcgatttgggactgaccaccgtaggcaacccatcgggacccgccgcttaccatcaaaagagaggaactcacatgagcgcatcaccacagacggccaccggcccagcacccggcgccaacgccagcggcgtggacgaaagcgcagccgaagccgcacggaacaagccaatcggcaccgccgagtttcggccttccgccatcttctcccatgacatggtgctacaacgcggcaagccaatcgtattgttcggcaccggcacgcctggacggcccgtcgtgaccgtgctgagcacggcagatggcagcgcactgattcgccgtcaatcatcgcactccatcacggacagtgtcagcaccatcggatcgatcaccccggacggcacctggatggttacgctaccgccactggaagccggtggaccgtacacgctgaccatctccgaccgcaccagcgtaacgcttaagtactttaacgtcatggtcggcgaagtatggattgccagcgggcaaagcaacatcgaattcgaactgcacaacgaccgtgatgcggattcggccatcgccgcatccgatgatccgctgctgcgcttcttcaatgtgcccaagttcggcgtggtggacagcgaacttatcgcggccgagaaccagtcggcctggcgaccctgctcccccgattcctgcagcacgatgtccgcaatcgcctattatttcgcacgcaaactacggcgggacctgggacccgacgtaccggtcggtatcgtcgattgctatatcggcggtacgtcgatcacctcgtggatgagcgagcacatgctcaccgccaccgaggccgggcgcggctatcttgaccgctaccatcagcaaatcgacggcaaaaccgatcagcagttccacgacgaaaccgactcctggcaacgcacctttaatgcgtggaatgagcagatcgccgccgcacaggctgcagaaccggacatcacgtgggatgtgctcgacgcccggtacggcgagtgcccgtggccgccgcccgtcaccccgttctcccaatatcacgtcaccggcgcattcaacgcgatggtgcgccggttggccccgttctccacgcgcggcgtgctgtggtatcaaggcgaagaggacgagcagcggtacgcctcgtatcgcgaactgctgggttgcatgatcggtgaatggcgggcgttgtggagccggcgcgcaggcggcgatttcagtgatagctacaatgtgggacggatcgtcgccgatgatgccgcgcgcggccacggtgccgaaccaatcgccgacacgcctaccgcaacggtcggaaacgaggcggaactgccgttcatcatcgtgcaattgccacgttggatcgatcagaaggaatacaacagtgacattgatcgcatgttctggcctcatattcgcgaagcacaagccgatgcagcacgtatcattcccgacgtgtatctggcggtcacgttcgacaccggcgagttcaacaacatccatccgaccgacaaacgtccggttggcgagcgcatcgcgttgcaagccgaagcccatgtctacgggcttcccgtccgcgccgatggtcccgtattcgtttcgttggcatccgctggcgaaacggccgatgagctgcaggtgcgctttggcaacgccgacggcctgcatttcggaccgtggtctgggagcgacgacgccgggcacctatcggcagttcactcgtctggatccggggaaacagaacccttgtggaccgtgaatcgatgcgacgcggcggcttccggcttcgaaatcgctggatcggacggcatctatcaccgtgcggacgcacggatcgaggccgataccgtggtgcttcatgccaacgcggtatcgcatccgatctgcgcacgttacggctggttcagttggggcccggcaccgctgttcaacgccttcggcctgcctgcggccccattccggattcgcaagtaacttcgctgatggcgccttactgcgctgctggcaagcgcacgatgatggtggcgccttggcctttggtgctggtcacgtcgatgaatcctcggctcaggtccacggcgcgcttgaccatcgccatgccgaggccgttgccttgtgcggcgtgcgaggtatcgccctgatagaacttgtcgaacatgtgggcggcttcgtccggggtcatgtcgcagccgtcatcgctgatctccaccgacaccatattgccgtgcgagcgctgtgtgaagctcacatggccgcctgattcggtgtatttgagcgcgttgccgaggatattgctccagatgagcgtggtgatgccaaggtcggcgtgcaccatcgcacggtcttccaggtcgcagcccaaatcgatgttcttttcggtgaacaggtcgtcgagcgtgaggatctcgtcggtcagctgacgggtcaggtcgtagtcgacggcctgggagacgatggtctggctttcgagtttgttgagtttgaggatgttggtcacgagcgcgttgagtcgttcggacgcggagatgatggtccgtacgcattcctcgcgctgggccttgtccatatccatgtcacgcatcatggtcgcgtaattcttgatggcggccagaggattgcggatttcgtggctcacattggagacgaagtcgtttttcatggtttcgatgccgcccagttcctcgaccatggtattgaaatcggcgaacatctgatcagtcgaattccgaaggggatgcggacggaaagttggacgcttgggcgtccggattggagtccgcatgttttcgatggaggatcggcgcagggccgttgacctgtatttcacggagggcatgaccatcaggaaggtcattgccgagcttggttacccgtccgagggcgcgctggtgaaatgggttcgcgaggacccgcgttacacgggcgcgtgcaggcgttcgtatacgctggaatgcaagacgaatgcggccagacgcgcgctcgagggcgagcccctcgcccgcgtggcgcgcgacgcgggttgcacgccgacgagcgtgtaccagtggatgcgccgctaccggagcgaggggatactgggactgatggacaggagaaacgcgccgatgccggccgaaccgatgcccgcggccggcgatgacgtggaggagctgcgccggcaggtggaggtcctgcggctggagaacgcggtgatgcgggagacgatcgatgttttaaaagccgacgacccgcgcctcgacccgtccatgctgacgaacagggagaggacgcgggtcgtcgacgcgatcaggggtgaattcggcctggcggcctgtctgaaggccgtggggctgaaacgcagcacctactattacgagcgcggcgcgatcgccgcgggcgacaggtacgccgtgctgcgggcccgcgtcgccggcctgttcgagcagggtgggcgcgcatggggataccggaccatccaccgcatgctgcgccttgacgagtccgacccgatcgtcgtctcggagaaggtcgtcaggcggatcatgcgcgagggggccatgcggcccgtgtacctgaagcggccgaagcggtggagctcctacgccggcgagatcggcgaggccccggcgaacctcgtggagcgggacttccacgccgacgcgccgaacatgctgtgggtcacggacgtcacccagttcaccatggacgggtacaagtgctggctttccccggtggtcgactgcttcgacgggatggtggtctcctggaccttgtcgcgctccccgaacgccgacatggcgaaccggatgctccttgacgcggtcgccacgctcagggacggggaacatccaatcatccattccgaccgcggctgccactaccggtgggacgaatggatccgcatctgcgaggagcacgggctgatccggtcgatgagcgccaagggatgcagcccggacaacgcggccgccgaggggttcttcggcaggctcaagaacgagttattctacgggcgggactggaggggcgtgggctacgaggagttccgcgaacgcctggccgcctacctgacccactacaatgaaaccaggatcaagaagtcactggactggatgagccccgtgcaataccgcagaagtcttggactggccgcctgaccgtccaaaaaaacatccgcacccccgaacgcccgaatttttgcgcactttagtccggccttgaaatagaagcatggctcgtgtcccgccaacaccaagccgacggaactcatcaacatgggtttcaaccgcgcactcggcacaatccatcttctcgcgtcacagacagtgggccatatacagcggcagcttgatgcgttctccatccacttcgagttggcggggatgcagaacgtattccttgcccaatcgttgggcataccttttgcggaatttgtcgagcgaagatacgccgtatcgtttcgtggatttcacttcaatcgggctgatgcgaggcttcatcgcggcattatcgtattcccgaacgatgaggaagtctatttccatggttttcgtggcatccgttctatccgagcgcgagaagaaatacagtttgcgcccattcgcccggaattgctgagccaccgcattctccaccagcatcccttcgttgagcgagagtttatcgaacagaatatcccggtacacatcatccggcgttgtctctcgatcggcaaacgcctgcgacaccagcaaaccggtatccgccatatagcatttgaatgaatcgttatcttcgtacaatcccagtcccaccaaagggtcagtcgaattacggcacaggttcaccaagcgggcgtcttccaaccagaagaacgccgaatcgtattcacgagatcgagcacccttgtcgaccgatgccagagtgaatcgtttctcatgcttggacagctgccctggaatctgagcgaaaatgccccgcacacggccggcatcgccattggcgaacttgccgatatcatcactgtacagctgcaggatgccacgcttgatcaaatccacctcgccaaaatcgcgctgctcgacataatcggcaaccacctgcggcataccgcccaccagcagatattcgcgccacagcctcatcccccgtttatgcagagcatcgggcaatgggaccagacgctcgaacgatttacgaatcgtttcagcaagcagctcctcccccatagcccagcagaactcctcaaaatcgagcggccccatatccattttccgttcctcggagggaatgacgatattcgccacattcctcttgatggagatcagcgaaccagtttccacatagtcatatcggccatccgcaaccagatatttgacgagctccctcgccgccggataccgctgtacctcgtcgaaaataatcaacgattcacgctcatacagtcttgtgcggtaatacgcagacaacagcatgaaaaatgtgtcaaagtcatcacgctggttttcgaagatgtcgcgaacgtcgcgcggcaaacgcgcgaaatcgatgagaatatatgacttgtactgagtgcggccgaattcctcgacaatggtacttttgcccacgcggcgagcgccttcgatgagaagcgactcacgcccacccgctttttgtttccatgcgatcagcttatccagcatcttgcgcttcaacatgagcaatcacctcattacacgaaaacaacagtatggacatatgctattttacacgaaaacagaagtatagaggtagccgattctacacgaaaacaacggtataaggacgcaagccgaatcggctcacccccaatcccccccccatcacaccggaggcctgtttgattgtgcgattttgtgcgaatggctcacacggttcttggtgagaaccgttcgctgcgtacctgaccctagaaccggatcagcgccttgatgactttgcgaaagaagttcggcattccgttccgaattgtttgacgattagatcagccgatgtgttattccactgtgatacggtgtcgatcaccggcaatcttcggattggcacggagattcctgcagagctgattcctatagtcatagattcctcttttcttactattcgacgcttttcagcgcggacgagagatcgatgttggcgattcgtttcgcgatgacgagttcgataatcagcatgttgcataacacgaacagggccgacaacgcgatgtatggtgtgggaagatatgcgaaaaattgcgcgtccttggaatcggcgacggacacatatgcgttcaggaagcctatgcccagggggatgccgagggttgtgcccagaatccaagtgacgaagctgtctttgagcatgatggaccggatttccttgatgtggaagccgagcactcgcatggttgcgtattcccggtatcgttcggtgtagttcagtgtgccgatgctgtacaggatgaaccattccagcagtaccgcgaaaaccatcagcaatgtcaggatgctttggaaggtgtccagcactttgttggcctgcgccttgtcccatgcgagggagtccacccgctgcaccgccggatggttatcaacggaactgggcacgcggccattgaccatgatgctggtggggtggaacgtttcgccgaggttcttccaatatgctgaactgaggtatatgccttgcgggctgctgacgcgcacgatgtcgataacggtcatgatgaccggttctgacatgctggccgagtcgacgctaatagtgtcgccactggtgactccgagagctttcgacagtccttcagaaatgtacgcaccatcggtttgcgtagtgattggcatagattcgcgcttgtcgtcacgtgccgtgaggaatatgccgggtgtggcgatggacatgacggatgactgttcgtgatgcgccgttgtaacagtgatgggcagttgttcgaggctttgcgcgttatccggcaagccgctcatgattgtgtcgtaatctgtgtcggtatatccgttggcaagctggatttgccgaccgtagcggaatacgtcgccatatgtcatatcgttggtggcggtgagcgagagacgcacaccgaagcttgccatcaccagaacggtcgcgccgataatcgccacgacggagatgccttctttgaccatggaacgtgatttatcccgcatgatccagtgccattgccagtgttgttggctgtcgcggcgcgggttgcgcggtgttgatcgcatggtgccgacgccgcgcatggtgttcgtgtctaggatcatggcgggcgtcaggcgggtgatgcggaatgctggaatgatggaggcgatgctgctgacgatgatgatgcctagcatcatgagccagctggcgttgtcgatgcggacctgccaatggggaagattgaacaggaaccgttgtttgtccagaaacagccgtcccagaagcgcgggtccgaggaacaggccgaggagggcgctgggaagcgttgcgataatcgcatatatctgatatccgaagatcagggcgctgcgagatatgcccagcgctctcatcagtcccaatgagctgcgctggctgttgaccagtcggctgatagtggtgatggtggtcagcgtcaccaatacaatcatcaacgtggagaacatgtacgacatgcgatacatgctcgcggttttggcttggaacttcgaaatctcggttctggcgtcgcggccttgcacgctgacggctgcgttgcctagcgtgtctcgaacggaacgggcgatgcagccggtatcgcagccaggttcggctttgaccgctatgctgttgatgcggtccaaagtcacgggcagcgatgcacgattagtgtatgcgtacccgtagtggtcgtgattcgccaccatgtcgttcattgggctggtgtagccgatgtactccggactggcgatgaggccccgtacagtcaatgcgatcggggacttgtttacattgatggtgactgtatccccggtgctgatgtgattggcgtcggcgaagttcttgtcaatccagatggagttctttttcttagtgtcgaattgttcgccgtcattgacgagtgggcgggacacttcgttggagtctttgaggttgacggtgagcagcttgttcgctccgctacgtttcatcgaggcggtgacgatcagcgatccgtcggcatgcgacacgtgcttggcattgttgacttcatcggtgagcgtcgcacctgcggatcgcacgctcacccacgcatcggccaagttggtttgcatagaccatcgttcgaattcgtagctcatgccgtgggccgcagacaacagtcctgagaaaacgaatagggtaaggaacacgagcactgctatggcgcttagggacattgcgttggttctgcaatccctcagtattttcttgagcatagaagacgcctaccactggatttgggtaatggattccggattgttgtttcgctgcacggattcggttttgccgtctttgatggtgacgaccacatcggcgattcgcacaatcgatgaattatgcgttaccacaatcacggttttgcggtattggcgagacatccgcatcagaagttttaggaccgactgtccggttttggaatccaacgcgcctgtaggttcgtcgcacagcagcagctgcgggttcttgcacagggctcgcgcaatggccacacgttggagctggccgccggacaattcttgtgggaaggcatggattttctcgccgagaccaacgtcggagaggacggcttgcggatcgaaattctttccgccgaagcgtgcgaccatttccacattttctagaatggtgaggttggggatgatgttatagaattggaacacaaagccgatggagttgcggcgatactgtgtcaaggcgcgttccctcatgtcggatatatcagtgccatcgactgtgatggaacctgatgtgggtgagtccatgccgcccaacatgttgagcagcgtggactttcccgcgccgctctgcccaaggaccacacagaaatcaccctcgtcgagggagaagctgacatgatccaaggccatagtctgcacgtcattgctgttgtattgtttagtcagattgatgacgtcaatgaacgacatggtgtttctccttgcataagctttaggatcccgactagcagtcgcttgatggactggaaggtcggcgtatccggtatggtgtcgggattcgcaaatttctcacgcagtatgccgttgagcccgtatacgatgaagcatgacagctcatgcacatccaccgcggcctcacgcgacgcgacgcctttcctttccagcaattcgttaatgatgtgttccgccataggaatctcttccgtcatcatggtcatgctgatggtatctagaatctgcttgttatcaccatggtccagaagattgcgatacctgttgaagtcgcattccactgattcgatgagacggtcaatcttccgttcgggatcgagtgtttcgtcgcgtacgatgctccatcgctggtctaactgctgcttgacgatgtgctgcatggccgcttcgtagatatcctgctttgacgcgaaatagtaatagaacaggccggggcccgacgcgtcagcctcctgaatgatgctccggacggacaggccttcataccctttctccaaaagcatgcgtgaagctatgtcaatcatctgctctttgcgtttgtcgtacttaagcatccaagctccctgtcccgcacattaattgaacgatgttcaaaaacactactacggcaccacagtcacgtcaacgcattggctttatttcacgcccttctctccgctgtcagcgtaaatagagatggaaatcggcgaccgctgcacaagccgagaggtgatccagcaaccaccgattatcttccgcgcattcatcgcaacagttcccgacagtgggcgcacgagcaagagacacgctacgagccaccccctctaggccgctccgcgtgccagcgtcctgtaacgacgaacggctcgacgtccaacattcccattacgcgactgccgtctcaccttcgcctacaaacagtccactggactgactgcttcacggctcaatcgtctgaggagacagctcgcccattatggacaatgaatcaacgtcctctggctttcgttcatgtccgtggccgttatccacaggccgtcctacgtaagcccgtagcgttcgcgcagcatgtcgaacgcgtgcaggccctcgcgcatcgctgcccggtattcgtcgtcgtccgccgcgctgttgaggttggcggcgatggcgaacgcttcggatacgaggcgttccatgtcgtgcgtggacagattctccgggtgtctttctcgtccgtcatcgaggaagggcgggtggttctccatcgcggcgcgccattcctggacggcgaggctgcggcgcgggacatggggatcgcggtcgcctacctgcccggcacggccatgcgcaggaccgcacagctgttgcccggggacgcgaagaccgaccgcagggacgcgcatgtgatcgcgtgggccgcgctcaaactgcccgagacgctcagggacgcgggaagcgacgacgagaccctcgccgcactgagaatgctcgccggccacgacgaggacctcgcccacgaatccacgcgccacgtcaaccgcctgcggagcctgctcctgcagacccaccccacgttcgaacgcgtcctgaaaggggaacgcgccacccgcgacgcgacgctcgcgctgctcgaacggtacggcggccccgcgggcatggaacgggtcgggatcgaggacgtgaaggactgggccgggtccaacgggcttcgcgccggccgcatcatcgacgacatgttcaaggccatcggcgagcagaccgtcaccgtgcccggcaccggcatggccgagaccatcatcccctccatcgcccgcgacatcaaggccatcaaggaccggcggcgcgaggtcgggcgccaggtcgagaagctcctggaggaccaccctcttctcacggtcccggcgtcgatgcccgggataggcgtcaggaccgcaagtaacatcctgctcggcatcggcggcgacatcgccaacttcaaaagcgcggcccacctggccgcctacgccggcatcgcaccggtcaccggccagtccggcaccagcatcaagggcgagagaccggcaaggggcggcaacaaacgactcaagaacgcgctatggcagtcctcgttcgtcgtcagcaccaaacacccgccctccatcgcctattacaaacgcaaacgcgaacaaggcaaacaccacaacgccgccgtcatctgcctcgcccgacgccgatgcgacgtgatctacagcatgctcaagaacggcgccctctaccagggaccagccctcgccgcctgaaccgggccacacgggaaaagacgccggacgccaccggcagggcgaagcacgcccacgacaaccaaccggaaaccaaaacgccagccctacagagttgacaaaaacataggaacacccccatcacaccgtcggcctgtttgattgtgcgattttgtgcgaatggctcacacggttcttggtgagaaccgttcgctgcgtacctaaccctagaaccggatcagcgccttgatgaccttgcgctggtccatcgcctcgtaggcgtcttggatatggtcgaggtcgtattcgtcggtgaacacgcggccggggttgatttcgcccttgagcaccgcgtcgagcagtccgcagtcaaggtcgtagtggcgcacgggggccgggccgcccttgatgccgatgttgccgtagaacgtgccttcggcgctgatctccacgtcatgcggcaggcccacacggccgatcacgccaccgcggcgaatcaggccaatcgccgtgtcgaaggactgcttggagcccacgcattcgagaactgcgtcggcaccgtaaccgccggtcattcctagcaccttgtcaatagcttcttggccgcgctcgggcacgatatcagtcgcaccaaattcgcgggcgagcgccgcgcgatcctcgtgacggctcatggcgatgatgcgtttcgcaccgagcatcttagcggcaatcacaccgcacaggccgactgcaccatcgcccatgaccacggcggtgtcaccgggcttgacctcggcagaagccgccgcgtgataaccggtggacatcacatcggaaatggtcagcagcgatgcgagctgctcatcggaataatcttccggtgaaccgggcaccttgaccacggtgccgtccgcctcgggcacacgcaggtattcagcctgacaagcggagaagtagccgccgtgcgggcacacggattcgaagccggccttgcataccgggcacttgccgcagctgtacgggaatggcacgaccacgaaatcacctggcttaacggattcgaccgccgcgccaacctcttcgaccacaccgatggactcgtgacccacctggctgtgcgcggcctgtccgctcagcccacggaagaaccacaaatcagagccacacacgcacgtgcgcaccacgcggatcacgatgtcatcatcctgttcacgcgtcgccttcggcacttcttccacggccatcttgccaggctccacgaaaatcgcggctttcatcatttcggtcatgtccatcactcctttgttgggaatatctgtctattgtcgtttattgtttgacgtcggtttgcaggcgcttcacctgttcgatgatgttccggttttcttcgatgagctgctgcgcctcctcgtcgcgcccctcagccttagcccgccagtacagtgtcttgaacgatacgtacgcctgctgcattcgaatggattcggctttggcagcgagacgcagggcctaggcgcgatgccccgaactcgggtcgcgagtgatgggagcgataatgccgatctgctcgtagtagcgcagcgtggactccggaagcccggaaatcatcgacgcctcgcgaatcgtatgccatgcggtcgttgtgctcatatcgacaactctaaaaacctcaagtacttgaagtaaaacggcgacacgcccatggatgtcttctgcacgagtaggctgggattcggcgatgggacccgcctgaacttgtttcgaaccgcacactgctgatagttcctacacacgatttgacattgcatgaaatcgttgtgtcttcagcaggattcagcggtttcaggaaaggctactatgggttcgcaatccccatccgcaggtgcccggccgattacgcacacgaccactcccccggcgcgcaagctccccgatattcatcttgatattgtgttggtcgtcttctgcggcggcactattggcaccgcgattcgctatgcgttcgcgcagattcccgcggctggcagcttccacaccggcacgtttgtggccaacatgctggcttgcttctgctatgcagggctgaccgcttacttggccggcgcttcccggttcggtgcacgttccaaagaacttgccagtcgcggactcggcatgggcgtatgcggtggtttgtctacgatgtcgacgttggcattggaaggcttcaccgcgattcgcgacggtcaggtggcggccggcattgcctatctactggtgacgttcgcgctgggtctggtttgtgcgtctgccggcgtgtgggcaggaacgcatctggccggctcctcgaacgcatccgccgaagcgtccgctgatacgaatgccgctacgaccagcaagggaggtaaggcgtgatgaccgtattcctaccaatcttggtctgcctgtgcggcggcgtaggcgcctcctgccgctatctgcttgacgcgaccatcaaaacgtattggcaacgcgcattcccgctgtccacattcaccatcaatctcatcgccggattcctgaccggtctggttgcggcgctggcactgggcgggacacttgatgaaccgtggcggctggtgctggccaccggtttcctcggcggattctccacgttctcgaccgcgatcaacgaaatggtgacgctcttccacaaacgccgctaccccacggcaacggcctatctggtgctgtcgctgggtgtgccggtcgttgctgcggcctgcggttttctcgtctgaccgccacgacgattcccgacgcggtcagcggtatcattgcgaggtcgaacgtcacaggtacatccgggaggtatatgggcatggcgaacaatggagcggatgtgaagcacaatcagggcgcggacgtcacgaatgcctcggccacaacgaacactgcggaaaataccgtgggcacggcaaccccgaagcaaaatggactagccgtgttgggcaagtatatgggtgtttccgccacgcagaccattgtggagtatgcgacgttcgccatcctgcacttgatcggcgtgccctcgcagatctccaacggtatcgccgtggtgtgttcggcgacctacaacttcgtgatgaaccgcaacgtgacgttcaaatcgtcaagcaacttcacccgctccgtggcgctgttcgtgctgctatgggactggttcgctgtggcgttcgtaatcatggtggtaatcgccttcgccatcatcggcatgcaacgtgcgatgtcctcaacgactaggcagaacactcatggcaatcatcacgacaacatcctcagtcaacgcggataccatcgcgccgactgattgcaccgacatatcacgacaacgaataggaggcatatgactcattcatatgccgcttattcgtatttcagagcacttatcagatcagaagaacagcaccgcgacgcctgccgcgaagcacatgagcaggatcgaggtcaggaagctggcgagcatgggcttcttgcctttggaagcgatggccttgaagttcacattgatgccaagcgcggccatggccataccgagtactatgtacgcgaagtccacaagctgcggggtgatgaaggcgatgaacggcacgaaagtgccgatgatcgaagcgccgataaagccgagcatgaaccacgggaaggccacggtcttcttgccggtgttctccacctcagagtgcttcttctcccaccagatagcgataatgatggcggcgaacacgagcatgagcacgcgggagagcttcatgatggtggcgatgtccaccgcgccgaaagcgtcgccggcggcgaccgcatgggcgatttcgtgcagggaagcaccggcggtgatgcccagctggtccttggtcatgccggtcagcgggccgagcgcgatctccagcaacgcgaacacagtacccataatggctacgatggccacggccatggtcacgtcgttgtccttctcgtcctgcttgtcctcagacaccttgatggaaccggccagacccatgacggcggccgcaccgcagatgccggtgccaccggcggtcaggatggcgagcatcgggtcgacaccgagcttgcgggcgatggcatagcacacgatgatggtcagcgtgacgaccacagcggcgatcggcagacacttgatgccctgcgtgaacagcacggcgaggttgagcttgaaaccgagcaggatgatgccgaggcgcagcaacttgttggaaatcaagccagcggcgtccttgacgcctgccttgcggccatcattggaaccgacgtaggcactgcggatcgggaactggatgatcataccgatgagcagcgcgatgataagcgcgccgaacaggctgaatccggggaactgcttgagccaggaggcgaacagcgaagccagcagagtcagaacgccaatgaacaacatgtcaacggcggcaatgcgcttccaccattttgtacagaactctctcatggtgtctattgaatctcaagcgtttacatcggtcaaatcattgctaccaatacatatcatcgattttgccgataccacattttggctcccctctgacgggagacaaggcactgactatccgcgcaacacagcgataatcgcttccaccagctctcgctgatcgtgcgtcaggccggatctcggcaccaaggcatagaaacggcgcacgaattcgtctccgagctttcgcgccggcactccagaaggcactgcggcttccgaaatcagcgactacccaaagccggaagacaacgccgccgcaatcgcggcattgctggacacctccattgtgcgaggcggcaaaccctgcatagtcttgaaatacaaatccgtgtaataccgcacaccggaaccgtgctcgcgcaccatccatacgccgtctggttctcccgccaagaccagccggtcctcgcacagggtgacacgatccaccgaatcattgacgatcggcttttccaccacgcccaaatgcacggctttcatgcttgcctggccaagaatggcgtccgagttcatcacctgcacggcaaaatcgaacccatccatgttccgggccatgaccggcaatgacttgggaagcaatattgcggcggtcgtatgcgagaacgagaccgccaatggctctcgatcctcctgcacgcgggcaatctgctcgcgcgtatcacgccataatccatcaataccaatggcagtctgatacagcatccgcccggcctgccatcagtgtcataccgggcaacaaccctcgcagtgcagcagtccgtttatctattggaaagcaacactagcgcatccaggccggaagtcgtggtacatatccatacctgctgcggttataggaaatcccctctgagtttcctcgaaggggatttcctataacgctagttcaagcgaagattcttgtctgatgaaaatcaggcgaggatcttggtcacacgaccggagccaacggtgtggccgccttcacgcacagcgaaggtcaggccttcctccatggcgatgggctgaatcagctcaacggtgaaggtggcgtggtcgccgggctgaaccatctcgacgccttccggcagctcgatgacgccggtgacgtcggtggtgcggaagtagaactgcggacggtagttggagaagaacggcgagtgacggccgccttcgtccttggtcagcacgtagacttcgccctcgaacttggtgtgcggggtgacggagcccggcttggccacgacctgaccgcgctcgacatcctcacggccgaggccacgcagcagcagaccggtgttgtcgccagcctcgcaggcgtccatggtcttgtggaaggtctcgatggaggtgacggtggtggtctgggtcggacggatgccgacgatctcgaccggggtgttgacggccagctggccacgctcgacacgaccggtgacgacggtaccacggccggagatggtgaagacgtcctcgatcggcatcaggaacggcttgtccaggtcgtgaaccggggttgggatgtagtcatcgacggcggccatgaggtccttgacggactggacccacttctcgtggtccggagcgtcgtcgtgcagggcgccgtaggcggaggtgtggatgaccgggcagtcgcgatcgaagccgttctcgtcgaggaggtcacggacctcttcttcgacgagctcgatgagctcttcatcgtcgaccatgtcgcacttgttgagggcgacgaggatcttcggaacgccgacctgacgggcgagcagcacgtgctcgcgggtctgggccatcgggccgtcggtggcggccacaacgaggatggcgccatccatctgggcggcaccggtgatcatgttcttcacgaagtcggcgtggcccgggcagtcgacgtgagcgtagtgacgcttctcggtctggtactcgatgtgggcgatgttgatggtgataccgcgggcggcctcttccggagcggaatcgatctggttgaagtcgtactccgggttgacatccgggaactcctcgtgcagcaccttggagatggcggcagtcagggtagtcttaccgtggtcgacgtggccgatggtaccgatgttaacgtgcggcttagtacgctcgtacttttcctttgccattacttttgtcctcctggacgtctcgtgagtttcctgcgccctttcgcacagggactcgcttattctactgggtttctgggttatgtgccactttgaagagccagaacccagtcagcggtatacgatactaccgctgactggagacaccggccacttcatgatgtggcgcgtgtcactcgccgcgctgggccttgatgatctcctcggagacgctcttcggcacctcgtcgtaggagtccatctccatggtgaacatggcgcggccctgggtcttggaacgcaagtcgccgatgtagccgaacatctcggacagcgggaccttggcgtcgatgaccttgacgccgacgccgtcggtcatggactggatgttgccgcggcgctggttcagatcgccgatgacttcgcccatgtactcttccggcgtgcggacctcgaccttcatgatcggctcgaggatgaccggcttggccttcggggcggcttccttgaagcacatggagcccgcgagcttgaaggccatttcggaggaatcgaccgggtgcatctggccgtcggtgacggtggccttgacgcccacgaccgggaagccggcgaggataccggattccatggcctccttgacaccggcctcgatggggccgatgaattcgccggagatgtggccgccggtgacctggttctcgaactcgaaggtcttgccctcggtggtgtcgagcggctcgaagttcatcaggacctttgcgaactggccggaaccaccggtctgcttcttgtgggtgtagccctggtccatgacggccttgcggatggtctcgcggtaggcgacctgcggcttgccctggttgcactcgaccttgaattcacgacgcatacggtcgacgatgatgtcgagctggagctcgcccatgccggcgatcagggtctggccggactcttcgtcggtcgtgacctggaaggtcggatcctcttcggccagcttggacagggcgatgcccatcttctcctgatcggccttggtcttcggctcgacggccacctggatcaccggatccgggaaggtcatggagtcgagggtgatcgggtcgttgatggagcacagggtgtcgccggtggtgacgttcttcaggcccacgaaggtgtagatgttaccggcgtcggcgcggtccatcgggttttccttatcggcgtgcatctggaagatcttgccgatgcgttccttcttctcgcgggtggagtcgagcacggagtcgcccggcacgacggagccggagtagacgcgcacgaacacgagcttgccgtagaacgggtgagtggagatcttgaagaccagagccgagaacggatcggtcttgaccgggtgacggtcgatctcgacggactcgtcgccgggcttgtagcccttgatggccggcacgtcctcgggggacggcaggtagtcgacgacgccgtccagcatcggctgaacgcccttgtccttgaaggcggagccgcagaagaccgggaaggcttccttggcgatggtgagcttgcgcacgccggcgcggatgtcttccttggacaggtcgccgtcctcgaagaacttgttcatgagttcgtcgtcggcttcggcggcggcttccacgagcttctcgtggtactcctgggccttgtccttgagatcgtccggaatctcggtggtgtcgtacttggcgccgagctcctcggtgccgttccacacgtaggcctgcatctcgaccaggtcgacgacgccggtgaagtcgttctcggcgccgatcggcagctgcatcacgatcggagcggcgcccagcttctccttgatggtgtcgacggagtagtagaagttcgcgcccagcttgtccatcttgttgatgaagcagatgcgcggaacgccgtacttgtcagcctgacgccacacggtctcggactgcggctccacgccctccttgccgtcgaacacggcgacggcgccatcgagcacgcgcagggagcgctcgacctcggccgtgaagtccacgtggccgggggtgtcgatgatgttgatctggaacttgtccttggtgtcgtgggactgacggctccagaagcaggtggtggcggcggactggatggtgatgccacgttcctgctcctgcgccatgaagtccatggtggaggcgccgtcgtgggtctcgccgatcttgtagttcttaccggtgtagaacagaatacgctcggtagtggtggtcttgccggcatcgatgtgagccatgatgccgatattgcggacgtcgtggaggtccgaaatctcttcagccatctttttccttagtttgtgctcagggcgagtgattaccaacggtaatgagcgaaggccttgttggcctccgccatcttatgagtatcctcgcggcgcttgacagaagcgccgaggccgttggaggcgtccaggatctcgttggcgagacgctcggccatggtcttctcacgacgggcgcgggagaagtcggtcagccagcgcagcgacagggtgttggcgcggttcggcttgacttcgaccggcacctggtaggtggcgccgccgacgcggcgggagcggacctcgagggacgggcggatgttgtccagggcgcgcttgagcacggccaccggctcctgttcggtcttctccttgaccatgtcgagcgcggaatagacgatgtcctcggcgatcgacttcttgccgtcaagcagaatcttgttgatgagctgcgccaccacggtggaaccgtagatcggatcgggcagcacgacgtgcttcttggaaggtcccttacgtgacatattacttacttcgccttctttgctccatacagggaacgaccctgcttacggtccttgactccctgggtatcgagcgcgccgcgcacgatgtggtaacgcacacccgggagatccttcacacggccgccacgcacgagcacgatggagtgctcctgcaggttgtggccctcgcccggaatgtaggcggtgacttcgatgcccgaggacaggcgcacacgggcgaccttacgcagagccgagttcggcttcctcggggtggtggtgtagacacgggtgcacacgccgcgacgcagcgggctgcccttcagggccaaagtcttggacttcttcggctttgcctgacgtcccttacggacgagctgttcgatagtaggcaacttgaattctccgattcagtggtttctcttgctttggtgcggccgccgcactgcgcccacacttttcagcacactcgcttggtatccgcctgttggcgacacccgacgaatcggaaaagatagcccagtccaccggcccgatggccttcgcccctcccgtcggcgcattactgcgtgcgatcagcggtttgaaggatatcccaactcgctcgcctgtcacataaggcgcgctgttggcacacacgaatatctatattacgattccgccggacaacgacgcgccgagggatggcgcgggtcctcggacgacgaacgcccccgcgcgagccttgccgcgcgggggcgtcgcccaggaggttacatcatatctcttctcgccacataccacctgcataccattgacgttcagcacgcccttcgtgctcttccatatacgatgggaacctccggcggcccggcctccttgccgtactaccttgccgctttcctcaccatcgattctaccaaaaccaccctggcgaaacgcgagccccgttgtctatttagaggtgcaacaccgctgttgatcctgcaattcccgcagttccccggccatgcccatccgaatctcgccgcgttcgggcggataccggcggatcatgccgttccagttctcgtcgcctccccgccgccggctggagtatgggtcggcgaagcacgtgtccatgcccggcccgtcgcgcaggcgcgtgcgacgggcgaacccggcgccgtcgtcgcacgtgacggcgacgcgcgccggccggcggcggacgctcggagatgggaacccgtccgggaatcgggaaacgcgacgtcctcccgccgccacgcccgcgccgccacccgcgaccacaggcgttcgcatgacgggcggtggtgtctgcgtggtttggcgcgcctgcggtcggccttgcgccgcgcggggccggcgatgtagcagcggcccgtcttcggacgcttcggccggtacggccgtcaggactcgttctcgttggacgggaaccacgtgtcgcgcctgatctccctgctgatgctggacgggctgcgtcccggcaaacgggccatcttcctgacgcccgtgccgttgccaacctcgatccggatgacctggagttcctcttccgacaggtgcgaatatacttctcccatgggtgcgacatcccttcggactggttatccggacgatctccaatccaacgggcgttgcactttcatttagacaacgggccacttgcttctgtgcaccggttgatatactgtttatgtcaacagtagcctccaagcctcctaacagtgctcaaatccggggctcttgttttatccatgggaggcggagaggtgcgtaagcaggccaagtcggtgttcgagatgatcgaactgctcaagcagcgcggcctgaccatcgatgtgcccgacatgccaggcatcctgttggacaataactactatcgcctgtccgcgtatttccgcccgttccagaaggatccggcgaacggtgacaatgatttccgaccaggtgcgaaggtatccgatttccttactccctttatgctggacgaccagttccgccgccttatccttgagggcacctcgcgtctggaactgacactccgtgcgcgcctcgcctacaacctggcgctgaacggcgacgcctacaactatgacgagccggattcctatcgtgacatcgcgtatccgaacggcatgttgaagcgagacgccctgatctcgaacatcaagggctgggtgtcccgttcccacgaagtatgcatccgccactaccgccaccagcacgagcagccaccggtgtgggccgtggtggaggtgctaccgttcgataccttgtccaagatgctccagttgcatctggacatggatgccgtggccaagacagtgctctcgctgggattgtgcaagaaccgccgccgtgcctcggaaatcgtgcacgcgatggtttacctgcgcaacctgtgctcacatcactctcgcctgtggaaccgcgagatggtgatcaccccggcggtgctcaaggacatgagggcggcgttcccggaatttgcatacgaagacaaatcagttggcaactcgctgattgtgctcatgtatctcgttgaccgtatcaacggcgaccgggaatactcgcacagaatccttgatttcctggcacaggatgattcataccggcatggcatcctccatccgctgcactgggactagagccgagacaacagcaaagatcgggactggtccgctaaccatctagggtgtgtttacgctatttaggttttgcgtgataattgtcgtatgtgtatgccggggtatgacgtcacgcttgaccggttcatgagggtcgcgcatccgttgccgcgtcggcgcggcaacgtggcggtcggcaaccacacgttcgtcaacgccctgccgtggatgcgccgtgtatttcgatgctcctatacattgtcaagcgtttgggtgtgttgttttgggttggttgtcgagtgtatccactggatggcccgttgctcgagttcgggaaggtcgcgtgcgccgcgttcgatctcgctgatgcggctcgagggcacgcagagcgcctcgccgatctgttgctgggtgatgttccggctgacgcgtagttcgcgcagcttggcgccgcgttcggccggggtcccgcgtccgacctcgccgttgcgtatgctgatgagcgcccggtatgcctcgcgggcgatgaaccgtttgacgcagcggatgatctcgagcttgcctttgccctcgcgggtctttttggccatgtagtcgcgggtcggcttgtggtatcgcaggcggacgatggcgatgcggtgcaatgccatattgccctgccggttgccgcctttgttgagcctgtgtcggttggtcctgccgctggacgcggggatggggcagacgccgcagagtttggcgaacgcggcctcgcttcggatgcgttcggggttgtccccggcgacgatggccagggtcgcggcgatgacggcgcccgcgcagtacatgtcgagcagcggcctggcgtgttcctcgaggatcaggcgcatgcgttcctccaggagaccggcctgccgtttgagcgccttccatgccttggcggcggatttcagcgcggccagcacgctccgctcgaccaggccgccggccggtctgcattcggcgagcctgttcatgcgggtctcgctcctcaacccccggtaacgttccctgatgggttccggggcggcggcgagcagcccgttcgtcgaatcggggatcgcggtcatcgccgacaccagttgggatcgctgcgcgttgaggtggcgcagtgcctcgacccagccgtccgagcttttcggcaggctcgtgccgtcgccggccatgacgctacgggcagcggcgaccgcgtcgaggggatcggacttgccgtccctgcggcgcacgcttcgcctggggcgcggcacctcgcgcacctcgtatccggcggcagtgagacgacgggccagggccgctccgaacgagttcgtgccctccacgcccacggccgcgaccctgcccggcccgggcggcatgccgatcagcctgtcgtatccgtccgggtccgccgtgaacgtctcggcgcccagcggcctgccccgctcgtcgagcaatgcgatggtgtgcgtgtccgtgtgggtgtcgatcccggcccgcaccacttcgttcggcggcgtcatcgttgtcgttcctttccatgtgttcggatgcctcccgggggcttgcggcgcagacaggacgttgacggggcacgctaccatggttcttgcgggatccgacgggagcggccacgctcccatggggtcatgcatccatggcccacgggtcggcggccatgggcgggacaaatcaaaataaggacagccaccggaaccgatggcgtcagtcaaatgtggggtcaccgcccaagccgtcatccaccattatcaccgatcagaaaccggcataaccattatcaacgtcaaatcgaggtggacgctttcagcacttaatctgaacaccttcggcgttcaagttgaacgccgtcggcggctgtttccttgttttttgttgtttgtctggttggcttacttcatgagggagtgtctgttccggtaggattcgccgtggaagcggaggatcccgccgtggtgcacgatgcggtccatgaccgcggcggccatgtccccgtcgccgaacacgtcgccccacccgccggacccgaagttcgaggcggagacgacgccgcgggtcccgtagccgtccgcgccggcctggaacaggagcccggccccgtcgatgtcgatgggcaggcagccgagctcgtcgatgatgaccagcccggccccgccgatcgccttaggctcttggtcgagacggttctcgtccctggccttcctcagccgcatgaccaggctcgaggcggtgaagaacatgacgggaaacatgcgctgacaggcgcgcacgccgatcgcgatggccaggtgggtcttgccgcggcccacgtcgccgtggagcacgaggtcctcggcccgttcgacggactccaggctttccagctgctcgcggccccggtcggcggggaacgaggccatgcccccggtcgtagccgtccagggtcttgttccgggggaagccggcccgtccgggcagccgccgccgtttggatccggcccggctggcgttcccggcctcgaacaggttggccaggaagccgagctggcccggggtcgcgttctcgatggcgtcgcgcggcacgctgtgggtcaatggcgggttgcgcgccaaggtcatgacctgtccgggtgtggccttgtcgaccactccgccgccgcgcttgcgcggctggccgtcgtgtgcgctcatgcccgtccctccatgtattcgtcatggtgtttcggatcctggccgcccgaggagcccttgccctcgaggacacgtcgggcgcatgtggcgattgcggcccggtcgatggtccgtccggcgtcgatgacggtctccaccgctttgacgatggccgcgaacccgcattcggcggccacgacgcggatgtcgtcgagccacacgtggaccgacgcccggaagccctcggccgacggcatcggcaccatcgggtcgcgccccgcgaaagccgaccgcgttctccacgccgcccttcccgtggccggaatacgggtcgcggaaccggggcccgaacccgtagcgcgcgcggaacagggagaacagacgggtccgggcggccgtgccgtcggcgttgcggtggcccacgccgacggcgttgtcgaacaccacgaccccgggcgccatgcccgtcctctcgaacacctccggcagaccccggcacacgcattccgcggtctcgcccggcaatgccgccacccggcgcatgttcgaacacgggaacgacaccgccaggaaatgcacgacccgttccacgccagcgaccacggcccgggcctggccgaaatcgacctgcgcgcttcccggcgcccacttcgattcggcgaagccgtccgaccgcgctcgatgcccccgcctccaacgcctgacccggcgctgcaccaacgagtacgggcccgtgaacccgcattcccccacaagccgctcgtacacgcgggtcgcggtatggcgttgcttgaccggcatgcgcaggccggcggccggccatccgtccacgacggccgcgtacccgtcatcaaccagcgatccacccgcgcgagcgccgtccgacgattcgggtgaataatccccatggttggcgtacctgaccacggtcgtgcgcgatacgccaagccttcgtgatatctccttgtggctcaggccttggcggtcgagctgcctgatacgccgtcggacacacaccggtgtcgtcatttcctttcctcccgagaaccatcggtttggttgacgggcactcgggaatccatcaaggaaccagacgatgccggtgttcttattccaccggcaccgtcaccgccggcgatgtccaaattgaacgctcacggtgtacagaaacaagtgccgacgccgaacacctttattcgatcacatacactcctcttccgacaggtgcgaacatgctttccccatgggtgcgacatcccctcggactggttttccagacaatctccaatccaacgggtgttgcactttcaattagacaacgggacgttcaactggaagcgcttggtatgataggggaatcggcatagtcgtggccgccattttcggattcgtactttatttgtctgtacggcggagcaataaggatggagaaaagtgatggatgagcgaccatgggttattaaagtggactcgttgtctaagtacggggatgcggacggaaagttggacgcttgggcgtccggattggagtccgcatgttttcgatggaggatcggcgcagggccgttgacctgtatttcacggagggcatgaccatcaggaaggtcattgccgagcttggttacccgtccgagggcgcgctggtgaaatgggttcgcgaggacccgcgttacacgggcgcgtgcaggcgttcgtatacgctggaatgcaagacgaatgcggccagacgcgcgctcgagggcgagcccctcgcccgcgtggcgcgcgacgcgggttgcacgccgacgagcgtgtaccagtggatgcgccgctaccggagcgaggggatactgggactgatggacaggagaaacgcgccgatgccggccgaaccgatgcccgcggccggcgatgacgtggaggagctgcgccggcaggtggaggtcctgcggctggagaacgcggtgatgcgggagacgatcgatgttttaaaagccgacgacccgcgcctcgacccgtccatgctgacgaacagggagaggacgcgggtcgtcgacgcgatcaggggtgaattcggcctggcggcctgtctgaaggccgtggggctgaaacgcagcacctactattacgagcgcggcgcgatcgccgcgggcgacaggtacgccgtgctgcgggcccgcgtcgccggcctgttcgagcagggtgggcgcgcatggggataccggaccatccaccgcatgctgcgccttgacgagtccgacccgatcgtcgtctcggagaaggtcgtcaggcggatcatgcgcgagggggccatgcggcccgtgtacctgaagcggccgaagcggtggagctcctacgccggcgagatcggcgaggccccggcgaacctcgtggagcgggacttccacgccgacgcgccgaacatgctgtgggtcacggacgtcacccagttcaccatggacgggtacaagtgctggctttccccggtggtcgactgcttcgacgggatggtggtctcctggaccttgtcgcgctccccgaacgccgacatggcgaaccggatgctccttgacgcggtcgccacgctcagggacggggaacatccaatcatccattccgaccgcggctgccactaccggtgggacgaatggatccgcatctgcgaggagcacgggctgatccggtcgatgagcgccaagggatgcagcccggacaacgcggccgccgaggggttcttcggcaggctcaagaacgagttattctacgggcgggactggaggggcgtgggctacgaggagttccgcgaacgcctggccgcctacctgacccactacaatgaaaccaggatcaagaagtcactggactggatgagccccgtgcaataccgcagaagtcttggactggccgcctgaccgtccaaaaaaacatccgcaccccctactatgggaaagtgtgcgcaattcgcgatatgtctttcgaggtccctcaaggctcagttactggatttgttggtcctaacggcgcaggcaaatctaccacgatgcgttgcatactggggctaacaaaaccctcgaaagggtcggccagtgtgtttggaaccgactactccaaactccagaatcctgcgcgtcgaattggctcagttttggatgcatcaaagcaacatccaggtagaaccgggcgtagtatattgctcgcagcggcagatgttctcggcatagcgtcttccaagattgagtttgctttggagtcttgtggactgacaagcgccgagagcaggcggcggatcggtacctactctttgggaatgagacagcgtctagcgttggctctcgccatattgcccgagccagagcttcttattctggatgagccgatgaatggtttggatctagagggaattcattggatgcggagcttccttagagactttacccaagctgggggaactgttttcctaagttcacacttgttaggtgagatggagaaaattgctgacagtgttgttttagtcggtaaggggcagataattgggtcggtgtcaattagtgatctaaagggggctggtaaaggcttagaagagttctatttggaacaaaccgcgagtgtctctcggggaagtgtggttaacaatggctaataatcttaatgattatgtcaaacctgtttcagattcaaagatgtcaggcattataaaatctgaactgaggaaagcttttggtactcgtgcgagcatagctataaccttggtcaccttgctgttgaccgttggaatgagcatttggtcggctgtattgctggaagctggggagtcttggtacatacctttcaaacaggtggcgagtcccctaatcactataagcccactcctaatcattcttttggtttgtgaggagtgggataaggatagtgcgctagtaacttttacgcaggttcccaagcggtctcgaattgtgattgctaaaactgtggtagcggtcttgattttctcagctagttttgccgcttcattactattaacattgattgtttcagttactacatcgagtattcatcattttagtctagattggaaagcttcactatcgggctttctaactcttgcgctaccgttgttggtgaatatgggtctggggctcgctatggctttattctcgcaatctaccgtaatttcaatctcattgtatttcatcattcctccggtcacagtgatgctatcgcagataaattccatatcagaatatgctagatggatttcgctgggacactcgtcttcaatttttgtagccggtctaacccctcaaacttattctcagattgttgtttcagtgattttctggatagttctgccgttcgtactaggttttgtgaacatctgcagacgagatatttcatagccctaacttgatgcacttttgccgaaaaaacattgaacataaacacgagaccaccctaccggcggacacgccgcgaacgcccggcccgccgacttcgccgcgccgggcgacggccttctcaggcgacggacggggcggtcttggcggcatcggacggacgggccgcgtcgacgacgttcgccgcggagcccttctcgccgttgtcggaatcccaatgaatctcatgccggtcatcatggttgcgccaccagctggacaggatggagccggaaatgttgtgccacacggagaagaacgtggacggcacggcggcgagcgggttggacgcgaaggaggtcagggccagcgtggcgcccagggcggagtcctgcatgccgacctcgaaggtgatggctttctgctgtgcgtagcggaagcccttcgggtagatcttgtacatcagcttcgagaagccgaagcccagcgagtagccgcacagattatgcaggatgaccaccgggatggccatcagggagctggccacgaacagcttcggaccgttggcggcgacgaccacgccgatgatcagcaggatggccacctgagacacgatcggcagggccacggtgaccttctcgatcttcttgccgaagaccatgtggcagatcacgccgagggcaatcgggaaaagcaccaccttgacggcattgaggaacagggattcgaccggcacgctcacatactgggaggccagcagctgcatcagcagcggaatcatgaacggggcgcacagggtggagaggatgccgatggagacatcgagggccacgtcaccacgggacaggtagctcatcacgttggaggaggtgccggacgggcagcagccgacgagaatcacgcccacggccagcgggccggacaggtggaagaccgcgcacagggccacggcgacgagcggcatgatgacgaaatgggccaccgtgccgacgatgaccatcatcggctgggtgaggatgcgcttgaaatcgtccagcgtcagggtcagacccatgccgaacagcacgatgcccagcatgtagccggtgtacgccttgccccacaggctggcggccggcacgaagtagttgaagacggcccagacgatgacgatgaccgtaaaccacttggtcagccaatctgcaaaggctttaaccttttccatggtgtttctcttcccttgttcggtgtaggtaacatcgcatgaaactaggcgggtcgcggttgatatgaaacataatgctcacattgtgaacgctcacgtaatcatctctgcaatccccagtcgcaccatcacgccgttgtgtgccctgacttttcatcaatcgctgcacaagacccactcgtccacatcccaccatttgagacagcccacagcctggccccaagaatgaaaccaaccacttgattccatcgcgacacaccgatgagcacacatccgaaaagttgtgtatagtattcacctgttgtgcgaattcagcttgctgaatacggcactatggtggccatagctcagttggtagagcatctgattgtggttcagaaggtcgcgcgttcgagccgcgttggccaccccagtaaaacccttccgttcgcggaagggttttgtttttcctgaattccccgctcctgcagggaaccaccgcgttgtacactcgggcatatccaattcaccgaacataaggacaaaaggtccgtcatgctgtcttttgagaacgattactcccgcgccgcccatcccgcagtgcttgaagccgtggctgaagccaacaaccatctgtatccgggctacgggtccgacgaactgagcgatcaggccaaggccaagatccgcgaggcctgcggccagccggacgcggatgtgtggttcctcgtcggcggcacgcagaccaaccaggtcgtcatcgacaccatcaccccggcgtatgcaggcgtggtcgcggtcgcctccggccatccgaacgtgcacgaggccggcgccatcgagttctcgggccacaaggtgcttacgattccccagcacaacggcaaaatggatccaaccgaactggacgagttctgcaagaccttctatgcggacggcaactacgagcacatggtgttccctggatccgtgtacgtctcgcaaagcaccgaatatggcaccatctactccaaagccgaactgcaggctatcgccgatgtggcgcataagtacgatatgccgctgttcgtggatggcgcgcgactcggctacgcgctgaccgccactggttccgacatgacgctcacggatctggcgaccatcgccgacgtgttctacatcggcggtaccaaggtgggtgcgctgttcggcgaggccgtggtgtttaccaagcacaacacgccgaagcacttcctgacccgcatcaagcagcacggcgccttgctggccaagggcttcgtgctgggcgcgcagtttgacgccttattcaccgacaacctgtatttcaagattgcccgcagcgccaatgaggcggccgatcgtattcgcgaggccctgcgcgccaagggctacatgctcactttcgaagcgcccaccaaccagattttcgtgacgatggatcagccgaccatcgaccgtctggagcgcgaggtcaagctcggctttaccgagaaggccgacgacacgcataccgtgatgcgcatctgcaccagctgggccaccacgcatgaagaggtcgatcagcttattgaggtgctgtaaaacccttcgctaatctctctctccgtcatcgcttcgcgatgccacctccctcatcagagggaggttttttcgtagctcccgccgatgagggagctggccgccgcaggcggactgagggaaagacctctccgcaaacgagaaggctcctactcccctatcgccttgcgttccatatccacgaacttgtggaccgaggcttccacggaataatgcgccttggtgtattcggcgtatttctcgccccattcggcgcgctcggcctgatgtgcgatccaccaatcgatgcgtcgggccagcagggccgcgtcccgcacggggaacaacgactcatcgatcagcgcgaactggccggccgccgacaattcggacgcggcgatcaccggcaccaatccgcacgccatcgcctcgatcacgctcaccgattcgatgtcggcaatcgaacaatgcacgaacaaatcgcccgaacgcaacaaatcgggcatatcggcgtgcttgtggaatccgatatcggccttgcgcgccagcaaacgcccggcgcggaacttgagatactgcttgagcggcccagtaccggcgatcaccagctgaatatcgccggcgtggcgggacatcgacaccgccttgatcagcgtaatctgatctttctcgctggccagtcggccggaagcgacgacacggaacggcacgggagccgaggcatccggatcggccggcttcttcggcgaatacaccggtgaataaccattggaaatcacgtgcaactcggctttatacccgtgcgcgcgcaacaggctcgcggtcatttcggtgggcacatggatgtggtcaatgtgcttgtacagccagtgcttgaacagccagtacaggaagctggaaataccgggaatgcgacgtagcgggccggccgaatacagcacgttctccggctgcaggtggaatccggcagtcacgggaatgcccatttggtgggcgactttagcggcacgacggccgaatttgaacggcatatagatatgcaccacatccacgccttggaaggcggtgcggaacaacgtgtcgctgggttcggcgaattgcatgagctgcttggcggccacccacgagacgagcggcaccttattcacgcgcgccggatattcgggcgcccctataccgacaagcctcacatgatggccttgccgctccaattccgcagcccattgcaaggccgaattggaggtgccgttgccctgattgcccaccgtatcgaccacaagagcgatagtcagcggacgatcaatgctctcttcaatcccgttttcgcgcattgcctcatcctaaaccaccgcgcggcaatggcgtcggccgcgctgcctgaacgcgtgtgaaatggtatgggctgccgcattttgcccaatattgaatcacgcgcttcgcagcgcacgatcggcgcgggccacggcctggaacaactcggcggtgtgcttgagcagactgatgcgcacccagccttcgcccgcctgaccgaagcagacccccggcatcagcgccacgccggccgtgttgagcagccaatccacgaatgcggcggaatcgccatgccaccgcaccggcacgcgcgcccacgcgaacaggccgccttgggcctcggccaccggcagaccagcctgggtaaacccgtcacgcaccacttcaaaacgatgctgatattgcacagccagcagcttcaccgtgctctgatcggattccagcgccaccgcaccggcctgctgaataacgctggaagccaacaccgcagtctgccggtgtacggctttgacggcagagaggacttcggcgttgcccgccacgaatccaccgcgccagccggccaccatatacatcttggacagcgagccaagttccagcgccacgtccagcgcgcccggagtctccagcaggctcagcgagcgcacgtcgccgaattcgagccccgcataggcgaaatcgttaagtacgatgaatccgtattgcttggccaggcgcatggccgtctcatacagttcgggtgttgcggccgcgccggtcggattgttgggatagttcagaatcagcagtttggcgcgagtccatagcgctgggtccaccgcatccaagtcgggcaggaatccgcggctcgggtcagcgggaatcgcctcgaactggccaccggccactactgttgagccctcgtactgcgggtaatacgggtcgaccgccaccaccgtatctcccggatcgaccagcgcctggatgacggtggttatgccgacggacgagccggaagtcgccagcagctgggtggcggggtccacggtgacgttgtgctggcgcgaataccagccggcaatcgcattcagatattccggaagcccatcaaatggcgggtaccggaacagggaaggattgtgggaagcgtgagaaagcgcgtcctgtacaaaggatggcggccagccatcgggattccctttgctcaagtcgatgatatccttgccagcggcgacggctgctgcagcgcgtgcgtccgcctcagcaaaaggattgccgggcagactagccgcccgtcgagaaatcagagccgcgttcgacgtcggcatgtcgccctcccccttcgactattgccggcgtgccggcttgtagcctgaaacgccggaaccgacacgccgctattcgctatatgtcgcatccaaaaatgttggcccgaccgccccatacttcatcggccggtgattgctaaggtacgacggctctgttacacacgcaatggcgtgtctatacgcagtatttatggcgggttacgggcatctgaatcttcatggggcggtaacctgcccatggggcggtatttaccccatggggcggtgaaattcccatggggcggtaaggcaaaacggcttaattccgcggtttcacaaaaccaacaaaccgccccatggactcattaccgccccatgaagccggatattccgcccgtaattttggccgcgcgaggcactccgctcacgcgacataccgaaatcatcgcgtcatggcagaatgtgggtatgactgaaaacgccgtgaatactgccgtgacttccgcctcctctcccgcaattcccgccgagacttccgccgtccccccgcaactcgcacagccaaccgcccgctgggcacaccgctgggcaagcaccccacccgcgtgctgtttttgggcgctggcgagctgggcaaggaggtcacacttgaactcatgcgactgggcgcatgggtgtgtgctgctgactcctatgccggcgctccggcccagcaggtggcgcatgaataccgcgcgttggatatggcgaatgccgccgaattgcaggcattgttcgatgaaatcaagccggacatcatcgtgcccgaggtagaggccatcgccaccgatgtgctggccggtgctgcggccgcgggcgcccaggtggtgccgagcgccgaaatcgccgcgatttgcatggatcgggagcgtctgcgcgtactggcccacgaagaattgggcttgccgaccacaccgtatcgttttgccggctcgctggaagagctgcacgccggagcttcggaagtcggctatccgtgcgtggtcaagccggtgatgagctcgtctggtcacggccagtcggtggtgcgttccgccgacgccatcgatgccgcttggaccgaagcgcaggagggccgccgcgccgccgatgagggcgatgtgtcgcgcgtgatcgttgaggcgcttgccccgctggagcgtgagctgacggtactgaccgtttcttcgtccgccggcattgtgacgtgcgcgccgatcggccaacgtcaggagtccggcgattaccgcgagtcctggcagccggctaccgagcccgatggcgaggccgagcgggcgcgcgacatcgcacgtaccgccgttgaaggcttggtggccaaggctcaggcgaccggcgaaaccggttggggcgtattcggcgtggagctgttcgtgctcaccgacggctcgattctgttcaacgaggtctccccccgtcctcacgataccggtatggtgacgatgacctcccagcgtctgagcgagttcgcgctgcacgcccgcgcgattctcggcctgccgatcacccccgaacatgtggcgctcacgattccggccggctcggtggcggcaagccatgcgattgtggtggccggcgacggtgaggccgagttcaccgatgtggccgctgctctggccggacccggcacggacctgcgcatttttgccaagcccgaagtgcatggccaccgtcgtatggccgtggcactggccgtcggcgagtccgaagccgacgcccgtgccaaggccggccgtgttgccgatgcgttgacgattaccgtggagtagtccacggcctgatcagctcagcatggcctcaatattattgccgtccgggtcgtggatgaacgcggcgtaatacgtggggccatagttcgggcgcgggcccggagcgccgttgtcggtaccgccagaggcgagaccggcctcatggaacgccttgacggcgtcctcatccttggcgcggaacgccacatgagacggcaccaccgggttgccgtccttcggagactccagccaaacgctgtcgccatcctcgtcattggcaaagcacacggcggtcgggtacgccactttcttgacgtaacccagcggggccagcagcttctcgtagaaatccgcgtactgtgcggcgtcggaaacaaacaaaccaatatgatcgatcatgacgaacctccttgcaccatttcgtcactcccattatcgtgcgtgcgcggccgtacactcacgttttgtctattgacgaacacctgagtgtccgcgcgcttgcgtagatactgttacgccgaacgactatgcgaccggcaatgagtcgattgtcggaccaataccgtccgcctccgccatcccaacagcgtatggccgttcgatgcagcgacgtatgatgcgctgaccgcatcgtagcgtcatgctgagtgttgttgtagccctcgattggtacccttttaccgttagttcacccagaaattccactcctgaaaggtgagtcatggagaagctggaaaagctctacgagggcaaggccaagcaactgtacgcaaccgacgatccagaggttctgtgggtcgaatacaagaacaccgccaccgctggcgatggtgaaaagaaggaagacttcaccggcaaaggccgcctgaacaacctcatcaccaccatcatcttcgacctgctcaagaagcgcggtatcgacagccacctcatcaagcgagtgaacgacaccggccagctggtgcgcaaggtgaacatgttcccgttggagatcgtgctgcgcaacgtggccgccggccacttctgctcccgtctgggcgtggaggaagggctgccgctcaaggagccggtgcttgagtacttcctgaagaacgatgatctgcacgatccgttcgtcaacgacgatgacctggtggccctcgacgtatgcactcgcgaggatctcgccgagatcgccccgctggcccgcaagatcaacgaggccctgatcgagatcttcgccaagatcgacgtcaagctggtcgacttcaagatcgaaatgggccgcgccaccgacggcacgctgctgttggccgacgagatcaccccggattcctgccgtctgtgggaccagaaggaccactccggcaaggtcgagcaccttgacaaggacctgttccgccgtggtctcggcagcatcatcccggcctacgaagagatcgaggagcgcctcgccgaactcgccaagtccgaaggcatcgaagtcgccgaataagtcgtttaggtgcaggtagcagaacatacagctggctcccctctctgaggggagctgtcgccgataggcgactgaggggaggtcaagacgttcaccgccatgacaactctcctcagtcagctccgctgacagctcccctcagagaggggagccaagttcttttaccgcacttcttcaatttttcaataatttcaagaaaggatttccatggtttttcgcgtgtacgtggaaaagaagcccggctttgatgtcgaagcccagcagcttgcgggcgaactgcgcacaatcctcggactgaacggcctcaaggccctgcgcatcgtgaaccgctatgacgtcgaaggcatctcccaggaactgttcgaccagaccgtgcccaccgtgttcagcgaaccccaggtggacaatgtggcctacgacctgcccgacttcgccggagccaaggtcttcgccaccgagttcctgcctggtcagttcgaccagcgcgccgactccgccgccgaatgcatccagctcatctcccagggcgagcgcccgacggtccgctccgccaagctgtacgcgctggaaggtgacctgaccgacgccgacgtggacaccatcaagcattacgtaatcaacccggtcgaggcccgcgaggccagcctggagaccaaggaaaccctgaagacccaggtgccggtgcccggcaaggtcgagacgctcacgggattcaacgagatggacgccgaggccggtcagcggttcatcgacgagcgcggtctggccatggacctggccgacctcgaattctgccagaagtacttcagcgaggagggccgcgaacccaccatcaccgagatcaaggtgatcgacacctactggtccgaccactgccgtcacaccacgttcggcactgagctggacgaagtgaccatcgatgacgccaccgtcaaggccgccttcgagcgttatctggcgatgcgccacgagctcggccgcgatgccaagcccgtctgcctcatggacatgggcaccatcggcgccaaatggctcaagaagaacggcatccttacaggcctcgacgagtccgaggaaatcaacgcctgcaccgtcaaggtcaaggttgacgtgaacggccacgacgaggactggctgttcctgttcaagaacgagacccacaaccaccccaccgaaatcgaaccgttcggcggcgcggccacctgcatcggcggctgcatccgcgatcctctgtccggccgctcctacgtgtatcaggcgatgcgcgtcaccggcgccgcggacccgaccgtgccggtctccgagacgctggaaggcaagctcccccagcgcaagctcgtgaccaccgccgcagccggctacagctcctacggcaaccagatcggtctggccaccggtcaggtcgacgagatctaccaccccggctacgtggccaagcgcatggaggtgggtgcggtcgtggccgccaccccggccgaccatgtgcgccgcgaaaccccggcccccggcgacaagatcatcctcttgggcggccgcaccggccgtgacggcatcggtggcgccaccggttcgtccaaggcgcataacgtggaatcgctcgaactcgacggcgccgaggtgcagaagggtaacgctccggtggagcgcaagctgcagcgtctgttccgccgcggcgatgcctgccgtctgatcaagcgctgcaacgacttcggcgcgggtggcgtgtccgtggcggtcggcgagttggccgacggcctgttcgtggacctcaacaccgtgcccaaaaagtacgagggcctggacggcaccgagctggccatctccgaatcccaggagcgcatggccgtggacgtggccgccgaggacgtggacgagttcctggcctacgcccgcgaagagaacctcgaagccacggtgatcgccaccgtgaccgaggacccgcgcatggtgatgacctggaacggcgacaagatcgtgaatctgtcccgtgagttcctggcctccaacggcgcttccaagcaccagaccgtgcatgtcgaggcacagcagtcctacgagaccccgtggggcgagggcacgctggccgagcgcatgaacgagctggtcaccgacatcaacgtggcctccaacaagggcctttcggagcgcttcgactccaccattggcgcgggcaccgtgctcatgccgttcggcggcaagcgtcagctcaccccgaacatggccatggtcgccaagctgccggtgttcggcgagaccaccaccgcctcggcgatggcgtggggcttcaacccgtacatcatgtccaagaaccagttcaccggcgcctacctgtccgtggtcgagtcgctggccaagctggtcgcagccggcttcgagcatgagaaggcctacctgagcttccaggagtacttcgagaagctgcgcgacgagccggaacgctggggcaagccggcggccgccgtgctcggcgcgctgatggcccaggtggacctgggcgccggcgccatcggcggcaaggactccatgtccggttcgttcgaggatctcgacgtgccgccgacgctgatctccttcgccgtggccgtgggcaacatgaagcgcgccacctcccccgagttcaaggacgccgatcaccgtatcgtgcgcatcgcaccgcgctacctggccgacggtctgaccccggacaaggatgcgctgcttgaggcgttctccgtgatcgaggagctcaccgacttccacgatgccctggccgtctccacgccgggctatggcgccaccgccgaagccctgttcaagatgacgctcggcaaccgcatcggcgtgaccctgaacaacagcatcgccgtggacgacctgttcaccccggcatacggttcgttcatcgtcgagctggcggacgatgccaagcttccggccgtctccaatttggtcgagatcggcgaaatcggcaccaccacctccgagtacgtgttcaaggccgccggcgagacgctggacctggacgctgtgcaggaagcttgggagtccggcatcgaatccgtgttcccgtaccgttccaagggcgaggacaagggcgcgaccgtcgagaccatcgacttccacgcgccgaagaagaccgtgtacgtcggctcttccgtggccaagccgcatgtggtgatcccggtgttcccgggcaacaactgcgagtacgattccgccgccgccttcgagcgcgccggcgccgacgtgaccacgctgatcgtcaacaacctgacgccggccgccgtcgccgaatccacgcaggcgttggtcgatgagatcaacaagagccagatcgtgatgatcccgggcggcttctccggcggcgacgagccggacggttccgccaagttcatcaccgcgttcttccgcgcgccggccgtcaccgaggccgtgcgtgacctgttgaagaaccgcgacggcctgatgctcggcatctgcaacggcttccaggcgctcgtcaagctgggtctggtgccgtacggcgacatcgtgccgatgaccgacgcctgcccgacgctgaccttcaacaccatcggccgccaccagagccgactggtccgcacgcgcgtggcctccgacctctccccgtggctgtccaagacttcggtcggcgacatccacaccgtggccatctcccacggcgagggccgcttcgtggcctccgacgaggtactcgcccagctcagggccaacggccagatcgccacgcagtacgtggacgagaccggcacccccggcatggatctggacgtgaacccgaacggctcgctgctcgccatcgagggcatcaccagcccggacggccgcgtgtttggcaagatgggtcactcggagcgttccggcaacggcctgtacgtcaacgtgcccggcaacaagtaccagccgatcttcgaggccggcgtggaatacttcgccgcctgatcgcccggacgcccgaaccgtgtccgatggacagccagggggaggaagcccgatcgggtttcctccccctgtcgttgccgaatcgtatgcaccgcgaacccgacgttgaaaggacctgccgtcatgccgattaacgaagcattgctcgccgcgatgaaggccgccaccctcatcaaacccaacgtgaggaaaacctataggatccaacgcgctgccgaggcgctggtcgccaagcagacgccgccgaacccgaaatgccgcatcgaagacgccgccgtccccatgccggacgggcacgaggtgccgctgcgcacgttcacgccgatcgccccgtatgggacggccttccccggcgccgatgccgtcggtgccatcgttgccggcgcttcggccgatgacgccggcaacatcacgccacggggcacgatcctgttcgtccacggcggtggctggtgcaccggaggcatcgacctgtacgcgcaggcgtgcgcccatatggcggttcggctgcagcgtcgagtggtcgcggtcgagtaccgtctgtcccccgagtaccggttccccgtggcggtcgaggaatgttatgaggtggcgcggcgtctatgccgcgaacggtcgtcgtcatccgcgtccggcaccgacggcatcaccttgttcggcgacagcgccggcggcaatatcgtggccgccgtatcgctcatggcccgcgaccgcggcgagttcatgccgcaggcgcagatgctgctgtatccggtggtcggcaacgactacaatcccgagaccagcccattcgaatcggtgcggaccaacggcaccgactacatcctcaccgcacaggacatggccgactacatcgacatgtaccgttcgtccgtggccgacctgaccaatccgtatttcgcgccgctcaccgcgcatgacctgagcaatcagccgcgcacgctggtgttgtccgccgaatactgcccgctcagagacgaggacgaagcgtacgcccgtcgtctgcaattggtgaacgacaacgtctcctgttacaggattcacgatggcatccacggctacctactcaacacgtcggccgtgggactggtggccaccacctaccgaatcatcgagcatttcctcgacggcacaccgctggaaccggctcccggcaccggcaccaccgccaacgcaccggagggaggcgacgcgtggcaagacgtacttggtaccgactagacaacatcggcaagttctactcctcccaggctggccgctcctcgcagaccgtgttccgctattcggctgagctggaggacgacatcgccccggacatcctgcagcacgcgctcgaccatgccatcgcccagttcccgagcttcaacgtgcacctgctcaacggcatgttctggcattacctcgaacagtcagatggccggccgctggtggagccggaacatctgccgatatgctcgcgactgcattacgggcccaaaagcatgctgttccgcgtgagctatttccgcaatcgtgtcaatctcgaggtctcgcacatcatttcggacggtcgcggcgccatcaacctgttcaagtcactgctgcacgcctacatcgccgagcggtacgacgtgccgggcgtgccttcggattatgacggttcggatagcgacaaagccgaaaacagcttcgacaaatactacgagaaagacaaggccggtgccgcgcccggcacgaagatctaccggctgtccggccctatcgaccgggacgcgcccacgttcatggaatatcacgtcagcgccagcaagatgcttggtgcagcacatcagtgcggagtgagcctcacctcctacctcatcgccgcgatactgtgcgcgattcgcgacgtcatgccctcgcgcgcccgcaatcgcgcgattcgcgtggatattccggtcgacttgcgcgccttcttcaggtcggagaccgtgcgcaacttctacggcatgacttacgtggcgtacacgccggccgatatcgaagccgatgaggactccgcgaaaacttccgcaacgggcccagacgcgaccggcgacggccagcagtccgccgcccgcaccgcgcacggcaacggtatgggtgggttgctgaccgatgagccgttggccgacatcgcccgccatgtgcaggagcagctcggccatgccaccagtcgcgagcgcgtcgaatcgcatatgaaccgcatgattgcgctggaaaagaatccggtgctgcgtctcgcgccctcccctgccaaggactgggtgctggagctggcccggttcatcaccgaccgcgaaaccacgaccaccgtctcgaaccttggccgagtcaccttggacgaacgactcgcgcgccatgtgcgttcggtgagcttcctcactacaccggccagccttaatttcacggtctgctcgttcggcgacgacctgagcatcggcatctccaccatctaccatgatctgaacgtcatcaagaacctgtgtcggattctcgccacgcagggcatcagcggccttatgaacatcgctggcgtgcatgtggagaaaggagcgtcggcatgaagcattgcgatgcctgcagcgtcgatttcaccggcgatatggcccgttgcccgctctgccagaacgaattgcacggcgaggcctctcccgccgcattccccgcgcagcagatctatctgcgtccgaggcgtctgacggtggagatcatcacgttcgtcgccggtgcgatcctgttgctgctcgggttcttcgcctatctgtggtcgtggccggcgccgatcgtcggcgcttcggcggccgcgctgatcatcagcgtgctgttcgtcaacagtgcgattctgcacgcgccacggccgcttcgactcatgtttcgatatttctatatcatgctggcgattgcgctggtctggtttgtcgcgacgatgaatcatgtcgtcaccatgttcgtcataccgatcacgtgtctggtttcgctggtctttgacgtggtgctgcttatcgtgctgaggaccaaggccattgaccagtacgccaagtatctggcgttcgacatcgtcgctggtctgctgcctctgacgttcattccgctcggctgggctccgtgggatgtgctggtgatggtcagcgggctggtctccctgctgatgctgctcggcctgctcgtcttcgcccgccgtcagctcttctcggaattcggcaaacagttctcggcctgattgcctcgtgcgctcaatcgcccgatttaggatggaaaccatgagcgaacatgtggagcatgggtttgggccggtgtgggatggcgagtcgcgggtgctgattctggggtcgatgccgagcccgaaatcccgaaaagcggcgttttactatatgcatccgcggaaccggttttggccggtgttgcaggcgctgtttgccaactccgctgatcctactgacgctgtcggcgatttacctgagtcccgtcgtgcgtttgctctgcgccaccacattgcgttatgggatgtcattgcttcttgcgatatcaccggagccagcgatgccagcatccgcaatgccgcgcccaacgacttggcaccaatcttgcgcggcgctccaatcgcccacatcttcacaaccggcgcgaaatcagcgcaactttaccgcaaacttatcgagccgcgcctgaccgaagccggtatcgccatcggcatgacccaactgccctccaccagtccggccaacgcctcaatgcgtttgccggaccttatcaccgcctatcgcgaagcttttcaaaaggcaaacgtgctagagaatgcgtattggaaaaactaagcatggcgaaaccatcaatctcggacggcaaacccagtatcacgaatcctatcttgcatttcattggcaatagcaatacagcgcgcccgcgaaataccagccttcacaccgacactagccaaatccgcaatagtgatgttcttccccttaccattaaccgaagtggtgtgctcgccgtttatcccgggattctctgtcaaatcatatccaggcgacaatctccacgcttggcgagaacgatcatagagataagagaaattcttcgcatgatcgtcgcggtttccgatgagcacgttaaagcacatgagacggtacaaccgctcgcattcctctgtactgttgcaaacacgcatagtcagccgcatcaatagtccgtaatccaaattgggaatacgatgcgacgtttccagcaatccgccggcggaaatcatatgcaccttatgttcggtgccatcgtcatcccgtgtacggtcaaaccgccggacaccgaaatatccagaacattgcgctgatgcgaacaaacgagtttccggcatatcaatgccgcactcgcgcgcaagtacagaaatttgatactcctgttctccgatattcgccgagtctacggatgaggggaatttgataatccattcttctccatcaacctcagtcagaattttcggccgcgcgccaccggacgagccaccaagtgcaaaaagctgatccaaatcctcagaaaaatcagtttccagaagattcgcgcactctctcgctatatcgtccaagtcggtagctgcaacgctattttcaataaccgctgctggttcatattccaaggctcccatgccgcttgatcccacaatggacagcctcgtcaaggttccgatagagtaaggatctattcctctctggcgcagaagacgatccgtaagcaaacgcccccacccgtctggcatactgtcatcgaacaccccaaacaaaccatgcaatggatctcttttggcgacaaagaccccctcacgcaatggcagactcagcggacttatgctgaatccactggacaaccacgagctttcgtacgagaacgccactgtttttgccggcgacagcgtcagcgagccaacaatttcaccatccaaaaacacccgtacccgatcaaccgataaatccaacggtactgtctcgctcatcgcgcttccctctcccgcgcagcaatgacatcatcgatagttgcatagtacggctgtgaaaacagtgtctcaaaatcctgctcgcaactcagcacaaacgcgatattgatgagcgccgtcaacgaaatttcgtgctgctgctcgaaccgtctgattgagccaagactcacaccggattttctagccagagccgtttgcgataacttatgctctttgcgcctggcaaccatgcgttcggcaatcgcagccgaaacatccccaggcataggctcatctaacaaagaaaacatactaatatactagcaatttcggcccaagaagccaataactactcatattttagtagttatcgattgcggcaagtttcacaggactacaaccggcgtgtcgcagtagccgccaatttgcgtccaagcggggttgagctgcctcaataagaattgttaacgctcacgactggctatggaaagacggcggtggcgattggtcagcaaggagcacatatgcagtatcgcaatgttggcaagtcgggactgaggatcagtgaggtcgcgctgggcagctgggtcacggatctcaagggcatagcggccgaggatatggccaagtagaccgtgaagctcgcctacgattccggcgtcaacttcttcgactgcgcggacgcttactcgggcggcgccgccgaacgcttcctcggcgagacgctgaagcagtatgagagacctggtcgcccagggcaaggtgctgtactacggcgtctccgaagagtggggttcggctcgcctcgaggaagcccggcgcatcatcgaccgctacaacctgtacccgatcaccgtggttcagccgcagtacaacctgaacgaccgttacatcgagcacgagatcatgggcacctgccgcaagctcgacatcggcatcatcaccttctccccgctcgcacagggtctgctgaccggcaagtaccgcaagggtcagccgctgtcggccggttctcgcgtcacgtgggctgacgaatctgagatttcctccaacgggagcgattgttaagcaccgaaatcggtatcgccttgggcctcggcctgggcgatggcggtttcggcgttttttgctgtttgcttgatgacttggttgtaaccggtcagggccgcgaacggcatgaactgcgcggcccgctggtggcgggacatgtgcggatgcttgcgcgactggtgatggggcaggttgatgatgtcgtcgtatgcccgggtctcttgcagggtcatgcgcgatggcctccgatctgacggttgcggtcctgaccggtggcgccgtcttccatatccatggctttgatgacggcgttgcggccgaatttacgtttcacatccagcagcgcacgctgaatatcatgctctcgagccaacgtctgtgcggcggcatcgtccccacaagccggcatacgcccgcttccgtcgccaccggattccgtgctatcacagtcatatcgcatatcgccatcatcaccgaacaaatcaagctgctcatagcgtttgcccgccgccagttctttgggcgtggccacatcatcggcaacaaccgtgagtcgacgcaccagcaaccgcgcatccacaatacgctcgtacagcatggtcatcgcctcgcgaatacgtgcggcagacgacgtaaaatcacccaatccaatcgaccccacggccgacttaggcacccgacgaccgaaacggtcaacggtcaccggcccttgataggtctttgccgcgcgttcggcggcacgcctcatcgcccggtctgcgcatgaatcaagcttcgaagcatcgagactgccaatgtcatagccgaccgccagtgtcagccgattcgtcatcacccccttatcgaccaaatcgagggcgagcgcatcggccatctccttggcgatcagccgagccgtatgccaatcggcgggcccggtgagcacctgcccgctgctgatgctgtgcgcacctggctcataggatcggatatctgcgatttcgcacggctcccagccccacgcatggtcgatgagcagttcggcattgacaccgaacatgcgatacagcaggtcttcgttgtagtaatccgaagcacgacccaccgagcatcgggcgatatcccccatggtcgtcaatccggcgcgctcgagttttcgggcatatccacgccctacccgccagaaatcggtgaggggacgatggttccagagcagccggcggtatgacatttcatccaattcggcgatgcgcacgccgtcgcgatccgcgggcatgtgcttggcgacgatatccatggcgactttggccagatacatgttggagccgatgccggcagtggcggtgatgccggtttcatcgagaatttcgcgcacgatggttcgcgccatggcatgcggccccatacccagcgagcgcagatatggcgtgacgtcgatgaacacctcgtcaatcgagtagacatggatgtgctcgggtgcggcgtatttgaggtagatgccatatacctgcccgctgacctccaaatagtgcgccatgcgcggcttggcgatgaccatcgaggctttgagtctcggcgagcgttccaggtcgcgcgcatcgcaggactccccgattaatcggccgccgggagcatggaccgcgcgctcgatgttgactccattcaggcgctgttttacctcgaatagccgcgcacgaccgggaatgccatagttcttcagcgagggtgagaccgccaaacatattgtcttatcggtgcgggtttcatcggccaccaccagatgcgtggtcaacgggtcgagtccgcgcgccgcgcactccaccgaggcatagaaggacttgagatcaatggcaatataggtatgctcgcgttgcgtcgataccgttccgctgcccatcgccatcacctccttaccaccgccgtcccggccagcatatcaatacggtcgaacatttgttcgatgcaacatgcctgttcgaagctgccgaagtcgacgcacgcaacgcgcccaagcatgctcttcacccacaccacacacgcagcggcagagcagcggcatgcatgcgtaccatggggaatatgaagaaaagcattacggcagacagcgattttgcggcgtgggcggcagcccgatcccagaaaacgaatcgatcactggcaggagcccgcctcgcgattccggagccgcaggagcatgccgaaatcaagtttcaggcccagcaatggggcatgaccgtcgaagatgccacgatgactgacgggcacagcgaggaattcctatgtgacggcacacaaagcattgattccattgccgacatgcgcacggcaagtgggctggaggcaatggagtacgcggaacagcacatgccggtattacgcgacaccatggatgacctcaccacccgcgtcgatttctcaggcattcgtattgccgtctgcctgatactggagccaaaaaccgcgattctgctgcgcaagcttaaggccgccggcgcaatcgtcggcgtatattgcggcccggattccacggatccccgagtggcggaacagctgcgccgggaaggaatcacggtcgaatccagccgagcctggaccgcggaacaggcgcacgaggcagccctgcgcctgctggacaagatacagccgaacatcatcatcgacgatggtgccagcttcgcccgtctcgcctcgttcgaacgccccgaactcacggcgaacctcattggagtggccgaggaaacgaccagtggcgtacgcgcgttccagcagatgcaggaagcgggagcgctcacctacccggtcgtagccgttaacgacagtgtgctgaaaaccggattcgacaacgcccacggcactggggagacatgcgtgaccaccatgcagcgcattctcggcgagcatgcattcgacggtaagaacgtcaccgtcatcggctacggcccggtcggccaaggcttcgcacggcgtattcgcgcgcttggagccgaagtcaccatctgcgatatcgatccagtggcttcactcaaagcggtgttcgacggcttcgccgcacaagacattgacgaggcactcccttgcgcggatatggtggtgtccgccactggcgtgagacatacagtcacacttgagcacatgcgcgcaatgcacgagggcgcggcgctcgcagtgatcggcggcatcgccaacgaaatcgccttggacgaggtaagcgacttcaccccacaggtcaacagggacaccgcgcaactcattgttcccgacggaccaacgctcacgctaatcgccgacggcgatggcgtgaactacacggtgggaggcggcaatccaatcgagatcatggatctgagcttcgccgtacaggccagcgccgtcgcatatcttctggaacatcgaggcacactggatcacacgcttatcagacttgacgcagcgaccgaccagcgcatcgccgccagcgcgctcaaggcgcgcggataccgagccagccatgccgtggaggacaacggctacgattggcgactgaccagattcgcggaaaacgaccgagagaacgccgaccgatagccatagacacggcaccgaacacaacgcagcgaggagaatatgaccgacaacacctggccgaccgtcgataccgagcttatcgatgatgtgacactgtattctgccaaactcatcatccccgtgacgggccccgtcatcatcgatggcgcagttgccatacatggcgaccgcgtggttcatgtaggtaaacgccgctgggtgctggaggcgctgaagcaggaaatgacgtctcacggcaccatccgtgaacggcattgggatggggtgctcacccccggattggtcaacgcgcacactcatctgcagtacagcggcatggtgcaggtcgggcaaggcacctacgatcggttccgcgcctgggaactggcattcaacgaggtgtacgccgaggcgcagaagacccagccatggaagcagtgggccgaggacggtgctcgccagatggtcgaatcgggaacgacggccgccgcagacatcgtcaccgatttggacgccgccggcgcgctggcttcgcagggcatgcacggcatcgcttattgggaggtaatgggctggcacaacgacgaatggatggaaaagggccgcaccgagctcatccggcagttgcgccggatgaacgaggagcagctgccgaacctcggcatcagcccgcatgctccgtatacgctggagtccgaaccgttcgttgatcttccagacattgctcgtcagctgaacatgcgactgcatatccatctggcggagaccccgctcgaggccggcacttatccgccggtgctcaccacttattcggcgtccgactggcgtgaccacgattgggaaagctaccggcagctcaaagacgtgggcaaaggtgcctccgccatccagttcgtcgatcagcttggctcgcttggcccggatgtgcacattgcacacggcgtgtgggccaatggcgaggatcggcgtattctacgtcagcgcggcgtgggcgtggccttgtgcccccgatcgaatcgcattaccaacaccggcaaagatgcaccggtgcgcgaatacctcgaggaaggtaatctggtaagcgtgggcaccgattcgctctccagcacgccgaccctcgatctgcttgatgacgtgtcgatgctttacgacctggcccgcgaacaaggctatgccagcgacgatctgacacatcgcctgattcgtatgatgacgctgggcggtgccgcctccatgggtatgcacgtgggccgaaaccgcattggacagatcaacgcgggcgcattggctgatttcgcgttcttcgacatccccgtcgacacatcatctccggccggcatcgaagaaacgctggaaacactggtgaagcacggtgcaggcacgaaccgagccacggtgatatccgggcgcgaagcctacaacaacgtctggtgacaccgctgacccgacctgatatcaagaagccaaaaaccagcaaacccgccaagaacaggagatctcattatgagcgtcgctttgcgagacatgagtccatacgcccggtccatagtggaacgccttggactggaagcccaccccgaaggcggctggtacacgcgtgactggcaatccccgcacacggatgaggcctcaagccgaccgctatcgtcactgatttacttcctgctgcccgagggagatgccagcacctggcataaggtcgatgcggatgaggtctggctgtggcatggcccggcatcggtcaagctggaactcggcggcagcggcgagactccggaatccgacgaatccaagcgaaccgtaatcaccctgggttccggcatcaccaccgatcaggccgacgtaaccgtatcgggacatgcggtcgtaccggctggcgtctggcagcgcacagtgcctggccagggcgatgcgctggtctcctgtgtggtcagtccgggattcgtattcgacggcttcacactcgaacagtgaacgccatttcgctctgcgccaatatgagatatccgttcgcttacgcgccagattgcgcggctctagccggccataagcaatggagataaccagcatccgagaatatcactgttttgtagtaacccaatagccatacaattggcgcgcatgcatcaagcacgactttgaaccgtgtgcatgacgaacacttgaggagaggaagcccatgttcaataagcaacacatcgtccgtaccattgcgtccaccgccagcatcctggctctgtcgttcaccgcagcctgcggttccggccagtccaccgcatccaattccgccgattcgaacgacatcacccagcagacgtacaagccgggcaagctgaccatcgccaccggacagccggcctacgagccgtgggttatgaacgacaagccggaaagcggtgagggctacgaggcggccgtcgcctacgcagtggccgacaagctcggtttcaagaagagcgacgtggtgtggacccgcaccgcattcgacaccgccatcgctcccggcgccaaggactgggatctcaacatccagcagttcggcatcaccgacgagcgcaagaaggccgttgacttctcgtccagctactacaacgacagccagtccgtcgtggtcaagaaagacagcaagttcgccaacgccaccaaggtatccgatctgaagaatgcgaccgtgggcgtcatggtcggcacccttgcctacgactacgccaaggcgaacatcaaggacgacatccagacgttcaatgatgatgccgcactggctcaggcacttgacgccggtcaaatcgacgcactggtcaccagcaccgtggaatgcgtgtacatggtgcagtccgagcaggtcaaggacgccaaggtgctcggccgtctgcctgactccgaagacaagagcggcatgggcatcgtgctgccgaaggattccaagctaactgcagccgtgaccaaggcagtggatgacctgaacgccgacggcaccatcaagaagcttcaggacaagtggctggccgagtacaccaccgacctgaccgaactgaagaagtaagtggagtaggctcacatcataaggtcacaacaccttggccggacgctgcggaaattttcctgtgacacccggccattccggcattcaggaagcgagcgacattcatcacatgaccgcagcaccaaccgaaaccaggcagcacaatgcccctgacggacacgaggtaagtcaggtcgagctcagacgacgccaatatcgtgttcatcagcaaattcaatcgacgattaccagtctgatcagcaccattgtgttcgttgtggtcatcgtcatcggcctgaagctctcccccggctggccacgagtcaaggagaccttcttctccggcgaatacttcgtcaaatcgtttccccatgtgcttgacggcctatggctcaacatccgcgttctgctcgtcgcagtggtcggcgtggcgattctaagcacgctgatcgcattggtgcgcaccagccgctcccctattctgttcccgctgcgtatcctggcattgatctacacgactgtgatgcgcggcgtgcctattatcgtcgtgctgtatctaatcggtttcggcattcccggcctaggcttgttcggccgtatcgatccctcggtactcggcaccattgcagtggtaatgggatacagcgcctacgtctccgaggtgctgcgtgccggttttaacgacgtacatccttctcagcgagcctcggcccgctcgttgggcctgacctccggccagacgacccgactgatcgtcattcctcaggcattgcgcaaagtcgcgcccgcactgatgaatgacttcatctccatgcaaaaggacgtcggcctgatttccgtgctgggtgcggtggatgccgtgcgcgccgcacagatcgacgtggccagcacctacaacttcacgccgtatgtggtcgccagcctgctgttcatcctgatgagcgtgccgttcatcctgctgaacgactggtacacggaacgtctgcgtaaacgcgaactcagcggaggaacggtatgagcggaataaccaatatcaacaccgaggcgagtgactccccgtgagcaacaagacggtgctgcgtcttgatgacgtgcgcaaatcctttggaaacacgcaggtgctgcgtggcatttcctttgacattcaccaacatgaggtggtggctttgctggggccttccggttcgggcaaatccacattgatgaaatgcgtcaacctgcttgagcaggtcgatgacggccagatttggctgggcaataccgatatcaccgacccgcgtgccgatcaggacaagattcgcgcacgtatcggcgtggtgttccagcagttcaacctcttcccccacatgtcggtgctcaggaacgtgacccttgccgcaatcaaggttcaccactggagcaaggatcgcgccgaaacccgcgctatggaactgcttgaacgcatcggcatgcgcgataaagccagcgcctaccctgatcagctctctggcggccagcagcagcgcgtggcgattgcgcgcgcactgatgaccgacccggaactgctgctgcttgacgagatcacatctgctcttgatccgatgctggtcggcgaagtgctcaacatggttgccgagttaaaggcccaaggcaccacaatcctcatggccacgcacgaaatgagcttcgcccacgacgcggccgaccgcatcgtactgctccgtcacggcgtcatcgccgagaacggcacacccgccgaggtgatggacgagtcgcaggatcccgagaccatcgagttcttcagccatttcaggcactgagacgaagccgaaaaacaaacaccggattcatacgacgaaaggccaaaatcctaagccactattcatactcaactgatctggtgcttaaaccgcgtccgcgaaccccaacaagttccaccaccccacaacacgcgatgtagccgccgattggtagggttggcagatagttaatcccctgtttgaaaaaggagctttggcttgtcggctgaactcgaagacattcatgaggaatgtggcatcttcggcgtatggggccaccccgacgcctcacgactcacctattttggcctgcacgcgctgcagcatcgcggtcaggaaggtgccggcatcgtctccaacgataacggtcatctcatcggtcatcgcggactcggcctgctcacccaggtgttcggcgatgagcgcgaaatcgaacgactgaagggcaattgcgccatcggccacgtgcgttacgcaacggccggctcgggcaccacggacaacatccagccgttcatcttccgcttccatgacggcgacgtggctctgtgccataacggcaacctgacgaactgcccgtcactgcgccgcaagcttgaagacgaaggcgccatcttccattcgaactccgacaccgaagtgctgatgcacttgattcgccgttcgatgcagcgcacctttatggacaagctcaaggaagcgctcaacacggtgcatggcggtttcgcctacctgctgatgaccgaagacgccatgatcggcgcactcgacccgaacggcttccgcccgctctccctcggcaagatgaagaacggcgcctacgtgctcgcctccgaaacctgcgccctcgacgtggtcggcgccgaactggtgcgcaacatccgccccggcgaaatcgtggtggtcaacgaccacggctacaagatcgtgcagtacaccaacaacacgcagctggccatctgctcgatggaatacatctacttcgcccgtccggattccgacatctacggcgtcaacgtgcactccgcccgcaagcgcatgggcgcgcgtctggcgcaggagtccccggtcgaggccgatatggtcatcggcgtgccgaactcctccctgtccgcggcgtccggctacgcggaggccgccgggctgcccaacgaaatgggtctgatcaagaaccagtacgtggcccgcaccttcatccagcccacacaggaactgcgcgaacagggcgtgcgcatgaagctgtccgccgtgcgtggcgtggtcaaaggcaagcgcgtggtcgtcatcgacgattcgatcgtgcgtggcaccacctccaagcgcatcgtgcagctgctgcgcgaagccggcgccgccgaagtgcacatgcgcatcagctcgccgccactcaaatacccgtgcttctacggcatcgacatctccaccaccaaggaactcatcgccgccgagaaaagcgtcgaggagatccgcgaatacatcggtgccgactcgctggcctacctgtcgctggacggtctggtcgaatcgatcggcctgaacgccgacgccccttacggaggcctgtgcgtcgcctacttcaacggcgactaccccaccgcgctcgacgactatgagaccgacttcctgaaatccctcacgcccgaagaccgcgtgcgcctgcccgaattcgcgctgtacaagagcaagtacatcggcaacgaatacaacaccgtgcagccggaagccgaatagctcaccaccaatccactcaataacaattctttgaaccagaggcgcttgcctcccctcagtcggctttgccgacagccccccctccagaggggagccaaaataagtagaaaggccaaccaaatgccaaaagcatatgagaacgccggcgtgagcgtcgaagccgggtacgaagtcgtcaagcgtatcaagtcgcacgtggcccgcacgaaccgccctggcgtagttggcggtatcggcggtttcggcggtctgttcgacctggcctccctgggatacaaggagccggttctcatctccggcaccgacggcgtgggcaccaagctcatggtcgccaagctggccaacaagcacaacaccatcggcatcgactgcgtggccatgtgcgtcaacgacatcgccgcccagggagccgagccgttgttcttccttgactacatcgcctgcggcaagaacgacccggcactgcttgagcaggtcgtggccggtgtggccgacggctgtgtacaggccggttccgcgctggtcggcggcgaaaccgccgaaatgccgggcatgtacgacgaggacgagtacgatctcgccggattctcgatcggcgttgccgaaaagtccgccatcgtggacggttccaccatcgttgaaggcgacgtgctcatcggcctgccctccaccggcgtacactccaacggcttctccctggtgcgcaaggccctgttcgagcaggctggctacaccgtggacaccaagctcgacgagctgggcggcgaaaagctcggcgacgtgttgctcacccccaccaagatctacgtcaaggccctctccccgctgttcaaggcgggcgtggtcaagggcgtggcccacatcaccggcggtggcttcatcgagaacatcccgcgcatgatcccggacggcctggccgccgagatcgagctcggcacctggcctgtgctcccgattttcgacgtgctggagaaggctggcaacatcgatcacaaggagatgtacaacatcttcaacatgggcatcggcatggtgctggccatcgaccccgctcgcaaggacgaggcgctgaagctgctcgccgataacaacgagcccgcctatgtgctcggccagatcactgccgacaccaccggcacgcaaatcgtactgaagtaactcgctttccgcaggaaaggaacaacatgggtcagaaagtattggttatcggctccggtgcgcgtgagcacaccattgcctacacgctgctcaaagcgccgagcgtcgatgaggtcaccgtggcgcccggcaatccgggcatggtcagggacggcatccacatcacgcagctgagccagtcgaaccacgccgcacttatcgaattcgtgaagaataatggctatgactgggtgttcgtaggcccggaagtcccgctgatcgaaggcatcgtggacgatttcgccgccgcgggcatcaaggcgttcggcccctccaaggccgccgcccagattgaaggctccaagaacttcgccaagcagctcatggagcgtcatgacatcccgaccgcccactaccagaccttcatcgacctggagatggcgcaggcgtacgtgcacgagcatggcgccccgatcgtcatcaaggccgacggactggccgccggcaagggcgtgaccgtggccatggacgagcacaccgcccagcgcgcgctcgaggacatcttcatcgaccaccgcttcggcgtcgccggcgccaaggtcgtcatcgaggatttcctggaaggtcaggagttctccctgatgagtttcgtcaacggcaccgatttctggccgatgccgatctcgcaggatcacaagcgcgcccatgacggcgacgagggcccgaacaccggtggcatgggcgcctacagcccggttccgcagattccgcagtccgtgatcgacgaggccatcgagaccatcgtgcgccccaccgtcgaaggcatggccgaggaaggcacgccgttcaccggcatcctgtacgccggcctgatcgccaccgccgacggcccgaaggtcatcgaattcaacgcccgtttcggcgacccggaaaccgaagtcgtgctcccgaagctcacctccgacctcggtgccgccatcgccgccatgctcaacggcgaaacccccgaattcacgtggaatgagtccaacgccaccctcggcgtggtcatcgcctccaacggctacccggagaatgtcatcaagggtgcccgtgtgcccgaaatcgaggtcgacgagaattcgcatgtctactatgccggcgtcacctccgacgacaagggtggcctgattgccaactccggccgtgtcctgctcgtcgaaacctccgccccggacatcaagtccgcccaagacaaggtctacgcgatcatcgacacgctcgagctgcgcggactgttctaccgccacgacatcggtttcaaagccctgaagtaacagaagcggcgcatctgccgcatattttggcccggtggccatgtcaatcgattgacgtggctaccgggccagatttttctgtcccggtagccgatttcggctctttttcgcaaaccaggacagttgaacacctcgaatataggaatatttggaattcccttccatgcaaaaccgcactattccgccattttcgtaatacgcggacgatactttcggcgtcagttttgtcccggtaagcagaaaatgactcgaaatcaaataccaggacagaaaaatctggcccggtacacgaatcaatcgattgacgtggctgccgggacagcgaacgtcactatgacaacgccatcacccaatatcagcgagcgatatcatgctagctgaatttggcgatgatgttgaacagtttggccttggcttcattgaagggcgggtacacgaggcgcagagtgtcggggaactgcggcttggtaaccacggttttgacgtggctgaaggtgaggaagccttctttgccgcggtaggcgccgataccggaatcgcccacaccgccgaacggcagtcggctggaaagcagatggcctaacggcagcgagtatccaagagcaccggaactggtctgacgttcgaaagtcagccgcacctcgtgatcgcgcgagaacacgtacgcggccaacggtcgagagcgcttgttgatgaatcggattgcggactcggcatcctcgaccaccagaatcggcagaatcggcccgaaaatctcctccttcattaccggcgcatctggcgacgtgccgtacagtacggtgggcgcgatatatcgggcggcgcgatcgaccttgccgccgcaaatgattcgaccggccgggtcgaacacgccgggcaccttgtgaatctcgctcggctcgacagcggccgaggcagtcgcatcactatcagcggctgccgtattcgaaccggccgccggcttcgccgcattgttcgcgctaccggcaccgccaccggctgtctcccccgcgcttccgcgtccggcagccacgacattgaagcgccgcccgaccatatccatggccgcgcctaccgccgatgccacctgcaccagcggcgagctcggctcctcaggcggcacggtgccgacgggcagtagcttgcacagtcgttcaaaatgacgatcgttgataatacgaccaaaatcaggcgaggctttcggatcttcaccatagaattcggtgatggatacggcgatacgttcagccagagcctcggccacatccggcgtggcaagcacatagtcgggtgccacacatgtctgtccggcattggtgaacttgccccatgcgatacgtcgtgcagctacattgatatccaccgtatggtctacgaaacacggtgatttgccgccaagttccagcgtgaccggcgtcaggtgcttggccgccgcccgcatgacgattttgccgacgtggccgccgccggtgtagaagatatggttaaactggcacttcagcagttcgccggtttccttgggaccgccttcgaccacgcgcacggcctcggggtcaaggtactgcggcacgagttcggcgataagacgcgaggtattcggcgaaagctcggagggtttcagacagatggcattgcctgcggctagcgcgtcggccatgggctccagagccaacagcaccgagtagttccatggcgagatgatgagtaccacgcctttgggttcggcgatcgtccagccgactgcgggctgcagcatccaatgcattgccttgggatggcgagcggcccataaaccgagccgattacggacgaacttcgcctcgctggccaccagattgagctccatcagtatggtttccgccgcgggtttgcccaaatcggccatggccgcggatgcgaaggcgtcgcgattgtccgttaccagccggcgcagcgcatccaattgcgcccgccgccaagccaacggtctcgtgcggcctgattcataggcgtgacgtagccgggtgaattccacattgaccatgacgcttccttcccacacacccccggaatggtcttcccgggtgccgacctacccatcgtacgtcatcgcgcccgcgtcccgccgtcgcgccggcgcgcgccgcccgggtttacggcaacgtcatgaaatcagtgtctttgaggtagtttttgccggcggtgatgtcgtattggatgagcttgtagtcggcaagcagctgcttggtttccttgtcgaagtcatcggtggacatcgggttgccgttctgatcaaggtagatgctctggccttcggggatacggtcccagccttggatcttgttgaccacgggcggttccatggcggcgatcttggaatgcatctcggttaggaacgccagatacgggctgaccttggcgttcatgtgatcggcggcctgcgccacgaagaagttcggcgaggagtaggctgcatcacttgctttattgccttgggaaccagaggccttgttcgaccagatgaagtaatcggtcaggtgcagggccagggagttattgtcatcctcactggcggacgagtagatgcccggcaagtggtcgccatagaacaccacggtgacgggcttatccagcgcatccagttcattcaggaactcctgagtggcctgatcggtaatctccacacccttttgataggtctcaatcgactgctgttcatcatcacccagcggcgtacccgtggtggattcggcggtgtagtcgttattctcataccactcgtggtatggcatgtgattctgcatggtgatgatctggataaatttgttcgtcttgccggacttgatgccttccagcgcagaatcataggaagacttatcagaaacgtacggcgactcgtcgatcttgtcctgatacttgatcacgtccggaccggtcaacgtgtagaagtgcgagaagccgaacttcttgtagttcgtggcacgcgagtacatgctggattcgtacggatgatagccgagcgagttggcgggcgcgccccacatctggttgatggtgggggtccaatgctggctcgggaccagctgctggtacgggctggacagggaggaatcgaaattggccatgctcaggccggaaagtcccatgtattcgaggttggccgtaccgccgccgtagccggaggagagcatcaggccggaggtggtgcccgccttgatcttgcggatgttgggcatcgaatccttgctggtcttcagtcccggcacgcggctcgggtcggagaaggattcggacagcacgtacaccactgtcgaatcagtaagattattggtgcgggaggcgttgatcatctccgctttcttctggtagcgagcggcgaccttcttcatggtctcctcggagtagttgctcggcttgtccatgatcttcgggttgagctggcgggtaaaggctacgagcggaccgttgcgctgcgcgtcatacacggaatcccacatggatggcgtgtctcccaaggcgcgggagaacttgttggccagcgaatcggtggtgctcacatgcatgcagtacaacgcgaacaccagaatcggcagcagcaacaggatcagacgggacgtgaggttcaggcggcgatcatccgtttgaatcatgcggcctttgcgtccgtcggcgtaccgcagcgccaataccgggacgagcagcacggcgaacacggcgagcgcgatgaggatggtcacgtgcgcgccggccggggcgaaggtgagcatgttgccggtattggagccgaggaacccgagatcggcgggcaggatggcctcgtagcggatctcgattttgaaatgctcgatgacggcgacgatgatcccggccgcgagcatcacgatgctcgacgcccagaaccggttgagcagcatcaggagcataaggtacagcagcgcgacaagtatcatgttgagcgcgaacacgaagttgccgtcggtccacatcttgctcacgaagccgaatccgacggtcggactggacagctgcacgcgggtggagcttgccgaaacaccgacttcgagcgccgtcacgacgatgatgtcgaagataacgaagagcacgccgtacacccagccggggaagggcttgtgggggtgctggggcgtgacttcattggcttcggcctttttggcccaaagcttgaaatggggtttcactgtggtggtggtactactagtgttctcgctcattcgcctgtttccgtatgtgccttttcaagggcatattgttgccactgaactttggaaaatccatagttccactattttcttaccgtttcctaactattcaccctaacgcaaagggtgcctcgggacatccccgaagcaccctgatatataaggagccttccctgatagcgaagtgttctgttctcccctagacaacgcctcgctatctgacttggctatttcccttatcgctgttgcggattgccagctactgccgcattacttcacggcggcggcgaactggtcgaccagcgcgctcatccagtcgagcaggttggtgtactgcttcggcatctgctcggtgagctccacgatcggcacgctggcgtccttggcggcaccggtgatctggtcagtggtggaggtggcttcctgactgttgaagacgagcatcttgatggagccagccttcagggtgtcctggaagtccttgatgtcggccggggtcggctcgctctcgttggcggaggcctgggcgtagcccttcggggtgacgtcggtcatcttgaggtcgtcggccaggtaccaggccacggattcggtggcggcgtacggcaggccctcggtcttggcggaagtctccttgatcttggactcaagctggtcttccttggcgtgccaatccttgttgagcttggcgtagtcgtccttgtggctcgggtcggccttctgataggcggcggtgatggcgtcggcggtgctggagcgcaccttggcggagaaccagacgtgcgggttgtcgccttccttgatgccggtggtctcggcggcggtgaccagcgtggccttggtcgacttggcggccttggtggcccacgggtcgtagtcggcgccattgactacggctaccttggcagtgccgaacttggcgacatcctggctggtgggctcgtaatcgtgcgcctcgacgttggtcttggccatgatgttggtgacttcgacgttgctgccgccgaggtcttcggccacggaaccccactggttgatggaggcgacgacctcgatcttgccggaagacgcggcgctgctggaatcggacttgctgccggcggcattgctggaaccgcaggcggccatcgagaacagggtcgccgaggcggccgcgatggcgagcgcgcgcttggcgttggacatgatggacatgattggattttcctctctaattcagctgtttggccgggcgatgctgctgttgctgcatcatcgcccggcccccaacacgacagaataacatgtattgagaattattatcatttgcatttacgtcggcgtgttgcacgcgcacacccgcgctgccggcggaaatcccgcgccccgacgatgacaacgcgggatcccgccgttttcggcagacgaaacggcagtatccccgcgtccgaacgatacccgcgcgggggttctgccatttaaggcctcggaaacgacagaaatcccgcgccaccttcgttcggacgcgggggttctgccgtttgccgcacatgtcacaacggcatcgcggcacagaccgacgcctgcaccaggtcgacgagccccacggtgtgggcatcctcacagaccagcgcatcacgcaaggcgattgcacggatgatgtcgcggcaggcgcactccccgtctgtatccaaatggcgtgccaggcaaccggcaccaatgaccggcaattcgagcacgcacgaggcctcacggatcaggcgggagaccactacgccggtcgaacgctcgtcatagacgccgttctcctcgcccatgccgtacaggcacaaacggtcgtcgtcaaagaatcgctcttcgaattcgtcaaggcctacggcattggccaccgcacccacgaacatcgactcaccccactcgttgagacggaaggaatcggccagatactgcgcgaccggcgtggcctcaaggcccacaggcagcgagaccagaaacgcgccggcccgcccttgcagcgatccgagcgtccgttcaaggtcatgtttgaccgtgcagctcatgcagcacccctcgagcccgaacgaatcggactcgccgaacaccaccccgcttgcctggggcttcgcgacgttgcgcacgatatcgagaccggattccacggcttcgttcgggcgcacgtcataagcaatcgagcatacggatgggaaggaatcgaccaacgagaacgtcacggagtccaggctcaggcggtcggcgccggtgagcagcaccacgggcgtgcgcccctccgcgtttccctgtgattgcaatgccggatgaatcatgacagcctttctgatttgataatggttatcattatgatatagttgcaggcatgtccaaaacatgtcaaattctgggaacacgcgccggggtcggcaaccgcgtctcccactcgcacaggaaaacacgccgaaccttcgccccgaacctgcagtccaagcggtactgggtgccgtccttgcagcggcacgtcacgcttaccgtgagcgccaagggcatcaagaccatcgaccgcatcggcatcgaggcggcgatcgcccgcatccgccgcgatcagaacgtcaactgaaccggccacggcatcacccccatgctcgggcagtcagtaggcccgccactgtgccggcgcgtaaccgcgcaacaaaccgcgctaacgagctgcatcacccacatggcaccgcgacgtacgcgacatacgtgacataacagcgtgacacccacacatagaaagcaccactcatggcaagcaaatcctccgcaatccgcccggtcatcaccctgaagtccacggccggcaccggattcacctacaccaccaccaagaatcgtcgtaatacgccggaccgtcttgagctcaccaagttcgatccggtagtccgcaaacgggtgctcttccgagagacccgctaatccatctgttcgttcattggacaccagtcgcgaggcgaggaagaggcttaagcacccgccgaaatcgtttccttgttggcattccggcggtttcctctatcaccatttcatgaactcatcttccgaaccttgcggcatgcgcccaatgaacgaatgcactcgtcccagctccggccggcgcgattcccgcgccccggagccttatcaaggagccggacatggccaaaaccagtaagatcaaccgacaattgcagcgcgaacgcatggtcgccaagtatgccgaacgccgcgccgaatacaagcgcgacagcgtcaaccctcatctgaccgccgaagaacgcgccgaggcgatgcgcaagctgcaggccctcccccgcgacgccagccccacccgtctgcgcaaccgcgattccatcgacggccgcccgcgcgcctacaaccgcaagttcggcctgtcacgtatcaatctgcgtgagaaggcacacaagggcaaactgcccggcgtggtgaaatccagctggtgatcaggccgtctcaggccatctcaattcaccggattccgcccgcgcgtccgacgccattctcatccatatcaccacacaacaccacacaaccaaaggtccataaccatgcaagagggcatccaccccgaatacggccccgtggtcttctatgaccgctccgccgacaagtacttcctcaccaagtccacactggtggccaaggccgtaaacctgccgaccatcgactgggaggacggcaacacctacccgctcgtcaatgtggaggtgtccagctacagccacccgttctacaccggcaagaatgtggtgatcgacgccgccggtcaggtgcagaagttcaacgctcgttacgggcgcaagtgattcgccgcacattccgcaaagaccgtaagacaagaagaaaggaacggacatgaaggtcaaggcatcggtccgctcattggcccgcaaggatggctcctatgtcgtccgccggcgcggccatctgtatgtaatcaacaagaagaacccccactggaaggcgaggcaaggctgatggcactgcccaagtacaaggcgtcccgagcaaacacgcattcgcgccgagccaactggaaggccaaggtgcctcagctggccacggtcagaacgcctgaaggcgaagtggttcaggttccgcagaatctggccgcagccgtacgaaaggggtatatgaagccataaccaacatcgtggattccgcaatccatcaagtctcgtaacaacaactcgacggtccgctccacaggccggcggcgtacgttctttctcccatttccttccgtatgccgtcacctgccggggcgaaccgccgttttatggagtccaccgcatccgatctggccaagctcgccaaggcagacatcgtggctcaacgtcgccggctacgatggttgggcggaaaggcgcagcttgacaagaaacgccagaccatcgtgaacgcgggcgacctcatgggcgtcaccgccaccgacgagtacgagcattcccacgaccacgccgagggcgaagaaggccaccatcaccaccatggtgctacgaacccgcacctgtggttcagcccggaagccgtgctaaaggataccgaagccatcaacgccgcctacgcggacaaggccggggccggttctgccaccgccgccaccgcgcaacgtcacttcaacgacaggaagaaaccctcaaggaaatggacaactggcccacgtattacccggtgtccatgagcaaggaggaagtggccaccgagatgctggcccactgattcgccatcggcccaggcaaccatgtgcaaagttccccgcatatcgatgtgtaccatcggcatgcggggactcgcatattatctcgaccactatcatgcgtacggtgctaatatgacggcgatatggcaggtgatattcgcatgaaagaacctcgcacgcagcgcacggaacaggtgaacaccgcgcaacaggaccattcggcgaactatctgtttctgattatcggcacgccgctggtggcgttcctgattgcggcttccgcgatgctcgagtcgcgtgggtttccggttccgctggtgcgtatcggcaccggtgccgcggggcttatcctgcaggcgattccgttcatgctgctgggcgcgatgatgtcggccgcggtcagcacgttcgtcagcgccgattttctggcccgccacataccgaaatcgttggccggcggactggccgcggcattggtggccggtctgtgcctaccggtgtgcgattgcatggtggtgcctacgttcgcgaatctgatgcgcaaacgcctgccgctgccgtgtgcggtgacgtttctgtgcgcagtgccggtgatgaatccgatggcgatatggtccacatggttcgcattcaccgacaaaccatggatggtggcggcccgcatggggttgggcatggtagtggcgatagtcgcgggggtgtcgttcgcggtgtggccgctccgctcccctgcggtgcgtgagaggccgctgacgattgggcggtcgttgatttgcgaggattgtgcaggggcgacgggtgattcgcctgagagccacccccagtcggctttgccgacagcccccgccggcgggggcacggggcgcggattggagcggttcacgcatttcattcggcatacgcatgacgactttatgcggatgatgccgattctgctgttcggcacgatcattgcctccatcatgcgcaccgcattgtcgtcgttgaccaacggttcaagcacgctcgatgacgctggtgccatcgtactgattctggcggcgatgggactggcgttcctgtgttcgctgtgctctacgtccgatgcggtgatcgccgccagcatgattggcgcgctgccggtctccgccatgcttgccttcctggtcttcggcccgatgctcgacctcaagaacacgctgatgctggccacggaatgccggccacggttcatcatccggttcatcgcgaccgtggcggcggcctgcctcctcgccgcgattgccgcccatctggtgatgggagcgtagccatgaagcgcaaagccacactccccgaccgcgtggaggcgctgtgtttcgcggcgctgggcgcggccatcgcctatgcagcggtgggcggatcatacaccacgctgaccacgccgcgttcgctgccgtatctcatcatcggtgcggtactgctgttcgcgctggcgaccgcagcatggctcggactgttccacgccacggagcgttcggttttacggttcctgatcgccttgattattccggcgctgctgatcgccgtgccgttccagcccagcagcggcagcggcggcttcgacgagtacgccggcggccgcgctatcgccattccccgcagctcgcacaagcctgatggctcctcgcagctgcacggactcgacacggcgaacaagaccctgaccatcagcaacgacgaattcggctcatggttcgagcagatcgaccataatccgcagcgttacgtcggttaccatgtgcaagtcaccgggtttgtgagcaagtcgcgtacgttcgacgcggacgagttcgagctgtcccgccagttcatgtcctgctgcattctcgacatgaccccattcgggttcatagccagctccggcaaggccggcacctcgcacaatcacgactgggtcaccgtcgacgccgtcatcaagcagggcgtctacggctccgccggccacgagcgccaaggccttatactgcaggtccggtcggtcagcaaagccgcagccgccccgaccggctacttctactggcagtaaatgacgcgtctcccgaaatggaaagcactgcgctgcgccatgactcgccccatatcggcagaaatcccgcgttacaacgaaaggtacgcgggggctctgcctttatagggctcaaaactggcagaaatcccgcgcaggcctcgttgaaacgcgggatttctgccagttgattcaaatcatgtgacaacatgccgggcatctgatttgctttaataacgataatgaatatcatttgttaacagaaaggggcagaacgtcatgagcaccgagcaaaccgcgaccactcggcgcgtgacgcgaccccgactcctcatcacccaggtcctggcggaactatcccgattcgccacggcccaggaaatcaccgacatcctgcgcgagcgcggcacgcgcatcggcacggccaccgcctaccgcaatgtgcagatgatggcctcccaaggcgagctcgacgtaatccacgtcaacggcgaggccctctaccgcgagtgctcggaccagcatcaccaccatcacatcgtatgccacgaatgcgggcggaccatcgaaatcgagattcccggacttgagcagtggatcgacaaagccgccaagcagttgaagtaccagaccatcgcccacgaactggagattttcgacctgtgccccaagtgtgcggcgaagcatgccatcgaaccgcctctcagcgtcggcacctcaccaaaggatggaccactgacgacgccagacgatactggccgtcggcgctcgaacaaataatggcgcagtcccgacgctactggccttcagcatcggtgcccttccaatccttggcgcaatagcgacgatataagctccactcgcatcgttagattgccaacgcttggcgcagcaccgacgccagacacgatcatcgtcgtcgttccaccaatatttggattggtaccgccaccacctataccaggcgtcgacactcggccaacaatcggcccgttaccgacacaaaactgcatgaggtctcattgctcttaatagcagcaatgggcctgataatcactttcaccaactttcgtcgctgccgtctgcctccctacagtcacagacgaacaaacgctgaaaggaacaacaatgactatcaagaccatcgatgagcatgcttacgagatcgttaccgaagagggcaccttcgccgtctgcaaggacacgctggccaagttcgacgccaccaagcacgagcacggcgtggccgcctgtggccgctgcggctgctgcttcaccggcgactgctgcgacgacaccggctgcgagcacaaccacaccgaagagtacgggggcaaggcttgcctgcacgcttgccacgagaaccgcgaaggccacgagtgcgccttctgccaccttgccttcgacaccaacgagaagtgccacgatgagatcctggccgacctcaaggaactcaaggccgagctggctgcctgagttttaggtttccgatttctcctgcggattggctcctctcagggaggggagccaaattccgacacgaaccaccgcgcttaccgtatgatgtctacgggcgcggtggttttgtttttctcgatgatggcgcagatttgctcgggtgcctccttgcagccgcgccggatccatagccaaataatcgatgagacggcggagaccagaatttccagcgcatagtcgcgcggaatgccgctgtagctcagctcggcacccacacgggccgcctgcccaagcagcatctgcttcaacacatccttgacccggtcatacatctgcatatcgttgcccgaacgggacagtgcgtcgaagaacgcatactcacgcttgacatagcgcaacgcctcggcttcgtgttccagttctacaatctggtggccaacctcacggccaaggagaacgtggagctcgcctccgaaatcatgaaagacgcgcaggaaccgacccaagcgcttatcgacgtggggcttcaggaccgtatcaacaacttccccgcgcagctttcgggccggacatgcaaacaaccggcaccgacttctttaatcagaacaatctcgatgacataaccgtcatcagcgattatggcctgaccaaagctgacgaaaacattattcgcggcgcgccgaagtggccaaggcgatgaagggcggggccgtctccgagtccgcgccgatctactacgaggagatgtcgaaagtggccggcaaggagaacgacaaacagtcgattaccctgatcgccactgatgacacctacaatttcggcgactacatcaccctgcgttcgcgcaccgggcacaagccgcaggtgctcaccgaccgtggtgcgatcatctccgaacgtatggcggagatgatggacgccaaggtaggcgacacgattaccgtcaccgattcgagcggcaccgagcgcaaggtgcgcgtggacggcatcaccgaaatgcatatcgggcatttcatgttcatgacttcgggtggctataagcacgtgttcggcgaacagtaccagtcgaacgcctatatggtgaggctcaagaaccatgagacctccaatgtggagtcgcgtagcgccaagctcataaagttggacggcgcgaagggcattgtgcagaacacgacttcgaagaaacaggtggccacaatcgtcgacttgccggatcagatcatggaagtgctgattctcgtggctgagctgctggccgtggtgatcctctacaatctgatgaatctcaacgtctccgaacgtatccgcgaactgccgaccatcaaggtgctcggcggactcggcgtgctggtctaccggcggttgaagacggtcgacatgctcggcgccctgaagtcggtggaatagcagcggaataacaaatgggatcggctttgaagccgatcccatttgttattcgctcactgctttctgagacttctgcgctttctgctccttttggcaatcagggcatagtccgaagacctccagggtgtgggattcgacggtgaagccgtggccgtcggccactttgcgcagccaagcctcgctgggcgggtcgatttccacggttttgccgcaccgcttgcacaccaagtggtggtgatgtccgtcgtcgccgcataggcggaacagctgctggccgtccaggcggatcgtgtcggcggcaccggcatcagccaaggcgttgagctggcggtacacggtggccaagccgattttcgagccttcgtcctccagcctgcggtgcaggtcctgagcggagatgaactcctcacagtcggccaaggcggcgcgaatcgcgtccttctgcttggtctggcgttcgatatgttcaaccatcgataaggtcacgccttctttttcaggtcgtcccagcagccggtggcctcaaggtcagcaaccgtggcatcagggttgtcggtgagcacggtgatgtggcccatcttgcggtcgtggcgcacttcggccttgccgtagtcgtgcacattccactccgggtgggtggcgatcagcgcgcgcgtcggctccacatgctggccgagtacgttgaccatcacggccggcgagagcagcttgggcttgggcatgggccagccggcgatgccgcggatgtgggcgtcgaactggtccatcgagcaggcctcgatggtgtagtggccggagttgtgcgggcgcggggcgagctcgttgacgatgacctgatcgtccttggtgatgaacagttcgatggccagcgtgccagccagttcgaagcccttggccaagcgaatcgccagttcatgcgcttcgcgagccacatgttcggacacttcggcgggggcgatggtcatgtgcaggatgttgttgcggtgctcgttacgcacgatggggaaggtgacgaagtccttgccgttgccggagaccaggatcgaagcctcgaatgcgaagtcgacgaagccttccaggatgctcggcgggaagccgccaccacggtcggaacgggagcggatcttctccaagtcggcgtcggaacgcagcacgagctgaccgtggccgtcgtagccgccggacacggtcttcagcacggccggataatgaatatcatccaatgcggcgtcaagctcatcgaagttgttgacagcgtgccacggtgcggtggcggtgccgtggtcgttgatgaactgcttctcgtgcacgcggtgctgggtcacgcgcagcaggtcagtgccctgcggggtggcggtgatgccgcgcacctcgtcgatggcatcggcgtccacgttctcgaactcgtaggtgagcacgtcggactgcacggccagatcatggatggcggttttgtcatcgtattcggcggtgatctggaagtcggccacctgaccggtcgggcagttcggcgtcgggtcaagcacgccgacgcggaagcccatgtagcgggcggacaaagccatcatgcggccgagctggccgccgccgatgatgccgatggtcgatcccggcatcagcatcgaaacacgaccgcctgtttcctcagacaagctgggcattggattcagccaccttttctttcagttcgttacggtaatcctcaagcttgtcggccagttcgggctcgaaggcggagagcatctgcacggcgagcaggccggcgttggtggcaccggagttgccgacggcggtggtggccaccggaatgccgccgggcatctgcacgatggacagcagcgaatcccagccggacagggcgtgggagcgcacgggcacgccgattacgggcagtgtggtctgcgcggcgatcatgcccggcaggtgggcggcaccgccggcaccggcgataatgaccttcaggccattggcgcgggcgttgtgcgcgaactcggccatgagctcgggcgtgcggtgcgcggagatgacctgcttgtggtaggcgacgccgaactggtcgagaatatcgcaggcgcgcttcatggtctcccagtcgctggccgatcccatgaccactgcgacttcgggcttggattcatttgccattatcatttactccctagttattgagaataaggcccactgtacgcttgggcgcttacttcggcaacgccttgcggttttccccgggtccgccccgcagacccgctcccccggcccgtgaagccgggctcctacaatgcgatgacgatcttgccgaacatgtcgccggcgatcattctggcgaacgcctcgggggcgcagtccaatccgtcgaccacggaatcgatcaccggatgcaggtcggcgtgctccacgaagcgcagcagccgggcgaaatcctcgcgcgaacccatggtgcagccctgcacgcggatgtcctggaagaacaaccgggtcagttcggcaccgggctggtcgccggtggtggcgccgcagatggcgatggtgccgccgggacgcaccgaccgcaccgaatgaccccatgtggccgcccccacggactcgatcaccgcatcgaccttgcgcggcaaccgcgcaccggtctccagcgcggccttcgcgccgagtttcagcgctttggcgcgcttgtccgcgtcgcgtgaggtgacgaacacctccagaccggcggcatgggcgagctggatggccgcagtggacacgccgccgcccgcgccctgaatgagcacggagtcgcccggcttgatgccggcggcatcgaacaacagcgagtaggcggtcagccagctggtgccgagtgcggccgcctcagccgtggtgaggtttgcgggcttggcgaacacgttggcggacggcacggcagtcttctcggccatcgtgccggggtatttctcggagaggatcgtgcggcgctcgcccggggccacgcccgcgccatcggtgccgacgaacgtgtacagcaccacttcgctgccggccttgagcccatgcttgccggggatgtcctcgtccagaatgcccacggcatcggtgcccaggatcatcggcgtctgttcggcggcgagacccacaccctgtaacgaccagacgtcgtgatggttcacgctcaccgcacgcaccgagacggtcgaccagaacgggcgggcctggggttcgggctgctcgcccaccgccaacgcggcaagcggatcggcatggttgacggtggatgcgtatacggccttcattgcgcgctccttggtatcaagggaattaccgcattcattgtcccacatcgcgcagcgaacgaatcacccatttacggagatgttgggggcattgcttcgtcatgtggacctcggacaatgccgggcgttagcattcaacttcggaaagattagcgaagggagattcgagggtatgcgcaacgcgtcaggaaacggatttgattcaagcgattccctcgccgtctccggcgccgccgaggggaccgcgcgccttcacgacatcccccgagcattaccccttcccatggcgacgactcccatctgctgagccgcattgccagcccggccgatgtcaaggcccttgctcccaacgagctcgccgaactctgccgtgagattcgcgccacgctgctggcatatggccaccaacacggcggtcatatcggctccaatctgggcatggtggaggccacggtggccctgcatcgcgtattcgattcgccgcgtgaccgcatcgtgttcgacgtgtcccaccaaagctacgtgcataagatgctcacgggccgcgccgacgcctatctggacccagaccgtttcagcgaggtgactggcttcaccaatccggatgaaagcaaacacgaccagttcgtgctcggccacaccggtacctcgatttcactggcttgcggtttggcgaaaacccgcgatatggaaggcccgaacagcggcatcggcaatgtggtcgccgtgatcggggacggttcgctgagttcgggcgtggcgtttgaaggactgaacaacgcggctgagcagggcggcaatctcatcattgtgttcaacgacaatgagatgtcgattgccggcgatttcggtggcatgtacggtccgctcgcccgcctgcgcgcgtccggcggcaccgcccagccgaatctgttcaacgcgttcggtctggattatcggtatgtggaatccggcaacgatgtttccgcgctggtcgcggctttcgaggaagtgcgcaatatcgatcatccggtggtggtccatatccacacgctgaagggcgcgggatacgacggcgccggtcacgtggccggcacatcctcggcctcggtcgggaacgtccatgagccggattcggcagtctccgacaccggcgtgcgccccacgagcaacgtgctgcacagcgaaccgtggcattcggatcactgcaatctgtccgatcacgaaccgcatgagggccagtgcgaggcctcacactggcagaacccggattcggccatcggcaaggcggacaatccgcgcaagcattacggcaagatggcgatggcggccctcgagccccgattcgccgacgaaccggggctggtggtcatctcccccgccacgccgggctccaacggcatcacccatgaattccgcgaacgcgcgggctcgcattacgtggacacgggcatcaccgaatcgcatgccgtggcgtatgccgccggcatcgcgcgggcgggcggcacccccgtggtggccaccacggcgtccttcttccaacgcgcctacgaccagttcttccaggagatgagcctgaaccgttcgcgggtcacggtgcttgatttcctgggcggcgtgtctgcctcggacaatacgcattcgggcgcatatgacgtggcgatgttcgccaacatccccggggtcacgatgctggcgccgacctcggccgacgagtatctggccgacctcgcgtgggccaccgcgccttccggcgccacgcacgcccccgacgggccggtggtgatccgcgtgcccggagagccgctgctgtcggccgagcgagacccgagtctgctgccgctgaccggcggtcggttcgcggcgcacccccggcctgccacaaggtcccacggcgacgacggataccgcatgctggactggcgcgtcaaccaggccgggtcggcggtcgcgctcataggcctgggcaacgcctatccgctggccgagcaaacggccgccgcgctgtgcgcggaccacggcatcacggcgacggtcatcgacccgcgccaatgctcatcactggactgcgccaccctggaatcgttgcgtgacggccacacactggtcgtcactctcgaggacggtcagcgcgaaggcggctggggcgagaaggtgaccgcatactacgcgaatcatcacgtgcccgaatgcgatgcggccggccacgatcgcaatccgcgcgtgctgaacttcggcgcggacaaggaattcaccgaccgcgtgccgctggacgtcttggacgagcggtatggcctgacggtacatcaggtggtcgaatcggtcactcgttgtttttgatggcgtctagggccgggattttaacggctttattggccgggccgaagccgaacagcaagccgatcagcgtggaaaacagtacggcgaacaggaacagccaccacggaatcaccgaataacgggtcacattctcgccaccaactatcgcctgccgcagtatggtccagagggaggcgccggactgcgcgccatcgccgccgcccggcgcaccgggagcaccactcgcgtacagcattccggcgacgttgatgcccagcgagaccagtccgctcaatgcgcagccgatcagtccgccgaagaatccgatcgcgccggcctccgcgagaaacatgatgcggatgtcccgcacatagcagccgagcgccttcatgatgccgatctcccgcgtgcgctccgtgacggacatgatcatcgtattggcgatgccgatggccgccaccagcagcgcgaccgcgccgatgccgcccagaatcagctggaccgcccgtgattgctcatccatcgacctgcgcatgtcctcataggaggaggtctcgtatcccaacgccttgatctgcgattcgacttcgggcacggatccgaggtcggcggccttgaccagcacctgactgtaggtgtcggatttcctggcggacggattgacctttgcggccagcgccttcatcgccttcacatccatgatcagcccatcggaggtggcaaagcctttgccgtagtcgctcgccgtgacgccgctgatctgcaggtcaagggtgatgttttccgagcgtcccgcggcgccgcccgcgcccgccgcaccggccgaaccgccgccctgcatggacatggtgtactggtcgccctggtaattgacgccggtggtcacgcgaatccgcgtgacgagcgggtcgaagaacggcttctcgtcacggcggccctcgcattgggcgtcggcgccggagacgcacgggggcgtcatgccgtcacccgcgcccatgcgccgctcgccgttcctcagcgtgtccaggaacccgtaggcgaacgtctccccggcgagcacctgatcgtcgcggaacggtttctcgccgccgacgagcttgtagcccatacggtcgaactgcgtcatatcgacgcccatgacctgcacgtaatcatggaggtaacgcccgccggcgccggctctggccgtcacggtgtaggggaagtccatcatcggcgtcacgccgtccacgccgttcatcgcacggaaggactccagagccttgtcgtcgagcttggcgccgctcccggtcgacgaaccgccccgctccgcccggtcggggccgccgtcggcatacacggtgacgatggacagatcgcccatggatttgatcaaggcgttcatctgctcgttgatgccctggcccagcgagaccatgagcacgatcgagcagcagccgacgatgacgcccagcacggtcaggatcgtacgggatttgcgccgccataggttctgccggcaaagtcgcaggatgtcgccgaatcgcatggccgaacctttcaacccttgcgggagggggcggcgggcgcgggtgccgtcccgccgggcgccgtcccgtcgggcgccgaggtgcgcggggacgcctgatcggcggctccatcgcccggggccgcgccttccccgcccgcggaccaatcatcccaatcctcatcgatgtcgttcttcccggccttcctcctgcggcgacgcacgagcagcacgatcgccgtgatcaccgtcacaacgcccacggcgatggccacatacgccggcaccggcagcccccgatcgccgccgcggccttcgaccgaatcggacgcgccgggctggtccgccgctggcgcgtcggccacggacacggtgagcgggaattccttggttttggtctgtccgtcggaatcctcgtacgtgactttgagcgtggtcttcagctcgcctgacgcgtgcggcgtgaaggcgtacccgatcgtgccggtggcgccggaagccacattgcccacgtactgggttttcatcgtggcatcgaaaccttcgccctccatcgtggcctcgacgttggcgatatcgcctttgcccttgttcacatattccatcgtgaccgtgttttcctggccggcgatcacctggtcgggcactacgggatcactgatttcgaaccggtcaggctgactgatcggcacggaaatcttgacgtcggactggcttgaggagcgggcgccggcgtccacatactcgtatcggaagttcacggtcacgggctgcgcgccgcttttcgcggaggcgagcgcctgcatgggcacggtctgcgtcatcgcgtacccggcccacagcgcgtcgacgtagaacgtgttcgtgccgcccgcgatggcgaatccctccgcgccgtccacggtgacgaccatgttcgtcaccgccacctgtcccttgttctggaaggtgaagtcgaggttgaatttggatccggcggccacggaatcaccgccatacgcgaagttggtgatgatgatgttgggcaccggtccggcgagcggcgtggcgccgccgtcgcttccctgcgcggcgcctcccgcgtccgcgccatcgaccgcatacgcctggcgcggcagggagacgacggtgagcgtcagcgcgagtgaggacagcaacgccacgatgatggcgatggtgcggcgggtgagatgcttcatcggtctgctccttgcatgccttggctggatggtgtggatgatgcggatgggcggggagtaggggatccggcaccgaggagccgatcgccggtgatgcgaccatcgagcaaggtgacgatgcgatcggcgtatgaggccatctgcggatcatgggtgaccagcacgatggtctggttgaagtcatgggcgaatgcgcagatcatcgtcatgacctcggttttggttctggagtcgaggttgccggtcggctcatcggcgaacaccacctcgggcttggtcacaaacgcccgggcgatgccgacgcgctgctgttggccgcccgacatctggcgcgggtaatggctgagacgatggccgagcccgactcgtttgagtacgccacgcgccgcacgttcgcgctgttccttgggcacgccgtggaacatcagcggcattgccacgttttccagcgcggtcagattgggtagcaggttgtacgactggaacacgaatccgagatgcttttggcggaaggccgccaattcgcgttcgtcgagcctgctgacgggcacaccgccgatgcgcacgccgccgcgcgtcggtttttccatgccggccaactggttgagcagcgtggatttgccggagccggactcgccgaaaatgcagcagatctggccttgcgggatactgagattgacacggtcaagcgccaccaccgtctcatcctcgacggggtattccttgcgtaggtttcttacctcgatgattgctcgcggcacgggcccttcttccttcgttcgtcgccattggcggacgcgcgatagctggttattatccagcacatctcaaatcagagtatagccgttatgcaggagccgcaccccttaagggtgttcccggatggcagtgataagcatataaccgctgatctcgaggtcgacggttcaggctccagacggacccagaccggcataatgcccaaaagcccctggcccccacaaacgatgaggaaccaagggcttattacatcgtgaccccggacgggctcgaaccgtcgaccttgagattagaagtcacatgctctatccagctgagctacggggccaaactcatgtaagtctagccgtaggggtgtaaaacacctcggcgtaacgtcggcttgcaccggtaccatcggcgatatggggacaacggagagcaacatagatcacaccgcatcgggccagaccgtcgcaggcgatagtggtgagctcactttcacatacgcacagggtcgttttgccagtgaaggcagggattgggaaagcccggttgtgaccaacatgactgcatccgtctctgccgatgccggtaatgccctcgccggcagcatcatcaacaccggctccaacaacactttcaccagcaccaccgaatcgtcgcttgccaccctgctgtccgaccaatgcccgttcgttatcaaggccaccattttcgagggcaatggcaaaaacgccattcgcgaacgtcacacattcaccggctcggtgctgcgccagctcgaccaagccagcgccctgctgaacggcatcaacgaatccggccaacacccggccatagccctgcgcgaagcattggtcaacgcactggaacatcgcgattacacgtactccggccccacactgatcaatatcttcgattcccgcttggagatcgtgtcgctcggcggcctgaccgatggtttggaaatcaatgatctactcaacggcgtatgccagccacgcaccccgcgtttggctgaattgttcgccgatctgggcctctgcgagaactgcggtaccggcattcaacgcattatggacgcctacgcgcagagcgcggtcagtccgcaactgcgcgtgggccccacttcggtggcaatggtgctgcccatcccggtatcggccgaggccgcatcctcgcatcgaaccgataccgatgcatccgccgcgcccagcaccactgacgaggcgcagcgcgccaaaatgtactcattccccacgattcagcgcatgacggataacgccgcagatgctttggccggcgcacgcatcatcggctgcgcgccattgcagacactgattctcggcagcggattcggcgagcgcccggacggtgacgatcaggtcagtacccgcccgctcgatacggcaacgctggaaccgtcgcctcaaacgttggagcagttcacgctcaatttcctcgcgttccgcggcgtgaagctcagccgtaaaaccatgcagaaagcgcttggtctgaacaaggatcagatgacgcagctcttggaccagctggagttgagcggcaagatcgaacgtcatacacacgccaagtccactacgtattcgctggcacatgcctcaggacggtagcgaccagggcgacaacgaccaaatcgtcaacaacccaagcagcaacgaccagagcaatacagcccaaggcgcgataaagcagcagctcagttctcgaatacgcgatcgcgaatcatgcgaccggattcgtcgagcgcggtggagaaccggccgtagtcggacagaatcacgcccatgtacagcatgtccacgagcgcggtatcggccacgcacgaaaaaatcgcattgccataaatcgtatgcgagtcacgacccgtcagcaacgtcacgtcggcccaactggccagcggcgcgccgatggcattggtaatggcgatggttttcgcaccatgcgatttcgccaatcgcaacgctttgacagtatccgccgaactgcccgaatgagagaaggcaacggccacagcgccgtgggtcaggtgcccggcaccgatctgctgcaggtaagcgtcagtattgagacggcacgtcagtcccaggtagccgagcttggtgaacagatccatcgccggtgtcaacgagttctccacgccgaaaatgtcgatgaactccgattcggcgagtagggcgaccgccttgcgataggccttggggtccaacgcactgtgcagctcatcgatcagcgccttcgcgccatcggccgctttgctgggaatctcatcctcgccatcccacggattcagatcgaatccatccaacggattgaaggtcactttgtgctcggcggccggatggcgcaacacgtaccgcagttcacggtaaccgccgaagccgagcttgcgggcgaaccgaatcaccgtcggctggctgacgtgggcgatgtcggccatctgaccgacggtcaggtcggccgcctcctcgatatgatcccgaatatactgggccacggcgcgctccgccggacgcagcgacggatacacgtggtcgatgcgctcgcgtattcccaccgaggactgcacagccacgctcctagtcgcccgtattttccattcccgtttcgagggtaccggctgtataccggcgaacaatcgacttggattgaccgcaacatgaacggtgagcgaactcttccgtttacctttccgctccatgccctctacaatcgaaaccatggtgcggattagcgtgggaagccccacccatcacacaagcgggcggctgtacggcgtgttcctcgaggacatcaaccatggtgcggatggcgggctgaacgccaacatggtgaacaactacagttttgacggcgtctatctcgaccatcacacgtggcgtatggccggcgccgaacgatggcgcacacaggccgattccctgcgtttctgggatttcatcaactgttccgccgccagcctcggcagtgagatacgcgggattcacggccagcgggtgaccaccgactgtcccgccccgccaattcacgcacatagccgatacgctcgcatcacgttcgatgttccttccgaaaccggccctgcatatctggaaaacctcggctataacggaggcggcgacaacgggggcgagcccgcgttctccatcgtcgccgaccacacctattccgtcagtttcgcggtacgtccggttcatgggcgggccgagctgtccgtcggcgtggtcgataggtatggcctgccgctcaccagtatcactcgattgtcgtatatcgtggactccgatccgcttgacggtacggaagagaccggtctgaggcaggacgatggggccgatgcgcaggattccggcgtttcgatcagtccggattcatcggatgatgccatcgtcatcggtcgtgacggctggtaccggttcaacgccgacgtaaccggcctgaacaccgattacggcaagctgcgtatcaccattgacgccggcgaacgcaccacgttcgatcttgatctggtgcagttcatggatgcggactattggggcgtgggcgacccgaaatggcgttacggcaagctgcgccgcgatttggtggagaccattcaggcgttgcatccagcgtttctgcgattccccggcggctgcatcgtcgaaggtgtgacgcccggcaatgaatatcgctggaaggataccgtcggctctctggccgcgcgacgccaacagtattcgatgtggtcgttcaagatgccggatggttccagctattcgcagagctaccagatcggtttctacgaatatttctgcctgtgcgaggacctcaaggccaagccgctgcctaccctgttcgccggcatcgcatgccagtcgcccggccgcgatccgcgccacatggatatcaattcggcaaccttccgcaacaatgttattcaggactacctggacctcatcgaattcgcgaatggcgatccggagtccagctcgtgggccgcggtccggcgtgatatgggccatccagaaccgttcggcctggacatgatcggcgtgggcaacgaaaacttcggggctgactacgtggccaagtttgacatgatcagcgaggccatccacgaacgatacccggatatgctgtgtgtgatgagcgccggactgttccccttccagccggcgatgaagcgcatctgggaccatgcgcgagcgttggccgcaaccgattccggggcacatgattccgccaccagtgacgcgattatcgtcgacgagcattcctaccactccccgaatggtttgcatcacaagcgtcacgattcgatacttacccgcgttgcggtgccggcgtctatttcggcgaatattcagccaacggctattttgccggccaaccacagaccgaacaaggcgcgaacacgtggaagtcggcactcggcgaggccgcgttcctgaccggttgcgagcgcaattccgacgtggtgcgcatgacctcctatgcgccgctgctcgcgcatatcccggctaaggggtgggcgcagaatcttatcgaattcaatccggcgcatgtgaaccccacggtgaattatgaggtggagcggctgttttccacgcatctgggcgacacgacgtatgccgtatccatcaagcagaccgcgtcacgtcccaccaaacatctgtatgtcagcgccaccgggcatgacggggatgacgcctgccgttacatcaaaatcgtcaatacctccgattccccggtggatgtgacgttggaaatcgcgcgcggactggccgggctgggcacctcgccatcgcgaccggtgcgtttggaggtgacgacgttaagcgccagtccgacggcgaagaccactatcggataccgcggcgaggcttcgggggcgattgtgccggaacgtcgggcttacacattgccgtcgccgtcttcattgctggcgatgaagatcaagccgtacagcgtcacgctggtggtttcgcgctgattggcatcggccattaggccgattcctttgccgttagaatcaccctcaaggatgaggggaatcgtgcagattcagggaataataggggctatccccatagcgaatacaagcgcgggagggcaggatggaaaccacggcggccagaagaccgccggccaacgatgaaggagtgtgcggtatgtttatcaatctgttccgcaggcagcgccctgcgctcgcccggctggcccgcaactccaacgcctatcgtcagccgatggttgcggccgtatcatcgtccgcagtcggcgtatccagcatcacctctgcatccaccacagccaacacagacggcgtatccggcgtatccacgctggatgccaccatcggccgcattcatgacatcccgcagtcggccatgagccgactgaccggctcccccaccgtatacgcgcggtagaccaccccagtcggcttcgccgacagcccccgtcgatgaacagcagcgaccagcaacacggccgccgtgccggaatacggtgccatgatgccgcgcaatgctgtgcccgtatatacggctgcatcattgtgtggcagtccagacacgactaccgtacgtgactggctcaaaccaatggaacatagtttcattgccacggccgaccgccggcagaacgatcatgccgccatcgccatgatgcgcggcgacttcgtccaaagtggccgtcgcggcatcctcgacgttctcgccggagaaacgcacacgatccgacacctgatgggcggcgaccacagcctcatgcgccggtgctccggattccaacaactggtatccggcatcgagggcgcgctgcagatcaagttcgacctgggcgatgcgttcaggcgtgctgtgcttgccacgactgcccgctccggcgtgaatgataaacgtgatgccggtttcgctgcccgccagttcagtggtcaccggcgaaacggaggatgtggtcatatcgtgtccctttctggagtcagatggatgtgctgacgccaacgtatcgctgctcccgcatgtatgggccgcgaccggttccgcatttcgcatcatcggctcgcgatggcgtgactcgttactgcgccacctcgccactacgccaggggcaatgcgatgccggctcgatcggccagatcacgcaacgaccacgtggtctgccccgttcgcccgacaacgctatgcgcatgccacagcgaactgatgatggcttcctcgcttattcattcgtcgaatgcactcatcgatgtgggtatgtagccatcaaaaaaactcgacaaccgcaatgagccagtcacttggctacatctgtgctatcgtctcgccaatgattcgaatgccggtatcaatgtcagcagcatccgggcgcacaaagttgagacggatgtgggaatcatccatttcgtcaacgtcgaacacactgcccggcatgaacgtgacgccttgggaacggcaggattccaatacatccagagagcgcacgccgtccggtaaggaaacccaaatatagtagccacctgcaggcacggtccaatacacttcatccggcgcatactgttccaatgctgcgattgctgcatctcgtcgaatgcggtaagccttaatcaaaccgtgcaaatgttcggcgacgcggccttctttaagcagttccaggcagatgcgctgcgatgacgtgctcgtatgctggtcgaccatgcgccgcagagccgccagccggttgatcacatgcgggtcggccacaacccatcccgtgcgcaggcccgaagtgacggttttcgagaacgtcgacaaatacatcacgtatcccgcattctccatgcccttaagcggtatggggcgatgtgcgtcagatgatcccccgccgtaccacaaatcgccgtaagcatcgtcttccacgatcagacactgatagcgccgcgccacgtcgatgagttcgctgcgtcgttcgggcggcagcgtggtaccggtggggttttggaacgtcgggacggtgtagatgagcttgggccggaatcgcgcgcaatagccgtccaacaggtctgtacgcataccgtgctcgtccactggaacgccgatgatgcgcgcatccgccgagcggaaggtctgcaatgccgggaagaatgtggattgttcgaccagcacgcagtcgccggggttgatgaacgcgcgcacgatgaggtcgatgccctgctcggagccggagagcaccatcacgttgcggacgccgcattgtacgcctcgtgtgcgcatatgttcggcaagtagcgcacgcaactcttcgaatccctcgataggtgattccggttggccgtcgaattcccgcgattcgaacgcctcgatgctcaccttgcgcaacaaatcgtccgggatatccgccgggttcggcgaaccggtggcgaagtcaataatggtgtcgccgcgctgcgcccgctcggccgaggcgatgtcatggtaggtaaaccggttggaataatcagagaacaacaccgaccatggaggacgcacgacgctcggtttcggctcctcgtcaatcggcttatgtctcactacaggaatccgggcagtctcagtatgctgcaacggcagcacgaacgtgcctttgccgactttggaggcgataagaccttcgtccttgagctgctgatacgcctgcaacaccgtggtgcgattgacttcgagacgtgaggacagctcgcgttcgggaggcaggcggtagccctcggccatcgcgccggagacgatctgttcacgcagctcggcagccagctgccggtacatcggcaccttgctgcgtcgattcagctcaagctgcatggcagatcgtctccttgattcgtcagtcggataccagtctagcggcagacgaatcgactacagcgacaggaagagctcgtggatgcgggtatcgtccgtgagttccgggtggaaggcggtggccaggatattgccttgacgcaagcccaccacgtggccatcgacttcggtttcgaccgtggcctcagggccgaccgacaccacgtacggtccgcggatgaataccagtgggaagtccgtgatacgctgcggatcatccgccgcaccaaaatcggcggtggcctggaaactaccgagctgacgaccataggcgttgcggcgtacgacggcgtcgagcgcgccaaagtagacattgtcgtcattgtcgagctttttagccagcagaatcatgccggcgcaagtgccgaataccggttttcctgccttgatgtgtacggcgatcgactcgaacagtccggtcgaatgcaggagcttgccctgtgtagtggattcgccgccgggtagaatcacgcggtcgatggattcatcgaaatcctcggtcgcgcgcagcagtttccacggcgcaccgagcttgtccagcaccgccgcatgttcggcgaatgcgccttgtacggccaggatgccggtcacgccgtgcttggcgttttcggcgtcctcggactcttctttggaaatatattcagcagctacaaccatgttgtctccttgggccttgactcccgctggcgggagcgtcaccttttcttggctcccctcaaagaggggagccaaggtgatgcactcactcgccgcgagcggccatgatggtctgaatctcgtcctcgttgatgccgaccatggcttcgccgaggttttcggacagcttggcgagcagatcggcgtcctgccagttggcagtggccttgacgatggcggcggcgcgcttggccgggtcgccggacttgaagatgccggagcccacgaatacgccttcagcaccgagctccatcatcagagcggcgtcagccggggtggccacgccaccggcggcgaagttcacgaccggcagacggccgttgtcgtgcacgtacttggccagatcatatggcacggccagctgcttggccgcctcgtacacctcgtcgtcgcgcaggccgacgagttcgcggatctgcttattcatggtgcgcatatgacgcacggcctgaatcacgtcgccggtgccgggctcgcccttggtgcgaatcatggcagcaccctcggcgatgcggcgcagcgcctcgcccaggttcttcgcgccgcacacgaacggcacgtcgaactggttcttgtcgatgtggtacacgtcgtcggccggggaaagcacttcggattcgtcgatgtagtcgatttcgatggcctgcagaatgcgggcttcggcgatgtggccgatgcgcaccttggccatgaccggaatcgagacagcttcctgaatgcccttgatcatggccgggtcgctcatgcgggagacgccaccggcggcgcgaatgtcagcggggatgcgctccagcgccatcaccgcgcaggcgccggcgtcctgcgcgattttcgcctgttcgggcgtggtgacgtccatgatcacgccgcccttgagcatctgggccagattacggttgagttccgcacgattctgcgtcatgagttttccttcgtttcgacgttgcttggtatcgcgcttcattattgaacgaatcggattggccccacccagaccagtccaatttggatggggccaatccgcaacttctgcacccatccaatccggcaaccggttgtatggccttatgcatccggcacgtattcgaagatgcgcgcaatcagtgggaggtattagccgacggtgttgccgtagatttgggcttggaggtctttacgggcggtttccatgcgggtgatctggccgaggagggttattttttcttcgccgtcgggcagctgggccatgcggcgtttggccaagccgatctggcgcatgaagcccatgtccagtagtcgggtgagcagttcggtggcatagcgctgctcttccggcgtggcagggcgtagctgcacggcggccgcaccaccgccggctcccccgggcgcgttcgactgcggaggttgtgcgccattaccaccgtcgtcgccaggcagtggcaacggcatgacggccagctcgttgattacctgattgagcatcggcccgcctgccttggtgaggttgtgcatccacagcccctgcggggtatcgtcggatggcagtccgccagcggccgcgatcgcctggaacagggtgcggaacaccgaagtcatgaaatgctcgatggtcagctgcccgaacatgatgcggtcgatggcgcgcggcacctgaatcaacacggccatgaactgctgttcggcgatgaatacggcgtcgtcgatcttgaaatatgcctgttcggcggcgtcacggcgctccaaagccttgcgcgtggccggattggtgtacgggttggtgccgggttccacacgcggctcgtcacgctcgaatcgacgtttgggcgcataggcgtcctcatcgcgcacgtgcatctgccggcgcgcgttcatcacctcgcggcgcatcacctcaaggtccacgccgatacggcccgcggacttgcgcgcgtaagcgtcccacagggagcggtcgcgaatctgcgccaccagcggggccacggctttcatcgcacccacctggccgggcgtgtaggtcaggtcgaaccggctgatggcggcgtcgatcacgaaatcatacaacggtttggcgcgggcgatcagcgagcgcaccgcctcgttgcctcgctcgatgcgcaggtcgcacgggtcaagattgtcgtcggccacggccacgaaggtttgggagaggaaggccgaatcaaggccgaaggcgtgcagcgcggccttatgaccggcagcgtcaccgtcgaacgtgaacacaatacgcgagctcaatggctggtccttgaccttcagcggcccgaccagctggaccgcgcccagcgaatcgtcggcgatcaggcggcgcacaatcttggcgtgctcggcgccgaacgccgtgccgcacgtggcgatggcggtgtcgatgccggccaagtgcatggccatcacgtccgtatagccttcgacgatcacgacctgccgcttcttgacgatggcggatttcgccaaatcgatgccgtaaagcacctgggttttgcggtagagctgcgtgtccggcgtgttgatgtatttggcggcgatctggtcgtcttcgtataatttgcgcgcaccgaagccgagcgtgcggccggtcgaatcgcggataggccacgtcacgcggccacggaaatagtcatagatgccgcgctggccttgacgggccaagcccgcgtcgaggatttccttctgcgtgaagcccttggaggccaagtggcgcacaagattatcccaaccttggggcgcgtagccgcaaccgaaacgttcgcaatcagcttgggagaagttgcggccgccaagcagcttgcgggcgggcagcgcttccttggtcaggatctgggagacgaagaagcgctgggcttcctcgcaggcttccagcagtcgcgtgcgcttggagccggtgttctcgcggctcgggccgttgccgctgttctcgtagtgcagctcgatatggtacttgtcggcgagcagttccacggcttcgcggaagtcgatgttttcggattgttcgacgtatttgaatacgtcgccacccaagccacagccgaagcagtgccacacgccgagcgagggacgcacgttgaagctgccggttttctcgtcgtggaacgggcacaggcccacgaaggtgccggtgccggagggcttaagcgttacggtcgcagatacaatgtcatacaggtccgcggcggcgcgcaccttctcgacatcttctttcttaatcattccgaccataagtctctagagtaccgcctcacctgagacacagtaaatttttaccgttggacaccagttcttctgggttcgactcccctcagactcagcgaggccccttccaagaggtgaacccgcaggacggagtatcgcacccgcctgacacagcctcagcacaaaatggagtgcagggccagggcggagttgtcggtcaggcttgcgacctgatcgatggcgacgcgcaggcgctcgtcgtcgttggtggattcgttccaatcggccaggaactggctttccaaagcgtcggatgggagcggcgaatcggccataagcacatcgaccaaatccgatacgatcttgagctcctcctgatggaatggctcgcgctcgcgaggcgccatgacgaagtacacggcgatgcccttcaacgccacgatctcgtaattcgtgtcctcgggaatcacgatgttcgaggaataccgggtcaacggcccgggcccatacgtgtcgcgcgtggcggtttccaccgaccaacagaagcggccgatcaaatcggacgtaatgttcttgagctgcgccaacgattcgcgcgaaccattgaaatgcgcggggaacaaatgctctcggcgcaatcgcatgaacgcggccagcagcttgtcggcatcccacttcgccccataccatgcgcgcgtctgctcgatgatgtggtccagcatcctcggatcggcgagcacaatcggatcgaacgcgccggtggcgatggaatcctcgacatcatgcacggagtaggcgacatcatccgaaaggtccatgatctggcattccatgggcttggtggcccggggagcgccgattttgagccagcggaacaccggctcatcatccgggtagacgcagaacttcttcgaccgctcccccttggggtgttggtcggcttcggccaaggtccacgggtatttgacggccgcatccaaggccgcacgggtcaggttcacgccggccgaacgcccgtccgggtgaaagatcttgggttcgagccgggtcaggatacgcatggtctgtgcgttgccctcgaagccgccgatattgctggcgatatcggcgagcgcacgctccccgttgtgcccgaacggcgggtgaccaaggtcgtgggccagacaggcgcagtcgaccacgtccggatcgcagccgagcaatgcgccgatttggcgaccgatctgggcgacttccagcgtatgcgtcagtcgggtgcgggcgaaatcgtcggtaccggcaatcagaatctggcttttcgcgcccaaacgccgcaaagcggacgaatgaatcagtcgcgcgcgatcgcgttcgaaagccgtgcgcgacttggatttgggcggctcgggtgcccatcgctcctcgtcgaaggcgctgtagccctcatcgctcagcacctgttccccatccaacgttgtttccatatgcccagcataggcacacatatcggccgcagtaatcccgacttcccgaatatgtgccactgacgtcaactcaacggcacatattcgggagattggggccgatttcccgaatatgtgacgctcagcacatgtcagtggcacatattcgggaaggaagggattacggggtgccaccgtatggcggtaatgcaccttatagcagcgtggccgggtcgagtttggcgaggtcggcggcgggcagcgcgtcggcggcctgctcgtacaggcgcgggatgcggttgcgcaggcaggtgaagatctcgtagctgatggtgtcggcggcgcgggcccaatcgtcggcggtaggctcaacgtaatcctcgccgcgtcccgcgccgaacagttcgaccgtgtcgccctcgtgaacgccgagttcggcggcggatccgtgcaggtccacgatgaactggtccatgcacacgcgaccgcacacacggtacagtctcgggccttcggcggtcatgatgcgcaccgggcctcccggcttctccacatgcttggccccctccatgtcgaatcccgaagcggagcggtggatgccgtcggcgtaccccagcggcactatggcggtggacgtgttgtccggggtcagataggtacggccataggagatgccgtgacccgcctccacgtccttgaccgtgccgagctgcgcctgcaggcgcatggccggggtcagatgccagtcgcgcggggtgcccatcgcggggtcgggttcgtagccgtacaggccgatgccggggcgggtgagttcgaaatggatctcgggtcggtccagtgtcgccgccgtattggccagatgtcggatctcgggcgggatgccggccagctccatgcgcctggtgaagtccttgaacgttgcgatctgctggtcggtggaggcgacgaattcgggcacatcgggcgaatcggccacggcgaggtggctccactggcccacgatgcgcagcacaccctccttggcgaggggcacgagcgcggcgagcgcggcgtcgaatccggccggagtgaacccgttgcggccaaaaccggaatcgaccttcacatgcacgcgggcgggcttgccgagcctgcgcgcggcggcggccagcgcttcgatgccggacagggagccgaccgacacgtcgatgtcggcggcgatcaaatcatcgaacggcgccgcggcgccgttgtatacccaggtcaggatatggcaccggtcggggccgatgccaagcctgcgcaacaggagcgcctcatgcgattgcgcggtgccgagccatgtggccccgccggcgagcgcggccagggcggtgggcagcaggccatggccgtatgcgtcggccttgaccacgcccatcaccgccgtgcccgatgtggggccacccaccacggagaccagatgggccatgttgtcgcgcatggttttgaggttcacgatggcctgcgcggggtattgccggcgggcggcctcgtaattggctttgccccgctcggaggagaatgcgatttccggtgctgcgttcatgctcatggatatctattgttgcgcgggaatatgacgtgcggtcgtttcgaccgcatgacgccgtcccggcgtgcggaacggcgggcaccgttttcgccgggcagtcgtacactaatgtccaatgtgcggttttcgacacaggaccgcctatgattcccggcgttgaggcgtgccgggatcccggaaatccgtccggttcagccccataatcctagatttcatgagagaagaacatggatctgtttcgtaagaaaagcgtggatcagcttgtcgccgaatccactcccctcaaacgcacgatgcgcacattcgatctgacgatgctcggcatcggcgcgatcatcggcaccggcatcttcgtgctcaccggcaagggcgcgctgaccgccggcccggccctgtccgtatcgttcctgctggccgccatctgctgcggtttcgccggcctatgctatgccgagttcgccgccatggctccggtctccggctcggcctactcctacgcctatctggcgttcggcgaactcgtcgccttcgtgatcggctgggatctgatcctggaatacgccctgcaggcggccaccgtgtccgccggctggtccggatacttcaacaagctgctggaaggcttcggcctgcatctgccggtcgaactgaccgccgcctacggcaccaacccggacgtcaccacctacttcaacctgcccggcttcgtcatcgtgctgatcatcacgtgggtgctctccatcggcatcaaccagaccaagcgcaccaacgacgtgatggtgctcatcaagctcgccatcatcgtgctgttcatcgcatgcgccgtgtggtatgtgaagccgtccaactggcagccgttctccccgtatggcgtctacaccttccagcccggctccacccagccgtatggcatcgtgccggccgcatccatcgtgttcttcagcttcatcggattcgacgccgtgtcctcttccgccgaggagaccatcaacccgaacaagacactgccgcgcggcatcctgctgtccctggccgtttccaccgtcctgtacatcatcatgaccctgatcatgaccggcgtggtgccctacaaggatttcgccaagtacatcgacgccccagtggccggcgtgatcctggagaccggcatgaactggctcgcggtgatcgtgaacctgggcgccctcatcggcatgaccacggtgatgctcgtacagctgtacggccagtcccgtatctgctacgccatgagccgcgacggcctgttcccgaagttcttcggccaggtgcacgagaagtaccgcaccccgttcaagggcacctggttcttcggtctgctgaccgcgttcgccggcggcttcatcaacatcaacgtgctgttcgagctggtgaacatcggtacgctgtccgcgttcatcatcgtgtcggccggtattctatggatgcgcaagacccagccgaatgcgccccgcggcttccgcgcgccgggcgtgccggtcaccccgattctgtccatcgtattctgcttcgtgctcatcgccggtctcaactgggagacctgggtgcgtttcgccatctggttcggtctgggcctgatcgtgtacttcggctacagccgcaagcgctccaagctcggccttgagcagaaggccggggctgacgccaaggtcgctgcgactgaggactgaggtctatcggctgaccgatagtcgatggctgctttcgtgaaaaccgtacgctgagttactttcagcgtacggtttttgcgatatgcacgagtttgaacgggcggccgacggactgtacgtgcgcgacgacgtggaccttacctgaccagctccaccgcggaaccgaacacgctggcgacagccacactcaccactcgtggcgctgataggcgattctggtggtgtcgaccggccggtcgagcagctggatcaggccgcaacgggcgaagccggagctttcgagcacgtgctgcatggccttgttattggggtgggtgtcggcgcgcacgttgccgtagtgcttcagggcccacctgatgcagtcgcgggccgcgtggcgcaccagaccggatgcggcgatgcggtggatggtcacataggtgtcgttgtccagccaggcgccttcgattttggcgtaggtcggatccttgcccgggcacagggcgaactgggccagaatgcgttcgtggccattgcaggtgtcgaccagcagcatcgtacgctggttggcgatgtcgtcctcaatcaccgattcacgcggaaattcgttgccccactgggtggggttgccgttggcggccatcaacgcgcgtgcgcgtgcgtagattttttgcatctgcggcagatcgcgcatggtggcgtggcggaaacggcggcctgtcgccttgtttgcagcgttcgactgagtcacttctcacctctccgacatgccgggttgccggcacggtgaccggcgactaactgacggccaacctaccatgccgtaggcacaagaaatcacctccgcgttgcatgacggacactaataaacaatggcttccgtccgcaggagccggacagtccagccgagttgaggacagccaccctcagttggctttgcccccagctcccgccagcgggagccgaatcagaattggatcgaatcagacgaatcagacgaccttgcgttcgaacgggtcggaactgatgccttcctcaaggatctgcttggcccattccttggcggcgaacaggctgtggtcgcgatagttgccgcagctcttctcagtggtggcgggcacgtcatcccacgtggccttgtatgcgatgaactccaacgattccttcaacgccttggccacatcctcggtggagtgggtgccccaggtcagcaggtggaaaccggtgcggcagccgaacggcgagcagtcgatgtagcccgggatacgttcgcgcagcagcacggcgatggtgtgttcgatggtgtgcaggccgccggtggggatggcctgcttgttcggctgggtcaggcgcagatcgtaattggagatcacgtcgccgtgagggcccgtttcggtgtcgatgtaacgcacgtacggtgccttgaccttggtgtgatcaagctggaatgattcgacgacgggcttttcggccttgccttctgtcatgctgttgcctttctacttgctgactgttcggtcatgaagtatcgaacagtcatcgtagtcgcgccagcccaagaacgcccgcaaatactccgcggttcgctataggagattgttatgacgcactcccggcattgaacgaggcgacggtttgcatgaagcgctggccgtagaggtcgagcttgtgttgaccgacgccgttgaccgccagaaattgcgcgttggtaaccggcttgatgcgggccatgtcgcgcaaggtcttgtcggagaacacgatgtacggcggcttgccgatttcctgggcgatggtgcgtcgcagttcgcgtagcttctggaacagcgattcctcgtcatcgtccgggatatacgagcccagcgcatcgccgggaacattggcggaatcggcagtatcagccactcccccgctccgaccggaaccggccgccgccgacttgcgttccacccgtttgatctcatagtggaagtcgggagcggcggtttcggccgcccgcgcaccgaacatgacgattggcatacgcccttcggcgattgacaggtaaccgtccgtggccatctggctcaacacgtcgcgaacgcgagcctcgttcacgtccttgagcatgccgaaggtgggcatccgctccgggttcagccatgccagatcctgtgcccgcgaaccgcgcaggatcttgacgatcttgccggaaccgacgcgctgccccacgtcatgcacgcaacggctgattgcctgcgccacgcgggtcacgtcgatggtctcgaacgtgctttcacagttcgagcaggcaccgcatctgccggactgcgaagagtccgccgcaatgtcttcacccgccgtggaaccagcattcgacgacaattcctgaccgaaataccgggtcatataccggtgcaggcagtcggtggtgcggcagtagccgaccataccgtccagcagccggcgcttggactggcgaacgatttcctgctcttcgggagtcaatcgctcgttctcataatcgttatccagcaaccgacgccgggtgacgatgtctgactcattccacagcagcgtgcatcggctgggctcgccgtcacggcccgcgcggccggcctcctgatagtaggcctcaatggattcgggcagattgtggtggatgacgtaacgcacgttggacttatcgatgcccatgccgaaagcgttggtggccacgaccaccggcaccttgtcggtgatgaagtcgcgctgggccgcctcacgcgcgtccggcgacatgccgccatggtaggcgacagccggatgccccatctggttcagcgtgtcggcgagtgcttcggtggtcttgcgggtggcgcagtagacgatgccggattcgtccgtatggtcggccacataccgcgccacccatgcggccttgtatttggtctccagtttgaccacatcaaaatacaggttcgaccggtcgaatccggtaacggtgacggccggattccgcaatcccagcagtcccacgatgtcccggcgcacccgttcggtggcggtggcggtgaacgcacccaccggtggacgctgcggcagcccggcgatgaaatcgccgatacctaagtacgacgagcggaagtcctgaccccactgggagacgcagtgggcttcgtccacggcgatcagcgagatcggcgtacgggcggcaaagtcgcggaatcgcccggtttccaagcgttccggggccacgtacagcagtttgatctgtccggcggcggcttgggcgaacaccatcgcctgctcgtcgggagtttgagtggtgttgatgaacgcggccggcagaccgaggtcgttcagcgcatcgacctggtcgcgcatcagggaaatcaagggagatatgaccaaagtcgcacccgggctgagcgcggcgggaatctggtagcacacggacttgcctgcgccggtgggcatcacgcccaagacatcgcgtccggcaagcaaagcctcgacaattccttgctgtccgggcctaaacgagtcatagccgaagtatcgtgtgagcgcctccagcgccgcctgatgtgctgtcataaacgaccagtgtaggccgaccgcggatggatttcatcgtataacggaatacctcgtaacgatgtacgtagcccttccgtattattatgcgtcgaggaacgctattcccggcatatcgcacgatatgccgctttgagagaactaagacggggcattttatggccaacgatacattttccttctcctctcctgacgatcaggagacggcggtgttgcagcctgtggccgccgatgggctgttcgcagccgcggccacaggtaccgccacaccacagcaaagtgacaatggcaccaataaccatgccgacaatacagcctatgtgggtgaacatgtcatggcatctaccaccgctaaatcacatggcaaggccgcacggatcgccatcataaccatatttgcagtgttgcttgccgcattaatagcctatttcttcgtcggacgttggtacttccaagacaaggctgcgcccggtgttcatttgggcaatgtctctgtcatgggccagacccgcgaagaacttgcgaatactgtgaagcagcagcagaataacaccacggtgacgttcaccgccgaaggaaacagcgtcaaagcctcgctgaaggaccttggtgtcaccgtcgacacggataaaaccgtagatgcgctgttgaacgcgaagaccggcgacgtggccaagctcaatattttcgatcagccgcatatcgctctgaccgccaccacgcacaaagagactgccgaacaattcgtcaccgacggcctggtcgacgagaccgaccgagcgcagattgccaccgttgtctacaacaagagcaccaagcagttcgattacaccgcgggtcaggatggcaagggcccggatatcaatgttgtcaatgctgcagtcaaggaggccgtcgcgaccccgggcgaaaatgcgacggtgccggtcaagatacagactgcaaagaatccgattgatgaggcgagcgcacagcaaacacagtttgacgccaatgccaagcttggcctcaaactgaccgtggacaacggcgtgaacaagagcgtcaccatcccggccgataccattgcctcattcctcaagcccacggtgaataaggcggatggcaccatgagtctggtagtcgaccgcgatgccatcaccaagtacgtcaccagtgacagcgtaaccaaggaactgactgttcccaaggtgacacgcgaggtctacatcacgccgaaagacgaaggcggcgtggaaattggtgccgataagacactcggcgtggatggtattgaagtgactggtgccggggacgcccccgaacgtctggctaccgccatcgagcagaaccagtccactgattccactgtggctgtgaaagacagcccatatgatgtcaagcaggtcgaggtgcctcataacttcgatacggcaaatggcgataagtgggttcatgttgatctgacgaaccagactgccactgcatatcagggcaccacggtggtcaggaagttcaacatcgcttctggcaagcccaccgacgatggttccatgctgtccgataccggcacgttctacgtgtatctcaagtacgaatcgcagaccatggttggcgaaggctacaaccagccaggcacgccgtggatttcctactataacggcggcgaagccctgcacggtgttcctgcatacatgtggggcgagcaccccatctatgtgcagcagggtatcccaggctcgcacggctgcatcaacatgcaggtggccgacgccaagtggatgtacgactttgccaccatcggcactcgtgtggtcgttgatggcaccacaccgacttccggtcaggcgttgcgcccggctggtgcggatgccactggatggcagggcggcaacgccagctgattcaatccatgtttaatcgataacgaaaaatccccgacccttgtgggccggggttttttgtaggtaccaatcgatagcgagtccgccgataagcgtggtggcaccgtcaatacggtgccaccagtaccgtcagtacagtcagatacgatccaacgcctgcttgagatcggcgataaggtcgtcggcgttctcgataccgaccgagatacgcaccaggttggcgggcacctgcagggtggtgccggccacggaggcgtgggtcatggcggcgggcacctcgatgaggctttccacaccgccgagcgattcggccagtgtgaagatctgcgtgtggtccacgaagtgcttggccgcctcggcaccgcccgcgagctgcacggagacgatgccgccgaagccgccgtgcatctggcgggcggcgatttcatgagcagggtgggactcgaggcccgggtaccagacgcgctcaatcacatcagagggctgggattcgagccattcggccaccttcagggcgttggcactgtggcgcttgacgcgcagatccagggtcttcaggccgcggatgtccagccaggagtcgaacggggagggcactgcgccggcggcgttctgcaggaaggcgaccttctcgcgggtctcctcgtcgttgaccaccacggcaccgccgaccacgtcggagtggccgccgatgtacttggtggtggagtagaccaccacatcggcgccatcggccagcgggtgctgaagggcgggcgaggcgaaggtgttgtcgaccgcgaccttggtgccgtacttgtgggcaacttcggcggtggccgcgatgtcggtgatgttgagcagcgggttggacggggtctcgacccacacatactggtagtgcttggaggccagtgcggatattggtattgattcttttgatagctagttatggagtccgtccccagctccctcatcagagggagctccgtcaaggtactgctcggcgagggagggtttgctggtgcgctccacaatatcgccgtagccgttggcgcgcatccagtcgtcattgaagatcttctccagatagctgcggccggaatcaggggcgagcaccaccacgatctggttctcgtccaaatcattggcgagcgcgtacttgatggcgctggccacggccatgccggacgagccgccgaccagcagcgcctcctcgccggccagacggcgggtcatttcaaaggcttcggcgtcggatacgcgcacgatgtcgtcggtgatattccggttgaaggccttggggtagaagtcctcccccacgccctcgatgtcgtactggtggacttcatcgcgtgaggaagcggagtagatggagccttccgggtcggagccgatgactttgaccgcgccgttggaggcttccttgaggtacttgccggtgccggagatggtgccgccggggttgaagtattcgactttgacggcgatggtggatttgacgccggccacctgcgggatgtggttgagtttgacgagtggggtgttgccgatgagttctgcgaggctgttgtggatggtcatgtgaagtccttcgttgctggggttgtggcgttttgctgcgttgcgttcgtgaaccgacgttcccagacgaatggactgtggctttggtttgaaatcgagtattcccactcactgtacggtgaagccgaaaagtgagtcggcttttcatgtcggcccacagctcgcgcgttacacggttacgctcgtgccatcaattccatgaaaattcatgcgacagatttgccgcaattcgaatgctctatctcaagttatgcgtcactgaccgctcgcccaggggcgtcggttagcgacaacaacatgagataatctgcatgtcccacaccatagcacaacccgcgacaagcgcgtgtcgccggcgttcatatggtggccaagattctttgacaacgattccgccacgccttcaagcagaacgcttccataccgccaatcatgctcttgtaatggcagaatcgtcaatccgaagtgatggcaaaacacaacagttcggatcatagacaacgatgagggccggcacaagccggccctcatttcacttcgccacgacctgacggccctgcacccacactgcgcggatgttctcgggtacggcaagattgaggatcttctggaagatgtcggcgggtggctcctgctcaccgtccgggatgcggcgatatacgccatgccgccgagcttcgtcccgctcgacggcataccgttcggcatccggctggagcacggacgtgatgatgccccggtcatcaatcaggaacagggcgttgtggaaatacgcgacctcgtcgcacgtgcgcgcggtgaagccggatccttcaatggccagggacagcgtcatggcatcagtcctgtgcgtagatcttcttgcggaacacgaggaacacaatcagaccgagcgtcatgacgccggcgccgatgagcagcaggttcgcgtatccggccgcggcaccggtggcgccggtgatgctggaaccggcgagcgcctgcgaacccatgagtccaccgatgatggagatgccgatggaggcggtcacgttcatcagcagatcgttcatgcccacgccacggccggactcctcctgcggaatcgtgctcagcacggtggagaccacgggcgaatacatcagacccacgccgcagtagaacacgcatgcggcgatcgtcaacgccaggaagccggcgttgacggccagggcggcggacacgaagccggcgatcatgaggcatgcggcgatgatcagcgcagcctgcttgccgatcctgccgatgatcaggccggagcaggtgcccacgatggccgcgcacacgaacgcccacacgacgtacgtggacacctgggcggtggtcatgccgtacacggtggtgccgatgccgttgaacagcggggagatgcagtagttggtgaagtagaacacgaggatcagcgacatggccgccagccagcgcgtgttcttgaagaaggcgggggtcacgaacggatcggaggccttggcgatgtacacggcgaagaccacgaacagcgcgacggccacgatgagcatccaccatgccatgtaggagaagaacagggtgaggaacgcgctggccaggccgaagatggtgaagccgatccaatcgaccttgtcgccgctgccctgacgtccgggcaggctcttgagcagggtgggcaggaagaggatggtgacggcggggatgaggaacaggtactgccaggcgatggagctgagcgcgccggcagcgaacacgccgatggaggcggacagctggtagccggcggtgtacaggccgaagaacacgaccttgagctcgttcttcagatatttggtggtgatgaccagatacacggagccggccacctgttcgcctgcggtctgcagcacgcgggcgacgatgacggtccacaggttcgcggggaagaagaagttggccacgaacccgaaaacggagccgacgaacagcatgatcaggccgacgatgaccagtcgcttcagggagacgaagtcgccgagcgaaccgtagatgaagcacacgatgccgagcacgatgctcgggaaggcggtgatcagcgaggcctgggccggggcgccgacgtcttcgcccacctgggtgaacacgaggttgaagccctgcaggcacagggtgccgaggatgaaggtgatgagcagcagcaccagggccttgacggccgtttgggtggtgacctgctcgtcggcggacttgacgtccgcggtgttggtcgatgatgtcatggaattcctctctgttctctgtttgctatgctctgtttgcggtgttcggcatgttccgtgcgccgacgccgttacccggcgtgcttggcgagcgcggtgatgcgggtcatgaactcgtgcaggaaacgcggcacgtcgacgccgaccgcggccttcatggtcttgaccggatcgttgaggcgcgtattgtcgccgatggtgcggccgcgcgtggggccgtccacatccaccttgaggttcatgggcagggtgtcgaccagcgtggggtccacggccacgccgaccgccagggggtcgtgcaggccgcagccgcccagatgcggggaggtcgtctcgtatgccttgatgtagaagtcggtcatgtccgccaggaacgcgccggccttggtgcccagatcacgccactgccgggtctcccggtaggtgagcagggtctggagcgtcacgtcgaggccgatcatcgtggccggggcgcccgaacggaacaggtaatcggcggcgtcgggatcctgggagatgttcgcctcctcccaggcgttcacgttgccgcagacggtcagcgcaccgcccataagcacgatgcggccgatctcgtccttgatctccggcgccttgcgcaatgcggcggcgatgttggtcatcgggccggtgggcacgtagacgagctccttgccgtacgtcttggccgcgtcgatgatgaagtcgaccgccggctcggattgcggttcgcggttcgaatcggggatcgagacgtcgcctatgccgttggcgccgtggatgaacttggagatctccagcacctcgaacgagtcggtggtgctggagtgcggcagacccttgtacaccccgacttccgggtggccgagcagatcggtgatggccagcgcgttgcgcacgccctggtcgagcagcacattgccgtatgtgccggtgatgccgatcaattccacttccggactgcccaatgcgtatgcgatggcgagcgcgtcatccacaccggtgtcaaggtcgagaatgagctttgtcatgaaacacccttcccttggggggcgagaccgaatggccgtcactgattcccccgcaagcatcatctatgatagccgccatgccgcgatggtgcgcgtcagagcgaggcggcctcgataagccgtctggtgtaatcggattgcgggtcgccgagcaccgcggaggtgacgcccgtctcctcgacccgcccgtcatggagcaccacgatacggtcggcgatgtgccgtaccacgccgagatcgtgggagaccatgatgatggcggtgtccgggcgggccgcacggatggcggcgaaggtgtcgagtatctggatgcgggcggccacgtcgatggcgctcatcggctcgtcggcgagtatcactttgggttcgttgatgacggcgcgggcgatggccacacgctgcgcctgtccgccggacaggtcgatcgggtatcggtccaggaagtccgccggttcgaggccggccatggtcagggccgaggccacccgttcggcgatggccgcggatccaaggtcacgccgttgcagggtcagcggttcggccaccgatctggcgacccgccatcgtgggtcgagcgaggagaacgggttctggaacaccagaccggattcgcggcgcagggcccgccctcccggcgacctgcggcccggggccacggattggccctcgtagtccacgctgccggcgtcggcgggttccaggcccagcatgatgcgggtcaacgtggattttcccgaaccggagccgccgatcacggcgaggcattcgccggcgtggacgtcgacggagatgtcgaagaggacttggtggcgtgcggcgcgcgggccgaaggatttggtgatggagtgggcggagaggagcggcacactgctgttactcatgcgaatcctccttgggagtgtggagggtgagggtttgggcggcggcgactaggcgctgggcctgcggcgtgtcgggcgcggcgagcagatcggcggtggcccctgattcgatgatgcggccggcgtccaacacgtagcatcgttcggtggcccgcgcgagcacggagaaatcgtgggtgatgaacagcatggatgcgccggcgtcgtccaccagcgaggtcagcaggtccacgatctggcgttgcgtgatggagtcgagcgccgtggtgggttcgtcggcgatgatgaaccgcggcgaggtgatcagcgccgtggcgatgcctacgcgctgctgttggccgccggagagttcatgcgggtatttgccggccacgtcacggcccagtccgaccttgtccaacatgaaggccacccggtcggcgcgttcggctttgctcagatcgtagtgcatgcgcaacggcagggcgatctgctgcgccgcggtcatcaccggattgagcgcatgggccggattctggaataccgtgcccacataccggcctcgcaggtcggcgaggacatgctcgtcggcgtatgtgcaacgcgcgttccccgccagcccgtccgcgccgccgtcttcgccggacagcacggaggtgtcccccatcgtgatctcgccggacggcacggcctcatgcggcaacaggccgagcagcgatttggcgatcatcgacttgccggagccggaggcccctatcaggcccacccgttcgccgtccgcgatggacaggtcgacgcccccgatgatcggcgtgccgccgatgacgatgcgcagtccacggatctcaacgctcatcgtccgcctccttcgccgccgacgcggcgtctgcgcgcacggcgcggccgaccccggccgatcgccgcagcgcggggttggacaccgggtcggtggcgtcgcgcaacgcgtcgccgaacaggttcagcgcgaccaccaccagggtgacgatcagaccgggccacaccaccgtcaacggaaacacgttgatgagtttgaccgaggtggccagcgaatggccccagctcggcacccccgcgccgacgcccacgcccagataggtcaggcccgcctcggccagcaccgaggtgcccgccgacatcgacgattgcaccatcagcaccggcgtgatgttcggcacgatgtgtctgaccagtacgccgaacccgctggcgccgttcgcccgggccgactgcacgtatcccgagcgggcggcgagcagggcggccggacgggcgacgcgcgccagatgcagcccgtagccgatggagcacgcgccgatcaccacggccgcggatgcgccgaacggcacggcgagcagcagggcgatgagcacggtggggatggagatcagcgcgtcgaccacggcgaccgacgccgaggcgagcaccgcggaacgggcgaccataagcccgaccagcagcatgccgatgcaggccgagcagatgacggtcagcagggcgatggcaaggttcgtgcgtgagccggccatcagccagctcagcacgtccgcgccggtgccgtcggtgcccagccaatgcgcggacgacggcttgtcccacacgtggtagccgtcggtggccagcaacgactgcggggtccagaacaacgacaccagggcgacgaccatccacaaccccagcacgatcagcgagtagcggccggtgccacgggaccagatggtgcccagaaccacgcccgaacgacgccatcgaccattgcgatcaaccatcattcctcctttccggcggccagacgcgggtcaagcagcgcgtgcagcagatccaccgccaggccgatcagcaggaagaacgcggcgagcaggaacagctcgctttgcacggccaccagatcgcggttgccgacgtcgcccaccagcagggcgcccagaccgggcagggcgaacaggttctccaccaccatcacgccggtgatcatcgaggcgaacgccagccccaccaccgagacgagttgcggagccgccaaccgcaatcccacgcgcaccaacgcctgggtgcgggtcatgccgcaggacatggccatatcgatcggacctccctcatcggcgatgccttccagaatggagcgcgtgtaacgcatgatgcccgcaccggacacgaatccggtggcaagcgccggcaggatcagggacgagaccgcccgcccgggagcgccccacccagcggcggggaacccctgcgagggcagcagaccgacaaggcccacgccccgtgcgaacagaaggatgagcatcaggccgctccacagggccggtacggcgccgcccacgatggacagcacgcgcaggaaaccgcgcacggccggcgaccgggagatcacggcggcggcgcccatggacaagccgagggtgagcgcgatggccagactcatcacgatcagcgggaacgtgatcgtcgcacgttggccgacctgggaggtcaccgcccgcccggtcagcgccgacacgccgaggtcaccgtgcagcagccctccggcccagtcgagatactgcacgacatacggccggtcaaggccgaattcggcgcgcagggccgccacacgcgccggcgatgcgttcatgccggccatcacgaccgccacgtcgcccggcaggatgcgcagcatcgcgaacaccagcaccgaaatgccgaacagcgccgccgcgaacagcagcaagcgttgcatcaagaaccgcataacgcctcccttatcgattccctcgccaccgcccgtggcgtcaccggccggatgggccgtccacggtcgggcgcgccacggaatcactcccgcgccgcgcccgaccgatgggttccgggactacttggtgtaggtgatccgccagaggggcagcacggtctggctcaggttctgcgggaagccgtccacgcccttggcgtaggcgatggtgaccttccagctgaacagccagtcggccggcgcgtcctcggagacgatcttcgcggccttggccagatacttcgaggcctcgtcgtcggaggtggcctccagcgccttggcgtacagggcctgcacgtccttgttgtcgtagtggaagtagtagctcggcgtggtccatccgtagaagtcgtggctttcggcatggtccacgagcgaaagatcgtagttgccgttggcgtgcacgtcctgcagccaagtggagaactccacgtagttgatcttcaggtcgatgccgatgggcttgagctggctcttgagctggtcgccgagttcggtgccgtacacgttggcgtaggtgagggtcaggtccagcggcttcgactcggagtatccggcctgctccatgagcttcttggccttggccacgtcatgcgggtacaggccgctcagatcctcgtaaccgggatcgaccttggggatcggaccgccgaggggggcgtccacgccgccgcgcgaggcgatgatctgcttatggtcgatggcgtatcggatggcctgacggacgcgcttgtcggagagcttgtcgttggccatgttgaaggcgagcacgaacttgtcggaaccgtcaccggacttgaccacatagttcggatccttgcggaacggatcggcaagggtggcggagatgggcgaaagcacctgcacgtcgccgctcttgagggcgttgatgctggcgttctcgtccggcaggaaccggacgatcacgttctcggtcctcgccttgtgctcggtgccccaatacttggggttcgccttgagcacgatcttgtcgttcgggtcaaaggagaccacggtgtacgggcccgagcccaacgcgccgttcttctgatcccaggtggcgtccttgtcgtagaccaggccgggacggctggtgaggtaccacagcatgttcgagttgggcgcggagagggtgagcctgaccgtgttggcgtccacggcctcggccttgtccaggctcttgacctgctcgtagtcgtagtacttctgggccttgagctcgttgatggaccacgccacatcctcggcgtcgagcttgtcgccgttggagaagttcatcttctcgttgaggtggaatgtgtaggtcaggccatccttggagatctcccagctcttggccagaccggggtggaccttgttgtccgagccacgcgagacgagaccctcgtacacgttgccgatgaggatctgctcaagggccgaacccgactggtggcggatgtcaagattgaccggggcgagtttgaggccgacggccacggtgtcggatcggctggccgagccggaggcgttcgcgtccttgcccttgcctttcccgccgaagacggtgacgcccacgatgagcgccgcggccacgacgaccgcgatcagcgtccacagccaccatttcgggccgccgttcttcttgtttgatgatttcgcgcgcgcgttcaggctcgcgtcggtgctggcggcttgattcgcgccgtcgatgttcctgtcttcggttgcgccggactcgccgtgcacaccattgttctgggacatggatactccctgatgcattcgggcatgcttacgcccgaatatggtttcgttgttatcttgcgtggttgaccgcccattcgggtcgatcaccacgttctactatatccccggacacgccggaggcaatggctatactggattgcggcgccgacggagggtccgcggcgaccacagcacgcggcgcatcgtcgggcaacaacgcgggaagcgctggcgtgggcacatgtgcggccttggcataaggccgggaggcagctatggcacatattcttctgggcgtcaccggcagcatcgctgcattcaaggcctgtcatctggcatccgattggaccaaggccggccacgaggtgcgggttatcgaaaccacagcggccgaaggtttcgtcactcccctgaccttcacctcgctgacccatcagcccacccgtaccacgatgttccccgcttatccggccgcgcacggcgacgtgacggccaatccgaccgtgccaacgaccatcaatcatgtggccgatgcggcctgggccaatctgctggtggtggccccggcgagcgccgacgtcatcgcccgcatcgcctgtggattggcgaacgatacgctgacgtccaccattctggcctatgaggggccgaagatcctatgcccgtcgatgaacgtgcatatgtacaacaatccggccacgcagcgcaatctgaaaacctgcgccgaattgggctggcagattgtggagccggaggaaggcaatctggcttgcggcgacgtgggacgaggccgtatggaagagccggcgcgcatcgaggaagtggccgctcggctgctggcggatgcgcaggatgaccaggctccctcatcttccccgctcaaggggctgcgcgtgctggtcactgccgggccaacgcaggagccgctagacccggtccgctatctgacgaaccattccaccggcaagatggggtatgcgattgcctcggccgcagccgaatttggtgccgacgtaacgttggtctccggtccagtcgccttgaccgcgcccgatgcggtggatgtggtgcgcgtcatgaccgcgcaggatatgttcgatgcggtggccgacgccttcccggcggcggatatcacgattatggccgccgccgtgggcgatttccgcgtggccgagattgcgccggagaaaatcaagaaggccggccgcagcagcatcaccgtggagctggtttccaacccggatattctggcgtgggccggcgaacgcaagcgcgacgacggctcgcagatcctgtgcggattcgcgatggagaccgagcatctgattcgtaatgcggagaagaagctgacgtccaagtattgcgacatgctggtggccaacaatctgcgcgacgccggtgccgggttcggcaccgacaccaacgttgtcaccgtgctcacgtccggagcggaggatgccggtaccccgaagatcgagcattgggacaagatggacaaaaccgtgcttgcgcaacgactgttgctgcggctcgcagcgttgcgttccggcggcgcgagcaatgtcgatgacgagaacaaggaggcctgacccatgctgatggcggtcgatatcggcaatacgaatatcgtgatcggttttctggagggcgaccgcatcgtcggctcctaccgcatcaccaccaaggcgacgcacacctcagacgaatacggtctgatgatcacgcagttcctggctttgagcgattacacggccgacgatgtggacgatgtgatcgtctgctcggtggtgccgaaggtgatgtattccttccgcgcctcgctgatcaaattcctcggattggaaccgatggtggtgggccctggcgtcaagaccggcatgaacattcgtctcgacgaccccaaaaccttgggctctgactgcatcgccgactgcgccggcgcctaccacacctatggcggcccggtgctggtggccgacttcggcaccgccaccacgttcaactatgtggacagttccggcacgattcgttccggcttcatcaccacgggcatccgcaccggggccgaggcgttgtgggggcagaccgcccagctgccggaagtggagatcacgcaaccacagtcgattctggccaccaatacgcgcactgctatgcaggccggactgtattacacgttcctcggtggcattgagcgcacgattcagcagttccgcaaggaaatcgatgagccgttccaagtggtagccacgggagggctcagccgcattttcaagaacaacaccgacatgatcgacgtctacgattcagacctgatcttcaaaggcatggcatacatctactcgcgcaatgtgaagtaacgcggcgtgcaggaatcggccgcgcatagcgcagtcgattccgtccctccccgaaaaccaactcaaaaccctacttaatcgtaaagccctgattgaagccgtattctcggaggtctttctgccattgggccaggccgtcggagagactgactttcttgccgggcttctccaacggttcgagcgggttgccttcctcgtccttcatgcccatctcaatggcttcctgtcgctgctgatagtcgtggaaactgctggaccattcgtatgcctggcccaccgtagatttgaagtcactgcgcgcatacacttcgaacggcagatactggtatccgatcggcacatcctcggcggcctccgacagtacacggttgaacttctgcccgccgaaatacgggatttcaatgccacggtcattggtaatcgtggttttatccaaaaaatcagcggaattcagggtgtcataatcggccgggaaagcaccgccatccacacgcgcgctaatgccttgggcgttatgcgccacaaagtccacgaaacgataggccgcatccggcttacgggtcagctgcaacacggtcagcgccgatccgccgctttcggcattggcgggctgaccaccataggtgggcatgggagccacgcgccacagaccggccgcgcccggcacattggacagcagcagcgacggcatccaagctccggagaacacggaggcgatggtgccggtgctcacgctgcttttccaccgatccgaccatgtggcggaggtggtatcgacaagcccctcatcgatcattttctgccagaattcggtgaaccgttgggtgccggcatcctcatccaaatcgatggtcacggttttgccgtcggccgacgtgtggaacggctgaccaccggcaagccagaccatcgcgtcatagaaactgccatcacccgagtcggcggcgatgtacacgccgatctccttgagctttttggcggcctcatagtagtcatcccaagtcttgatcttggtggcgtccacgccggcttggcggaacacgtcttcgttgtagaagaaacccatcgggcccgaatccatgggcagcccgtagatatggccggcgagctgcacggacgaccatgtgccgagggtaaagaagttggaataatccgagccgatcttgtcggtcagatcaagcaattggccggagaccgcgtactgcaacagtgcatagtattcgatttgagccacgtccggcgtgccgtaaccgtcctgaatggcggtattgagattgtcgtagccggagatgttggtccatttcacgcggatgtccggattggctttttcgaagcggcggacgacctctcccatgctcggttcccagctccatacgctgatctccgtacggttgtcgtccgtagcctgcccgcacgaggccagggatacggaaaggatggcagtcactgctatggttgccattcttttgattcgctgtccgatcactcgcatggtgacgagtgtactaggcggggcttaaaacggtagatgcatcctgctcatgaccactcacaacagccagcattccgccgaagcgctcgaggccttcacgccgcaaccgctcgacattgcgatgaacaccgaggctaccgaaacaccggcctcatgggccacgtccgccatcgtcactctgtttttgcctcgcacggtgaccaccctacccgactttgctggagaaacgaaaacggctccctgctgcgatgagcagcaagggagccgttgaataattaggcgctatgcgcggttttacagcttgacgacgagtacgccgttgggctggatggcggccgtgtgctcggactcgttgacctgggccagcgaggcgaccagcggttcgccttccacgtccacgaccgcaacatcgtgggtgcggttgaacaggaacacgaagtggttctcgccagtttcgtccgcacgctcgacgcgcagcacttcaccacgatcgtcctcagccgaagtctcgatgccgagttcctccagcagcgcgggcaggctcttggccaagccctcacgcccgagacgggcaccgacgtatgcggccttgccgtcgccgaagtcgttgacggtgatggcgggagcgccgtcgaaaccggtccacttatctgccttgaaggaggcgaccacgtgagcggtatcggccacggaggtgatcacgtcggcgaaatcgtgcgccacggttccgttgtccaagtcaaggtggtccatggtgccgggggcgtcggtgcccatcggggcgaattcctcgacgcgcacgcccaccacgtcgcgaatggagccggggtagccgcccagccagacgtgatccctgtcgtccaccagaccggtgtagtaggtcacgaacagcttgccgccgttcgccacatactcgcgcacgcggcgcgtggtctgctcggacaggatggccaggctcggcaacacgacggcctcgtactcatcccaaggaccgcggaccggcaccacgtcggcggtcaggccattgtccgccagcgcgcggaaccagtccagcggctcggtccagtggcgcacctcctgcgtgggggtggcggtgtgctcggtggcccactgggactcgtagtcgaagacgatggcgaccttggacttgaccagcttggtgctcagcaggccctcgtcagcaagcttgttgaggtcggcacccagctcgcacacatcgcggaagatctgggagtcggggcctgcgtggggcaccatggcggaatgccacttctcggcgccggccttggactgacgccactggaagtagcagatggcgtcggcgcccatggccagatgggccagggagtcgcgcaccagctcgccgggctcgagccggtagttggtcgggcgccagttgacggcggacgtggaatgttccatgaggaaccacgggttcttgcgggcgatgccgtcggtgaggcaggccgcgtaggccatctcgtcgaagtgggcctcgccgggcgagaagtaatggtcgttggacacgaagtccacgtcatgaccccacttgtcgtagtcgaggacggtgcagcccgcggagaccatgaagttggtggtctgcggcttgggggcgatctcgagcagggcgtcgcgctcggccttgtagaagtccagcagcgcgtcggagctgaaacgcttccaatcaagcagcttgcccgggttcatgaagttgccgtcgccgatgaatcgcggcgggatgatctcggagaaattgttcatgcgctgcgcccagaaggcggtgccccaggcgtcgttgacagcgtcgatggtgccgtacttcttctcgcaccacttctggaaggcgcgctcggcgtcttcggaatagtcgaagcggttgtggcagccgtactcgttgctcacatgccaagagaccacataggggttgtccttgtagtgctcggccatcttgcggcacaggttgagcgcgtagtcaaggaagaccgggctggtggcgcgccagtgctggcgggcaccgggctggcagacgtcgccgcggtagtcgacccagaggatctccgggtgggcctgggtcatccacatcggcggggatgcggtgccggaggcgagatcgacggcgatgccggccttgccgagcttgtcgatgacgcggtcgagccaatcgaagtcgtacacgccttcttcgggctcaagcttggcccaggagaagatggctacggagacgaggttgacgccggcctgctgcatgagggctacatcttcgtcccacacttcctcaggccattggtcggggttgtaatcgccgccgtaccagatgcggggcttgttgcccgcaagtggctgcggccacttgaacgctctatgttccatgatgattcggttcctttattgcattgcatcgatagtgtgcatgtacgcgagtggattttctcatgtcacacagacacacgggacgacgccggacggggcgtcgcggtcagatcagcaacggttgccgggaaacgaattcccgctcctgccccgtcaccggatcggtgaaccgcagcacacgcgccaccaactgcagcggctggctgaaatcgtcgtaccggcgcgcctggatgcatggatagaaatcatcgcccacgatgggcagccccaacgcattcatgtggacgcgcagctgatgggttttgccggtatgggggcgtagcgtgtagcggcaaacgggcacggccgacggacgggggccgcccgccatcggcatgcacggcttcacaccggggaaaagggacacgggttcgccgcgttcgataagggtttcggcgttgaccaagcccggcatctcgaaggcggccagaacgccacgctccttgacgatatgcgagcggcgcagcaacgggaacggacgcggcgggtcgatccgggtcacggtgccgtatcgaggccgcacgatcggccggcatggcgccagacactcgtagaccttgacggcctgccggttctggaacagcatctgatacgcgccgcggcaggccggatcccgcacgaacaccaatacgccggcggtcatgcggtccaatcggtgcgctggcgtgatgtccggctcccccagccgctcacgcaatcggatcagcgcggtctgccgataccacatgcctcgcggcatggtggccagaaaatgcggcttgtccaccacgatgatccgctcgtcctcatacagcacgtccatctcaaacggaatatgaggctcgtcaatcacataccgatgtggcttactcaacggtcacggacttggcgaggttgcggggcttgtccacgtcgtagcccttgagctttgccatgtccatggcgaacagctgcagcggcaccacgtcaaccagcgggctcatcagcgttgggcaggcggggcgccagaacaccacgtcagcgtaccgttccacatccgggtcgccctgctcggccacggcgatgatgtacgcgccacgagccttgacctcctcgataccggagatcaccttggcgtgcaacacattgcggccgcgctgcggcggcacgatgaacaccaccggctcaccctcgtccaccagcgcgatcggtccatgcttgagctcgccggccgcgaagccttcggtgaaggtgtaggcgatttccttgagcttcaacgcgccctcaagcgccaccgggtagcccacgtggcggccgaggaacaagaaggagttggcgttcaccatgcgctcggcggccgcctggatggtcttgggctgggtgtcgagcacccactgaatcttgcgcggcatatctttcagggagtcgagcacctgatgaatctcatcgcggaacatcgcgcccttgacctgcgccagatacaggcccagcaggtaggcggcggtgatctgcgccacgaacgccttggtggatgccacggcaacttccgggccggcgtgtgtgtagagcacggcgtcggattcacgcggaatggaggcaccctgcgtgttgcagatggccagcaccttggacccctgttcgcgcgcgtggcgcagggccatcagcgtatccatggtttcgccggactgagaaatggccaccacgagcgtacgcggggtcagaatcgggtcacggtaacggaattcgtgcgcgagttcgatttccacggggatacgcacccagtgttcgatggcgtatttggctacctggccggcgtagctggcggtgccgcaggccacaacgatgattttgtcgatggccttgaagtcgtgttcgtcgatacgcacttcatcaagggtgatgccgccattcgtatcgaagcggccaagcagggtgcgctgcactgcggcagggtcttcgtggatctccttgtccataaaggaatcccagccgcccttttcggcggccgaggcgtcccaatccacggtgtaggtcttcgggttttcgaccacgttgccgttgaaatcggtgacgatgaccttgtcggcggacacgcatacggcctgatcctggtcgacttccatggcgcgcttggtgtaggccacgaatgcggccacgtcggaaccgaggaagttctccccctcgccaaggcccacgaccagcggcgaatcatggcgggctccgaccacgatgcccggctggcggcagtcggtggccagaatggtgaacgcgccttcaagcatgcgggccatgcggcgcacagccttgaacaggtctggcttgccttcatccgcgataatcttgtccacgatcttgccgagcagcttagcggccacctcagtgtcggtggcagaagcaaatcggtagccttcggcttgcaggtcgagacgcagctgagaggcgttttcgatgatgccgttatggatgatggccaccttgccgtccatgctggtgtgcgggtgggcgttcacgtcgctcggctcgccattggtggcccagcgcgtgtggccgatgcccaccgtggcaagcggcatcggcttacgctcgatgtcttcgaccaggttcttcaaacggccggccttcttgcgcacgaccaccttatccatgccgggcgcggtcagcgccacaccggccgagtcatagcctcggtattccagacgttccaggccttgcaggcagacctccaaaggcctaccgcatgccgtttcaatatttcccgcgtatccaacgattccacacatggctcaccagcctagcggacgattattgcgcaaagcgaatccaacccgccgtattcgcgcgatcggagcatgcggcgcgggcgaaccacccggcgtgtccgcccggcttggcatggcctacagcacgtgctgtaggcggagccgtaaagcggggagcccagtgggctccccgtaggcgacgccgaagcacgacagtgctgaggtaatataacagccttcctacagcacgtgctgtaggaagtccttaaacctaggctcggtggggtggtcgatgatgtcggggccgccctgctccacgaccacgccgccatccatgaacacgatctggtcggcgacttcgcgggcaaagccgatttcgtgggtcacgcacaccatggtcatgccttccttggccaaggaacgcatgacgttgagcacctcgcccaccagttcggggtcaagggcggaggtcggctcatcgaagagcatgatctccggcttcatggccagagcacgggcaatggccacgcgctgctgctgaccacccgacagctgggaggggtaatagtccgtgcgatcgcctagaccgacgcgctgaagctcggccacggccaggtcacgggcggctttcttggactggtgctgcacgtggatcggggcttccatcacgttttccagcgcggtcatgtgcgggaacaggttgaagcgctggaacaccatgccgaggcgagagcgctgtgcggcgatctccttatcgtccagggtctgcagcatgtcctggccgtttttggtcacgtgcttgtagccgatgagttcgccgtccacctcgatggaaccgccggtcagggtttccagctggttgatcagacgcaggaacgtggacttgccggaaccggagggccccagaatcacggtcacagtaccgggcataacggttagatcgatgcccttgagcacatgcagcggcccaaacgccttgtgcacctgcacggccttgacagcaggaatcacggaaccgtcagccgccttgcgcacgaccggggcaacactggtgatgtcattcgtagtcataatcgcgctcccgccttatgcattcaatccgacaaatgtggtctggttgagcttgtccacgtcatccttcggttcaccgtcggtcttacccggcaatggcgcctgcttgcccttggtgcccaccggtcgggcatcgaagcccttgccgaagtgcgcctcgaggcgggactgcacaaccatcagaatggaggtgatcagcaggtaccagaagcaggccacgagaagcagcggaatcggcttgtagatacggttggcgatggcgttggtggcaaactgcaactcgagggtgaacggcacggcggtgaccagcgaggtggtcttcagcatgccgatggtctcgttgccggtgggcgggatgatgatgcgcatggcctgcggcagcacgatgcggcgcatgatgagcgtgcggttcatgcccaatgccttggccgcctcggtctggccggggtccacggcttcaaggccggcacgcacgatttcggacaggtaggcggcctcgttcagggccagaccaatccatgcggcgttgaatgcggtgaccaccacgttggagtcgatgctccagaactccaccgaggtgaacggaatgccgaggctgatcttgggaatcagcacggcgaacagaccccagaaaatgagctgcgtgtacacaggcgtgccgcggaagaaccagatgaagaaccagctgacgccgcgcagcaccggattgatggatttgcgcatgatggcaagaatcaccgacaggatgatcgccacgaccatggagatcacggtgagctccaaggtatagcgaatgccttcaagcacgttctcgttgaacaggtacttccagacggtgggccaatccagtcgcggattggtaatcaagccttgaatgagcatcgcggcgagcagtaccacgatcactgcggccacaatcgggccggggcgcttgaccggcagcgccttgatgcggttggggatgttcagcccctcaccgtcgacttctttcttcgccataatctggttccttggatgtgttgggcagcctgaactgcaagttgcgactagcattgaaccttagtgcacgaatggggcgactgtgttacaaacagtgcgccccatctggattgctgggcgtcgtgtggaccaccctcagtctcgctccgcgagccagctcccgcaagcgggagcattcttggggggactattcgacggccgggttgatttcggccttgtccagtgcgccggattcgacgccccagtgctggaggatcttggtgtaggtgccgtcgtccatgagcttctgcatggccttctgcacggcttcggtggtctgggaatcgcccttcttgatggcgatggcgttcggcacggagtcgaagtccttgccgagctgttccagctggccttcggtctgggcgatggcgtagccgacaaccggggaatcggcgaagaacacgtcggccttgccggtcaccacagcggtggtggcgtcggtctgctgcttggaggactggatggtgatgtctttcttgccgtccgccttgcactgcttggcggtcttgttgatggcctcttcctcgacggtgccggtctcgacggcaacgttcagaccgcacaggtcgttctcgtcgacattcttggggttgcctgcggccactgcatagcccatgcctgcggtgaagtaggagacgaagtcgacggattccatgcgctccttggtgatggtgaaggcggcgatgcccagatcgtacttggagccgatggccggaatgatcgtatcgaagttggaggagacgatttcggtctcgagaccgaagatgttgcccatggcgcgggcgagatccatgtcgtagccgatctgggtcttgccgtcggcgtcgaggaattcggccggggcgtaggaggggttggtgccgatggtgagcttgccgtccttggtcacggattcaggcagcagtgcggctattgcatcgtccttcttcacggagctcacgtcgtagctggtgatggtgaccgacttggaggagccgcccttggcggaatccgtaccggcatcggccttgtcggaggtgccgcaagcggcggtggcgaacagcatggccgagctcagtgcaatggccataatggacttcagtttggtggactgcataatcgtttcttcttctctcttacgccgcttcaacggcaacgatcaacggttaagcatatttatacactacagtgcatacatatacaaaaagactcccgccgcagggcaacgggagtcttcatagtaaccgaaactactcgacggacgggttgatctcggccttgtcgacggcgccggaagagacgccccacgtgtcgaggatcttcttgtacgtgccatcatccatcagcttctggatggccttctgtacggcctcggcggtcttggaatcgcccttcttgacggccacggcctcaggggtcacaccaacgtcctcgccgagggcctcgagcgtatcaccggtctgcttgatggcgtagccggcaaccggcgtatcggcgtagaagatatcagccttaccggaagccacggcggtagtcacatcggtctgcagcttggaggactggatgtcgatggcatccttaccgtccgccttgcactgctcgttatccttgttgacttcctcttcctgggtggtaccggtctgcacagccaccttcacgccgcacaggttcgaggagtcgaccttgttcgggttgcccttctgcaccacgaacgtggaaccggccttgaagtaggtcacgaagtccacagcctccatgcgttccttggtcacggtgaaggaggagatgccgatgtcgtacttggagccgacggacgggataatcgaatcgaacgtggaggagacggtgttttccttcagtccgaacactgcggccagcgccttggacaggtcgacgtcgaagccaaccggggtcttgccgtcttcggccaggaactcggccggggcataggaagtatcggcgccgacggtcagcgtgccgtcgccggccacggaatcgggcagcagtgcggcaatctcgtcgtccttctggatgctgctggtgtcgaagccttgaatcgaagtgctggacgagtccttggatgaatcgccgctcttggatgcggtgtcggtgccgtcagtcgtgccacaggccgccacggcgatcagcatggccgcgctcagggcggcggccgcagcggattgtattcccttgcttagagacattggatttcctctctccggatagtcagctgggcgggtatgtttcccagatggttccagagcgtaggagtgcaatgctacggaagcgttaatcgtgggcgaaacgacccacaacgcggacatcctactcttggcccccctccggagaggagccaagtggcgggactagtggcgcatgttggcgtagcgcatggcgcgtagggcttcacgcttgtcctgctcttcgcgcagggcctggcgtttgtcgaattccttcttgcctcgggccagtgcgatctccgccttgacgcgaccgtccttgaagtacaggctcagcggcacaatcgtgtatcccttggcctcgatgccgcgggcgagcttggtgatctgcagtcggtgcagcagcagcttgcgcttgcgcttgggcgcatggttgttccatgtgccgttcaggtattcggggatgttcgcaccctccagccacatctcgccgcggcggtcgatggagatgaacgcctcggacagcgatgcgcgcccctcgcgcaacgatttgacctcggtgccggtcagggccagccctgcctcatacttgtcttcgatggcatagtcatgccgggccttcttgttctggacgatgagtttctcaccagtctccttgggcatgtctcctcctttcgtgggcaacaactcgtgggtagcagtagcaacgcaacatccgacgatatcacggaccggcatcgaatacgaaaaagggttcctcttcaagaggaacccttcaaccgtatatatcggccgaaccaaccgatcagtggacgaaccagtactgacccaaattggtcagcgtgcggtcgtgcatgttccacggaccaccccagttcatttcggagatctggaatgtgccgtcgccatacacggcttcgactacggcaacatggccataggtaccgtcggcaccatcctgaccaggcaggaaggagagcgccgcaccgacctgagggttgtggtccacgcgcaagccgtacgagggggcgttgcgccaccagtcgccgccattgccgagataggacggcgtgccaatgcccatctgcctacggcgttcatacgcccagtacgtgcactggccggcggcataggcgttgccgtaatcaccgttcgacgtgccttggccgccgacgctgggggcgggggcgggggcgggggccggcgccggagccggagccggagcgggcgccggagcgggggtcaccggagtggacggcgtgccgccctggttaccggtatccacccggttggcggcgtcctgctgctccttctggaactgacggttgtaggaatcgacctgcgaggcgatcagcacggtccgggccgcctgcctggcggattgggaatccagactgtcgaccatggaggacagttcgttgcgccgcgtctcaccctcctggcgtagcttgtccaaagcgtcacgttcgctttgcgcggtttcggcggcggtctgtgcggaagcggccttctcatcggactgggtcttgagcacagcaatctgcttttcgatggccgccagacgttcgccacggttcttcgacgtgctcagtgaggtcgcggcggaggaagccgcattcgcctcgttgcgagacaacgcgtcccgggactgcatggagttgacgaagtcctgtgtgctggtggcacccgtcaccacgctcatcacgtcggaagcattcgagccgtgcatctcgtcacgggccagctgggccacggcggcgtgcgcgtcatcgtagtccttgccggtctgcttgatctgctcctcgagcgtctccttgtctttctgcgcggcggaaagacgtttggatgcggcgtcagcctcgtcctgagcggtggcggcatcctcgttggcctgcgtgaccttgctctgggcggcgacaatcttgttgttcgtcaaatcatccagctcaagtaccttatccgccagttcctggctggcaccggccaactgctgcttgagttcggcctcgcgctgtaccgacgcggcgtgctggttctgcgcagtaatcaggtcggaataggtgtctgcctgggcaggctgtgccgagctgaacgccagacctcccacacaggctgcggcggccaccaatgccgccagtgcgggcttgatcacacgtacattcgtcatatgtgaatagtcctttcgctcacttaagccaataccataacatgtgaacctgagaggtttgcacacgatatcatcacatttcttgcgggtaagccggtcgcgttacgccctcaaataacgccgcaacgagatggttgaagcgatgatggacagcagtatcgcgcccacaaccaggaacggcgatatcaccagtaccgtgaactgattcacataaggaatccaggtaatggatttcgccagccagccggtgatgaacacattcacaatggccgaaagcatcaggcacgagagcaccgagccgatcagcgaggcgatggcgccctccagaatgaacggcagacgaatcgtccaattcgaggcacccacgtacctcatgatttcggtttcggttcgtctggatgcggcggacatgcgaatggtggttccggtcagcaggatggcgaccaccaccatcacgccggcgagcacggccgtaaccgccgtggctcggttgagcacggcgaacaccgggtcgaagatctggcgctggtcggtgacgtcctccacgccctccttgctggagagcacttcggagaccacctgatatttggtcggatccttcagcttgagccagagggagtcctgcatatcgtccgcggtcagcgtacggccttggaattcgccattcgggtactgcttggtgaatgtgttgtcgtagaagtcctgcttgctgacgtagtcaatgttggagaccacgtcgttgagttcgtcgcgaatggttttctgcagtgccgtgatctcattggctgagggcgatttgccggaagcacagttcgcggattggctggtgccgtcggggcatagccataccacgacctcgaccttgtcgtaccagtcgcccttggctttggtgatctgcgcctgagtaagcaccgaagcgccgatgaacaggaacgagatgaaggtgaccagcgtcagagacagcagcatcgacaggttacgggtgaggttggcccacgtttcggacagaatgaatcgtgctcgcatgatgatccccttactccttagcgccctcagcgggttgatcgtcggatgtttggtctgcggcggactgctcgccggcggactgctcgttggccggcggtgcggtcggttccggcggttccggcggtgcgggcagttccggcggggccggcagttccggcggggccggcggctcggcggcggatgacacggacgtatcggcaaccgcggcggtctcgccggactcgtccttgaacgggtcgaacgcctgggtgctttccagggcggcggcctgctcgtccagcggaatgcccttgccccaggtcagcgtgttttccagcggcgcaaacgtctcgccatagcggccggtgcggccggaatgcacggaattggccaaacgggcgatgccttcggacggctcgtcactgccctcgatggccttggtcgccgccgccagcacatgatgggcggtgtcggacttggcttcgacttcggcatccgggaagaacagggcggaatcgtaggagccatgagcctcgtcacgcacgatcttgccgttgtgcagttcgaccacgcgcttgcgcatcgagttgacgatctcttcgttatgcgtggccatgacgatggtggtgccggtgcggttgatggcgtccagcacttccatgatgcccagcgaagtggtcgggtcgaggttgccggtgggctcgtcggccagcagaatctgcgggtgattcacgtaggcgcgggcgatggccacacgctgctgctcgccaccggagagctcatgtgggtagttcttttccttgccggtaagccccacggtatccagcaccttgggcaccaacgatttgatggtggaccgccgcgtgccgatcacctcaagggcgaacgccacgttctcccatacggttttgttattgagcagcttgtaatcctggaacacgaagcccagcgaacggcggtactgcggcacttgacggttggtgatgcgccgcagatcgttgccggccacgcgaatctcgccgttggtggcctcttcctcgcgcaacagcaggctcaagagcgtggtcttgccggagccggacgcacccacaaggaacacgaaatcaccgcgttcgatatcgaggttgatgtcgtcaagcgccggtcgggtgcctttgggatagatcttggacacattgtccagtgagatcagtgccataatgctacttactcctcggtttcggcggcgcggcgctgttcatggcgccagcggatgccggcctcgatgaacgcgttgatgtcgccgtcgaacacggcctgggtctggctggtttcgtagccggtgcgcagatccttgaccatctggtaggggtgcagcacgtaggagcgcatctgatcgccccagctggccttgatgtcgccggcgagctctttcttcttcttggcctcctcctcgtggcgcagcacgagcagtcgggactggagcacggccatggcggaggcacggttctgaatctgcgaacgctcatcctgcatggtcaccacgatgccggtgggaaggtgggtgatgcgcacggccgagtacgtggtgttcacgccctggccgccggggccggaggagcagtaggtgtccacgcggatgtccgtatccggaatgtcgatgtgatcggtggcctcgaccagcggcaccacttccacggcggcgaagctggtctggcggcggccctggttgtcgaacggggagatgcgcaccagacggtgggtgccgccctccacggacagtcggccgtaagcatagggggcatccacctggaaggtggcggacttgatgcccgcctcttcggcgtaggaggtgtccatgaccttggccttgaagccgttacgctcgcagtagcgcaggtacatgcgcaacagcatctgtgcgaaatcggccgcgtcgacgccgccggcaccggagcggatggtcaccacggcggaacgttcgtcgtattcgccatcgagcagggtctgaatctccatctggtcgagatccttctgaatctcgccgatttcgctttgcgcctcgtccagagagtcctggtcgccctcctcgtggccgagttcaacgagcgtttccacatcgtcgatgcgctgggaggcggagttcagacgcttcagctgcgattccgcggcggacagccggctggtgatcttctgggcgttttccggatcatcccacaggcccggcgccgcggcctgcgtttcgagatccttgatgtcggccttgagccggttgatgtccagcgccttggcgatggattcgtatttggcgcgggcttcgccgatcgcctgggtaaagtcaaattctgccatcgtggtttaccttactgttggttctttgagattccttgggaagtcacgtccttgttggcagccttcgcacattcctctggcgttggcgggcactgccgcgccacacacgcattcgcctgcaatccatgctgccagaaggttccggggcctgccttgccgatagccggccgggcgacctcacgaatccctcgcatcagacgtgttcaactgcgggcacgaatatgcgaaggcaacgtcaaagccccgcgtagatcgccgggataaccaaggagccgagcatggccacagctatgacgacgcacaccacacgcacgatggtgcggcggcggttctcacgctgctgtcggctgtcctgatagtcactcacgatgccaatagtgtactcaccgcttacgaccgactacaaaccgatacaatccgttcacggcgtaaacgcctattcagataccgatgcaaatctgcacgaccgccacgcacgaaatgttcttttaacttgaccaatcagtacgcgggcttcaccgcacgtatgtcacaccatgtttagaactcaaaaaaggtgtgtttaccccaaatataaaaccttataaatgtgcaatttagcgatatgataaaaccttagaaacgtgcaatcaaggagtgttgatgttccggaggaaggcgtacgacagactactggcatggaagggagctgatgacaggaccgccatgctaatcgagggtgcccgccgcgtgggcaagtccacagtcgccgaagagttcgccaagaacgaatacgagtcatatgctcttattgatttcacgcgagtggacgccgagttcaaacagacgttcctggacctacgcaacgacctcgacggcctgttcctgtacctgagcgcggcgcttggcgtaacgctcacgcagcaccagtcactggtcatcttcgatgaggtccagatgtttcccccgcgagggagttcatcaaacatctggtcgccgatggacggttcgactacatcgagaccggttcgctgatctccatcaacgccaacgtgaaggacatcctgatcccctccgaggaggagtccatgcgcatgggaccgatggatttcgaggagttcttgtgggcgatgggtgaggatgccctggttcggatgatccgccacgcgttcgattccggcgtggcattgccggactcattgcatcgtaaggcatcgcgtctatggcgcgagtacatgctggtcggaggcatgccccaggcggtggcggcctacgctcccgcccgcaacatggccgcggcggacagggccaagcgcctggtactcaaactgtatcgggaggatattggcaagtacggcggactagcagcgaagcgcgtgcgcgcagtgttcgacgcgattcccggacagctggcgaagcacgagaagaaactggtctacacccaggtcgaggaggggtcacgctcacgtgacttcatgacggcctttgcatggatgcgcgaggccgcgactgtcaacctgtgcacgctggccgaggacccgtcgctgggattagcactcagcgccgacgacacggtcgtgaaatgctatatggccgacaccggcctgctgtctaccatggcgttctccgcggacggcacgtcgctgccggatgtgtaccgtcaggtgctgctgggtgccgacggcgtgaacgagggcatgctcgccgagaacgcggtcgcccagcagctggccgcggccggccatgacctgtatttctatgcgaagtcgtccaacgtgcgtgaagagcgcatggagatcgatttcctgatcgtgcgcccgtacccggacgccgcgatgaaaccgcggatcagccccatcgaggtcaagtccggcaaacgatactcgacgatatccctcgacaagttccgcgcgaagttcgccagcagaacgggagaggaatacgtgctccacccacgccccatggcgaagaaagaccatcgccgtttgcttcccctgtacatgtcgttctgtctgtaactgctgctccacatgttcagcgagaacggcaagacttgccgccgacgccagccctgccggcgggcccccacggccctttcccttgcgctttcagcgccgccagatggtgtttcatggccaccagcatgatgtgcgaatcctcaaggcccaagtggcgttcgttgtgggcggaatcaagcgcatcctgacgtttggcgtaggcgtcgagcgtgttgtctccgtaaggatgctcgttggtgggcaccgcgccggggtcccactgccggctcatcggcagggtgtcgatgatggtgatgcgcccggcacggtagctttccgcatatccggcgacgttcagcatgaaccagctatgttcgaaggtggcgttatgcgccacgtacggctgctggataagccgcgcgagcaggccggcctgggcttggggccattcgtcgaagagtcgatacccggcctcgctgctgcggccgcgtacatcgatgccggtgagtttggcgatgagggcgttgccgagcgccgcgttttccggcggcacgccaaaagcgagacgagactggccgtaggcgtcgccggcggcataatagccctgctcataggcgtatgtctcgggttcgccggccgggcgcggactggccatgttcatgaattcgaagccgacgtcgatgatgtagtcacgcgccggatcgatgccggtggtttcgatgtcgatgcccatcaccgcgtccacgtcgcggccgggcagataggcgtcgcgccagtcgggcttgggatggtgtccggtagcgttgccagacgcggcggcgccacccggcagagcggcaccacccggcgaagtcgcgccggagagattggcgcgggccatcgccgcatcgcccgcacgcttctggaagcgctgggccttacgccgtttggcgcgtgcgtcaagaatcgcctccgtacgatcttggatatcgtccaaggcgactgttgtggggaacttgacatcgctgttttcggcggcagtatttccggcagatgcgccaccggcttcgccgctcagatccagcatgccttggtcatcgttcgacgggccgctgccggagtacggcttgagcacggcaatggtggccctcccccgccgttcgcgactgaccgcccataggtgttgctgttcgcccagatgcaacatcgtgttgatgttgtcgttgagccggcgattggcgtaggcgagcgcacgaggcagacgataggagccgatgagccggtcgaaatcggtcatgaatgcgctgttgcattgggcgatgatcgattccagacgctcgcgtgtggcgtagtcggccttcaatgcgtcgtggatggaccgtggggtggattccggtatcgtgccgacgccatgcgccaggtccagagaacgcacccagtcccagtcgatggtggtgccatcggcgtccttgggcatagccgccgcccattggggaatgtctcccttggcggcgtcgaaccatgcgcggtcggtcatagtgcgaaaccgagctcttcagcggcctcggtgggcaccgggtcgtcgcaccaatagtcctcgaggttctcgttggtggtcagcgaacggatttcggcgcgatcgatatacagctcgccgctcaaatgatcggtttcgtgctggaagatgcgtgcgggccagccgtgcagcggctcgctgtggtgtttgccgtcttcatcatcccattcggcggtgatgtcgagccaacgcttgcgcacggcttggtatccgtcgaagctcaggcagccttcgtagaacgaggcggttttgtcgctggtgggtttgtagctcggattgatgatcacgtggaaggggaattccgcgatttcgcgcggatcatcctcgtcgtcgcgcacgtggtcttcgaccacggcgagcgcgagccccaagccgatctgggtggcggcgagccccacgccgggtgcctccagcatggtggtgtgcatcgtatcgatgagtttggcgagcgtacgcttggaaagctggccattgtaggccactgtccgttggcgcaacaccggttcgccggcctgcacgatgggcagaatcttctccttgccgccggttttgatgagttgttcgacgtcacggttgagttcgaggtcgactttggcgttctttccaaacattgtttttccttagggaagggtgctacagcgcgagttcttcggcgacgatcttggcgaggcgggtgcagacttcgtcggcgtaggcctgggtggcggcctcggccatcacgcgcacgagcggttcggtgccggaggggcgcagcagcacacggccggtgtctcccagcagttcctcctcgcgggccacggcatcctggatgcgcttgttggtggcggcggctttcttgtccacgttcggcacgttgatgagggtctgcggcagctgcgggaagtcggcggcgagctccttcaggctcttgccggacttgacgacctcgttgcacagggtcagtgcggtcagggtgccgtcgccggtggtggcgaattcgcggttgatcacgtggccggactgttcgccgccaagcgagtaaccgcccttgagcatctcctcaagcacgtagcggtcgcccacggcggtctccacggtcttgatgcccatgtctttcagggcgagcttcagaccgaggttgctcatcacggtgaccacgagggtgtcgtggttgagcttgccttcgcgctgcttggcgcgggccagaatgcccatgatctggtcgccgttgatcatgttgccgtcttcgtccacggcgaggcaacggtcggcgtcaccgtcgaaggccacgcccatcacggcgtcagtggccttgaccatggcctgcagctgctcggggtgggtggaaccggcgttcttgttgatgttgtagccgtccggcgaggcgttgatcacgatcacgtccgcaccggcccggcgcaaggcttcgggagccaccacggaagtggcgccgttggcgcagtcggccacgatcttcaggcccttgagcggcttgggctgggtcttgtcgtcgttcagcggagcgatggtggccaccagatgatcgatgtacaggttggtggcggtggtctggtcgtggctcacgcggcccacgccggcaccggtcgggcggtcccagtcctggccgagcacggcctcgatgtcgtcttccttctggtcgggcagcttgaagccgccgcgcgcgaagaacttgatgccattgtcgggcatcgggttgtgggaggcggagatcacggcacctatctcgacgttgagcacggaggtcaggtaggccacgcccggagtggggatgatgccggcgtcgatcacgtcgaagccgccggcagacatgcccgcggacagggcggaagccagaaaatcaccggacacacgggtgtcacggcccacgagcgcgcggcggcgcccctcaggctgatcgtcttgggtgccggcgtcgccgagcacacgcacggcggcatcgcccaaatccaacgccagacgtgcggtcaaatccctattggccagtcctcgaacaccatcggttccaaacatcttcggcatatgaagttccactccttgtatcgcgttacccgcaccatcgtagtcgttgtaccgcggcgcggggcgcgactcggcgaaaaaccgccacggaatccactccggggccgcgcggggacgatacgggaacgccccggtcgagggcaccgtcatgcggcgtcccgcgacacggggcgagtgtcccatggccgatgaagtcggcggtcaccggtcagagggcgtcgttgtattcacgaaccttgagagtgcggtgggaggaggccacgttctcgatgatcagacgcctcagggcgttgtccgcgtcgccatgctcgtccagccatgcgtcaccgagccggaccagcgtggcggggtcggcgtggtccgggtacaggccgttgagcagggcctcggccatgtggtaggtcttgttcgcccagatccagtcgacggcctcgaaataccgggcggcgaatggctcggccaggtcgtggcgcggggtggcggagaagcctccggccacggcctcgagctgggagttggtcagctcgtcgttgtggagcgcctgatcccacgcccattccttggcttcggtggtggccatggaggcgcgggcgccgtaggcgaactcgcggttctccgtggtgtccttcttggcgagctgcgcgtccacgtcgtcgttggtcatctcgttgacggaggtgagcgcttggacgatggtccacgtgaagttgttgtcgatttcgaggccttcaagacgcacggtgccgtccagcagaccgtgtgcgttggcggcgaatgcggcgtcgccctcctcgccatagcccagataggcggtggcgagctggaactgggtgtccgagccggcttcggcggcgttggccagggtccacagttcggcggccacgtggcgcagcacatcgtcgcggcgggcgggcgccacgtagtggtgggcggtggtgctcatgcaggccagcgcgtagcggaaggtggtggactcggtttcggtagacagcaggcgcagggtcatgtccacgaaacgctcggccgggaactcgccgtcccgggtcatgtcccagaaggcgagccaggtcacggcgcgggccagggcatcgtcgaaacgatgcaggttggcttcggcgaatgcctgggattcggcgtcgaaacggatcttggtgtaggtcaggtcatcgtcgttgaccagcacgaatgccgggcgcggcttgcctgccgcggcctcgacgatggtggtttcgccatccacgtcgagttcgaactgctcggtgcgcacgatcttgccggttgcggcgtcttcattgtagaagccgacggccaggcgatgcgggcgcagcaccgggtgttcggccggcgcgctctgggtgagcttcagttcggcgatggtgccgtccgcgtttacggtcaggtcggtggcgatcgtgttgatgccggattcctccagccacttggcgctccaggccttgagatcgcggccggaggtcttctccagttcgctcagcaggtcggccagggtggcgttggagtaggcgtggcggttcaggtaattgtggataccttcgaagaactgcgtgcggcccacatagaatgccagctgcttcagcacggaggcgcccttggcgtaggtgatgccgtcgaagttgacataggtgtcgttgaggtcgttgatcggggcgacgatcgggtgcgtggtgggcagctggtcctggcgcaacgcccagctcttctcgccggagcagaaggtggcccaggcgtcgtgccattcggtggcttcggcggtggcgagcgtggaggtgaattcggcgaaggactcgttgagccacaggtcgttccaccacttcatggtcacgtagtcgccgaaccacatgtgcgcgagctcgtgcagcacggtcaccacgcggcgctcggccagcgcgtcggtcaccttggattcgaacacgtaggagtcgcggatggtgaccatgccgatgttctccatggcgcccgcgttgtattcgggaacgtagatctggtcgaacttggcgtacgggtagggcacgccccaggtcttggcgtagaacgcgaagcccttcttggtgatgtcgaacaggtagtcgacgtccttcgcgaaggccttggccaacgactggcggcagtactgggccatcggcacgacgcggccgtcctcgttgtggtattcggtgtgccattcggcgtacgggccggcgcagatggcggtcaggtaggagctcatcaccggggtcggctcgaagttccacaggcgggtgctttcgttcggcttgtcgccgagggtgccgtcaagggtcgtgcgcgaatcgtcctcgatggaggcgaccggcatgttggaggtgacgatccagctggcgggagcgagcaccttgaagtcgaacgtggccttcaggtcaggctggtcgaacacggcgtagacgcggcgagcgtccggcacctcgaactgggagtacaggtagatgttgccatcggacgggtcgaccgagcggtgcaggccctcgccggtgttggagtaccggcacttggcttcgacggtgacctcgttcttctccttgaggtcggtcagttcgatgcggttgtcttggaaggccacggccgggtccaggggcgtgccgttgaggtcgatggaggtcacttcgtcggcgatcaggtcgaggaaggtcgacgaaccaggcttcgcgttgaagcagatgagcgacttggaaccgaagttcttcgcgccgaccgtcaggtcaaggtcgacgtgatagtgaatcggcgcttcgataacggccttacgttcttcggcttcaatacgagtgagattcgaaccgggcatgacttcaattactccttacggtcgtccctggataatccggactacttggtttctacggtttcgacgtcctgggcgatgtcggccacgacgggcacgatcatcggcttgcggtgcagctggcgtgcaacccagctgccgagcgtacggcgcatggtctgctgcagcttgtaggtgtcgcgcgtgccctgcatcatctggtcgttgagctgttcgacgatctggtgacggaccttgtcgaactcgctttcgtcctcggccacggcgttcaggtagatcttcgggccggtgacgacctcctggttgtcggtgtcgaccaccacgaacgcggagacgaagccctcggtgccgagaatgcggcgcttctccagctcctcgtcggtcagctcgccgacggaatcgccatcgacgtacacgtagccgcacggcacggagccgacgaccgcggccttgccgtggtagaggtcgaccacatcgccgtcttcggccaagaccacgttctgcgggtccacgccggtcttgacggcgatcaggccgttggccaccaggtggcggttttcgccgtggatcggcatggcacacttgggcttgacgatgttgtacatgtacagcagctcgccctcgttgcagtgaccagacacgtgcacggccgcgttgtcgcggttgacgaccttggcgccgagctgcacgagcttgttgatcactttgtagacgccgtgctcgttgcccgggatcagggagctggcgaggatcacggtgtcgaactcgttgatgtggatgtcgcggtggttgccgtccgcgatgcggccgagtgcggccatcggctcgccttgggagccggtgcacatgaagacgagcttgtcatcctgaatgtcgttggcctgcctcaggtccacgacggtgccttcggggatgtgcaggtatcccaggtcggcggcgatggacatgttgcgcaccatcgaacggccgacgaacacgaccttgcggccgtacttgtgggcggcgtccaccacctgctgcacacggtgcacgtgggaggagaagctggcgacgatgatcttgcgggtggcctgggcgaacgcttggtcaagggccgggccgatggaggtctcgggcttgacgaagccgggcacctcggcgttggtggagtccatcatcagcaggtccacgcccttttcgccgatcttgccgaattcgacgaggtcggtgatgcggtggtcgagcggcagctggtcgagcttgatatcgcccgtgtcgatcagggagccggccggggtcttgacatagacggccagggcgtccgggatggagtgggtgacgttgacgaattcgaggtcgaaggggcccaccttgagcttctcacggccggcaacctcaaccttggtggggttctggtggtgttccttgcacttggcgtccacgaaggcgagggtcagcttggagccgatcagcgggatgtccgggcgcagcttcagcaggtagggcacgccgccgatgtggtcctcgtggccgtgggtgagcaccagggcgtcgaccttgtcgagacggttcttgatgtagctgaaatcgggcaggatgagatccacgcccggctgctcctcctcggggaagagcacgccgcagtcgatgagcagcaggtgaccgttgtattcgatcacgttcatgttgcggccgatttcgcccaagccgccgagcggtgtgatgcgcatggagcccttgcggtacttcggcggggcgatcagcacggcatcctgctgaggtgcggtggcctgccgggtggcgttgatcttacgggacggcgtacggctgttggatccgttggcgttgcggccgcgcgcggaaccgcgacggcgagaattcgtgttcttgcttgttttcttttgttcttgtgccataacctttttgggatttctgttgtggtgcctctgctctgtcatgcaggggcggcgggctggcaacccgtatgcagcgtttcgggcttacagcagtccggcagcgcgcatgccctcttcagccttgtcaagctgagtggcgtcgggaccgatgttcggcagacgcatggtggtggaggggataacacccttgaccttgagcgcagccttggccatgacggcctgataaccgtcgccattcaacgcgtggacaaggggggcgagctggttggcgaggcgacgggcggtggtgatatcgccgcgatcgaatgcctggacaagctgctgcatggggttggaggcgacgtgggcaatcaccgaaatgatgccgacggcaccgatggagaggaacggcaggaacaggccgtcatcgccggaataccaggcgaggccggtgcgctgctgcttctccactgcggctgcaagatcgccggtggcgtccttgacagccttgacgtgttcaagtccggccagtcggtcgtaggtttcgaccttgaccttcaagccggtacggccgggaacatcgtagacgatgatcggcttttcggcggattcgtcgacggccttgtagtggccgacgataccgtcctgcgaggggcgggaatagtaaggcatgacgacgagcaccgcgtcggcgcccgcttcctgagtctgttcgaccatacgcacggtgtgtgcggtgtcgttggagccggcgccggaaatcaccggaacgtcgacgacctccttgacggccctgaccagctcgaccttctcatccatatgggtgacgggcgattcaccggtggtgccattgaccaccagaccatccgcgccatcggcgacgaggtatttggcgagcttctgcgcggcggcgaaatcgacgctgccgtcggatttcatcggggtgaccatagccggcagaatgcggccgaaaggtgctggctcaagaaggtgcatgtcatgctcgctcatagtgttcaccgtacttcccattgtggactcttaatatattacgtaccttgattgttgctgcatgcgtggcattatgaccggaaccggcggcaatgccgtgatgcgcgtcccggcgcgcttccctgcccgaattgcggggtcgactgcgggtcgattacaggtcgaggaagtggtcgaggccgatggtcaggccggccggagcgtcgccggcgagcttgcgcacggcaagcaggacgccgggcatgaagctggtgcgatcgaagctgtcggcccgaatggtcagctgctcgccggcgttgccgaagagcacttcctcgtgggcgttgaggccgcgcagacgcacggcgtgcacgtggatgccgtcgaccacctggccgcgtgagccgccatcggtctcggtggcgtccggcacgggggcgagtcctgcggccttgcgtgcttcggcgatgccgtgggcggtgtggatggcggtgccggagggggcgtccaccttggtggggtggtgcagttcgatgacttcggcggattcgaagtatctcgcggccttggtggcaaagtagtcggccagcacggcggagatcgcgaaattaggtgcgatgaagaccttctgggtttcgggcttcgggccgttggcgatggcggatttgacctgggtgagtttctcgtcggtccagccggtggtgccgaccaccacgtccacgccttggccgatcagggtcagcacgttgttcaggctgacggacggcacggtgaattcgacgaccacatcggtgttgtcggtggtgacctgggtcaggtcgtcgtcggcatccaatgcgagcgccagctgcgtatcctcggccttgttcaccgcttcgaccacgtgcgagcccatgcggccctttgctccgaccaccgaaaccttgatcatgtcttcttccctgtctacccgtacctgcccggcaatgtacccgggacgttttccaatcggcaatcagcctatcaccgccaagccctcacgccaatatcccgtccacagaatcaagctccctctgacgagccgaaccgtgaagaaaacgccggaggcgtttttaggtgagggcgaacgacagtgagcaataattcagttggctgaaagccatcatttaattgcgttcgagctggccgtgaagcggactgagggagagaccccggcgaagccgccaaccatccatcgggcgtagcccgatcccgtttcacccacgccgcttggccaaggcccatccggccaacgccaatggcacggacgccagcgtgaagatgaatggcagcatcatgcccacatgagggttggaggcgtcaagcacaataccggccacggacgagccaatcgaggtgccgaccgtgcctgcggtggttacccagctcagtccttcggtcagggattccgccggcaccagatccttgacgatgaggttgccggtggcgaacgtcggcgagacggtcaggccggagagaatttcgaagacgcccagcaggatgagattgtccattgacagccggaagaacacgtagccgacggtcaacagcgacaggaacatcaccatatgcgcccaatgggagcctttgagttggcgagagccgaacaccagcgcgccgatgcacgagccgaccgcgaacatcgccaattgcagaccgaggaagggctcaagtcccatggatttcatggtggcggtgatggacacgtcgaaggacgtgaagctcatattgaacacgatgaacacggcgagcaacggcagtacgccggtatagagcaatacgcttttgggcttggcaccgctgcgtttgagctggcgcagggtcagctggtcggcatcttcgcttgcagcggggctgccgtcatcgtgagcggccacggtgacctgttccacgatgaccggcggctgggtggatttcagcgagaagaatatggtgccgccgatgccgcatgccacggtgggcacgaacagttgggataccggatgcacggaggtggccagccaagccgccagaatcggccctagaataaagacgatctcgtcaatggcggcttccatggcgtaggccgtgttgagcagctgttcgccatcttccacaccgcgcaacgcataggaccagcgggttcggaccaatgcaccgaatgagaactgcgtcagacccatgatgatggccagggcgaacagcagcggaatcggcacgcgcaccaacgccgcgaaggcgaaggcgagcatggccacgatctgcacggcgagcgcaagccggcccacgcgggcttggccgaaacggtcgaaggcgcgggcgtagaacggggtgacgcagctcatggccagcacgtaggcggcgctcatggtgccggcgatggtccaattgtcgtagagatggttgagcgccagaacgatgccgagactcatcatggagatcggcaatcgtgccaccgcgccggacaggcagaacgccttggctccgggcagcatgaacaggcgctggtagggcgagtgggcagcggacgacttcgaaaccgcgcgagtcgtggacacaataactccttactggtgcgttgtccggcacgtgcgcccgcccacacgtgccatccgagggtagcggttcccgagcaacgtcacgcggtgcgtttcaaccgcggaccggtacatggccagtcgtcttcatcatcggagatgccttgcgatgcataaggtctctccgccggtgaaggccgtccgatggtgcacaggtcatgagcctttgggctcagtcgttgtcagattgttcgggaatgccggagctcaactcggtaaggatttcctgtttggttttcgcacgggcgtgaagctcgcgcaagccctcgtcgggctcactgacatagtagagagtggcgtcgatactgtccaattccacaccttcgaccgctgccagcagcagtcggtacatgtcgagctgggcgagtttgcgggtgatgtcgtctggcttggtgggccgacgaccggttttccagtcgaccacggtaaagcgtacggtggtgctggacgggtcaagtccaccgatgaataccgcatcgagtttgccattgaccaggcccacgcccggcacgtccacgacgatggcacgctccgtccacgccgggatgcgcttggcccacgatgattcggccagtctgcgctgccacgccaccagcttggactcggtggcattgtcgctacttatggatgcggcggatacggcggatgcggcggatgcggattgttgagccgtggactgtgggacagcgggctgccgtgtggatggcttgcgacattgccgctcccgttcggccaaatcggccaacatggcttcccgggaaacgaataccgcatcctgacctgtatgcggcatacttgattcggcttcatatgccagtaccgcttcatccggtttaccggcattgatgaattgctcggcccacgcatggaactgcgtgccggcttcggccgccggagacgatattcgtggaatcggacggataatgctacgccagtagaggcgctcctcccgttcgctcatgccacctacgcgggcttgcaggcttgtcacgttctggcgtccggcggccagaatgcgttgcgccttggctttgactgcctcatcaagcgactggccgctggcggcatcggccatcaaatcggcgtcgtccaccagcaattgcgcccgttgcagcagtgggccggcgtcttggcgctgctcaagtgacgaggaatctgcggcgatgacatcgatgccacgtgacaactgttcatgcaccgcgtcgctgagggtagccggccacggcaattcgacagcggcatccgtctgcgtaatcggcgtttgccacgcctcccccaccacggcgtcaccgtatgccgcggcatgctctccgataaagaacccttcgggaggggcaatcgcttcgccttgcgccgagatcagcatgggcttcccggcattggcggcttgcagccgtcccacacagtcctgagccgatatcgcatgttcacgggcttggagcgcgtcatgcacttcaagccagaaattggatggctgagcggcgcgagagcctttgggcaccactgacgggtcccgcccggattcgcccgtataggcgcaataggtcatcagggcatcttcccgcgcacgggtaagcgccacatacatcaatcgacgttcgtcggcatgcagccggcgcccatattcctccgcctgcgtcaaataccagccggatgcatccacttcttccacgccatcgccgaattcgcgcatggagccgaacacttcatcatcgataagctccacatcatccaaagccgccaacgatgcgatggggtcggcttccacatcggcatcatggggaatcgcggcaaaatgccggcatcggcgcgtataggcacgggcacggcggtggggttggtgagccaggagtcggcggtctcatgatattcgggtgcggtccagtgaccttgctcggtgcctcccgtatggtgttcgtccagcacgatcttgagatggtcgccctgattgctggggaatccgccggcggtaagccccactaccgcaacggcatcccattccaaccctttggactggtgtacggtcatcagttccacatccaccggagcgtcggggagactggcggcttcatcctccaccgaagccagatgatccacccatgtgatgaacccatgcaatgagggagtttgctcagcggcaatctcttgcgtgtacgtatccaccaaatccacaatcgcatccataggcatatgcgccaaagcgggattggcgcggtgctgcggattatgcagcacaccggccaatacggtgtcgatgtcaagatccaacgcttctatgccggcgcgaatcacgtcgcccagtggccgcccgacggcatcatgcacctgactgagcatcaccgcggcccgggttatggcgttgcgcccgtgtgcgctcaaccgttcaagcagttttaccaggtcgccgcgtagcaatacgtctggcaggaataccgcattggccacctgatcgcggtactcacgcaccacagccgcccattcattcgctgatgtatccggttgggcaaggccggcctgcaccaatgattggaagcgttgttccatgttctgttcttcagcaaaacgggccaacatggtcaaatccgctgcggacatggtgaatcgtggcgtggccagcaaacgcatcagcgatcccgtatcggtgtggtcggcggccacgtgcagcaacgccatcagatcgcggatttccggacgttccaacagcgcggaatagccgaccacgaatgtggtcaatccggcctgttccaatgccgcctgatattcgggcatatgtgatttggaccgaaacagcacggcgaccggcgctttctgttcgcccggcatctgttcctgttgttcggctgcggaacggtgccgtgcgatggccgtcttgcagaaacgcactacggcgtcgatctcctgcccggccgtggcgaagcccagtactcccaatgttccttcgggggcatcaggcatggggtcgagcgatgagacatcgacctcacgcatcaatgagctggagggacgcgacggattggagcgcaacggcagcgtgagattattggcggcttcgagcactatacggctgttgcgcctggtgacggacaacgggaatggcttgtatccggcagacaggtggaaatcttgctggaacatacggaatgcaccagggctggcaccacgccatgcgtaaatcgactggaacggatcacccaccgcgttgacggcggacctccgtgacgcatccacatggaacagtgctgccagcagagcggcctgcgtggtggaggtgtcctgatattcgtcgagcagcacatggctgtacctgcggcgcgtgcgctctccgatggaggggaagcgctcgataagctgatacgcggcaatggtgaagtcggagaattcggccatattgcgttcccgcttggcttgggcataggcctccaccagctggagcagaatatcgcgtttgcgcgtggtctccagcagcgcaccgcaatgataggtgcaacgggcgtgcagatgttcggcacggtcatcgagcttggcttgccagctggcgtcggtatctttcttcagtcgtctgatcttggggattttcggctcgtcctcgggcatgggttcgtctgcgacggcttgttgcaatcgattgatgaatgccgaatcccattgccgtactcgattgatcgcatcatcgaagctggtgcagccggcaccgatcatggcactgccaatggcatccgacaacgccagaacacggttcgccaaactggagaaggcgccaaaatcctcactgaacgccagatccatgtgactgtcgatgacttcggtggccagttgaagcgctccggctgcgctcaatggttgcgtgttctgatcgaatccgacaagcaatccatattggcgcacgatggtctggaagaaggcgtcatacgtgaaaatggccggcttgaggaatgcccgatcagacaccgtggcggtcgtagagcccgccatatcaccggccactgcggcggagacgcgttccagcagttcgcctgcggccttgcgtgtgaaggtcaggccaaggatgcgttcaggtgccacacctcgattgataagcgcgatgatgcgttgggtcatcgtaaaggttttgccggaaccggcaccggcaaccaccagtacgtcagcattgactggcgcatcgatgatggcggcctgttccgcactgggagtgaacgtgctcatgcttgcctcgtttcgaaaatcgtgtcgatctggcctgcacaggcagggcagacgttcttcatacggcagaatccgatatgggtgtcttgcggatgggcctcgatgatggccgacctgctggccgccgcggcatagaatacgcgggcgatcatggtcagcgaccataacgtctgcgtaccggcgagcgcggcgaattgcgcccacgcttcggcactcacaccttcgggaggagtagccggatctatggcgggtatgtcgaagaaacggttggggtctttataccagtatcgtggcgtgaacggttcggcattcaacgaaccatcagtgaacagcggcggctggaaggcaccttccggagcatagcttctggctggtgccgtattctgcccgacatggaacagcgcgctttggctgatatgcggcattgcggcaagtgccttggcaccgcgcggcccgtcttcggggaatacgaggccaagctgatagcatacgagctgcaaatcattgaaaatctgtttgaccgtgggcgttctgcctgttttgtagtcaatgaggcgaatgcattcgccgccgtctgcgagtacgcgggtttccatacggtcgatgcgcccggacagtctcacggtcagatgctcgtccatgccttccggccatcctccgaccagtgctcccatcagacggaccagcgtgttccgatcaatcgggtgcatgccgggcacggcattgtatgcgtcgagtatgtcacgcacatcgaatcgtgcggcaaactcccgttcgcattcggcaccggccaatgcgccaatgctgaagttgctggagttcttgccaagatacgtttccggatcggcgtcgctgcgcacaaagtaatcggcgatgttgcgcagggcatccgccgcggactcgtccttacgggtggcctcatagcggttccgggtgtcggctatggcattcggatcaggacgtttgctctgatagatggcattaagccgtgccgtgacagcctcgatgcggcgttccgtgccggccgtggagtccaagcccagtgtggccaacgcctgggcattgtgggaaagatggtccagcccttcctcgctgccttgctgcgcaaccgcatggatgagggttccgaaactggtggccacggagctggggcgaggaccggcgaaccggttctccagcatccagcacaccgggcacgcccataggctgtcgaccgccgatggagacagggtgaccatgggtgcggcctgcgcatccgtcttgcccttccctgtttggataccgtcagactgtacaccgccagatgacgcgctgtcggatgaggcactgtcggatgaggcatcgccagatgacgcaccgccagatgatgtgccatccgattgggccggcgattccacgaacgcccagctctgcggatttgcggcgcgcacaccatgctctgacaggagtgtcaacgcaaccgcggcgtcctttgcggcagcctgctgcggttgggcagtggccagaaccgcgcgggcggcgctgaccaacccacgtgggtcggcgtccaatccggccagatcatattcggcgaatcccgcatgtgcccctactgtggtgaaaggcgcctgttgccggttgcgcggatagtattccggcagatacccgaaaagaaagtccgatgggctcatgctgtcgttccataccgcgctgatcatgattcgccgtgcacgggtcagcgcgaccaggaagctcttcttctcgcccgacagcacagccgcaaaccgcggatcatgaccggttttgtcgctttcttcaagcgctcccctcagcacgagctcggcaaggtcttcaccaccgaacatggtgttgcgcccggcgaggttcggccacacgtcttgctggaccaccggtatccacgcatattcccagtggcgtccggccgcgcctgccggcgtggtcaatgtcaccgcgtcttccaccggccctatttgggccaaggaatcggcctgcacttccatgccccgaacctgtgccatgaatgacgtgacgtctcggctggcggtggaatcatcggcgaactggaacaggcgcattgccgcgtccagccggtcattggccgtacgcccttctgccgtgttgaataatgccgcacgctgccagaccggtgccagaccggtggcgttccacgcaacagacagcgcatagcgcggctgtacgcgctggcttgccggcagccgctccaagccggaagcaacgctgcccaccagatgccacaggttcgcaaaagcgcgggcctgagagtcgttgccgagcaccgcgtggatggatgcgagcgcagcctgcgccggcgcggcggcatcatcaacggcaagcatcacgtatagcgcgtcaacgccaaaggccaagtcattgtcggagggctcaccgagtatttcgacagacactgacgacgaagtcactggcgacgaaaccgctgacgtcgaaaccactgacgaggatgtgtcacgacctgtttcatgccgtgtttcacggtatgtttcacgcaatgtttcccatgccgtcgtcagagaggtcagcatggcatcatccgtggcgagatgcgccagcgactccaacgaccccatggccgattcgatcggcgcaagccttgcgggacgcccctgaccgggtctggccccggcactcaccaacgggccgtccatcaacgtggccactctagtccttacatatgccgcgcaggaagccaacgtcatctgacattccgccattccctcggcacgcaatcgggcaagctccacaagcgcgaacaacccctgcacgaaagtctcgtccttcaaaggacgggtaaccgacgaataccgcaccggcacaccatctcggcgcagtcgttcgccgaacagccgcacggcggcattgtcgtgggcgatgaccgccatgtcgttccaccgaatatgccggtcaagatgcgcccgcttgatgcgccagaccacatcatccagctcctcacgtgaggatcggtacaggccggcggtcactgtgccgtccgactgataattcgctgcatcgactccgcccagtatggcggtcagcttgccgggacgctcggccggaggcagcggctcgtcttccggcgagggaatcgacagcgaaatacgagacgcgatcacatcagccatcgtcatgtgcgactgatcagcgccggtactgccgccaaccagctgttcttccttggctttcagccgcccttccacggcacggcgcatcagatattccggatacgatccacggaaggtctgcaccgattcatccgagttgccgaccagcaccaacttgacgccggcattccccaactcctccaagaagcgcatgccggccagcgtggtgtcttgaacatcatccacaaccagcagccggggcaagcccaacgcctccatacgcataggccggccggaatcatccgcgtgatcggcggcgaatgcctcatgcaccacacgagcgcctgccaccagcaaatacgaggcatccaaacggtattgccccggatatgccgcgctttgggctgcaatatattcacggcgcaacgcgaaagccaaacgccattgcaccgacaatcgcgcgtcctccgtcacggcgtccaaaagacgtggctcttcgtgaacgcctacaccgagctcatccaatcgggccagcatatcgcgcaactggctgataaacgcatctgaaatacctcgagtgaacctatccgcgctggtcgagccgcctgccgacgtcggagacggtgaatccgacccttgtttcaagaggcttgattgtgcggaagcggccgagccgggcatctcgccggcaccggcatcgcgtatgagtttcgcccagtcatcctgggcaaagtagatgcgtagcagatcacaggtgccgcaatcatctcccgctacggcatggcgcagatgcacggccatgacttgacgcagcaaagcatcctgttccgcaccgttcaacaatcgaggcgacggcaatccagttccctcgcgcgaagctgatatggcccggaatgacacggcacccagcgtggtgaccggcctggcctgcacggaaaacccgagctcacgaatcacccgattgcccaatgcgtcggcggccacacggccggatacggccatcaccacctgcgcgccaccgtagcggcgcagccccgccatcaacaccgataaggcgaattcagttttgccgcttccaggcgtgccgacaatcagcctcgccgctccatcacggtcgatgccgtccagcactgttccaggttcaagtctcgtcatcatggctccagcctaaacccgaccgtcacagagggaaaaattttaccgaacccaacgaagaatcgtacccttgacggtatcctgtagaacgaatgcagagagagtgcattttccaaggagggagggaacagatggccaatattccgatgaggccgccgaaactgcccggatatgatttcgtccagatgttgggaagcggtgccaccgccacggtgtacctatataaccagcgtatgcccgcacgcccggtggcggtaaaggtcagcgccaaaacccttgacccacgggccgctgccctgttcaaccgcgaggccaacttcatggccaaactgtcatcccacccgtacattctgccggtatatgatgccggcgtcacctccgatggccatggctacatcgtcatcgaatatgcgccgggcggcacctacaacagcatcatgaaggcccggtccatgacctgcgagcaagtactcgacctcggcatcaagctgtcaagcgcgctgttcaccgcgcatcgcagcaatatcatccatcacgacatcaagcccagcaacattctcatcacctcgaagggcttgcctgttctgggtgatttcggtatctccaccgatgtgtatgaccgtaccgaaaccggattctcgccgccgtgggcaccgcctgaagtgcttcagcatctgaccaatggttcggaagccgccgacatctattcactggcggccaccctgtacgccatgttcgtcggctgctcgccattccagcacgaatatcatccgcgttcgcaatcggaactgatttcgctgatcgtcaaccagccattgcctcgcctcaaccgccccgatgtgccggccgatgtggaagcggtgctgcgccgggccctgaacaaggaccccgaccagcggtactactccgcgttggagttcgcacgtgccatgcagcgtgtgcaattcgcatatttcgggcatgccactcccgttaccgtggaagggatgccggcctaccccaaagacatcgagcgtcggcgccgggccacggaccagcgagatcagatcacccattcgtcacggcgatgggtcaaaccggtgggcattaccgtcggtatacttgcggcgatcaccgcggcggcactgatattcgccttcgtggtcgttccccgcatggacagcgccaccggatcagataccaaacaggtggcgacgcccggcaccaaggacgatgacaacaaccgcaataatcaggatgacgtgatcaccgataccgcgaacgcccagattccttccccggagaatctgaacggcacctatgcggcggatgggtcatccgtgacgttcacctggacgaatccagacccgcaaagcggtgatacctatgcgtgggccatagtgcagggcagcaataccgaccagagcgcgcaaaccgtcacaacgtcagatcccacggtgaccgtcaacgcgcaggaaggctcgcagacctgcattcaggtgtccattgtgcgcaagaaccgccagatgtccgtcagccccgccatcgcctgtgcggccaagccgcaagagtgatccgctcgccactgccgggcatgccaccttggcattgcgtatcgcatcaggcagcgcccggcagtggcgaattcaccaaatgggcaacaggaacggcaggtatcggaaccgtaaagcgttgtcattacaccagcaaccagagaaaccagggttcagggagttcagatggccacatcatcccagtcatacggtcgtcgtcgacgcatcagcgcggctttgcgccgccttatgccctccggagggcatacgtggacggttcccgcaatcacgctcctgctgcttctgggacttgttgccagcgcggtgatcatgagcaccgtcacacgccgccatgtgcaactggacgatggcaccgtatgggtcacttcgctgaagaaccagaaggccgcacgattcaacgtaaagaacaaggaggccgacgccggcatctcctcctccgccccacgattcgacatcgcacagcataatggcgacaccatcctgaccgaaacgaacagagcctccaccatcaaggcatccacggtcagcaccggtgtcaagaccgacatcaaagccaacaccaccactgtggtcggcggggataccgtagccctgatcaacgagaagaccggcaatgtgtggaccggcttgtcggaaaaccttgattccgtgactcccaccacttccgatccgaaaatgaagctgggcgagggcgggcgcatcgtagtaacccacgatggcaagatctacggctaccgtccatccgacggtatggtgctgcgtcttgacaatcccagcagcgccaaggccagaaccctcgaatcgctgaccgacggcaagcagcagaccgttgaaagctttaccgtcatcgggagcacgccggtaatcgcaaccggcaaaaccgtcatattcaagggcggccgcgtcgatgtcgacacgaccggcaccctcacccttcaggagcctcccaccgatgacgtacagtccgattgggtggccgcggcatcaccgagaggccttgcgcttatcccgttgaaatccaatgccaaggcgaatttcatagccaacgggggcaaggcgaatccggcacgaccggtatcgtccaagggctgcgtgtactcggcttggagccagaaggccagcaactacattcgcgcctgctcccccacggataccagcgtcaagccgcaaaccctcgaatccgtcaatgccacttccgaattggtgttccgcaccaaccatcgccttgtggtgctcaacgacacggttaacggcaatgtgtggaaccctgaggattccaccacagtcatcaaaatacagtggaacaaaatacagaccgagcagaccgggaaagaacagcagaacaacgactcagccaacaaccaccacgacttctccaagacctgttccgcgcaatccggccaaatcaaagccgaggatgatgaaatcggcgcgcgagccggttcggaacagattctcgacgtgctgcgcaatgacgagcagaccgattgttccgtactgaaaatcaccaaggttggcgcaccaaacgacaaagacgtcaccatttcgccgatttacgatggccggtatctgcaactcgatgcctccgccgcatccgcaggcaccgttacctttacttacgatatttccgatggccgcggccagacctcttccgccacggtgaccgtaaccctgaatgatggcggcaaccacgctcccgtacagttcgacactcctcccgagatcgatgtggagcagggagccagttataccgccaatgcgctgagcagcttcaacgatccggatggagacccgctcactctggtctccgctgtggcccagaacaccgaccaggtgcaggtgtccacccgagccgacggccaacttacgttcaacacaggtgcgctggcgtcgggacgtgtgggcgtcgaggtcaccgtctccgacggcacagcgaccggcaccggcatggtgtatttctcggtcaagcccgcgaacaccttggccgcggtcatcgacccggtagcgaaaaccaccgttcccaacacggataccgtcgtcaagctgtcctcttacgtgcatggcacttccttgcagccggcacaactgactcaggtggatacgcccaacggcgcttcgacgaccaccaatgcggcggatatgtcgttgacgttcaaggccaccaatcccggcacctactatgtgccctacaccattactcaaggctcgattccggccaccggattggctcgcgtcgaggtgcagcccgccaccggcgaggccgccaaaccggtcgccgccaacgatgtcgccctgcttggcgcggataataccgccattgtggagccgctcaccaatgacgtcgatccgatgggcggcgtgctatccgtcaccacggtgagcgcaccggccgactccggcatcaaggttggtctcgtcagccataagcgcgtgtatatcaccgcgcgtcaggtgcccacgaaacccgtcgcccttacctacaccgtggccaacgcctccggaaccgccaagggcaccatcgtgttgcagccaccggctctgaccacctcgaattcagtgcccaaggccagcaatatcaatgcccaggtgcgtaccggcggcatcgtgtccgtggatgtgcttgaccatgtgtcctactcggatggcaccacggtcaaactcaagaacaacctgcaatacgacaaggagacgttcaagggcctggctttcgtctctggagacacggtccgctaccaagcatccagcgagaccggcaacttccccatcacctatacggttgaagacaatctgggcaatgtggcttccgccaatatcaccattaccgtgcataagagcgacgcagcgagcaaggccgtgccaaccccgcatgacgccgaagcgcaggttgccgccgggcagaaggtccgcgtccccatcatgctgaccggcatagacacggatggcgacgacgatcagctgttgggtctgggcaacaaggcacccacgctgggccgcatatccgaagtcggttccgactacttggtctatgaagcgtatccggattcgtccggcaccgacaccttctcctatgccgtggaggattggaccggtcagcgcgcacaggcgcagatccgcgtgggtgtattccaaggatcgtccgactccggcgtatacgccagggatgacgaaatcacgttgaggcccaatacagccgcaaccgtgccggtcgcgcagaacgacatctccggcgacaacaccaatctgaccgtcgacaagcatgtcgaggtccaaggtctcgacggggtgagcgtgaaagacaatatgatctccttcaccacgcccggcagcgccaccaccgcctatatcgcctacacggtcaaagacaaggccggcttgtccgatacggccaccctcacggtaaacgtggatccgaatgccgccatcgagccgcctaccgcctacgactatcgtgtgccgtccgccgccaccatcgataagaagtccgtggatgtggatgtttcccagtggatcgccaatccttccggcacagccaatgagctcaaggtcggcgtgcatccctccgccagcgctcacgctcacgtcaagggcggcgagcattcgaccaccatcaccgtcgacctgacgtcacaggcgcgagccgtgccttacacggtgaccaatacgaaatacaacatcacctccaccgcgttcatccaggtaccggcctatggtgtctttccgcccacgttgcgtcccaaggcaccggaattgaaggtcaattcgcgcgaaaccattgaaatcaacatcaatgactatgttcgcgtcggcgccggcaaggaaccgtatatcgaaagcgctgattccatcagcgccaccaaggcttccaactccgatttctacgtgaacgacaagaccctgaagttcactgctgcaaaagactacgcaggccccgcctccattacctttaccgctgtggatggcaagcagggatcggataagaccaagatcatcaattccgcagtgatcactctccagatcacggtgataggccgcgatgtgccgccgcccacgttctcgtcctccactattgatgtcgaggcgggcgcggcccccaagaccgttgatctgacggcgctcacccatgcaccgtccggcgtgtatgacgacgagaagcaatacacgtattccggcggaagctcatcgtccgggcgaatcaccgctaacctgtcccgttccggcagcttgcaggtttccgccaccaaggatgccgctcctggcaccaccgcgtccattcccgtgcaaatcgcatacggcgcgggcaccgtgaatgccggtgtgaccgtgcgcgtagtgtcttccacccgtccgctggcacgcgtcggcgacaagacgctgaagatcaaggccggtgccagcgatgccgtgaacgcgcttaccggcgcgtacaatccgttccccgattcctcgctgaccgtcatcagctgcaaggcggatgacgccgccaaactcactatcgccggatgcgatgcctccggaaacgtcaccatcgccgtcgcatccgatccgggtgcttccacgaataccgtgctcgtcaccgtgcaagacggcaccaagtccaaggatcgtgaagtcaccgcatcgattaccgtgtccgtgatcgacaagcccgagccgccactgctctcccccgtagccggggaaccgcagaacagcgcggtcagcctcacatggacgcccggtgccgccaatggcagcccgatcaccaactacaaggtcagttggaccggcgccgccaccggagagaaggattgcggtgccgtcacctcatgccaggtcactggtctgaagaacggcaaaacctattccttcaccgtcgccgcgcgaaatgacgtcggctggtccaagccgtccaccgccgtcgaagccacaccggacaaggtgccgtccgctcccaccgatgttacggtcacgggtggcaataaaaccgccaaggtgacatggaaggcaccgagcggtgatttcagcgccgtcgacaactattcggtgaccgtcaccggtgcaggtgctccgcagaccaaagaaaccggcaatacggccaccgagctgtcgtttacgttcaacaacaacgacatttccgatggcaccgccatcacggcgaccgtcaaagcccataacaaaatcaattggagtgccgagtccgccgcatcgccgtcagagaagatctggggagacccggatgcgccgaacattgcgttgtcgaacaacgacaccacagtaacggcgaaagtcactctcggcaacaaccgcaatgccggctgccggaagatatcctttggtggcgacgctggcggcgaagcctcttgcgagtcaccgagctcccggtcgttctccatcgatgagtcgttgctcaacaccacaacaatcaccgtaacggccaccgtggtgccgcagcgcgatgcttccgccggcacgggcgagagcagctttgtcccgcagtacaaggtccagccgcccactgacgtctacaccaccggatccggcagtacatgcaccgtgcattggaccaagcatgggcatgcgcagtcctacagcgtgactgccgatggcatcgattccggtacagctactaaccggaactcactcgacttccgaatgagtccttgggccagatgcaacaccgcatcggtgcaacaggtgttcaacggcgctaccagcgatgccgccaccggaggcccgcgcaatggcgctccctacacctatgagaagaaggctgtaatcaacaaaccgcaggggctgcgctggtcagacaacgctcacgtcattaacgtcaccggcggttcggttgatgtctatggcaagccggccactgtacaaatcatcatcaatggtcaaccgttcacgtggaactccggccagccattggacgtcaccgacctggccgtggccgccgatggcaactacgcgtggagcgtcaaagtcaccggcgggccgggatactccggtctcgacaacactgcggacggagacagcgtcgcgggcacacgcccctctggctcctcggaggggaccgaatcgctcaaatccggtaccgatgtcatcactttggccaagaacccctggattcttggtttcggtaataccccaatatcgtcaaccaccattcacaagcagtaggagaacatccatgagcgagaacatcgacgacgcgacgcagttgtctgacacgacccgtctgtccgacagcacgcagctatccgacgccacgcacttgtccgacgccacgcacctggcatccgcaccacacaccggcacgaccccaagcaccgcgtcggtgccgcagcccgttgcgctgcctaacctgccgcagtggccgtcacaagcgtcgtcagaaaagccgtctcctactactgatgccgccttcatccctgcgggcgatgacagcacacctcaatcccaaccgcagcgtcagtcaagcaaagccgcgcaagcagccgcatcggcactgcccgccagcatcaattcaggactactgtcccagcccacggctcaggtccgggatttccagcagtccttcaatgcgctggtcgagaatgtctccaaggtggttatcggcaagaccatccccatcaagcaatgcgtcaccgcactgatggtcggtggccatattctgcttgaagacaaccccggcaccggtaagacccagttggcccgaggcttggccaactccatttccaccggtttcaagcgtattcagttcacgcccgatctgctgccttcggatgtggtgggtgtgactttctacgatcagaagcgcggagaattcgagttccgcgagggcccgattttcgcctccatcgtgctggccgatgagatcaaccgtgcatcgccgaagacgcagtccgcacttctggaggttatggaagagcagaaagtcaccgttgacggcgtcacccatgatgtgccgcagccgttcatcgtgatcgcaacccagaaccccatcgagcagctcggtacctataagctgcctgaggcgcagatggaccgattccttatcaagacgtcgattggctacccgggccatgatgtgtccgtcgatattctcaagcaggtcgatatcaccgaccgtgcgcagaccatttccccggtgctgagcggtgacgatgtcatgcggctgcgtcaggtggccaccgaaatccatgtggatgatgcgattcgtgaatacatcgtcaggctcgtcgaggcgacccgccacaacgagaagatcacggtcggctcctccatgcgtggcgctttggcactgacccgatgcgcccgtatctgggccgcggccgatggccgtgcctacgtggtgccggatgacgtcaaggaccttgcagtggccgtgctcgcacaccgtatcacgctgactccggaagccaccttcgatggcgcgactccggaaagcctgatcgcacaggtgctcgaagacgttccctcccccaccatcggttcctgatagggcctggaaaggtatccgaccatggcatctgcatccgcctcattacgccgtcgccggcgcgttgaacgcatgttcaagcgcgcggtaagacgcatcagacggttcttcgcatcctacgtctcgcccttgggctgggcggtaacgggcacaggcatcgcatgtcttattgcgttcctgcctctggactggcatgagctgctcgtattcggcatcgtggcgatggtgatgatgctcgcggcaatcgcgctttccctcggcaacatacgcttccacgcgtccatcgccgtatccaatcatcgcgtgaccgtgggagacaccgtatccgttatcgtcggcatcgacaacaccggcagaacgccgacgaccacggcacgcggatatctgccaatcggcgatgcgcgtgaacgattcaacatccccatgctggctcccgggcaatcccagcaaaccgatgtggagttccgtaccgtatcgcgcgcaatactgcccatcggcccgttgcgcatccgcaagggagacccgttcggcctggtgcgtcacgaaaaggagttggccgaccgcatcaccgtattcatccatcctcgtaccgtgcgtctcgataccctgaatgccggcgtgccccgcgatctggaaggccaaccatccggccagatcgtggatgatgatctcgacttctacggattgcgcgaatacgagccgggcgacgacgtgcgtaacgtccactggctgagctccgcgaaaaccggcacgttgatgattcgccaatatgaggccacgcgccgcaccgacacctcggtgaccatcagcgtgaacccggatgagtacgtcaacggcgaggaattcgagatggcggtgtccatccactcctccatcggcgtcaaatgcctgctgcaggatcgcccgctggtctgtcacgcgggcaacgcgcatggccaaccgcgcaacgccatggagttcctcgacaacgccagtgccatagagcctgatcgtgaggataatccgaatctcgccgagggcacgctgaagcacagtcctgatgcttcgttctattttttcactgttggatcgctgaaagacatcgagcaaatcaagcgcatgaccttggccttgccccgatcggccagctgcgtggtattgcaggccagcgccggcgccaatcgcggcatcagaagattcgccaatttcacattggccaccatcggcgaactcgatgatctcccgctgatcatgggggtgctcgcatgaccttcgaccagtccagtatcaccactaccaataccgctgcgtacgccggatcgagcggcacatacaccggcacttcctccggcacgtacaccggaacctccaccaccaccggctcctgggccgactccacacattcggttatctggatgaccagaggcaatgtgcttcgcggcatgggcctcagtcgccagccgtggggcaaacgaatcgccagccttgtactcatagcggcgatgatgttgctggcgcaagccaatctcatcgacgtgtacggcggcgtggccacttggacgattgccgccgtaccggccaccttgctgggcgcgatcatcgctctggtgggcatgttgccggcgttgcgactgtggtggcaaatcgtgtttctggcgtttgcccaattcatcatcggtccggtggtaacgctgagttccaccacgtcccattacgtgattcccaccttgaagaccttgagttcaggttgggaaatgacgtttggctcgttcaagtacattatttccgtcgatccgcctctgggcacgcaagacggcgtactgatggcggtatggaccatcggcctgtggcttacgttcctcaccggcgtgtttgccattaatgccaacgcatggttgtctctggtgggagtgccgccccttgcggcggccgtggccgtatgtgctctgctgggtacggacagcggctggcaacgtgccatctgcggcattgcctttgccttgctgctgattatctggctgtcttggcgtcttgaactgctggaatgggggcgctggatatccgcgctgatcatcgtcgtgctcgctgccggccttgctttcgggggcacgttgctggtgccgcaggaccgtttcgtgctgcgtgaccgctacgatccgccgttaagcccctacgattacaccagcccgctcagcggcatgcgatcctatatcaaggaccacaaaaaagacgtgttgctgaccgtccataatctaccggccggaacaccggtcaaacttgcggtgatggatcgattcgacggcacagtatggaacctgtccgattcttccgaagccacgggctcctcgaattatcatcgcgtgggcaccacgatcaaggcggatgagcagggtaaatccttcactgcgaccttcaccgtcgatcagggactgaccgacacctggctgccgctggcgggagcggccgctggcgtgagcttcgccaacgatgccgacaacggcaatgacacgttctactacaacacggataccgattccgccattattcccgccggcacgcgcaagggactcacctataccgaatccggcatcatagcccacaagcccaccgataagcagatcagcagtgcggccgcggcccgcatcacgcagccttcagcccaggatgttcccgattcggccagcaaactggccacgtccattgccggcggacagtcctcgggcggtgccgccgccacggccttggccgacacattgaaagactccggatggttctcacacggtctggaaggcgattatccttccgatgcgggccatggcaattaccgtatcaacaagctgctggcaggcacggccatggtgggtgattccgaacaatatgcctccgccatggcactgatggctcgtgagctgggactgccctcccgtgtggtcctgggattcctgccgaaaaacgaggatggcgaaatcaccgatgcccgcacggagaagacttcaggcaatggcaccaaaatcgaattcaccggcaatgatgtgaccgcttgggtggaaatcaaattgcaaggcctgggatgggtggcgttctatccgacgcccaaggagaccaaggtgcctgatgaaaaccagaacctgacgccgccgaatccgcagacactggtccggcaaccaccagtgccgttgaccgacccgctgcgcgatcagacgcaggccaaaggccagagttcgttggccggtaccgacgccgatgattcgccgaccaacctgttctgggtgcggttctggcgagttactcgtgcggtagccatctatggaagcccctgtggactctgctcatcgtttgcggactaatcctgatatttaaagctgcattgctggcacgtgcacgacggcacggcagtccgaaagcccgtgtggcagcggggtggaatgccatacacatacttgccgagcaaagcggcatcacagccaagggcactcgtcgcgatcaggccggcgcaatcgcccgtcagctcggcacggacgatcaggcactgattcaactcggtcgggaagccgactacgccacgttctcggggcaagacattgcatcgggccaagccaccacatattggaatggagtcgaccggttgcgcaaggcaatgctcgcttctttgccgcgtttcaggaggatacgtacacggctttcgctgaaaagcgtgtctatattggcaaatagacacgcagcaaagccgcatacagcgcgagtcaagcgcaagcataagaagaggaaaacgtcatgaccacaggttccatccgtgtcgcgatgaccagtgacgtgggtcttaggcgcaacaacaaccaagacaggaagccgtggacgccttggtggcggccgcgctcgatgcgggcggaaccgacaatatcactgtgattgtggccgatatgccactgaccgaacccgaacatcacgcgttcagcgcttttagactggacgagggcgaggacattggcgccattgaagacgcaacactgcgaacactacggaccatacgttcggcataaccgagcgaacataaggaggtaatcccatggttgattatgatgctgcggtcgctgccgtacaggatccgaacgcggacccgattctgttggcaaaaatcgcctacgagaatccggaattcggcgcaaacgtcgccgtgaatccgcgttgttatcccggcttgaagcgttggatcgccgaattcggcgatgagcgtgcccgcgaaaccctggcacaatacgggttcaccgccgacgcattcggcggcccggttcaggatcaggaggctccggaacaggcggcccagcaggctgccgagcagcagcctgcagacgcttacgccgccgaccagtacgccgcggctcagcagactgccgccgcccagtacaacgccgcccagcccgccgccgaccagtacgcggcccagcagcccgcagctcaggcggcattcgaggagcctgtggccaccaatccttatggcttcaccgccgaacaggccctgaccaccaccgaccagatgcaaatcgcccagattgcccagtacgcgcctgaactacgcgcctgcatcgcacgtaatcccaacacctatccggcactgatcgaatggctgggccagctcggcgacccggcaatcaacgccgctctggcttttcgtcagtgaaaggacggcatcatcatggccaaacttccctaccctccagcacctgaactgggttggtattccgacgatccggtggaaggcaccacggattccgcagttggcacagccgaaccgcagaacgactatgggcagcccagctctgcggaaaccgcggccaataccgcttttgcggcagagcctgcctccactgccgctaccgccgccgctgagcccgctgccaccgctccggcagacaccacaccgcacgccgccgaaaacgacatcgaggattgggacggcaccgtgctttcctcctcgttcacgtccaaggcaccgaagaagacgtacctgctgcataacgatgtcaccggccagaccattgtgatcgataagagcacgttgctgggccgcaagccttccatggatgtgccgcaaggtgccaaggcggagcgtatcgaagacccgacccgcaccacgtcccgcaaccatgccgccatcagcatcgacaccgatggcgcgctgtggatcgaggactacggctcgttgaacggcacctacatcatcaccaatggccaggagacccaagtcaccaagggcacaacgctcaagctcagtgcaccttcaacggtgcgtattggtgatcagttcttccagttcaccgaaaaacaggcctgagtaatcaagcaacgagcggctgcctgctcttgttcaacaggaaaatcacaatggcaaatatacggatggcccggaactgatatagttccgggccatcttattgcgattaacgcaagatctgagtcctagaaaggacatcctttctaggaccctctcgcttactcctcgatgtcaggctgaccgccctgatcggagtagaaatcatccgggttgaagtcgtcgccgagcttcagatcgccgaactcgagattcgagaagttcaggtcggacaggtcggcgtcggagaaggtcgcgtcaccgagatcgccatcgccgcccagaccgaagttcgggtagatggtgtcgcggatggccttgtcgggctcgaccacggcgttgcggtagcgggcgaggcccgtaccggccgggatgagcttaccgatgatgacgttctccttgaggcccttgaggtcgtcgaccttctcggagagcgcggcttcggtgagcacgcgggtggtctcctggaaggatgcggcggacagccaggagtcggtggccagcgacgccttggtgatgcccatgagcgccggacgaccgacggccggacggccaccgttcttgacgatgttgcggttgatctcgcggaagcgggcgttgtccaccagctcacccggcagcaggtcggtgtcgccggagtcgatgatggtcacgcgacgggtcatctgatgcacgatgacctcgatgtgcttgtcgtggatatccacgccctgggagcggtacacggtgtgcacctcctccacgatgttgacctgggcggcgcgcttgccgaggatggtgaggatcttcttgggatccacggaaccttcgaccagctgggtgccgaccttgatgtggtcgccgtcggcgaccttcagcggcacgcgcttggagacctggtaggtgatcggcttgatcacgccgtcttccttcggcgcgccggaatcggcgtccggggtcaggatgatctggcgaccgcgatcgttctccacgatcttgatgctgccggcgaactcggtgatcggcgcctcgcccttcggggtacgcgcctcgaaaagctcggtgacacggggaagaccctgggtgatatcggatgccgcggccacaccgccggagtggaaggagcgcagcgtcagctgggtaccaggctcaccgatggactgggcggcgacgataccgacggtctcgccgacatcgaccagcttgttggtggccagggaccagccgtagcacttggcgcacacgccgcgcttggactcgcaggtcagcacggaacggcacttgacttcctcgacaccgtgggccacgaggtcgttgagcacgtccatggacagggcgtcgtcgcgcttgtacagcacggtctgtccgtcggccgggtcgatgacgtcggcggcgagcagacgggagtacgggccaccgtcggcggccttgacgagcaccaggttgccgtcgttgtcgcgctcggcgacacggatgggcagaccggccttggtgccgcagtcctcttcgcgcacgatgacgtcctgggagacgtcgaccagacgacgggtcaggtaaccggattctgcggtacgcagtgcggtatcggccagacccttacgtgcaccgtgctgggagatgaagtactccagcacggacaggccgtcgcggtagttggacttcacaggacgaggaatgatctcacccttcgggttagccacgaggcctcgcatacctgcgatctggttgatctgcatcatgttgcctcgtgcaccggactgcacgatgatggccaggttggaggtcgggtcgaacttctcctcgacttccttggacacctcggcggtgcactcggtccacaggtcgatgagttcctgacgacgagcttcctcggtcaacagacccatctcgtagttggcgttgaccttgtcggccttggcctcgtactcggcgatcttctcgtcgcgctcgggcggctcgttcacgtcggagaacgcgaaggacacgccggaccacggtgcgcgggtgaagccaagatccttcagggcatccagcgtggcggccacctgctgggtggagtaacgcatggcgatgtcatcgacaatcttggacagacggcccttggccacctgctcgttgacgaacgggtagtcggtcggcagagtctcgttgaacaggatgcggccgtaggaggtggcgaacagcacggtgccgtcgtggaagcgctcttccttgacgacctcgtcctcaccttcgcgcgggtcgagcaccttgacctcgccgggctcccagttcttcggcagtacgaagctctcgggcaggcggatgagcaccttggcctgcatgtcgatctcgtggcggtcgagggccatttcggcctcttccagcgaggagaacacgcggccctggcccttggcgccttccagcacggtggacaggtagtacagaccgaggatcatgtcctgggacggcatggtcacggtgtgaccgtcagccggcttcaggatgttgtcggaagccatcatcagcgagcgggcctcggcctgggcttcggcggacaggggcaggtggactgccatctggtcaccatcgaagtcggcgttgaaggcggcgcaggccagcggcggcaggtggatggccttgccttccaccaggatcggctcgaatgcctgaatacccagacggtgcagcgtaggtgcacggttgagcagcacggggtgctcggagatgacctcctcgagcacgccccacacttcggcgtcgccgcggtccacgagacgcttggcggacttcatgttctgcgcgtagttcaggtccacgaggcgcttgatgacgaacggcttgaacagctcgagggccatcggcttcggcagaccacactggtgcatgcgcagggacgggccgaccacgatcacggaacggccggagtagtcgactcgcttaccgagcaggttctgacggaaacgaccttgcttacccttgagcatgtcggacagggacttcagcggacggttggaggcaccggtgaccgggcgaccacgacggccgttatcgaacagggagtcgacggcttcctgaagcatgcgcttctcgttgttgagcatgatttcaggggcgccgagctcgatcagtcgcttcagacggttgttacggttgatcacacggcggtacaggtcgttgaggtcggaggtggcgaagcggccaccgtcgagctgaaccatcgggcgcaggtccggcgggatgaccgggatcacgtcgagcaccatggcctccggcttgttgccggtggtcaggaaggcgttgacgaccttgagacgcttcagggccttggtcttacgctgttcggaagcgtccttgatctcctcgcgcagttccttggagatggtctccaggtcaagggactgcaggcgcttcttgatggcttcggcgcccatgcagccgtcgaagtaatcgccgtagcggtcctgcatctcgcgccacaggtccacgtcgtcgaccatgtcgccgggcttgagcttcttgaacttgtcgaagacggcgtccacacgggcgatctggtcgttgtagcgggtgcggatggcggccatatcgcgctcggcaccgttacgcagcttggtgcgggccgggcccttggcctcgccggcctcctcaagggcagcgagatcctcttcgaccttcttggcgcgggcttcgatgtcggagtcacggcgctgctcaaggcgtttgatctcggaatcgaactcgtcctgcaggccgggcagatcgttgtggcgctcgtcctcgttcacctcggtgaccatgtaggaggcgaagtagatcacgcgctccagatccttcggggtgacgttcagcaggtagccgaggcgggaaggcacacccttgaagaaccagatgtgcgtcaccggggcggcgagctcgatgtggcccatgcgctcacggcgcacgcggctgcgggtcacttcgacaccgcatcgctcgcagacgatgcccttgaaacgcacgcgcttgtacttgccgcaggcgcactcccagtcacgggtcgggccgaagatctgttcgccgaacagaccgtccttctcaggcttcagcgtacggtagttgatggtttcaggcttcttgacctcaccgtggctccaaccacggatgtcatcggcggtggcaaggccgatgcgaatcttgtcaaatgcgttgacgtccagcacttgttaatccgtttctgttcttgagaccttcccgagctccccttgtcaggggagctgtcagccaaggctgactgaggggtagtgcaaaccggaaaggtctctgtacgttatctatttcacgttggcggggctacacgcggcgtattgaccgcatgcagcccgagggatcactggtattcgggctcttcggccttctggtcttccttggcggccgcgtcggggcgggcgccaatgttgaagccgaggtcgtcagcggagctggccggatcgtcatcctcatccttcatgtcgatggccacgccttcggcgttgagcacttcgacgttcagggacagggactgcatttccttcaggagcaccttgaacgactcagggatgccggccggaggcaggttatcgcccttgacgatggcaccgtagacgcgcacgcggccgtcgacgtcatcggacttggtggtcatcatctcgtgcagcgtgtaggcggcaccgtaggcctcaagggcccacacctccatctcgccgaagcgctggccaccgaactgggccttaccaccgagcggctgctgggtgatcatggagtacgggccggtggaacgagcgtgaatcttgtcgtcgaccaggtggtgcagcttcaacatgtacatgtagccaacggaaatcggcttggtgtacggctcaccggtacggccatcgaacagggtggccttgccgtcggggccgaccagacggtcgccgtcacggttcggcagcgtggtggacagcaggcccttcaggacctcgggcttgacaccgtcgaacaccggggtggcgaccggggtgttcggctcggccttctcggcaccggacggaaccagcttcttccactcggcttccatgttcgggtcaagggagatatcccaaccggagtgggcgatccagccaaggtgcagttcgagcacctgaccgaggttcattcgggaaggcacacccagcgggttcaacatgatgtcgaccggagtaccgtcagccaggaacggcatgtcctcttccggcaggatgcgggagatgcagcccttgttgccgtggcggccggagagcttgtcgcccaccgtgatcttacggtgctgggcgatgtagacgcggatcatctggttgacgccgttgggcagctcgtcaccgtcctcctcggcatcctcgcgggtgatctccttgacgccgatgacggtaccggtctcgccgtgaggcacacgcagggaggtgtcgcgcacctcgcgggacttctcgccgaagatggcgcgcagcaggcgctcctccggggtcagctcggtctcacccttcggggtgaccttaccgaccaggatgtcgccggcctcgacctcggcgccgatgcggatgatgccgcgctcgtcgaggttggccacagcgtcctcgccgacgttcggcagatcgcgggtgatctcttcggcgcccagcttggtttcgcgggcgtcgatctcgtactcctcgatgtggatggaggagagggtgtcgtcctgcacgaggcgctgggagatgatcacagcatcctcgtagttgtagccgttccaaggcatgaaggcgatgagcaggttcttgcccagggccaggtcgcccttctggatggcaggaccatcggccagcaccgagccggcttccacacgctcgccatcatgaatgatcggacgctggttgtagcaggtggtctggttggagcgctggaacttggccagcttgtaggagctggtggtgccgtcgtcgttcatcacgcggatcaggtcggcggacacgtaggtgaccacaccgtccttctcggacttgatgacgtcgccggagtcgttggcggcgcgccattcggagccggtgcccaccagcgggcgctcggattcgatcagcggcacggcctgacgctgcatgttggtacccatcagtgcacggtggccctcatcatgctccaggaacgggatcagggaggcaccgagggagaccatctgacgcggggagacgtccatgtaatccacggagctcaccggcacatcgaccgcctcttcctcgccgactcgggcaagggcggacttggagacgaagttgccgttctcgtcgagctcctggttggcctgggcgatgacgtggtcaagatcgcggtcagcggtcatgtactcgacctcgtcggtcacatggccgttgacgaccttgcggtacggggtctcgatgaagccgaacgggttgacgcggccgaaggttgctagggagccgatcagaccgatgttcgggccttcaggagactcgatcgggcacatacggccgaagtgggacgggtgcacgtcgcgcacttccatggaggcgcggtcgcgggacagaccgccggggcccagtgcggaaagacgacgcttgttcgtcacaccggacagcgggttgttctgatccatgaactgggagagctgggaagtgccgaagaactccttgatggtggcgttcaccgggcggatgttgatcagggactgcggggtgatggcctcggcgtcctgagtggtcatacgctcgcgcaccacgcgctccatacggctcagaccggtacgcagctggttctggatcagctcgccgacttggcggatacgacggttgccgaagtgatcgatatcgtcgacgtccacgcgcaggtcaacatcttcgccgttgcgcttgcccgggaaggtcgccgcaccgtcgtgcagggccaccagatacttgatcgtggcgatgatgtcttcctggtggagggaacggtcgttgaaatcggcctcgacacccagcttgcggttgatcttgtagcggccgacgcgggccagatcgtagcgcttggtgttgaagtagaaggagtccagcaggttcttgccggcctcgggggtcggggtgtcggccggacgaatcttgcggtagaggtcgacgagggcctcgtcctgggtctcgagggtttccttctccagggcgtcgagcaccagcgggtaatccttgaaggcctgggcgatctcggacttggtcatgccgatggccatgaggaacacgatggcggactgcttgcgcttgcggtccacgcgcacctgcggctggtccttcttgtcgatctcgaactcgagccatgcaccgcggctcgggatgatcttcgcgccgaagacttccttatcggaggtgcgatcctgctggcggtcgaagtagacgcccggggaacgcacgagctgggagacgatgactcgctcggtgccgccgatgatgaaggtaccgtgcggggtctgcagcgggaagtcgcccatgaacacggtctgggacttgatctcgccggtgtcgccgttctcgaattcggcgttcacgtacagcggtgcggagtaggtgtaatccttctccttgcactcctgcacggtgtggcgcggctcctcgaagtacgggtccgagaaggtcagggacatggtctgtgcaaagttctcgatcggggagatctcgttgaagacctcgtcgaggccggaggtgtgggccacggtgttagtaccgttcttttcgtcctcctcgacgcgcgccttccagcggtcagagccgatcagccaatcgaagctgtcggtctgtacgcccagcaggtagggcacatcgatgggttccttgatggaaccgaagttcacgcgatccgacgccttgtgcagatcaatgtcatgctggtcggcgcgtgcgatgatggtggtggtgttcgtcgtagactcagtagccaatggacgttccttatcgctcgctaatatgtggtaattcccctgggagcgccggcatggccaccatatgcctatgcggacgcttcattgtcgacggcatgcccgcaatatgacacacctcatgcaaagtcaaaagaatactgatatgcgaggacatttttagctcccgctgacgagggagctgtcgagcggagcgagactgagggagagacccagcgtccaaacaccaaccgcaggtcctaccccaccgtaaacgtcaccggatcgctcttcaccttcggatgatccttcaaactcaactgcgccacgtacgttcccgcattgaccttggcccaacccgactcatccgtgcattcggtgagcgtggcgttcgcattggtattccacgtgaccttctgaacgtccttatcacccttagccatcagcagcagacgcgaatccgccggacacacatcggacttgtaaatcgtttcctgaccggaagtaatggtaagcacacggccggaatcggacccgtccaccaaacagttgcctgacccctcgtgcacgatggtcgcggtgaaatcaagcgatcctcctaccggcacggattgggaggccacggaaagctgcaatgtcacatcactggccgagcaatccttgacgttgctgactttcttcggcgccggcgtggcgtcgcgggaaatcgcatacacctcgtcatggtgaatcatcgtgttcacggcaccgataccccggccaaggctgtacacgcagaatacaatcagcgcgattatcagcagcaacaccgtaccggccacgatacgccgacgacgatagatggcctgctgctttttgctgatcttgcgcttgcgcggcttgccggaacggtcgtttcgggcgggcccgccggatggcccattggccccggtaccggctccgcgtgccgttctcgcgcctgatgtgttcctctgcactgccataacccttccagtctacggtcaccacacccatacacgcttggggagcccgccatttttcacaatgtcagttgggtagtcgcaggccgccgtccagaatctcgatcaggccgtcatcgtcaaggctggcgatgcaggcggcaagctgaatctggtccttccaaagcttgtcggcatcttccctgggcaacgtgactccagcgggaagctcgcgcagcgcggcgagcaccagaccgcgcacctgacgatcagtgccttggaatcgctgccgcgggcgggtgcggcgctcccccagtccggggcggccggctttgagaaatgcacaatcatccgcaatcgggcaaatctcgcataacggcgtcttggctgtgcaaaccaccgcgcccaattccatcaccgactgattccacgtgaccgatggaggttcgctgcgctgcaggaaagtgtgttcgccggatcgatatgcatggtccgtgcaatcggcaccgtccccacaaaccctgtcttggggcaacatgcggttggcgagcgcgcgttcggccgggctcgccgctcccccgcgagattcggtgccgaggaatacgcggctcagcacgcggcgaatattcgtatcgatcaccgcaatgcgctcaccgaatgcaaagctcagcacggcggaggcggtgtagtcgccgataccgggcagagcgacgagctcgtcgtaggtgcgaggcagctcatcgccatattcttccgccaccacgcgggcgcattcccgcaatcgcagcgcacggcgaggatagccaagccggccccatgcggtgatcacatcggctttaggtgctgcggcaagagcacgggcgtcaggccagcgtgccatccaatcgttccaatacggcaccacacgactcatctgcgtctgctggctcatcacctcactgaccagcacgccccacggcgtggcccgtccgaagcgccatggcaagtcacgcgcattggcctcccaccatgcgccgagccgtaaagaaattgctgtgtcgttcatcgttcttattcttagcagctatgacgaacgaggcagaacagaattcgcagaacgcgcagaatcccgaaacaaaagtcgagacgatgttcgagtacgggtaccgtaaatcgaattacggaccggacgaactcgtaaccgacgcgcatggcaaccccatctccgtggtggacgcgatgctctcggctgaaaaggccgccaccaccgaaaccgtaacaccgcacctgtgctactactcaccgcgtattcccggcaacaccggctcggccatccgcctgtgcgcggtgaccggcaccatcctgcatttggtggagccgttgggtttcaacctgcgcgacaccaagctgcgccgagcaggcctcgactaccacgacatggcccacgtggtgctgcatccgaatttcgacaacctggtggagtccatgcccaattcgcgcatcatcgcgttcaccgcacatgccaccaagctgtacaccgaagtggaatacaagccgaccgacatcctgctgttcggccccgaacccggcgacatccccgacccgatggacatcatggaaggcccgcatgtggccgaacaggtgcgactgcccatgcgcccgtccttgcgttccctgaacctcaccaattgcgcgtccatcgccatctacgaagcctggcgccaactgaatttcaagggcggagcgtgaggaaaaggcccggtgggccttcgagtagcgacgacgaacgaacaccgacaggcgtgagagaggaaaccctgagcctcgcgcagcgagaccacaattgcaggacggagcgtgaggagaaggcccggtgggccttcgagtagcgacgacgaacgaacaccgacaggcgtgagagaggaaacatcaagcctcgcagcacgaccatcattgtggagatgaacgcaaaaatgggtctatcggcacttcgaggggctgatttggcatccgccggaggtctactgccgcttcaaggggctgtcaaaggacgaagaccccgagtataggcgttgaaatatcaacgcctatactcggggtcttcgcatatatcagcccctcgaagcggcagtagaccttcagaaaagtcggaatcagccccttgaaacgggaatagacctctcgaaaggtcatccaaatcgatatccgccttcggagggggtgcattcgggcttttgcagaatgcgttctgctttcaaagggatacctacgcagaaaccccgagtatgaatgttgaaatatcaacgctcgtactcggggtttcttgattgaggtacctctctgaaagcagatacctatctgcgcaaatgtacctctctgaaagcagataccctaccgaatcagttcttgaagctgtgaatcggcgcagggattcggccgccacgggtcacgaaagcctcgcagctggtctggttcaccggaatgatcggcgcatagcccatcaggccgccgaagttggccatctcccctacgcctttgccttccaccggaatcacgcgcacggcggtggtcttctggttgaccatgccgatggcggcttcgtcggcgatcaggccggagatggtggaagcagaggtatcgcccggaatggcgatcatgtcgaggcccaccgagcatacgcaggtcatggcctcaagcttctcgagggtcaggcaaccggaagaagccgcgtcgatcatgttcttgtcttcggagaccgggatgaacgcgccggacaagccgcccacgtaggaggacgccataatgccgcccttcttcacctggtcgttgagcatggcgagcgccgcggtagtgcccggtgcgccaacctgttcgaggccgatcttctccagcacttcacccacggagtcgcccacggccggggtcggggcgagcgacaggtcgatgatgccgaacgggatgccgaggcggcgggaagcctcctgagccacaagctgacccacgcgcgtgatcttgaacgcggtgcgcttgatggtctcgcacaggaattcgaagtccttgcccttggccgcatcgagcgcgcgggagaccacgccggggccggagacgccgacgttgatgaccgcgtcgccttcggtgacgccgtggaagccgccggccatgaacgggttgtcgtcaggcacgttgcagaaggccacgaacttgacgcagccgtaggagtcgttgtcggcggtgcgctcggcaacgtccttgatgatgtggccgagcagttcgaccgcgttcatgtcgatgccggtcttggtggagccgacgttcacggacgagcagacgatgtcggtctcggaaagggcttgcggcagggagcggatgagcaactcctcggccggggtcatggacttggagacgagtgcggagtagccgccgatcaggtcgacgccgacttccttggctgccttgtcaagcgcgtgggcgatcttgacgaagtcctcgctcgtcttgcaggagctggcaccgaccagcgagatcggggtgacggtgatgcgcttgttgacgatcgggatgccgtagtcgcgttcgatggccttgccggtggaaacgaggtccttggcataggtagtgatcttgcggtagatgttgtcgcaggtcttgtcgacatcgtccgaggcgcagtcgagcaacgagatgcccatggtgatggtgcggacgtcgagcttctcctgctcgatcatctgattggtctcgtggacctccatgatgttcagcatggtttgttccttacaggatatttgaagactagtttggcggtcaccctcatcagagggataaggatggctccgtcagcggaaagcccaccgggctttccacctcctcgcgtgaggcggcctgctgagccggtcgcctcaaatacggtgcatcttggtgaagatttcctcacgctggcagcggatgcgcacgccgatgtcgtcgccgaggtcctcaaggttgccgaccatcgcgccgaagtccttgtccgcgttggcgtagtcgacaatcatcatcatgttgaagtaaccgtcgatgatggtctgggaaatgtcaagcacgttgacctgatgttcggaaaggtatgtgcagacgcgtgcgatgatgccgacagtatcctgaccgacgacggtgatgattgccttgttcatggaactccctaaacgtgaggtgtgaatatccagttaccgtcttggcgaattgccggacgtgccctcaagtatagggaaggcacgtgccaaaacacgtgcctttcgtctgttttgccttacatactgagatgactgccggttaccacctaccgctgcagcagctgtatgtcaccgccagatgccgtcaagcacacgcacatccacgcaatcgaccttgccgtcagcaacaaaacggaactcgccatcgccgtccgcaccttggaacagcatactgccggccgcttcgccgttgttaaggaagacttccaccacattacggtcgaagaagatttcgacgcgacgcacatcggcgatgccgctatcgaaatcgatgtcgtccacgactgttcccttcgtgaccagtcgggtcacgccgtcgcgacgctgcagctgcaattccatcgaattaccattggcggaattggtaccagtcgcgatgagcattgtgaaatcgtcatcgtcagccagatgcatgtccgtgtaatacgcgttgttcggcacaataaagaaggtcccgttttcgtctgcatgcgcttccaaacgatcgcctagcagctgctcgtacacttccttgacaggacggctggtcaagcggccgtcacgcacgtgcagttcacgtggcagcgacatcatgccgttagcgatgcacggcttttccacacgcatcgcgggaaagtcggtataccagccgaacacgatacgacgcccgtcgtcggcagcaaagctttgtgtcgcgtagtagccggtaccgaaatcgcaccaatcgctgttccctacctgcaaacgtgggccatcggcggtgtccttgagatcaccaacataccaacgcacctgctggaaacgaccttgcttgtcacggtagtgcatcaaagctccgatggcgaccgtcttgccgtcgagctggaacaggtcaggacattcgtaggtacgtgacagctggtggccgaagtcggcgagcaccggtccttcatactgccacgtcacgttgcgcttgagcggtttcttcgcggagaagagcgccatggcaggcaccgtatccatattgggcttgtcggtgccgggcatgccttgcggaccgcacgtaaaccagccgtctgtaccctgtacgctgatgccaggcgccgcggaggacacagcatcagtatcgaattcggcgaccggcagattcgtggcggtcaccatgtaagcgcgttccggatcgatcgcctcgccgcccatgccggtttccaccttcggatcacggaaatcgaagccaaaaccatcgttaacgcgcaacgcgactggagattcgacactcacatgcacgccatcctcacacaagcaggtggtctggtattcagtaacagacgattcgtctccgcgagtctccaggtgccgggttagatacaggcgaatagcggccgcatcatcacccttgcagggattgtcacacgcatccaccgtcaccgcggatccggagaacgcgccgccaacgatgcgttcgtcgatatgcagctccggctgcggttcgaggaagattggcagatgcgtccaatgcaccagatcgcggctcactgcatggccccagtgcatattgtcccagccaaaaccatacggattgaattggtagaacagatggtagcgtccttggaaacgacacaggccgttaggatcattcatccagcgagcgaatggctcgaaatgcgccgcagggcgagcgaaacgatcatagatctgatccagcgtcggctgcgtatcccattcattgtcatatggattcatgctgatgaaacgcacgccttcatcaagaagattctcacactcggacaagtaggcgaaccgcacggtcagttggcgcgctctcaccgtgagacacacgtttgtcggcaccggaatcaagaaacggtggcgacgctcggccaccggcatgacatggctggcgatttgatggccgtccccgtctgtaatggtgacggcagcgtcatcgccgcatctttcggcgaacaattccagcaagcggtagccgccggtttcgatggcaacggaatagttgtcaggcataataatttcctccacagcgccacatgatcagatatcacgtggctacgcattgaaaaactgataatcggaaaactaaatatgaaaaaggggaacacccgtcacaacacgatggaatcgcgttcgatgatgcggcagcgcaatgctgttttgctgccatcacgttgcctctgcaccgccatgccacgatcggactcaagatcagctacggccttgtcgccgtcaagtatggcgacaagttgccgaaccgcttcaaaacccatctcataatggggcagttccagcgtagtcagtgatggtttgatcacattagtgatgaacggctggttatcgatgctgatcaccgacacgtcagcgccgatgcgcactctgcgttcgcgtgcggcttcgtagatgaaagtggcgcgcacatcgttgaaacaaaagatgccgtccggcttgatttcgtcgaacacccgcgccgcctcagcagcagcgttggtcgtctccaatacattgacgaccaaagcgtcatcgaatggaatgcccgcttccgcaagcgcacgtcggtaaccagtcagacgttgaccttgcgcgacgatgggagttgcggaaccgtagtagacaatgcgtctgcatccagctttgatcagacagtcggtggcgtcataccccgccagttcatcatcggggtagactgagggaactcgccccgctgcatcctcactgtccaccaccacggtcgggctgccttccaagacttcgggaatgtccactttgcggtggaacatcatggcgtataggaagccatccacgttgtatcggagcagggcggatatttcttggttctcgagttcagcgtcattattggtgttcgtggtaagcagtatgtatccgagcttgctcgcagcatcctgcgcaccttcgagtaccttgctcgcgtacggggtcgtggcgatctcatcggtgacgaatcccagagtattggatttgctggtacgtagggtgcgcgccacagaattgggcttgtaccccatgttcttggcagtcgcacggattttctgcgcaaccgccttgctgacgcgattgtgatccttgttgttcataaccaaagacacagtgcatacggaaacacccgcttccttagctatgtctttgatggataccaatcgtttggacctgttcactcgttgacttactgacgactgcaccattttatcacccccctttttgcgaacatgtcacgatgtctggtttcgggcgtggcccgcgctctgttccatgcggtcatgaatgtccattccaggcagacggccgaatgaataaataatccaggctgtgcagaacatcggcagcgacaagccgaacaccatgagaattccaggccattgcacccatacaagcacggtaagaatcagcagtccaacctgcagaaggctgcacaacgggcgtgccacaatcatcgccaacgtcgtgcggacaatccagacggaacgttccgcgtaattcgcgcgcactacccaaaccaagcaggtgaacatcacgagaaccgcaatgagcagcagaagcacaccggaaatcgcaatatcaaaactgttgcgggcatgtctgctcatcatacagcaatcgatgatgattacagcccagagaacgatcaacggccaaccgaaaagattcgcacgtttgaattcgcttttccaaaagccatggaatgttttccatacttccttagcacatatggaacggtcctcggaaagtaaccacatgcggaacgtggagtacgtagctgcgagtgaggggagaaatcccagcacgacggctcccatcagagtgtgcgcgagtatggccacgttgaccacgaaaatcgtgactagcagacggcagaaccgctcgtaggccacagagaagcgggcaagcatagcgaatcctttctatcggctggcttttagattggttgtctcttgtcggattgcgtttgactcaacccttgaccgcaccgagcatcacgcccttgttgaagtacttctgcaagaacggatagagcacaagcagaggcagggtagagacgatgatgatgccgaacttgatctgatcggcggcctgctgctgcgcagccgcgttgacattggttccagtaccctgcgccaccagtagcaactgctgcaacaccacctgcaatggctgcttcttgtcgtcggtgatgtagataaggcccgtcatgaagtcgttccagtggccgacaaagtagtacagaccaattacagccagaatcgcggagcttaacggcagcacaatcttgaagaagtagccaaagtagctcagcccgtcgatctgggccgcgtcgaagagctcttcggggatagaggtttcgaagaaggagcgggccacgatcacgttgtacacggaaaccgcgccaggcaggatgaacacccacatgctgttgttgatgccgaggctcttgtacagcaggtagttcggaatcaggccgccagcgatgaacatggtcacggtgaacaggaacatgatcacgcgtcgcggcttgaactcgcgacgggatagcgcgaaggcgcagggaatggtcactgccatgttgaccgcggtgccgaccaccgaatagatgatggtgttgagatagccctgccagatgcgctggttggcgaacaccttagcatagccaacgaaggtcacacccttgggtagcagcagcacttcaccgccggccacggcgttcggatttgaaaatgatgcgatgaccacgaaccacagcgggtagagcaccgccacaatggtcaggagcagcagcacattgatgatgcctgacaccgccaggtcacccggcttctgcttctggcgcacgtgcttgttccagggaatgtcgttcttgttctgggtaacagcctcaattgttgcagacatgataaaacccttctagaaaatgctcgtatcggaaacgcgcttggcgattgcattcgcggtgatcaagaagatgaagttgaccaaggtgttgaacaggccgattgccgtcgaatacgagtattggccattgataataccgattttgtaggtgtatgtggcgatgacttcggtggccggcatgttcagcgagttctgcatcagatagatcttgtcgaagcccacgttgagcacggaacccatgttcatgatgagcaggatcgcacatgtcggcatgatcgcaggaatatcgacgtagcgaatcaactgcagacggcctgcaccgtcgatcttcgccgcctcgtacagcgatgtgttcacaccggcgagcgcagccaggtagatgatggagttccaaccaacatgctgccagacttcggagatccaatagaccgcggtgatggcgctggtggagcccatcagtgattcatcaccgaagaagcgaccgagaatgccggtaccaggagtcaggaagatgttgagcatggagacgatgaccaccacggagatgaagtggggcatgtaggtgatcgtttgcacgaaacccttaattttcttagaaccgatctgattgatcagcagggccagaataatcggaaagatgaagcccatgaccagtgtccaaagggaaatgcggatggtgttggtcatgatctcgccaaacagcgggttgtggaagaattccaggaagtatttgaaaccgacgaatttgccgccggtcaggcctttggtcggatcgaactcgcggaaggcgagctggatgccccacatcggcacgtaggagaacagtcccacgaagaacaatgccggagcggaaagaatccacaactgccagtagcgacgtaaatggtcggcgatgcgatcgagcagacctggtttcttgcggtcgggagccgcttccatcgccacggtccgtgcagcaacgccttgcgatgtttgtgcactcatgttggtctccaatttaggatgattgctagggaacaaaaatgcggggtccggcggcagtcacgggagagaaacgaacccgtgcgatggaccccgcggtattacttggctacttggtgtacttgtcgtaccacttctgccaaatcttgatgttggcgtcgaggccgagggtcggttcggacaccttcttcacgtaggcatcccattccttgtcgatgccgcccttctggacccacttcgcgatctggttgttcgcgtagttggagatggcggtgttgttgttttgcagggtgttggagtcctcggtattcgggcgcacgtaaatcggtacgacatccttgacgccgtcgacgcggttgcgcgcctcacgaatggccaagtcggacgcagtgacctggtcggcgttggtgtcgttgaccatcttcacgtcgtcgcgaatccagccaccgaagcggtcctgcagggcgacggcgcgggtatcaggatattcggcgtaagctttagccttgtcgatggtgtactggtggtcgccgtcatcggagacgatatctggaatagagccgaagaatccagccacggaaagcttctcgccgtacatggcgtcgatcaccttgtagatggcgtcctggttggctgcgttcgggttgacggtcaggccggaaccggagtaggcccagcggcaggcgtcctgggaataatcccacttgacctgggagtcgggcgtggaggcgtccttcttcagcggcggcagggtgacgtactggtcgccaagcgcgttgccgtattcggcgtagttggaccaaccaaaggagacgccggtcagcgcggtcttgccgtcactgacggtctgcgaagtgtattgcgaggcgtcgcgggtgagcacatccttcgggataaggcccttggccatgagtccgtgcaggtaggagacgacgtccttgagcgcgtcggaggtgtaatagctcttaaccttgccgttgtccacataatagccctgttcggaagcgccgccgcccatgaaggaggtgaccacgccttcggagttcatcagcgccagagggctccacaggccgaaaccgaggctgcggatattcatcggcacctcatcagccttgccgttgccgttcggatcctgggtcttgaatgcatcgagcacgttctcgagctcgtcccaagtggtcggcatctggagtcccagcttgtccagccaggtcttgttgatgaacatgtgagtgccggaaacctcgtaacccttgccgcggtcggagggcagcatggcgatcttggtgccatcggtaacgtacttcgcggcgcccggctgggccttgaggaacttcttgacgttcggcatcttgtccagatgcggcttgagatcctcgaaataggtgctgtacttggccgcatccaccatgctgaacaagctcaagccaatgtccgggaattcaccggcggccatcttggcgctcttctgctggccccaagcgttgtcggagacttcctgccacttgatggtgcaatcgcaggcggcttccagatccttggtgtattgggtgtcctgcatcggatggtcggtcacgttgcgacgaaccagaatgttgacgattggcttgccgttctcgtctgtggtggcctgcttgttgccgcaggcggcaaacgtcgtggccatagtcgcgactgcagctattgatgccaacaggcgaacacttcttcgtgccatgattaggctccttcttccttgatgtttcctcatcgcaccgatacgagaagcaccggcgaaatttccgccgcccacttactttgtggctattgctttgcggtggttaacactataagacgttaatcgattaatgtcaaatgttaatcgtttatctcaatagttaacactctcattgaccagtccacccagcgccgcaaacgtaaacttcggctccatactgccgttctcgcagaacaccggaatcacccacatcgcgacacgccgttactcgtataacgtatctttttccatcaaatgcacgtacaacccgtccgttgtacgcacaaaagagtagccgaacatgacggccaccaagtcggccgctacttacaaaaggtgctcccctccttcaggaggaagaagaagcgcacggatacgatcagacagcaccaaaccaaacagtagccgcacctgggagccaggatgaagcattcggcatcgtgcctgctggccatcgtcgtgggatacgctgtgcaccatctggcccacaagtaaatcatgcaaaaacgcgcgttggcgcacgtccatgaaaaaggacgtgcgccaacgcgcgtttttgcatcagcttccgagatcaggcctcgcggctcgcggaagccgcagcgaacgccggcaaggcgcgaggtgcgttgaaaccttccttttcgaagcggtcagcaatcttctgtgcaatctcgtggccctggcccttgtcgaccagggcgatgatggagccgccgaagccgccgccggtcatacgcgcaccgtaggcgccgttcttgcgggccacgtctacggcgatgtccagctcggggacggtgacctcgtagtcggcggccagcgaatcgtgggaagcgttgaacagacggcccgcagccttgatgtcgccctgagcgaaggcacgcacgaaggaacgcacgcgctcgatttcggtgacgacgtggcgcacgcgcttcttcatggtctcgtcaggcagggcgtcaagcgtttccttgagggcctggaactggtcatcggccttggagatgccgtcggcggtcacacgcaggttggccacaccgagaatcttggcggcttcctcgcaggtggcgcgacgctgagcgtactggccatcgttgagctggtgcggagcctgggtatcgaccacaagcagctcgaggttgtacttgtcgaggtcgaactcctgctgggagacgttctccagcggggtcagctccggacggcagtcaagcagcagcgcgtggccttcggtgcaacgcatggaagcgttctggtcaagaccgccggtggaggcgccggccatctcgttctcggacttgatggcggcgttgatgagggtcacacggccggcgtcggaatcaccgtagccaaggccgtacacgtcgtccagagccagagcggtggagcaggtcatggcggcggaggagctcaggccggagcccagcggcacgcaggagacgaaggcggcatcaaagcccttgaccttgtcgaaaccagcctgacgcagcgcccaggccacaccggtcgggtaggcggaccagccgtccacgccacgggccttgaggccatcgagatcagcttcggcgaccttgtcgggagccacgccggagacgacgcgaaccttggtgtcttcgcgcggcttcagggcgatgaaggtgcgatgcggcagagcgatcggcaggcacaggccggcgttgtaatcggtgtgctcaccgatcaggttcacacggcccggagcagcccacacgccctcgggcgcagcgccgtaggtgtcgacgaacagcttggtggcttgcgagacgccttcctcatgggtcagcggctcaatgaattcaacagcagtcattggtgttttctttctatcagtcggcgatgtcgatggagccgagctcatggaagcgcttggcgatgagttccggcgtggtgtcggagatccaggcggccatgccggattcggagccggcgaggtacttgatcttgttggcggcgcggcggaaggagaagaactgcaggttcaggcggtagttctcgcggcgggcgtcgtggatcggggcctggtgccaggcagcgatgtacggcagatccatgcccttgccgtcgcccttgtcgaagaaggcgttgccgcgcttcaggaggtgcgagtacatggaggcaaggtcccaacgctcttcgtcgttgagctggtcgagggtgagcacgtcgcgcaccggagccacgtggacctcgaggggccaacgggcggcggccggcacgtaggcgacccagctgtggttgcgcatcacgatgcgttcgccggcttcgagctcggagttcatgatgtccttaagcaggttgccgccggtcttctcgtggtaggcctcggtgtgctggagttccttctccatcttcggggcgatgaacgggtagcagtagacctggccatgcgggtgggcgagggagacgccgatttcctggccgtggttctcgaacgggaagatctgctcgatgccttccatcttggagatttcggcggtacggaaggcccaagcctcaaccacggtgcgcaggcgggagaccggcaaatcggccggcaggccttcctcgttcgggtcgaagcagatgacttcgcagcggccggcggcgagcttcttctcccacagcgggttgccgtcaacgtaggtcacgtcctcggagacaccgggcacgcgcaccatcgaggggaagcggttctcgaacaccacgacgttgtagtcggtgtccggcacttcgccgtcctggtacgggtcaccgggcttgcgggcggccagcgggttgcccttggcggtggctccgggaccggcggtgatcgggcggttcatacgggcggtggccatcgggatccagtcgccggtcagcgggtcgcggcgcatctgcggggcggcgtacggcacttcgttgccgtcggcgtccaggtgcggggcgaaacggtagtccagcgggcgcgggtccttgagctcgcgggtcttggcaccggagacgaactcggggtcgtcgtccaggtagaaaaagtcacgaccgtcggcaagcgtcgtcggcgtgatgcggatgtgctccttcgcatactccccgggggtgtagttggcgaaatcagccataggtttactcactttcctcaatggtctcgctctggtgggccagcacgagttcctttaccaaatccttggttttggcggcggagtcggggtcgagcccgtcgtcagtaatgaccgtgtccacttggtcgaagcgcgcaaacagcgacagcgatgtgcagctccacttggtgtgatcggtcaaaactatggtgcgatcggcgatgtccatcatcgccatatcggttgcggcttccagcgaattcggcatcaggaagccacggggaatcgacaccgagtgggtgccgaggaatacggtgttgacacgcagcgaggcgacgaccttgtccgcgatcgggccgacaagcgagttcgatcgggtgatcacgccaccggtgacgatcacctccacatccttggattcgagggcctggaccagctcggccacgggaatcgaattggtgaggatggtgatgccgctggactgctgcgattcgagcagatgctgggcgaagacataggccgtggtgccgccgccgatggcgattacgtcgccgggagccacatattggatggcttcctgggcgatggcgcccttcaggccgatatccatctgggacttgacagagaacaggggttcgctgagcaaagtactggtagtcaccgcgccgccgtggacgcgcttcagcagtcccttgtcggcaagttcggcgatatcgcggcggatggtcatcgctgacacacccagttccttcgatagcgccgtaatgcgcactgccccgcgtgtgcgcaacctgctcaagatgaggtgctgacgttgtgacgaaatcatgtgaacattatcgcacacaaaagctcacaaaccaaaccggcttgagcgttttggggacaatttctcgaaaattccgggcaattcaggtgttcatttccgcaaaaccacgcaaaatcgcacattgcgcgaaccgatattctcacagcggccaccagcgcgatagctcacgaccgacgactctcccgcgcgcgttgctcagcggagagtcacgcctgatacctggtgcgtcccaattcatgtatcttctgccgagcctacgtctgcgtgtgcctcgacacgcggtagccccttccccaattcgcctaggtagggatcgcctagccgcaccggcccaagcgtgagacaataggcggtatgacttacgtttctgaaagcttctggcacgacgccgtcaacaaagccaccaccgatctgttcaccttcggctacaagcacatcatcaaaccgaacttcgtgttcaaccaccgccccgatgaggcacacgatcagatgatcgagttctgccatgtcgtcaagaacgtcccgccgctgctgctcgccgagcagcttatgctcgactacaccgaccccattctggaaacgaatgtgatgggcgtcgatttcaccaacccgttcggcctgtccgccggcctcgacaagaactgcgacatgcccgtggtgctggaccacgccggcttcggcttcgaaaccgtaggctccaccacctcgcgtccctgctcgggcaacgccaagccgtggttccaccgtctgcctgaatacgattcgatgatggtgcacgtcggcctcgccaacatcggttcggacaaggtcatcgagcgcgccgagaaggcttggactcaggcccgccagatgcagctgtccgtgtcgatcgcccgcaccaacgacgaccagtgcggcgatttggacgaaggcattgaggattactgcatttcgatgcgccgcgccgtcggccgcaccgcgatggtggaggtcaacgtctcctgcccgaacacgcacgtcggcgaaccgttcaccacgactccggaagcgctcgaccgtctgtttacggcgctcgacaagatcgaccgcccgcagcccacgctggtcaagatgccgttgaacaagccgtggggcgagtacaaggagctgctcgatgtgctggccgagcacaatgtgcaggggctgtccatcgccaatctgcagaaggaccgcaccggcctcgagattccgcgcgattgggagggcggcctgtccggcggcccgtgcaccaacgccagcaccgagctgattcgcaaggtgtataaagagtatggcgaccggttcgctatcgccggcatcggtggcgtctttacccccgagcaagcctatgcgaagattcgttccggctccagcttggtcatgttcatcagctcgctgatgtaccgaggcccgcagcagattaccgtgttgaagcgcggtctggcccagctgctgcgccgtgacggattcgagcacgtctccgatgccgtcggcgtagacgtggagtgaactcacatattgccctattacccatggggcggtaaaaccctcatggggcggtgattgtcccatggggcggttagccaaatttcacattccgcagaataccgccgttttgggttaccgccccatgagggttttaccgccccatgggaaagttaccgccccatgaggatttagtacgcaccggccacgtattgcggggcgtaggggacctctgtggacggtatgcccagcttgttggccgcacgcaacggccagtacggatcgcgcaatgcggcgcggccaatttccacggcatcggcttcgccatgggccagaatcttggccgcctgcttcggcttggtgataagacccaccgcggtcaccggaatatcggccttggacttgacctgctcggcgaacggcacctgatagttcggcttgaccggaatcgacactcccgacatgatgccgccagtggacacgtccatcacatcgacgccatgctccttcagcaccttggatagtgcgatgctctggtccaaatcccaaccgccagcggcccaatccgtggccgaaatgcgcaccagaaccggcacgccctcagggacggccccacgcacggcatccacgacctcgaccaggaatcgagagcgaccggtcaaatcgccaccatattcgtcatcacgctcattgctcagcgggtcaaggaactgagaaatcagatagccatgcgcggcatgaatttgaatcgcttggaagccggcggccgacgcccggcccgccgccgcggcgaacgcgccgaccagaccatgaatctcatccacggacagcgcgcgcggcgtacgcagcccgccgaatgcgatttcagacggtgccatggtgggccagccgcccgcctcctccggcacactctgaccgtcgtagccaacggcaaaacaaccagtcgaagccttacgccccgcatggttgagttggatggcaggcaccgcacccgcctcgcgaataccgtccacgatccagcgccaagcatcaatctgcccgtcttcccacaggcccagatcgcacggcgtgatacgcccctcaggagccacggcggtggattcgacgatcaccatgccgaatccgccgaatgcgcgagacacgtaatgctggtagtggaacggcgtgggcctaccgtcgcgggcgaacgacgaatacgtgcacatcggaggcaaccaaatacgattacgcacggtcacctcgcgcagcgtcattggcgcaaacagcccaggacggtccttgctggctttcttatctgccttgcccacagcttcccttccctcataatcctcataatcctcataatcatcgaacgattcgctcgtcttgcccgtgccggcccgcttcttggaccgtgcgtcggattttgacttcttcttaccgtgcttacggttcttcgatgcatcatcgtgcttggtcttcggctgcttggactgatcgccgtccgaagacgaagccatcgtcaccgctttgagatccggcacgtcgaatccacgaaaatcaaaattctcatgcgtcagatcgtcgttgctcatcgttcccctttccaatgcgcgttcatggcgaatattcgatgaacgcgctggcgttgtcattaagtattgtaaaacgggcgtcacctgaaacaggtaacgcccgcaaactacgtaatctgggtatcgcagtcggccatgttacgtagactcagccggcctgcaatcaccaaatgtcaaacgccaatcaccaatcactggccatcattcacaactgctctgaatcagtgcccctgggtttgggtgttgttttgcccagtgttctgcgactgagactgattgttgttgctctgcgattggctgttgccattcgtagtggtctgcggcgcgctgaacgttcgtccgccaatgcccagatacttgccagtcgtggtgtacttcgagacgggctggccgtaatcgttgtcaatcggtattttcttcttggaaatgtagctattgaagaagttggtaacggccggagctgcgattgtcgaaccatcccaatagctgttgtaccggccgttgatggcaatgttggaaatacggttggtgtacgggttctgtgcgtcgccgaccacagcgaacgccgcgatctgattaggaatgaacgatccaccggacaccgcgagatcctcactggtaccggtcttaccaaacgacttacgcccgtcagccaatctgaatgaccaaccggcaccatccggccgcaccgtaccttggttcagggtataagcgagtgtttggatgatgtccttatccaccgcctgatggcagttcgcggacgggaccttgaactccttgccgtccctgccggtcaccttgttgatggcgatcgggttgcactgcacgccgttcgaggcgtatacggcgaagatgctcgccatggtcagcggggacacgttcaccgagccgatcatcatggacggcgtgtacaccggggtcttgtcgatggtctcgccggtggcggcgtcatggtatcccagttcggtcgcggtgtccgccaccttgcacagtttgaggatggcgcccatggaggcctgggtggtgttgtgcgatcgcaccagaccgaggaacgggctttccgggttcaccgtgccggcgcccatggcgttcgacacgttccacgaatcggcgccgcccttgtagttgtcgcaggcgaagtcggtcgtggggtacgtcgtggtggtctgcaggttgtcgttgatcgaatggcccgcctccatccatgcgatgaggttgatgggcttccaggacgagccgatggtccaaccggagccgccgccgtccaccagatcgacggcgtagttctggctcgtcttggtcgggtcgttcgcggccgccggggtggcgtcatagtggcggttcaggccgaagcccagcacctcgccggtccccggtttgaccgcggccatggcgatctccatgccgctgggatcatcgggcggaatggtgcggcgcgcggtgtccatcatcatggagttcgcctccacatccaatgtggtgacgatcttcaggccgccctcctgcagcagtttgttgcgttcggcgcgggtcttgccgaattcctcggagttctggatgcggcgcaccacgaagtcgcagaagtacgcatagtcgccggtgtcctggcagccgacgttcacggactgcaccttcagcgtgtccttcagcggcgtgttcacggcctcggtgtactggtcctgggtgatgtacccttcctgcagcatcagcttgagcacgatgttgcgctggttttcgctttccttctggttctcctcgaccagcggatcgtactggctcgggttcttggtgatggccgcgatggtggcggactgcaccacgttcaggtcggcggcggacacgctgaagtagcgctgggccgcggtctccacgccgtacaggttgttgccgaactgggcgatgttcagatagccctgcaggatctcggccttggaatacttcttctccatctgcacggagatcagcatctcgcggatcttgcgggcgacggtgtcttcggtggcatggtactgggcgatcgggtcgtcgtcctcgatcgcctgcatgagcagcacgttcttgacgtactgctgggtcagcgacgaaccaccctgctgggagcctttgacgaggtaggtctgcacaaacgcacgcatcacgccttgcacgtcgacgccggcgtgagtccagaatcgacggtcttcgcgcgccaccactgcctgctgcatggttttggaaatcttcttcagcggcacgacgatacggttttggttgtagaacgtcgcgataacggtggaaccgtctcgcgcgtacatcgtcgacttctgaggcagactggtcacatcgaagtccacattttctaccttgagcgacggaatcaccgctttggcggctttattggcaccgaccacacccggtacaaacaacacactggccgccacgccgccgcagacggcaagcatgatataggccaagaggagaacaagcacacgttggagagtgagggacttctttttgggcatgggccccattctaaatggggtgccctaccaaccgggcttacggtcagctcccgtgaacatatcatcacaagaaccgcactagcgtaacatcggctggaagtcagccgaacggtcagcgccgcgagcgtcgaatcagcatacctggctggaagatgatgatcgatcggccgtcacgtgcgatccatccgcggttggaaaagtccatcaacgccttgttcacggtctcacgactggagcccaccagttgggccagctcctcctgagtcaggtcatgcggcactttgagaccctgttccaccggctcgccgaaacgtgagcccaagttgagcaatatcttggccagacgcgccggcacatccatgaataccaagtcggagatgcgttcgttgttgccgcgctggcggttggccatgacctgcaacatgtcgatggccacacgcggatgctcatcaagccatgcgaacagggcatcatgctccagccagaccacgcgcgttccatggctcatggccactgctgacgcggtgcgcgggccaccatgggggtcgaataccggaatctcgccaagcacttcgcccggcgcgtggatggacagcagttgcacgcggtcatcggaagaagtgcgaatcagcttgacgcgcccctgctccagtaaatacatgcgctgatcggtatcgccttcggagaagatatagtcgcccttatcgaacgccgcacgcttcaaatgcggcaacagctcctcggcttcggctggcgatacctgcttgaacaatgccgtatgcagcaggatgttctcctcgtcagcaaaagcgtttggcgtttccaagctcatcgcaccatccttatcgatcgtcccgtgcctgacctcgactgtcatattgtaacgcgcccgttcggcgcggacgctcatgcggagaaccagtcgatgaggtgttcgacgatccgcgcccggctgagacccgtctggcttttcatcgggtccacgcgtttgaccgctgatttcaccgctttgtctgacatcttctcgtgactggtgttgagcacacggctcatcttggccgcatcgatgtcatatgccatggtcacatggtgcagcaccgcgccgcctgagcctacggggaagcgccgctgcgccgctcccccgatcttgccgtactgcgaggcgatatcattgaggcccgtgaaccgcacatccaaaccaagttcgcgcagcgcttcgaccagccaccagtcacagagccggtaggattcttcgatgcttacgccctgaacgaaatcgagcggtgcatacagagaataggtaatggtgttgcccggttcgataaacatcgctccgccacccgtgcaacggcgtaccacgtcgaagccgagctgcttggcaatgtccagattcacctcgtcctgggccgattggaaacggccgatgaccacagccgggcccacccactcccataatcggatggtcggctgtcgtgttcctgctgcgacttcacgcgcccaggtctcgtcaatggccatttgttcgtccggagtacgcggatggtcgtggatcacggtgagttgaggcttgagggcgttccaacgctcccggtattcagagcttttgtcggactgtttggtttgtgtattgatggatgctgggatgttcggcgcatcggggctgaccacccccacccgctgcgcgggagcccccgccagcgggggcaagttgctgcttacggctcggctgtatgcggttttgatggcaacttcatcggtgccgataattcggcaacttggatgagcgtccaatacggaccgcaatgaatcatcgctaattagcgcttgttccaggtcatgtaacaaagcatgagattcggcatccgaaactgattcaataaagaaatcaccactgatatggcatgactgtgcggtgccgtcatcatcgacggatacggtcacggcgactagtttgccgccaacggttttgcattccccatgtcgtatttgcatgcaactcagtatagagagttttctggctcccctctgaaggggagccaagtttgaggtcacatgcgggccagaatgtccttgccgacctggtcggtggagcgcacggtggagccgagctcctcgatgtccgcttcgacggcggtgtgaatcttcttggccgcatcatcaaagccgagatgctcgagcagcatggcggcggagaggatggcggcggtcgggttggccttgttctgaccggcgatgtccggagcggaaccgtgaatcggctcgaacatggacgggaactcgtcggaggcgttgatgcagccggaggcggagtagcccacgccgcccaccacggagccggcctcatcggtcagaatgtcgccgaagaggttgtcggtgagaatcacatcgaaacggctcgggtcggagaccaggaagatggtggccgcatcgatgtgctggtagtcgtgggtgacctcagggtattcctcgccgaccttgtcgacgatgcgctgccacatatcaccggcgttgacgagcacgttcttcttgtgcaccagggtgacgtgcttcttgcgcttcatagcaagcttgaaggcgtaacgcaccacacgctccacaccgtatgcggtgttgatggacacctcggtggccacctcctgcggggtgttgcggcgcaccgcgccgccggcaccgcagtacagaccttcggtgccttcacgcaccaccacgaagtcgatgtcgccggggttggcgagcggcgaggtgacgcccttgtacagcttggaggggcgcaggttcacgtactggtcgaggtcgaagcgcagcttcagcagcaggccgcgttccagaatgccggccttgatacgcggatcgcccacggcaccgagcagaatcgcgtcgttggccttgatgcgcccctcttcgtcctcgggcaggatcgcaccatcgcgcagatagcgctcggcacccaagtcgaagttctcatactcgaagtcagctacgccttcagcggccttttccaaagccttctgagcccacggagtgacttccttgccaataccgtcgccgggaataacggcgattttatatgtctttgccatagttcaaggagcctactcgcgcgaccccctgccggcccgaacccgctcagctagtggacacaaccaacatgcgtatcgtgtcgagacattcattaggtcattttagtgttcattaggtcggtgtgggttcatttcagggactgaaatggcggcatttcagtctcacatagaagaggacaccgacctaatgaacgacagaatgacctaatgagcgagccccatcacatccatgcaccaagcgttctcataggaaacctcttcccattgcttgtaacgcccggatagaccgccgtgaccggcctcgacctcaatcttggccaccgcgtccacgccggcggactgcagacgggccagccatttgagcggctcgacgtacagcacgcgggtgtcgttcatcgaggtggtaatgaagattctcgggaattgcgcggcggcgagcgcgccggtggcagccccatcagcactgccgccaccggcagcctcgtcgtcgccgccctcgagcacggtgaccggcacattctcgtatggcgtgtacgacttcatgtactgatacacctcagggtcatgcaacgggtctccccattcgtcccattcggtgacggtcaacggcaagtccgggtcaagaatggaggtcaacgcgtccacgaacggcacatccgcctcaataccggcgtagcattcgggcgccatattggcaatcgcgcccatcagcaggccgccagcggatccgccgttggccacggtgcgccaagcatcagccaaatgcgccttctgcagcgcgcgtgtggcgtccacgaagtcctcaaaggaatgcttcttgttcagtctgcgcccctgttcataccaggcacgtcccatttcgccgccgccacgaatatgcggcacggcgtacagcacaccgcgatccaacatgctcagacgagagaccgagaaccccggatcggaggaaatctcgtatgcaccatatccggtaatgaacatcggcgaatcctgcgccgggcaatcgcggtgccagacgagggaaacaggaatgcgttcgccgtcgcgcgcggtaatccacacacggcgttccatgtaatcgcgtggattgaagttgcccaacacggtggctcgcttcagcagcgtatcttcaccggtggcgggatcgatttcgtgcagctcgcccgggcgggtgtagctggcgaacgagtagcgcatgcgcggcgcctcatacgatgggttgccgccgacgccgatggtgtacaagcgccgggtctcaccgggcaggtggtcgtcgctggcaccatcggaagatgacgtgtgatccgtgggggcctcatcttcggtccacaagatttcgccatgatcgccggtgaagccttcgcgatcggcggcaaccatgtcccagtcgtcctccagggcaggcggcagcagttccgtaaaccgccacggccgtccggccaggaagtcggcggcagccgcgctcttggtcatgtatgccacgtgcggctggccgtcggcacggtagctcagggacacaaagttgcgatgcaacgcgatgccttcgatgcccagaccgtgggcaccctgcaatatcgccggattggcggcgttgaagtatgcctcggtaatcggcttatccggctcaccatgttcacagccgtacggcgacccggcggcaatgcacacgccttcgccgagccggtacggcggctcatggccacgcatgtcaatgacgtcgatttcgaaattcggattggcggcgttgtgatagaccacggcgagtggcacatccgcaccgttctcccccacgccttcaaaacaggcaaagctcacatcatattcaatatcgttctgacgtggaatgaaggcttggaattcgccttcaggcgtggccaccggcagcatcagcacttcggtggtggttttggaaccggtgccgatcacgatattgcgctcatcaaaactgatgccgacgcccacccagaaccgttcatcggtttctcggtacacgcacacatccgattcgaccgccgtgccaacacgatgccgccacacggcgagcggccgccaggaatcgtccaattccacccagaacacccattggccgtccggcgtgaagcatgcgctgccaatgccggtgaactgttcgggcagttcgctgaccggctccccggtctccagcccggcaaggtcgcgaatgcggaaatcatatcgttcgtctcccgcaacatccacgccgtacagcatccaacggccgtccttgctcagatccaagccgccgagccggaagaagtcatgcccctcggattccttgttcgcatcaaaaacgacctgttcaccgggcatggagccgggcgcgccttgcggatccacgaccggcgggtcccagtcatcggcatcgcacacggggatgcggcattgcacgccatactgtttgccctgctgcgtgcgggtgaagtaccagtaatcattgacgcgcgtgggaaccgacatatcggtctcttccacatgcgatttcagctcttcaaacaacgtatgccggaaatccgccagatgcgccatgcgacgctcgcagtactggttttcggcagctacgtagctgcgcacatcatcggagtctttgtctcgcatccactcgtaatcgtcttcgaaaacgtcaccgtggaattcgcggcgcttcggctcgcgtttggcataaggcggcatcgcggccgcggcgtttgtgctctcgtcagtcataccacgcgattataggcgaggcaccacaccgggacgcattcggcgttcatcacgccgcgcttatcgcaacaccgtcttcagatacggcagcatggtcttcagaatgttcgagccggtggtgccggtgaatactggtacatcggttaccggagtcggctgggtcgaggtgagccccgtcaccgacgccaatccggttgattcgcgcgggctcaactcacgaatgacgatagccagtacacgtccgggatatctgcgggcgatggtggcgtacgtggtcgggtccttctgcccgtcatcgcccaccagaatgaacttcatgtccgggaagtcggccataagttgttcagcaaactcaagtttgtgctgggggccggtgggcacgaaggtcttgggcctcgggtcgaggtcgcgcagcagcagcgggccttcgggaaaaccatggtcagtgatgaagttgcgaatcgaactctccacattccaaggcgatgtcgaaagatagaagaacggtgcgccggggaacaagtcggcgatgcgggtgaacagcacgctcatgcccggcacggaggctttcttcttggggtcgaggaacagcaggttgtacgcggccttccatggcaccggggcctgcgtgatcatgatggtgtcgtccacatcggagatgatgccgactttggcactggcggggatggtgtacaggttggcgctcacgggtttgcggttggccacgctgtaggagacgcgatggatgccgggcaccagacgatgctcggccacgaggtcgaggtatccggcggaatcggagatggcgtattcgctgccgagatcgcgcgtgcggtccaccttgtcatagacctcggagacaccgatctgcacggtgttcagcggcatgtcatcaatgctggcctgcacgtgggtgcgcggcgcgggcacggcaagcatgccgcggatgccgcggatcagttcgccggattgcgcatgcttgggggcgtataccgtgcggcagatcaggcgcgagtaatcgccggtgccataacccacatagggttccactcgcggataccagccccattggcgcaccacctgagtggagatgtgtgaccatacgccgaacacgcgggtgatggcacgacgtatgaatcgggtgatcggcggcttgacctcgatgcgctcatgcttggagggggtgtcgaacgtcgtggcagccttgcgtgcgggaatcggcacggtgggcatgtcatcggaatgttcagcattgctggcattgtcggcgccattggcggatgccttgacgtcagagactggcgcagtggcggacagcgctgcattgcgagcagcagcatcccaaggcagtcgcttgcctgccgcctcaaaatcctcgcgtgggcttctcatagacaccaatataggccatacacctcattttcttggctcccctctctgaggggagctgtcgccatgggcgactgaggggagtccccaacatatggaaactcccctcagtccgcttcatagccagctcccctcaggggggggagccatgggtagaactaccgcacgacattcgcgtattcgtcggcgctcagcagctccggctcatcgtcgtcaagctcgaccttcagcagccagccttcgccgtacggatcgccgttgaccacggacgggtcgtccgccacgtcacggttcacatacttgaccgtacccgccacggggctgatcaacggctggacggccttggaggattcaagctccacgatctcgtcgccggcctccacacgggcgccaggctcaggcagatccacgaacacaagttcgccaagctggtcggcggcgtattcggtgatgccgatgattgcggggtcgaccgaacggtccacccacgcatgctcctcggagtattcgagatggtcgggaatgtcgaggttcagcggctgttcgttttcgttgtcatcactcatagtcataagcctaacctatcttcgcggtccgtcacagctcgcgaccgagccattcctcaatcatgtagcgggcgatggtggcgcggcccggcgccgccatacggccggcgatgagctcggccgtgtattcgtcgcgtgtgacccatcgcgcggtcatggtctcctcgccgtccacatgcacgtcggtggtgattgcatgtgctttgaacgccatcatcagcgaagccgggaacggccacggctgcgagcccaggtaccgcacctcgccgagcttgatgccggtctcttccatggcctcgcggcggcaggcgtgttcaaggttctcccccgcctccacaaatccggcggacaccgaatacagcctcgaatcattccatgccgcgttgtgttgcagcagcagacggtcgtgcccgtccacgatggcggtgatgaccgccggctccacgcgcgggaacagcacacggttgccgtccgcctcgttggtgcatcgctgcgcccatccggcgagcgccggccggaccgccgcgccacaggtggggcagaaccgctggcggctgtgccagatgcttaaggtgatggcactggtggcttgcccagcctcgcgcgcgttggcgtgaggggcgaatccgcgcaggtccacccagtcgaaccgggtcacggcctgttgcaacagcgtgggcttcgggaccaagggttgtacgggcgcgccgaccgaatcatcgaaggcatcgtccgcaccttgcccggccgaatccggtacaccgagcggcccggcgattttggctgcggctacgccgccattgcccttggtatttcccggctgccgtattccggcggcagcacctccgctgatgccgttcttgcccagcgcgccgtccacggtgccggaatcctgggtgccgagcacgccgccggcagcaccggaaacatcagcaatcccgtcaacaccgggaacaccggcttccggcacgcgcgtgatatccacggcgaccacggattcgccgcgcgccccgacataggagccgaggaacatggcgaccgcttcggggtagcgtgccagttcggcggacacataggcgcccggcaacgtggcgagccgcattttcacgttctcatagtccacgagctcgccttggccgcgcggtacggcgacaagtccgccgcgcgtaagcacgactttggtggtcggctcggccaacagctcgtcgatcagaccgggttcaccgcgccggtccacctgatagtcgatgtcaccttgcgcgagcggcaggaacggcagcgcatgggtcagtgccagaggtgagaaatgaatgtcagcggtcatcgaggtctcctatgcgttcttctgcgcgctctgcacgcgcctgacaagcgagagcagcgcccgcgccacggtatccggatgttcgacggcgctgaaatggccgcagtccggaatgtcgatgaattcagcgccggtgattcgttcggcgagcggacgcatcacgctcgggttgctggaggggtccagttcaccggataccaccaggctcggcgcgctgatcgtttccggcaccgcctccaattcgggccggccataggtcatgcgctgacgccaagccagaccagccgggttctgttcgttgatccagtcggtcatggtcgcgatgaattcaggagtcttcttgacggtggaatcgccatcggccggttgcgcgaagtgcatgaccggttcgaccgagttcgtctgttcggcggcgtccgccatcttcagtcggttctctccgcccacaccgtcggacgcggccatcgtgtcgcacaaggccagtccggccaccgtttcggggtacaggcgctggatgtccatcgccacgtagccgcccatcgacagcccgacccagatcgcctgctcatagccggcggccttgatcaggtccacgtaggctccggccaggcgatccagcgcctcgctgtacgcgccgttggccatacgcgggccggaatcgacctcgctgggaaccggggatgcgccggagccggccatatccggcgcccaaatcgggaagtccggcacatcgttcaggtcggcgaagtcggcgagcgccttcgcgcacacgtcccacatgcggtggtccaccgggtaggcgttcatcagcaccaccggcacgccttcgccatcgcgatagatatgattggccaattcgattgccattgtcgttactccttcacattcacaccccactggcggagctgtcggctcagtcggctgggagcggtttcaacgcggaccgccctccgtcgccacgcgccatccccaccagcgggaagcagaacaactgtcagattccggcccaggccaacgcctgccgcacgatgcgaccatgaccgttgaccatctgcgccacgaacgtgttcattacgtcgctcttgggatccacccattccacatccagcgtctcgtcctgtggcttgcagtcgccagcgataggtaccacgtagcacagtgcgatggcgtgctggcgcggatcgtagtattcgcttagtcccggcgtcgggaagaattcggccacggtgaacggctggagcccgaccggcagcagcggcaaggcgatatcgcccaaatccttggccacattgcgggcgatggcctcgcgcaacgtttcgtgatacagcacacggccggtgatcagcgtacgctcgatcgacccgtcttcggcgacgcgcagcaacgagccgacctgggcaatgcggcccatctcatcggtgcgcacgggcacgatctccacgtacgcgatgggcatctggtggcgggcccggttgatgtcggccggtcccagccatcccggcgggttgccgtggcccgaaccgccgccgtgaatgaagtcctcgggcgtgatgttgtcgaattcgccgcggccacggccggcatcgtaatcgccctcgtcgggcacttcatcattcatgactggcatggtctcattatcgcgcgcattgatgaacatgggcacaattcaccgaaaaattgtctgtgaattctcagcaaagcgcctcatcgcctccatgcgcccgcaatccattcagcttggggcacaaacttttgccgaaatgttgggtggtgctgggaaactggtatacagcatcaagcactgtgtttgaggaaggaacttcaatggccaccaccgccatcacttcagctgagtttgagaagaccattaccgacaacgaaatcgtgttcgttgacttctgggccacttggtgcggtccgtgccgagcattcggcccgattttcgaggctgcgtccaacgagccggagaatgcgaacatcgctttcgtcaaggtggacatcgatgccaatcaggatctggctcaggctgccggcattcaggcggtgcctacgctgatgattgccaagcagggcgaggtcattttccagcaggccggcgcgctgcaggcctccgatctggacgacctcatcgcccaggccaaggcgctggatctggccgccgccaaagcgcagcaggcagcgcaggagcagcagtaagccttatcacgctgcggcagcggaagcacggaaaaagaccatatatagcgcttccttgcactgctagctactacatatgccatccgtggcgggtcgaacacccaccacggattttttattcatccactcaacgtcctatgatggagagcagtgtgtacccaaccaaggagcgcaatgtcgaagcacgctgagcgaacctcaatcgtcaagaccctatctcggggtcagtgggcgaagatcgcagcggccgtagccgcagtgggtctcattgccactgcaggcgttatatctcgcgacttctatcagtcgagcaccgctacgcatcccatcaccccaacctcattctccgccaccgacggcgcagcttcccgctcggcctcccgtggtgcgctcaagagcaccacctacgtgaccgtcaaggtcaacggcaagtcccgcgtggtcctcggcgaaaaagacaacatgaccaccgtcaaggatgtgctggaaaccggcgatatcgttctcgatccggaagatagcgtgagcccaagcctggattccaaggtcaccgagtccacggtcatttccatcgaccgcgccaacaccacggtggagaccactgacaccgatatcgctttcaatgaagtacgcaaggagacctcgagcctgcccaatggccaggagaaggtcgagaccgagggtgagaagggtgtgctggagaccacgtctctggtgacccgctccggcgataaggtcgtctcctccaacgtgttcacctcatgggtcaagaaggcaccggtcgacaaggtgattctggtgggtaccgccaccgtgtcttcgcccagcgccgccagcatcggcactaccacgccggccggcgagattcagtcctgggcgcatgactacctgatttccaacggctactccgaggccgacttcaccgccgccaacttcatcatcagccacgaatccggctggagccccaccgccacgaacccgtcttcaggtgcttatggcctgccgcaggcgctgccgggcagcaagatggcttccgcaggtgcagactggcagaccaactaccagacccagttcaagtggtttgtgaattattgcaaagaccgctatggttcgatttccggcgcgtacgcgtattggcaggcgcacaagagctactaagccagccaaatcaacacgcacacaacaggttccgcgccgcaaggaggctgagtgaaacccggcccaaacgccgagcgaactcatgcgcatgatgccggttcccaatcatcggggatcggcatcagcatttctgcgccttatcagccgaataataattgtgttgtctatctctaacattttataaaatgttagagatagacaacacaatattcatatgtaatgttagaatgatcgaacaatgacagtaatgttcggtattactaacatccaggtggatcaatgaaagcttctagtatcatacggtcgccccgtcagctcgctatcagcctacgtgacgcacgcatcgccaaaggactcacgcagacagcgctcgcccaacaaaccggtctcggccgtccttggatcaaccaattagaacaaggaaaaatcgaaaacgccagcctcagccgaatccttgcattatgcaacgccctagaggtcacttttaccgtgtcatacgaagtgccctccacacaggacatagccccgtacccatcagcgcatgcatctctcgcaagcaatcagaatacgttcgcagaaacatcagatgcattgagccaaaccaatacaccaagcatggcaaaactggccaagcagattgcggaacaagcgacctcgttaccatcattccaagagcagctcaaacaatatcagcttcaactgaaatccatatcttcgctgccagtgcgacaatatctcgacacattgcatgacctatcctcagcatccgacgcatatgaccttacaggggcagacgaaccgaacgacagcgaggaatacgatgacaaaaatcaagatgcttaacgtttttttggaaggcatccacttaggagtcctccaagaggatcttttcggcaatcatactttcacctatgacttatcaagccccagcaatgcgcagttatcattatcgatgccgcgccgcgcagcaccatggaagggcattgcagtcgaagcgtatattgatgggatccttcctgatgacccagcagtcaggcaacgcatagcacgtttacatggcgttaatgcgcgcaatcctttttcgctactcaccgccgttggccttgactgtggtggaggggtgcaattcattcccgaaaaatcagactctctaatcacagaaacgattacgccaatcagcaaagaacaaatcggacaacgactcgaaaaaataacaggggaacagccgccttcctggcaaagccccgatgaacattggtctttaaacggcgcacatgacaaactcgccgtcagattcaccaatggacaatggtatgaggccgaaggcaaagccgccactactcacatcatcaaacccggagtaagtagtctgcacgaacaggcattcaatgaatacatatgtcttaataccgcaaagaaactcggaattcccgttgcacaatccgactattgtcttttcggcggcattccggcaatagtcagcgaacgatgggatcgcattgtcgacaacagcgtcgcacccgcaatcgtgaagcgcattcatcaggaggatttatgccaagcgatgagtgttatgaccgaccaaaagtatgaatcagagggaggcccaggagccactgacatcgtgcatttcatgcgcgacaatggtttgccagaggacagcgtacatcttttcttcaaagcgttggttttcaactacatcattgccggcggagatgcacatgccaagaattatgctattttggaaccaatcggcgggacaccccatcttgcaccgctatacgatatcgcatcgtattttgcctacgatacacagcgcaaagaacgtaaacttgcgatgcgcattggaggagaatattcatgggaacgtatcgatttacgtcactggcatcgatttgccgaagcatgtacaggacaatccgattgggagacgctcggtaatatacttctcgaatatgcattgagcacattgccagcattcctacaagtttctgaggaagctcttgcactggcacaacagctggagcaatccgccaccggcgaacaaaccgcaaataaattcgaactgattatgcgaatccgtgacggcatagcggcacaaagcacgcgtatattgagctggttcgcaacagcaaatggtggaaatgcgcgctactgttattcgcggttcctttgacaattaggctagagcacaatcacttacggcttcggctcaacttccggttccttctcctgatcatctttcggtttcttctcctgatcaggcgccggggcgcctgtccccctcatcgtctggttgttctgctgctgcaacaactgctgctgccttaatcgtgcataataatcattcagagctttctgccgcgctgcttcttgctgagcctcaacagctgcgctgtagttggccatggacgtgttgactgcatccatggacgcagtcaacgtgttgacggcatcctgcatggcctttacgtcagtgccctgctgggacagcacggtattggcgttggcgatgtcgctttccagcgtcactcgcgttgaattatcgtcgacggcatacaggctgttgtccagcaaagtctgtgcctcggcgatcttgccttgcaacgcctgctgggcgttagcctgatccttagtgttcttgctgtccgtcacggcctttgccgcggcagtaatcacagtggcgttcttcttggcggtcttggtctggctagtggccgtcttggcatattccttgaggtccgacgtagaagctgaagtcttgcactccaccgcttccacgttctttaccgcagcaactgccttcttcaacgcatccacggtcgcgccgtcagccacttgatcagctgtaatgctttgagcactcttggcgtcggccaacgccttggccagcgccttctgagcggtggaattctggtccacggcctcagcacatgccgtcaacgcatcctgatgcagctgatggctttcctgacgctgctcgctggaacgccagtaccatacaccaccaatgatcgctgcaatcaccaccagcgcagcaatcaccgaaatgataatgcccttggtcttcttcttgccgcccttgccaccgcgaggagtccctgccacacggtcttcttccggctcctccaccggctcgggattctgttcgatggcactgaagtcgatgttcaaatcgtctatagcactatcacgttgcggcttggcttcaggaaccggcgcaaaaagcggcagcgtcgcattgtcatcccgccgaggcgactgagcgctctccgcagtatcaggcgccgcaaaagtcatcggggcagtagccacagcatcggaaggggaagaggcaccgccatcagtattcgccgcgcccgcagcgggccactccattacttcgtcaaagctggggaatgcaaattgagagccatccgcaacagcaccagtactgttgccgtcacccgacgcagcgctgcctgcgttctcgacaaacgagataggcggtatgtcccagcaggtatcgacgatatcaccacgagccggcgacgtagaggaaccagattccgcgttcggttcagggcgttcgtctgttcccatgctcttctcattcctttgcatcattgaagtcattccaaactgtcagtttatacagccccatgccaagtgtgccagctggtactcaagaacgtcacaattctttactattcgatatacagccagcatcatgcacccaaacaactcagtcctttaacagtaaaaccgtgcggcacagaagcaccgcacggttcatattgcaagacaataggcaaacgccgaaactactacttgcggccttccttcttgccctagcccttgctcttggcgcccttatgagatctgcgcttgttgccgtcctcgtaatagtagtaataatagttcttcgagtgcatcttcttcggatcagcgaagttgaagatgaagccgagaatcggcacttcggcggtctgcagagccgtagcggtgcttctcagctccttcttctccacaacgcccttaccggtcacgagcaccagaccaccggccatacgaccgaatacggtggcgtcgctggccacggacagcggagcagtatcaataatcacgtaatcgtactgggtgagggcctgctcgaccatttccttcatgagatcggagttcagcaagatgctggcgttagccgggcgcttgccggcaggcatgatgtgcaggttcggcttccagtacttctggatgacatcggctggggacgcctggcgagacagcacgtgagacaggcccacgtggccttcgatgccgagtttgtgggccacggacgggtggcgcagatcggcgtcgataagcagcacactcttgccttcctcggcgagagccacggcaacgttgcaggaaaccgtcgtcttaccttcggacggatcggtagaggtgatgaccagcagtcggccatgaccctgcgtggcggtggtggtaaggaacgaaaggttcgtgcgaatacgacggaattcctcggcctcgctaccggccggctgagcaaccacgaccgggcggctgtcgtcaagaatcgcagcctgcggcacggcacccagcgaagaggcgtgggtcagttcgcgcacgtcatcggtggagtccaccttggtgttgaggatgtccttcagcagggcaacgccaatgcctacgatgaggccgagaatcaggcccgcggccagatacagcggaatgttcggggagctctgcccggtaggagtctgagccttctgcactaccgtgagcttgatgggagagtcgctggaagaggagttgttgtacaggtcggaagaaacctgatcggccaggttcttcgccacgctgttggcgatgtcggccgcttgctgcggatcgccgacttccgccgagatatccaccatgaacgtgttcgtggggttcgtagcggtcaccacatcggcaagatcggtcgtggtcatatccagaccgaggtccttaatgacgggctggagcacggcttcggtcttcaccagttccggatacgtcgtgatctgggtattcaaataattggcaccagagctcatatcgttggtagtctgcgtctcaccggactgaccggcatacgtggcgaacacttcagccgtagccgtgtacttcggcggcatgatgaatgtgacagctgcgactgcagcaaacaccaccacgaacgagataatcgcagacgcgagatgcttgcgaacaatctgcagcaaatcagcgatggtcaatgttcttccttacctcttcgggaaattttcacagatggtctataatttagcacctaccggggaacttctcgagcttttgtatccttgtgaacaatgaccaaaacccttgatacgactgcagaataactgtacacaatcgcaatcacaatgtactctcactaaatattttgcgacagcactattccctattccatattatgaattgaaattgagaatgtgatatataaaattgtaattcaaattatcattcattacaatcaaaattgtcaataatatttatgcagtgtgaaggagtatattatggcatccttgcttcaaggattcgaattttgtaagcgactgccaattacttggtgggagtttaaaagtacttcatgaaagtgaacggttgaccgaacccccatcacctcacccacacatgcaactggtacagttctcacggaggatatgggagggaaccaagtatgtccacaccgaacaatacgcagctcagcaacaagtcagttcaagaaaaacgcagaaactccggtcattgccccgcgctacagcgtggggcaatgaccgagacgctgactcgtatcaccatcaccccatcagacatgttggtgtttgccgcagtggccatgctgccatttgatggcacaaaaattggcattccactcccctattggacgccaatctccccctggttgttcaccctgtacacaatcatcaactggcgatacttgcgcgataccgcacgccgcttcctgccgttcttcctctttcccctgctactagtgctcacatccgtatacggctggcagtcatatggaatacacgccagcgcaaccgcaaagtcattcatctccatattgttagggctggcgtgcttggcttcgctcgacatcgcgatccgcattaaacgtgtacctgtacgaacattgttaactacgctattcaccgcatatgtagtggcattcctcattgggatactgcaatatatcgctttggaacgacatctgaactggcagccagtacgagcatatttttggggtgctctgtatagaaactatgcgagcgttcgtcctcaattcatgttcgcagaacctagctatatcggcatgcatttgttcggcgtactcctgccagttttctggctgacccgcgaccgcaagattggcatattgataccgatatttgccgctggagcaattgcgatgggctccggcacccgaatcatactggatacagtggtagctacatttatctggctgatagcgacaatcaacttccactcacgtaaggcaacagctgggttcgtcggtgctttaggacttcttggagcaggtgggttgagcgcaattatcatcaatccgcgtctaaactctttagtcaccaatggattacttgctggtgacggatcgatgagtgcaagaatcttccatatgctcgctcccatgtggtcatggaaacatgatctacctcacttcatgtttggatggggcgcaggcaatatctctaatgcagtgcgtactggttacgccggtgcccgccaatggtatgacgcccatggcggtgcgcccaataccgaaatcgacggtttagcaaatcccccagcggatactttcacaatgagcatctatgccagcttcattaccgaatttggtctattttgctttttgaccttcttgctcttggtattagcacatgtagcggtccatcatggatggagccgacggaacatatgctggttcattcttctcgcatacctatatattcagtttgaatcatacgcattctatgcaattccactgttcatatgggctgtctgcacaataatgaatcgaggaaaaaacaacatcaattctctttagaatgcgagaatcgcaattcgctactctctatcatgccgataaagagtgcgcatacggaatgatcggtcaggcgttttaggatacagatgcggacggtatcctttttgatgaaaagtgcggtacactcacccatcttttcacgtaccaggtctaggaaaacacctgatatgagctaatttttgttccgcatttcccctaactcgatgggagatgatggaaccatgacaaaaggaacgagatacacgccagagttcaaggcgtcggcaccgaaccggctgcatgtcgccgacatcacctacgtgcgcacggcgggaccgacgggctcgtgcaccattccgaccatggcgtgcagtacaccggcaccgtctacaccagccgggtcaaggaatacggcatgctgccctcgaccggcacgcacagcgcctcgccgacctgctgttgggtgatgccgtgacttacgcgccgttcgcgcagtctggcgccgcgttcgaccaacgttgcacgtctagatagacaacgggaaagacaaagacctcgaaacatctgttatacttatggatacaagccccgtgctgaccgctggttcccatgtcaccggggcattgctttactcgttcgcctacgacgccaaggagtcccaagaatgattgacgtcctcgcgcacaaccacgctccagatgaaacatgggtcctcgaatggctctcatcaccacgtctccaaacgtatcttgacgcttcagggaacaatctgcagcgcgccctccggttgtacgaatggaatatcaatcttggccagaccctgatgaaggacatcgcgttcttcgaagtcgcactacgcaatgcctacaacagagaaatcgactcgcgttgggacggtaccaggcactggctgttcgatgacgattcacctgtcaacatccctataccacgacataacagagccggacagtcgttcgacgcgaacgcattgaaccggacgagcattcgcaacgccacaccctcccgtacggagaccatacaaccggacaagacgatcgcgaaccttccacttggattctgggcgcatctgacctacaaagcccacgaaagaattctgtggataccatacctccaccacgcgtggccctccgggacgaatcgtgcggacctgaacgctaaaatccgtctcatcaacgagtgcaggaaccgtattgcgcatcatgagccgttgtttcacaatgccgacgggacaaggaacccgaccgtggttgatggattggttgtggatttgttccatgaactcctgccacaagcagatgtcttcgaacccgatgcgccaacccccgtcgaactttttctgcattccagcccacgcccctgactcacttcggaacattcgtcccgcggccgtccgctgacgcgattctgtcttcccttacagcatggattgaccgatatcccgaatcagtcaattcaatcaaaccacagcagaaaggggctggtgacgttttcttggatgaggttggtcacggaagaaatgggatgaggcatacagtcggtctgggaacgtagaattcagagggaagagagaccacagactagaggagaattgtgagcgagaagaaccaggccacggagaacaacggcggtatgagcgccaaacacagcgcaccggcacatggcggattctagtggtggttgcaacacctgaggtttgagcggccttccatggtcacgttgtcggttgttgaggttatcacgcggcgtcgagcagttcgatgatcttctcgcttggtttcatgaacccgagggttttgcgtggccggtcgttgagttcctcggcgaccgcgtcgaggtggtcctccgggtagacggatgggtcggtgcctttggggaagtactggcgcaggagcccgttggtgttctcgttggtgccgcgctgccacggggagtgcgggtcgcagaagcagacggccatgtccagcgaggcgccgatccgtttgtgcagggcgagttccgctccctggtcccaggtcaggctgttgcgcaggagtttgggcaggtgctgcatcttgtcgatgatggcctgccgggcgtgttcggcgtcgtgcccgtcgggcaggtgcggcaggatcgtgaacctggtggtgcgctcgacgagcgtgccgatggcgcttttgttgcggctgccggtgatgagatcgccctcccagtggcccgggaccgcccggtcctcgatctccgggggccgctccgagatcatgaccatgggttcgcggaaacggggtttgcggccttggccgcctcggggtctgcgggcggttcgcccctgcctcatggcgcgtttcggctcctgcctgagttcgcccctggcctgcaggtagatggcctggcagatcgtctcgacgctcgcgtgcatatccccattatccgggaggtccggcctcggccggttggctatctgctccgggctccaatgcctgcgcaacccggcggcgatctcgtcccacagtcgcgtgccctcggacgccttgcgcggtttggggcgtttgagccggtccgcggccttctgccgggcgcggcagggctcgtaaccgccggactcgggattcccgtcgcgctcgacctcgcggccgaccgtgccggggtcgcggcccagcaggcgggcgatggcgcggaccgaatcgcccagacacagacggtccgcgatctggatgcgctcctcctggctcaggtagcgcggatggagggtcctgggtttgtccatggtggaacgataccggtccaccaggggtttctcattccttcccgtggcgcgcgtcctgccgttgcgccacgccttgccggtgcgtttcgagacgccgaccgcgtgcgcggcctgggtgaagttcatgccttcctcgtccagcaggcgcacgtactcggcgcgtctcgcctcgcacatcagcttcctcgtcggatattcgacgccgttgaacgcccaacggtgttccccgccacggtcttcgtctcggtggcttctggccacctgaccctccttgcggtaggtcaggtgttgcaacgatcactagaactcgcccatcacttcatcggccataacggctatgacgtgctgaaactccccttgggaccggaacggatcttcttccagctcgtcatggccggcggcggcaaggtcggcgcggtcatcttcttttccatctccgcatggttcttcctcgacagggagcagaccatcaaatccaacctgaaacgcgtgtggatcatggaacgcgagctcctgttctggagtctgtgccttgtagcgttctacctcgtgttcgaccgagccgatctcagtatgaaactcatggtgaaaagcgtcatgccgttgagcatgggcgtatggtggtacgccaccgcctacgccatattcctggcgctcctccccttcctggccaagggactgaaggcgctcggacgcgaataccacctcgcgctggccacgaccgtgctggtcatatggggattgaccagtttcatccccggaatgataaaaattaatgatggtttcttcggattcatctacctgttcattctgatttctgcttataagtggtatatggaaccgttcaccaccaagcaggtctggctgacgaccggcatcaggctcgattttttcctgttgtacacctgcgtctccataacattgtcgctgcttaggcacgacatgggaatatacatcaccggtgattggcggttacccgtcatcatggtcggcttcggcatgttcctgctgttcggccgcgtcaccttccacaatcgaaccatcaaccgaatcgcgcaatccgcgttcgccgtgtacctgatcaccgactacgctgcttcaatgaaactgctctgggcacggctgctcaatctgcagaacctgtaccagcagccattggcaatcctgcagatcctcggcatcctgccggcgatctacgccgtatgcactctgcttgacttcatccgccaagcattgttcgcagccactatcgaccggcgtcgcgggcactggttcgagctgctgtgggacaaagtctccatccgagtgcacaatcattcgcgcacgccgatgaccgattcatccgacactcaagcccgctgaaaaacgatgaaccatcattgattagctgataatccgcgcgaccgaacctagacggtcgcgcggattatcagcatgtaagccagtggaaacgtcaaaggacgaacgtgccagaacacccaatagaactaacgctcaagtcagttctattgggattgcgcaggcaacgcagcaatcgacaacggcactattgacatcgcaggtatatcatgcgactgcaattgttcaacgagcttttccctcatgtaaggccatgcaacggaaagagccgccggggtattttcatcatcaatgggcgaatcgaattgaatcgcatagcgcagatcggatacgaaaaggggagacacattcttttcggaatcgccttttttgagagtgatctccgaatgcaacgttaattcgtacggccaaggcttgtcatcgcttggattcaaaccaaaattaaaattgatgttgctttccgcgccttcctgcaagtcttgggcaagatcgcgctcgcttgactggccgagcagcataattctgttgacgttcatccaaccagctcctttttcgattccatgtcttcatttgcacgccaaggagtagccttgcccgaagcacccattacggtaaccttgtgcggaccatcatgatctggtttttgccgggatacttttatttctatgttgatggcgcccaccgttatatcgccattggaccattcacttgttacctgcatttgctgagcggccttccacgtatcgtatttccggccgccctccggctttagctccgcaggttcgacgctatatgtaatgcgcgctccgacttccagcgcatagtcggtgagcaatgtcacaagcttttttcttccgttctcaatctgagatacgtaagactgggacacgcccagctcatcagccaattgcttctgagtcatgccccgttgcgcacgcagggaaacaagctcctcaagaagctggtcctcggcgtgatacaaatcgtaggcaagttcccgataatcgtaaggaagccgaccatccatggttccctcctgtggtggatattacttatagtaatatccaccacaggctcgacattattaccatcagcttagcctccagtcattttttgaacactcgtcgtatagaatttcagctatctcaatctgacgattttgcttttccgtaatttcagtatcggttcctgttatgtccttcacatgcatgacaagaccaaaaacggagttcctcacttcaacaggctccgcctcgtaatggcgtatctgcgtcttgcctttatgctgagccgcggcttcaaaatgccaacgcaattcaaagatgactcgcgagcttgcatgtttgacctctataacctcgctgccaggcgttagcttcccctcctgcaatcgattaagcttttcctcaagaaaggcttcgagcttaatcctgtatttgtcgaaacgacggaaatcgatattcccattcgcaagttcttgattcgccgctttgtctgcaaaccaagacgccaccgttttggacatggtttcgccttgttccgaagtttggcccaaagactcgccggcccataggtataccactgatttgccgcttacgcaacgacttcttgcagaacgagaagccatatgatatccaccctttccgaggaatacgctatggcaaagctagcacactcctcaaacgtttgttcgattctgagaaggcaaatcctatatttcccacgacagataacactgacatcgacttcccccaagaccattacccagtccccgaaggatatgacgaaaaggaacaacagcaacttgtttcatcaatggaaggttgagcaccaaaccagcgaatgcgattcaatgttgcttaggtggtggttgcatcggattctcagaaacctgacagatgaatgccctaatttgtgatatgactgcgcttcgtgaaacaacgcaagaccacttcggattcacaggaatagtcgaaagcacgctaggctcatcgatgaagatgatgagcccacggtttttagtcgtgaataaaagtatataaggcgggaatataccccgccctgggagagaccgaaaatcagccccagactcacccctatatacgacagaaatgtctcactataaagtgcatatgaacagccattgattattccatagtttcaacatacgagcaaggcacatcggcgattccctactgccggaaattcctttctcccagctcgacttcgtccgccagacactgctcgccatcaccatcaaccaacgacgcggatagccgcgcatggcgtaggcaagaatacgcgagtgctctatcccgagctttttcaccactgacaagacctgttatggaatgcgcttccttggtacgaataatttcaattagagtacagtttccacactctttcacaagagaaaaacgcacaacaagagattgatcgggcatgttttcatgccacctttgaattaaggttcaataagcatatatgcattccggagaaggagatatgcgttgggagaggtattccaggagatcgtcagcggcatcggctggctatgggcccacagaacagtcattcccgatgatttatacatctggacactgctgatcctggcgacaggaggatcccgcctcccatcattgcatgcagataaccaatcacgaccgaaaagacaaaagtatatgctttatcataaaattatactaagcaataaatggtattagtcaacttcatagaatatcgaaaagtgtaagtttagctttatggaatacaatcgaaaggatttacatgagaacgctgtaccttcttggtaatggcttcgacttagcatgcgggttgaaatctcgctatgcagattattttgagtcacgtttcaaatggtacaaaggatataactcctctgattcaaaagcgattacagcactttatgaagaaattcaagatggaggcatcaagaatattccctctgcttggttcattgtctttgcctatgaacatgaccaacctggttataggaatgattatgttctttggcaagatatagaaaaaaaatatcgatacgtttttacaggattatccacaagaaaacgagatatctatcagcgaatattttaaatatttttccaatagaccagaaaatacatctcctcaaaagaagagcatgtatgagcttttaacactttacttccaaaagaaggatatcgctttccgtacagaagaaaatttatttgacatatttgatcaagagctaagcaatcttgaaaacgattttgcaaaatatttaagtacaatagaccaaaatcccaactatcaaaccaacgcaaagctactattcgaaaaaattcagaaagccgagacctcaaaacggattgaatatgttacctttggaaccatcggaggacatatgtccagtatgcccaaagagccccacgaagaatttgtaatgtcttttaactacactcggccattggaaggcatacctaactacgttaatcttcatggtgaagagaatcaaggcactgccatgtttggcatcgcagacgacaacggttaccctactaaaactaagatgaagattacatcaggttaccgctcttctttcttcaaagacacaagacgacaacaaaaagaatgcttagataagcaatctgcaagaaccattaatgaattaagtaaaaaacaaattgacgaaatcagatgtttcggatgttcattcagcgatgctgattttgattatttcagaagatattttgatcttgcaaaatttgacaaatccgattctacgttgggtatatattacacgaacggcatatccagaaaatctgcaataaaaacttacgcaaactgcttaataaatacgattcagctcacgaatctgataataataatacgtatcaaaccttggaaaatagtggcagaatttcttttgaagaaatccaacttccataaagataaacaatacaaaataacaagtatttcgcgaatcttattacgcttggggattcttcagccactagatatataaggttgcgcatttgggaatcatgcatgtgacgtaaaaatcctaggtgcgcaacctctcagtcactactccactgattccagatcaccttttaaaatatctgtgggctaaacgtccagcttttctttcaatgctttcctcatagaagaacctattgaatcttccagggcaatcagtcgttctctcattctggcaggaatttcctcagtaaattcgatcaccgcttcagctatccattctttttgagcaagcgtaccgttcgccattatgtcctcaacagtttcggttacgatcacgccaccgaaattgcatagctcgagtttggtcaacgcgccggccgcagtatcgcacatgccagcaggtcccattttcagcatggtgaccatcaactgtacgtacctctcagcggggaaccgttgcactatgcgagcgaccgcattgtatcgcttattcgatatcagataatcaataatattttgacgttcatcctcacacagtaatgccattgcctcatacgctagccaatagacaatattggccttatcctcacagcttttgacaaaacacgacaacatgctgaaaagttcctctcgaattccatcaggcaattcattactgaaatgtataaggaatttcaaaggccatcttttgtcttgaagcgcctcagcgttggacagcataagcttcacgaatgaatcccaatcaactaattccggatgagcatatccgcagaagaggaatgcgctcagcatgtgatccacaccatgaacagcaataactccagactgttcgtagcttgctattgcctcagcacaatatgcagaaaaacaatcagaaacccttcgaatctcgtcctcggaaagtttttgcgcatcatcgacgctcttgattacatcaacttgaccgctcttcacctttacgcgccattgcgcttccgattcctcatcatgagagctttgcttatattcgtaccattgctgcagagagcctgcatcgcatcgttgcagcaagattgccagattgtcatcaccccaaaaggactccggaaacagaatcgtcaggttctgcgctctcgaagcgtagctttcttctacgcaaggcaactccaagaaccattgctcaatcttttcctgtacatctcgatttgccgccctataacaagctttaagcgtctcgagcagttcaatagggatattgaacgtcgcagaaaccttccgagcgtactcccgcacagacgccatcgtcgtcaagcaccaaaggcaaacttcatcagccttatctgcagaaagataatcacctatgcactggaacaacgtcagatcattcagtgccgttgaatgcgtggactcattcaacgatacagtttcggcatattcaacaatcctggaatctgaagctctctggatggcggaccaaagtactttccgataatcgtctttggaagaacaccgccgaaacatttcaagcacattgacgatgtccgttctcccctcattatcatcctcaatctgagcatacgcattttctgcctgcaaacagcaatatcttttccacgcatctctgtcaccgagaaatgccgtctgaagaataagggagataaaacgtcgtcttagcgaatgggttttctctgcttctccaatgctatgaagccaccgattcgacactgcgttacccgcaatgctacgctctcccaattcgagccaccagaaaattggattgtcggatgactgaatcacctcagctacatcaacctgctttccagatgacttaacgtttccccaaatccaatcgtattgccacagcaatctcattgccgcgccacagattccattagcggtaatatcatctggattctgcaagcaaagactcactgcattcgaaccggcagaaatagcttcatccttacgaccgagttcaaacatcgcccatgattcgtgaaccagcagccacgctttatctacaggataaagatcataagtcataacagcttcaatatgttgaagagcggcactccaatcattatcatctatatcaaaggcaaattgcattaccgccgatgcggcttgctcttcaggagatttcgcaaccgaaaaaagctcatccaagcgtccaccctgtccatcaaagtaatcataaaaagccgcggccgccttccagcaccagtcagatgaagcccatgcctcatcctttcttttccctttctgcatggccacgtcagccatggaaccacttcccgctctccagtaccactccaatccatactcattcccatatagcaaggaagccaaggcctcatgacctttcaagttatctatatgtttattcacatgcggggctatcacacgaggagcgagcattgcgagtcgaatgcgatcctggtttttaatgtttttcagaccattccacacaactccgttgaatgcagacttctcatacgtgctgcatgcgaactcataaatctcttcttcatctgtcttttccagcacatgatccttgtatacaagaatcttgggttttcgggaagaacggtcaatctgtgaagactcgatcttggaccaatacattgttccttcattagaaatcagaacaacaacatgagcaattctcccattagtccacgaagcttcatgattggcatcaaatccgaaccaccagccaatcacattaccttgctcatcctttttaggatgcctgaagtagcttgctcctttctttacttgcacaccgagaaccacaaatgaaggaattccctcatcgcccaccggcatcacccataaatcagtgccaaaatcaatgtccttggacattatgcaccattggaaagtgtcagagaaaaaagcctttacctgattttcgccgccctctccccttcgagcttccggtgagattctgaccccaaatgttccaggcataaccactacctttcacaagtaacttcgtcgtgtatttttcactcgttttgctctgaatcttacagtacaaaggacaaatgttcgagtcggtttagataaccccgagattctatgtgctcttaagtttcacccttgagataaaaataacgcaatttacatcttatgcgcgacctcgctaaccgataggggggctgcggacgttttcttggagactgaacgaaaggattatcatatgtccggtcccgaggaacggcgacgtacggtggagctgtatttcaccacgccgatgaccacggcccaggtggtgaggcatctgggcgatccgaccaggcagtgcctggaacgctggctggcggcggatcccgggtatgctggccatatggcggaaccaatcatcccgccggagatgaggaccaaggcgatcgaaccggtgccggacggcatgcggcagaagcaggccgccgaactgctcggcgtaagcgtcggagctgtccacaactgggtcaaggcgtatcgcgagggcggcatggccgcgatgcagcccaggaacaggaacgccagccagaccaacaagcctgctccgcgacccactgtgtgtgatcgaataaaggtgttcactgtcggcacttgtttctgtacaccttgagcgttcaatttggacatcgccggcggtgacggtgccggtgaaataagaacaccggcatcgtcttgttccttgatggattcccgagtgcctgtcaaccaaactgatggttctcgggaggaaaggaaatgacgacaccggtgcgtgtccgacggcgtatcaggcagctcgaccgccaaggcctgagccacaaggagatatcacgaaggctcggcgtatcgcgtacgaccgtggtcaagtacgccaaccatggggattattcacccaggccatcgaatgccgtccgaccgggcaggtcgctggtcgacgacgggtacgcggccatcgtggacggatggccggccgccgacctgcgcatgccggtcaagcaacgccataccgcgacccgcgtgtacgagcggctcgtggcggaatgcgggttcacgggcccgtactcgtcggtgcagcgccgggtcaagcgttggaggcaagagcatcgagcgcggtcggacggcttcgccgaatcgaagtgggcgccgggaagcgcgcaggtcgatttcggccaggcccgggccgtggtcgcgggcgtggaacgggtcgtgcatttcctggcggtgtcgttcccgtgttcgaacatgcgccgggtggcggcattgccgggcgagaccgcggaatgcgtgtgccagggactgccggaggtgttcgagaggacgggcatgacgcccggggtcgtggtgttcgacaacgccaccggcgtgggccaccgcaactccgacggcacggccgcccggacccgtctgttctccctgttctgcgcgcattacgggttcgaaccccggttctgcaacccgtattccggccacgggaagggcggcgtggagaacgcggtcggctttcgcggggcgcgacctgatggtgccgatgccgtcggccgagagcttccgggcgccggcccgcgtgtggctggacgcgtgcgaacgcatcgccggatcggaccattaccggcatggcgttccggttcgggaactgttcgaggcggagaaggaccacatgctgcccttgcctggcgtgcggttcgacccgtgtgactggaggagcgtgaaggccgacaagaccggctccgtcgtcatcgacgcgaaccggtatctggccggcccgagatggcgttcgatgcgtttgcaggccggggtgcgcgtcttcgagatcgagcttcgcgatcccgatggcgggcacatcgtcacattggaacgcgtgtgggggaaatcggcggaaacccaggcggatccgacgagcctgctcgcgatcatcgcgcgcaagccgcgcatatggggcgaaagcccaatcaggaacgattgccccgataccgtgcggtccctgctcgaccgcatggacggacgcgtgcgggccaacctgctcgacgacatccgcgccgtggccgccgaatgcgggttcgccgccaccgtcaaagcggtggagaccgtcatcgacgccggacggaccatcgaccgggccgcaatcgccacatgcgcccgacgcgtcctcgagggcaagggctcctcgggcggccaggatccgaaacaccatgacgaatacatggagggacgggcatgagcgcacacgacggccagccgcgcaagcgcggcggcggagtggtcgacaaggccacacccggacaggtcatgaccttggcgcgcaacccgccattgacccacagcgtgccgcgcgacgccatcgagaacgcgaccccgggccggcccggcttcctggccaacctgttcgagaaggagaacgcgagccgggccgaatccaaacggcggcggctgcccggacaggccggcttcccccggaacaagaccctggacggctacgaccgggggcatggcctcgttccccgccgaccggggccgcgagcagctggaaagcctggagtccgtcgaacgggccgaggacctcgtgctccacggcgacgtcggctgcggcaagacccacctggccatcgcgatcggcatgctcgcatgccaacgcatgatacccgtgaggttcctcgccgcctcgagcctggtcatgcgcttgaggaaggccaaggacgacaacagattggacgccgagctcaagtcgataggcagggccgggctggtcatcatcgacgagcccggccatctgcccatcgacatcaacggggcccgcctcctgttccaggccggcgcggacggctacgagacccgcagcgtcatctccgactcgaacctcgggtccggcggatggggcgacgtgttcggcgacggggacatggccgccgcggtcatggaccgcatcgtccaccacggcgggatcctccgcttccacggcgaatcctaacggaacaggcactccctcatgaaataaaccagacaaacaacaaaaaaaacaagggaacagccgacgatggtgttcaagttgaacgccgaccgtgtccagattaagtgctgaaagcgtccacctcgatttgacgttgataatggttatgccggtttctgatcggtgataatggtggatgacggcttgggcggtgaccccacatttgactgacgccatcggttccggtggctgtccttattttgatttgtcccgcccatggccgccgacccgtgggccatggatgcatgaccccatgggagcgtggccgctcccgtcggatcccgcaagaaccatggtagcgtgccccgtcaacgtcctgtctgcgccgcaagcccccgggaggcatccgaacacatggaaaggaacgacaacgatgacgccgccgaacgaagtggtgcgggccgggatcgacacccacacggacacgcacaccatcgcattgctcgacgagcggggcaggccgctgggcgccgagacgttcacggcggacccggacggatacgacaggctgatcggcatgccgcccgggccgggcagggtcgcggccgtgggcgtggagggcacgaactcgttcggagcggccctggcccgtcgtctcactgccgccggatacgaggtgcgcgaggtgccgcgccccaggcgaagcgtgcgccgcagggacggcaagtccgatcccctcgacgcggtcgccgctgcccgtagcgtcatggccggcgacggcacgagcctgccgaaaagctcggacggctgggtcgaggcactgcgccacctcaacgcgcagcgatcccaactggtgtcggcgatgaccgcgatccccgattcgacgaacgggctgctcgccgccgccccggaacccatcagggaacgttaccgggggttgaggagcaagacccgcatgaacaggctcgccgaatgcagaccggccggcggcctggtcgagcggagcgtgctggccgcgctgaaatccgccgccaaggcatggaaggcgctcaaacggcaggccggtctcctggaggaacgcatgcgcctgatcctcgaggaacacgccaggccgctgctcgacatgtactgcgcgggcgccgtcatcgccgcgaccctggccatcgtcgccggggacaaccccgaacgcatccgaagcgaggccgcgttcgccaaactctgcggcgtctgccccatccccgcgtccagcggcaggaccaaccgacacaggctcaacaaaggcggcaaccggcagggcaatatggcattgcaccgcatcgccatcgtccgcctgcgataccacaagccgacccgcgactacatggccaaaaagacccgcgagggcaaaggcaagctcgagatcatccgctgcgtcaaacggttcatcgcccgcgaggcataccgggcgctcatcagcatacgcaacggcgaggtcggacgcgggaccccggccgaacgcggcgccaagctgcgcgaactacgcgtcagccggaacatcacccagcaacagatcggcgaggcgctctgcgtgccctcgagccgcatcagcgagatcgaacgcggcgcacgcgaccttcccgaactcgagcaacgggccatccagtggatacactcgacaaccaacccaaaacaacacacccaaacgcttgacaatgtataggagcatcagaatacacacgtctccgtcatcgccggaggagtcgtcgcgccgcggcctcgacggtgtcccgccgtcctgcgcggcgttcccgttcctgggcggcaacgcggccatgccgccctcgcgatgcgccttggcccaatgggccacggcgctcacgcccgcgccgagccgccggtcggcttgcttccgcgcatgccgcccgataccggttcgatcgtcttccgcccggtttccaggggatgatgggtttcgccatatggccgacgtaacggggatccttcgccggccggcgttccaggcgccgtctggtcggatgaccgagatgttcgaccgcttcggcggtcgtcgttgatgtcgtgagatagagttccaccgcccgcttgcgttcctcgggagtgaacacaaccaaatccttgcgttcggtctccaagaaaatgtccgcagccccttttcttggactccccgaccgggaggagaccccccctagggtggtatacagcctagcgcgcacgatgcggcgcgggccattcgaaaagcaggacacgctgctcacggcgtggattgatgggcccatgccccggccaacgcaaactgaggcatgtcccggttcccgaggaatcgaaacgcagagctgtggacgcggtcgcgttgttccttgctgtataccaccctaggggtctcctcccggtcggagagtccaagaaaacgccaccacctcgctagttgatatgtagcttcttcttcagcatacctaccaacatggaacgttctttctttccgagcaacaacactacatccaaaagcattgtgaccaatgcatacaggcaacacgtcagaatcaacgagacccagccattggcgaccagcgcgaacacatgcctgattccccagcagacggcggcagccaccgctgtggaggcgaagtaccgaatatagatgggatagaactcgaatttcccgatgcccaagcatctggaggcataaacgggcacgaatgtcacatttgccaaaatctcaaacagaggcggaatcgccgccacgaggaaaacgccccacttcggaagaacctcgataaaggcaatcagcacgaccatggatatcgcactgtagacgagccatccgatagaatacttcttcaaacggttgacgatcagcggcagattctgcaacgtcgtagcgacaccggaaatcagcaagcccagcatggtaagggtaagcaactgatacaacagctccgtatcctgaccatgctgccacaaactcatgaaatcatatcctgcaacaagcatcgccacaaaaataatattcgtgaagaaaccggtcaccttcatgcccgatttgaggtcttcgatgagttccttatgcttgccctgcgcatagtatttcgtctgttcaggataaaacaggctcgacacagtccacattagtccgctgatctggttcggaacggtctgggcgatggagagcatacccataagatacgggctgatcatcaggttcgccaccagcaactgcaatccgaacatcataatctgctggagtttcgtgaccacgttccacacgccggcggaaagcatctcacgaatgctcgtccacgataccgatttcctgtcgaaggaaatgtcgggaagtaatctgcgcgtatacgagcgattcatcagcgtcatcaccgccgtcgccaagcatacggccaagcccacgtagtagacctttggcggcagaatcccgaaaagcgcgaccatggccaccacacgtaccaaggaaaacgcgagattcgcgatactgctcagatacagcttgttcttcacgaatgtggcgacggaatacaccgtggcgatggtcgaaagcatgaaattcaggaatatgaagacgaacagagccttcacgtctcccacaagatgtggagagatgttcaccagcttgtcaaggaacgtcaccaccggaaccgcgacgaccaccagtatggcgaccatgacgccgtttgccgcaagcgtagacgaataatacccgttcgccttggaatcatcgccttcatggtatgcgaccgtgatgaagcgcccggccaccgaattcaatgcgatggtaagcagctgcgcatagctcacgaacgtgttcgccaatccgacgaacccataggcttcagcgccgatgctacgcacgatatatggcgtaagcaccagaccgattccaacggaaaccgtgaaattcaccaaacttgcgaccatgttcacaagcagttgtttcttatctcccataattcagcctattactcgcctatcttctccacgaattcccgataaaaggattcttccgtaaatttccgcgaatgcagcaacgccgcctgcgacatcgattccagtctcctggagtcgccgttcaattccctaagcgcatccaccaacgaatcgatgatcctgccgcaatacaatgccacgaaatcatcgggagcaaaaccaaaccgcgcacgaatcgcctttcggtcatcctcagtgaacccgcgttggaatttggagatatcgatgccgttatgagccacacgcacatccgtcaccggatcaaggcaattgcgcctccacgagttcgccatatagtcgctcaccgcgatcacgcgcgaataccccgtgctatggaacggcatcgtcggatcataatgcaggtggtacatcaaagcgtcgccgcgataatcctcatacggagccatggcatcacaaggaccgccttcaatgaccaccacatcgaacggaccggctttcttgatctccaccagcgccttcgcataatacgtggaaacgcgggaacgcttcttccggttccataggttccgaacccggttggccaccttgtacggcagaccggggctctgcaggaacacgacatgggtcgaacggtatttctcggccaatgcgcgagccttcggctcatcaggcgaaaccaagcacacccgaatcggcgtatcaaccatatcagagcattccaatcaatcacacaataaaaacttcatggctcgaaccatcattccgccactctccacatattattgggctccccaatgacaacccacataccccagctcgaagccagacagcaccttctccggctccccttcacccccatatacggtaagtcattatatactgactgtacagaagcacatacggcatatgggaactatcccggcgagccccgtatatgccttcctttcccgcatatgaagatataaaagaaggtaaatatggccgatagtcgattccaagagccaatgcaaaatcacgaaggacgccaatcatccaatgggtcggatccactgattactgtcgttctgcctatttacaatgttgcaaagtggcttgatacctgtatacagagcatcgttaaacagacctatcggaatctgcaaatcattctcgtcgacgatgggtcgaccgacgaatcgccaaccatctgcgagcattgggcagccaaagacagccgcatcaatgtcgtgcaccagcggaatgcaggactatccgcggcaaggaacacgggattgcgactgcgcaagggcgaatacatctgctttgtggacagcgacgattatgtcgaacatgattacgtcaaacgcatgctcgatacggcacatgccgaacaggcggatatggtgatttgcaatgtccggaaagaggatgagaacggcgctgcgctcgccgaagaagctgatcctagctttgagactaaaacactcaccagccgccagtacatgatctatgcgatgcaatccagctggaagcatatcgtggcgtggaataaactgtaccgaagtgaaatttgggataatctcacataccctgtcggtaaaattcatgaggacgaatttgtattcgcgcaactggtcgtccgctgtcatcgtgttgcatgcatcgatgatgttctttaccattatgtgcagcatgatggcagcattatgaacgaaaattattccattaggaatcttgataaaatcgaggcattgtgtcagcgcctcctcttccttgatgaaaacggctttaatgaatgccttttaaatacttttaatggtattattgcagatttcatgcgggcggaaaacaatttacgcagcgatatgcaagcacagcaacgcttacattccttgtcatctcaagcacaagcattatctcctatatgctttaaatcaccaatgtcttggtttgaaaagacaaaagtactattttgcttaatattttcaccattgtcatatgctatattcagcaatcgattacatcatttgataaaaaaaattaagagtcaattgcagttttcgtggatcaggtgacgggcgccggtaggcgaatcggcagcccgctgtatctgagtttgaccatggcgatgaggctgtcgaccttgccgaaacggtagtgcccgaaaggttgcgcactttggatcgtggccgtccatggcgcgatgaccggttcgcttccatgagactgtcatcgagccgggacatgtcaaggtaacgccggttggaccattcgttcgcggtgacgtacctgatgcgggcgcatatgagcatgagggcgctgttcccgtccgggaagcttcccacgacgcgcgtgcgccgcctgatctcccggttgagccgttcgatcatgtcgttcgtgcggatgcgcctgcggtgccagtccgggaacccgggcagcaggtaggtcacggtctcgccgataccctcccgcaggcagttggcggcggccttcagcctcctggcctccatctccgcggcgacggtctcggccttgtccagcgcggattcccaggactccatggcgaacacggccttcagggccgccgacgtccattccctgtgtccgggcggcaccttggagagcacgtcgcgcatgaaacgcaccatacaccgctggtacctcgcctcgggcagcatcgagccgaccgtggcgacgagtccggcgtaccggtcgccgaccaccaggcgcacgcccttgaggccgcgttcaatcatggagcggacgaactgctcccagctggcggaatcctccttcatgccctcggcgacgccgagcacctcacggtgaccatccatgccgatgccgatggcgacgagcacgctcacgttctccactcgcccgccccatgatcgcttgtgccacacgccgtccacgaacacgtacggccattcgccctccaacggcctgttgcgccactggtccatctccccatagaagcgcttgaacttgtcggagagcgtccgcgagggcatgcgatcgccccacaacagccggccggtgtcgtccacctgccgggtgctcgcgcccgccaggtacatgtcgatcaatggttcctcgatgcccctgctcgcaccgccggtatcgttcgatcaccgccgacccgaagaccgcgccctccggtttcggcaccttcggctccagcctgccggccttggcggtcaggccgcgttcgtaatggccggcacggtacgccttgcgtccgccggttcgttcgtatcctgcggcgctggcgatctcgtcgacctgaagcgtcgggcatcgcgttgacgatccgctcaaccttgtcacgcaccatggcgtcgagcttcgtctcgaacatggcgtcgtcgaactgtatgatttccctggacatggcctccgcctctttccaatcgcggttttccagtgtcagcgactgaaaatcgcacccggaacgggccatgtcctcttccaagaaacccgaatcacaaagtgcgcaggatttcgggccttatcccagcaatactttggaagcagtgctccaagtattgttccatattataagccggcacgataatgctgactaattcgttctgcttgacaagaatttcctgcttcccaccgccatacaatacataaatcttatacttctactaaactaatccggaaaaattttttacagatcatatcctctaatatttctcgcaagatcttcaattattccttcatcaactcgttcgtcaaattttcgcgcgaacagcataggcgaggtaatcaattcgttgtaatctgatgaatggaaaacatacggattaccccgtttccagtcaatgagtctcataatagatcggtaatcatcatcagcctgtggatgccagatattttcccggaaaggtgagttcatcagcattgtctgcataaataattcatcagcacaccaagaatactgaaaaattcttctatatgccgcccattgatcgacgacccataaagcaaacccatgggtaatactgtaccagttcgctcccttagcaagaacttctgcatgttctttcaaacggttgacccccattaaacgttgaaagcgctttgagagccactcaacatatcgacaatctcgacccaacatattttgaaaaggatggaaaagcgagaccctttctcgtgtagactgcaatatgtctgatccaatctcacagaaatcaacgaattcttgaccacgatgggatttgaagaagtcatcgatataatccatgtcatgtaatggcaagtcagcccccgacaacagatggtagtaatcacattcacaggcaacagctcggcgaagaagcgccaactcacattgaatctgggagctcccaccccatgtcactttgacgcgggggcaaaagtcaacgaagcatgcttcaataccccattgaacatgcttgcgtcaaaatctttcgatcgggcgtcaatatggacatctatcgaattccgttcgtcatcaagcaaagagagcaacgtacgcaactgattccagttgttgtgcgccataatcataaatgcatgtctcatatacggaaatctcctgaacctgcgttacctgataccatactgatccaacaactgaccaaaccatgaacgctggccattcccacaatctggttgaggtggttctttccaagaaagcttatgcaagaaagtaccattgtcatctgaacgatggtttatcgaagctgtatttacaattggtgatgtcagcacatcgacattgttaacaggaatagcatctatggtattccgcacatccacaaattcttgatatgccacagaaataatgcgatctatcaggaaatagtcaatcattacactgccttctcgctcatgatatcgctcaaagaaacgcaacatgaaatcaaagaaaggatcgcctgcgcatccaccccaacagtatgcagtccaattgcgagaccacatcggactccattgctctcctggccgtatagtgccatgcttgatgctgaacagtctgagatcattcacgaaatccggtatgggagcggtcatcagcaatgtggcatctagccagaatccaccatatttgtgaagcaaatcaaatcgaacataatcagaaaaatgagtcagagaaatggctccatgctctacatatcgatagaaatcgacggaccgtttggcataatcatgatagttgtccttcgtaatcagcatgacaggtctccggcctgcaaacctacgcatggaagcgaccgccaaacgcacaacatcaggcatccgttcctcaccttgccaccacatcacccagattggtgcatcagcttgaatttttccacaaaactcagttttatggtaggcaacatccggaagataataatgtttcagatactcttctatctgtctacatacagaaaagccagcctgcggtaacagcttatacagcattttcgtagcaacaagtcttggaccaaaacgcttacaataattaactgcctgacccaatgattgaactgccatgctcagtgtcccctcatacatttagcagcaagaaccgcacatatacgaatatgcaacaacttgaattgtactaaaataattcgaatcctattctttagatcacgataattaagcgaatccttatattgaacaaatttttcttccagaaaaacttgccatttgttgttgattaatttattattcaataatcctattgaaattaaatcaataaaagccaatcgagccgagaaagcagcatatgcattaagctgcatggggaatcgctcaactgtatagttccacagcttctgctgcatgtcccaagtatcacagagccttttatccatcgcctctactgttcttgccttccccatcatggaatctggacgctggaaatacccataatacgctttatcaagaaaagcgacctgttttgcagcaccaataagatgatatgtgaaatacaaatcttctcccacataaattcccttagggaaacgaacactactgtcagtaaataattcacgcttggaaatggtctgccatacattccaataaaagcgtccttccaacatccatgttagcgcagtcgcggaatcaagcaattgattggatgggaacgtaagatgcacaggtctaggagaagaatcagttttctctgacgaattgaagtaatcataaaaagcgacatcagcggcacttttctccaatcttgatacggcgtcagtaaccgcaccttgcgcaagccagtcatcggcatcagcaaacattaaataatctcccgatgctctttcaataccaagattcctcgcaatagaaactccagtaaccgccgattgtatcactttgatgcgagcatcttcccgagctagacgttcacatgctgcaagcgatccatcacttgaaccattctcaaccaaaagaatttccaaagccttataatcttggtcagcaatgcttcgcgcacagcgctcaacgtactgttcaacattatgcacaggaatgataaaactgaccattttcttattgtacatgctcgttttcccctgaatatcagcaatctgccgacgaataaatcaactcaagctgccgagtaattgcaacacggttataacccagcttgttcacgatacgagaaccatcactacggtcagacaaggtttcatgcattttgcattgcattatcgcctcagcccattgccgtggttgaccagtcggaagatgacgaattcttggcgcttcaaaagatccaagctggattgtatccgagattaaaataggaagcccgttgtcagtggcttctaccactaccatcggaaacccctcgtataaagatggcatggtaaaaacatcaaaagcactcataaatcgttcgggctctgctgtgccaccaggaagatgaaccctgtcatttaagtcaagtactttcgcttcttgtctcacattacaagacaatggtccctccccaactagaagtaaatgagcatctacccccatatcacataatactttcaaaacacgaatttggaataacggatccttggcttctgctaaacgtccaacagaaccgaataacaaagattctgaaccaactccgagctcagcacgcacctgggaccgaataggcatactgaaacggaaacgttctacatctacgccattatgaataatgtcaaatcttctttttccaaaaagatacttcccagcctcagatgaacaagcaagattaaacgtggcatatctggaccacgcctgttgcccaaatttatgcataatttgttttattatccgtgatcctgagccaaaagcagaattatgtgaatgaacaattctgaccggtattcctgcatcataagcaatcttagcatataaaaaacccatgccattcatggtattaatatgaacagcgtcatagtgtttggaacataattgctttctccaagcactagaactgcatattgcacgtttcataagattcggcttaaaaccatggaataccgtgtaacgcttaccaccgagacttgaaatagtatcatcatagcatgcactccaatcatgcgtacaaaagacatcaaaactatagttatgtcgatccaacgcttctgcggtatttactatgaaacgttcaataccacctaagccccaaccttcagaataatataaaacttttatggtcatacatactccttatttaatactcgaaactgtcaattaaataccaagtatttctgaagtgtaagggtatacttcataccagccaccatatatgaccagatacaaaaaacacactacgccccacaataagaataataattgtagcgttttctctaacagcttattactggaaaaaatattaggtattaataatatagtaaaaattttctcgtaaaggaaaactctatcgatatttggactaatcactgtaaattcagtaccaagccaacctataattgcaaaatatacatatacatttaaattctggttgtaaataatgtctttatcttggtttttgactactaaaaaaatacaggaaatcagaacagcagaaatgattggcaggatagacgtgccacccgtaccaagtcgagctacactccaattaacagtgggatgatattccgcaacaaatcttactagagtagatccactataataccctaaaacaaatataaataatgtaattaatacaagaaacgtccttcttgttttttcggtgcttacaatatttccagtgttttctccttttatcaataaaacacacggataatataccagagcagttaatgcagtgaaatgaaactgtgttgcaataaaaattacacaaataaattttacgatttttttgtcaaagcaatatcttagagaatataagcaaattgcgacagctaagtactgcttcatagtattcatagattcagcatagaagaatagcatatatgcggccatgcatagccaagtccttcccttacagaatcttgcagcagaaacatagagcatgaatatgattaataattctattgcaaataagaaaaaatggacatctgagactacgtgagcacatagccaagcaagtagtgcaaaaccaagaggaataggcttatcaattccaaaataactaataaatatatccgtaaaacgcagctgactgactttttcgaatgtgtcaatcacatataccttgacatcagtaccaatagtcacatcacgcacaccggcgattgatgcaagaaagagaattccagatgcagaaaagattttacataataaatatctatattgttcaccgccccagaaatgcgccgatctgtctgaaatccagaaaaaaacaagcgagatagcgaatacaagcggataaaataatatttgaaacatataaatcaactaattcatctattttaagggatcaatctagaaacactactgctaataacgtcacgcccaccgcttccttcctagacgaatctgcgtgtgcctaaaccaagcgaccacatacaagcagagaaataagtgcagtttccaaaacataagcactatggaacgactcttggaattcatctgcgcgcaatgcacatttcttattgcacacgcaaattcatcaatctgacgaaccttacgatacaaatgccaatgatcttttaaagtcattcccgcatttgcattaaacacataattgacagttaattgcatgagaacatgcgctacaaaaatgtcaaactctttgggttcccacttcgcttctttaaaatcctgattcattattttaaatgcacgaatatatcgattcatataatcttcagaaaagcgtttcgttgatgaatctgcattgcgataatactgataactaaataccggagaccccatgaaagtgacattgttttgttctgccttaaaagccaaacgtagaataaattcacaatcttcaccgaaagcaagactctcatcataatacaaatgattagtaattagaaaatcccgagaaaaaagctttgcccaagcttgccccatgttatacgtacaccgcatcaagcgcgaacagcactctacaccattaaagcgctcatcttcacaataattcatcatacgtttactgtatgatctgaatacctcgatatggtttgtgcagtacgccaccgtatctgatgcaccttttagcgcattcaacgccaatgtcaaaccctcgacacagatagcgtcatccgcatctacaatgaaaagccatttcccctgagagagtttgatgcccgcattcctaacagcatttagcccagcatgtgctatttcgattactttcactctctccggcgaagaaaaacactcctggcatattgcccaataacgatcgtgttggccatccccgtcaatcataatcaacacttcataggaaagatttttaagattggcaatactgttcatacaacgtttgaaaatctctgagggaatattccatgtgggaacgataatagagagaataattccctcatcttcctgattttgtggaacaatattagccaattttttgtctttcatatgtcactttccgccttatataccgatacttttgtattgcattttatcatatgcgcgctgcatagaaagctagctcttggactatagggggccaaaaagcatccaaaagcaaaactatacaagccaaacagcattcccaatttatcagaaactcttcccatatttcttgccacggaacttggcgttaaggaatcccatgatcttagcaggccaatcgaccggttcgggcgacgcaacgggaagctcaaccatccggacaccttgctgcagctgctcggaaagccatacatccagcagcgtctctgaaacacgtcctgggtaccgcaggttgaaagcgtcataggctgaatcgtcagtgcgctgttcaagctcgaacagaattggaaacagccaggcacagtaatcggcaagcagatctcgacgcattatgaacatattgaacatatgagcctttgttccacccatcaccttgtcgaacgtggcaagatactgcgggtagcgttcccgaataacgtcccgcgtaacatcgagatgctcagccggcaatgtgtgctcataatgcgaacggaccgtttcaattacgtaattacgatggtttggcactactacatccgccttttgcagcacctgagcaagttcctgaccgccgatgatcctgtcaaaacgatcgcgggctcgacgccccagccaactgcgagtagcgaaatgcctgcggtagtgcaccaaaccgatgtaatcggcatcgcagttcttccacaaccaatacaggccggtcagctccgaatacttgccattgcgatccgagatattctcaccctcgttgtcctgaacccaatcgggcaacacatccggatgcagcgcggcgcccacatgcagtggcatatataccgaatcagccggcatgcgatatggcttatgcgacactacggcaacgacaatctcctgattcacacccgttgtcatattgttatcctacctttcacccgttgtctaattgaaagtgcaacatccgttagattggagattgtccagaaaaccagtccgaagggatgttgcacctatggggaaagtatattcgcacctgtcggaagaggaacgccaggtcatccagatcgaggtcggcaacggcacgagcgtcaggaagatggcccgtttgccgggacgcagcccgttcagcatcagccgggagatcaagcgcaacacatggttcccgtccaacgagagcgagtcctaccggccgtaccggccgaagcgtctgaagacgggcccgtggacgggccggtatcacatcgccgactcctacggttcccggcggcggggcggcgatgagaaccgcaacggcatcatccgccgctgcctgcccaaacgcacgatcatcgaacccggtatggcaagagggctccgggagatcgtcgacgagaccgacgaccggcccatgcgcgtgctcggccaccgcacgcccgccgaggcattcgccgacgaactgctagaatcagccgaaaacaaggatgctgcacttacaaatagataacgggtatatttgaacgagactatcttccgcatctggaagtatgaagtgtagatacccgtatcacaaataaacactcataccgtataagcatactgacgcgtaatttgaggccgtaccggggcttcctcaacgcggtagtgcttacgcatgctggtcaggatggtgcgcagcgctttgttcgtctgctctgctgcggtacggaactttgcgtattccttgccgtgcggatcttcaatatcctcaggctcagggagcattggccgaataatggaagcagagtcaatcactgactgcaagcgttcctgaatggtcaagcccttgaccagcccgttacgtgcgcagtactcacacatgttcgcaaagtcgtccagcaggaacgtgtatttcacagcagtgggagccaacgtgacgatgtctttgcgctgatccttttcaaagcacaggatcagatcagctgacttggccatcggctgtgtcaggcgtcgagagcggaacccacccggttcgatgcccacgctctccatgagcagggcgctgttaggatcaatctgatgcatgggcaagccatgcgtacccgcactggaaacctgcaccgtggtgccagagaggtagcgagtgagcaatagctcacccataggagaacgacaaatattgccggtgcagacgaacataatgtgcatgggctcagtccttcttcatacttacaacgctaccttgcgggcctgcgtacaaaccactagcgcaccattctagtccgatacgtcggactgtggccaatccgcgtccgcccaccatcacttcatcttcacagaatgctaatgggaaatccgtttttttgagcgattttgctataggggggggtgttcctatgtttttgtcaactccttggggagttgacgtgtcgggattccggttggctgtcgtgggcgcgcttcgccctgccggtggcgtccggcgtcctttcccgtgtggcccggttcaggctacgagggctggttcctggtagagggttccgtttttgagcatgctgtagatcacgtcgcagcgccgacgcgcgaggcagatgatggcggcgttgtggtgtttgccctgttcgcgtttgcgcttgtaataggccacggagggcgggtgtttggtggatgcgacgaacgcggtctgccacagcgcgttcttgaggcgtttgttgccccgcctggagggccgttcgcctttgatgctggtgccggattggccggtgacgggcgatatgcccgcgtaggcggccagatgggcggacgatttgaagttggcgatgtcgccgccgatgccgagcaggatgttgcttgcggtcctgacgcctatcccgggcatcgacgccgggaccgtgagaagagggtggtcctccaggagcttctcgacctggcggccgacctcgcgccgccggtccctgatcgtcttgatgtcgtgggcgatggaggggatgatggtctcggccatgagggtgccgggcacggtgacggtctgctcgccgatcgccttgaacatgtcgtcgatgatgcggccggcgcgaagcccgttggacttggcccagtccttcacgtcctcgatcccggcccgtttcacgcccatgggcccgccgtatcgttcgagcagcgcgagcgtcgcgtcgcgcgtgattctctcgcccttgagcgcgcgttcgaacgcggggtgggtctgcagcagcaggctccgcaggcggttgacgtggcgggtggattcgtgggcgaggtcctcgtcgtggccggcgagcagcttcagggcggcgagggtctcgtcatccgggcccgcgtccctgagcgtctcgggcagcttgagcgcggcccacgcgatcacatgcgcgtccctgcggtcggtcttcgcgtccccgggcagcagctgcgcggtcctgcgcatggccgtgccgggaaggtaggcaaccgcgatccccatgttccgcgccaccgtcaggggcagggagccgatggtgttgggctggtccacgaccagcagcacacggccatgcttggagagcttgcccagcatcgtgcggatggccttctcgtcctgtttcaacggcttgtcgtacagggtgttcccgtcatggtcgagggcgtgcgcgtggtgcgcgctcttgcccacgtccaggccgacccacacgtcgatgtcgtccggggtcatcatcgttcctcccgtcatgaaggttttccggtcgccgcgggctcggaggagtccggacgcccgcgccgcacccacattacgacgagacctgcgccatgcgcccctgaagcgtccgtgtagccggcctggttcctatcagcggtcatcgggcgtccccgttcccggcgacaacaccccccggatcatcgacgacagggcaggaaagtcataccggaaccggcgacccggccccgaccatcggggcctaccaaacatggtaatgggcggactcatggtagggtgtgccacagagatgaaattaacatgatttccttgcagtttcaggaaataccttaagggaaagaagttcacgtaccatgtcgagagtcagcaccacggcatcagcaacggctcaacatatgaacagcaccacagcagagactgagacactgcaccgagtgcaaatcagccgtgctcaggcagcacatacggattctcacattgcggacgcaactcctgatacggctgcaccaacattttttgacggcacttacttctcatcttctccggatggcaccgttactcataacgatgctggcgataggcctcatctcatcgaatattcagtgcccaaatggcgttatctgtacaatacgaccatggtgattctggatctgctgatgaccatcatcgccacctgcatcgtattcgcgtgcaatccaggagcatatgccaatgtgcggaacatgggaccatccgattatggtgtattcagtttcctgagcttggcctgcatctcctggctcatcagcctctatgcagctcgaagctacgaacgccacactatgggcgagggatacggactatatgccaagctgctgaatgcggcctttatcgacttcattatgctctgtacattgggctacttgttccatctgaatgtgccgcgttccctgaatgtatttattcctatcctttctctcatcctcgttatcgttgaacggtggctgatgcgtcgtgcgcttcaccgcaatcgagcaaaaggcgagttcaactaccccactattatcattggctctccggagggcatcagtaaaacgctgaagcagctcagggcatgcctcagcctggggtatgcacccatcgcggtctgccctgttgcctctgtgtgtgattcggatgacccgaatgctgctcaacatcttgtatcggttccgtttattcctgccaatgatgaagaagcgcggctcaaggtgttggcgttgaactcccatttgcctcagaccgccaagcggatgaaggttcgcactattctgatcgctgatgtgctgacgcatgattctgaaaccatgcgtactctttcgctcgctgttgaatctatgggcatcgagctggctcttactgcatccgttgcagatctgagcggcgcaaatctgcagctacacaatgacccctctatgccgattttgacagcccgacttgcacagtattctctgccgactcgcatctttaagcgtgtgtgcgatatcgttctctccctggtggcaatcattctgagttcgcccatcatgctatgggctgcatataaggttaagcgagaagacggtggccccgtgttctactcacagactcgtatcggcatctacggcaagcctttcactatgtacaaattccgttccatgcggctgaacgccgataagatggatgccgaagtggctgccgcagctggcgtggaactgggaacaacattcaaggtcaaggacgatcctcgtgttactaaaattggtaagtttatccgtaagacttccattgacgaggttcctcagttcttcaatgtgctgaagggcgatatgtccatggtgggtccgcgtccgcaacgtcaatatgaggttgaccagtactcgccattgtattccactcgcctactggtcaagccgggtatcaccggtccttggcagatttccgggcgtaatgatttgtctcaggaacagtctgaatatgcagatgtgtcatatattcagaattggtctatcacgggggatatcgcgattctgctgaagacagtgggcgcggtatttaatggaactggtatgtagtttttgcaatgcgaagaagggcgtcagcttcttgctgacgcccttcttttgtctctccctcagagcctgtggctgacgtcctcgtcagagggaacttttttaaccggttctattgtggaggttcgaagttatgaagaagaagattatggccgtgctggccgctatcgccgcggtgtggccattgcgttgcttgccgccgcgggcatcgccctgttcgccgtccgcaagagcaccactcgtcgctgacgtgactgacataatagacggtagacgctgaagcatagttcgcgaataccactgaaccgggagtcgatgattcccggtttttccatgttattgctacggtaattatgcaatcatgcatgcatggatttgtataatacggaattagctggctacaattagcgacgtaaaaaagacacgtgaccaatgcaataaggagagcaatcatggcttcattgcttcagggattcgaagaggttcagctggtcaagccggtgggcaagaccgttctgaccgtcaccgattccgccattcgtttcaacaaagccaccgctgaagcgctcggattcccggcgtacgtcaaggtgctgatcaacgacaagaccaggcagatcgccgtgaccccgaccaccgccaaggccggcaacgccatcaagttcagcaagcccgaaggcaagcaggccgcttcggtaagcgtcaaggaagccacgttcattgaagcagtgaaggcatacctcactctgcccgaggcaccggaaggcgaaatcgcctaccagtccgtcaacggtaccgcctaccccgaaagcaagaccgtgatcttcgacgtggccaacgccaccgccggcaccatgaagcgccgcgggcgcaaaaaggccgcctgattcttccgccttgaaatggtgccctgattgaagacgaacagccggaacccgtaaaagattccagctgttccgctgaggtgccacgtcaacagctccttggtttggtctgtccagtgtacgggaaaggttcgatggatactggtaggctgtcttctagcagaaaggtcgcgccaacttcggagcaatcttctaggcggcgccacagactttcgtcccgttggacccaactgccgaggtttcctcaacctcagttgttaccagaaaggtccttggctggtgaactcagtcagggaccttttactttttcaaattccgggttaagggccagtttccttacctcgatttgcaaggaaagcccgatgccataaggcaccaccgctaagaatcgtgtcgcaaccgcgctttgcgacccgcccaagcaaataccaggcaaataaaatttggcgaaattccaacgtttcgcacatgtggagtgcagaatacgcagtaacgaagcaaataaaaaaagtccattagagctacggcagcactatcaccgaatcagcataaacgattgctcactctcgtacccatgccggtatataccgcatcttcttattggcggcatccgcatccaccgggcgaatcaacctgtcagatatggcgtcagcaatcagccttgagatttgagagctggatgatgtggatagtccgaacctctcacgcaaagacgcattagtcagcgcattaccattggcgtactgcagacaagcatgccagtagcatgcctgcaatctttcatcaaccgtaagatcccgatatgggcgccgctgcattaaacggacccgcatactcggcgcatcaccgcgagcctcctgaatctctggcgcaggcaactgcatcagttcacaggaacgaataatcttatcccagccagacccggcttcttcacatatatgcagcctacgagccaattttgccagtcgcggattgcgtgactgaggaggatcattaaccagcctcggcacctgaatcagggatgcacctggattagaaaattcaacacgatcatcaaaaacctccacgagaggaccaccgcctcgtatcgtaagatcctgatgaatgagcatattgcccacgagttcacgaatcgccaattcaggataaccgttcatggttacacgcaatcccttatcaatcacttcttgctccggcaataacgcctgaatgtaatccatgacaccgtcaatataggcatatccacctaggaaaatcttggaacgagtcgccgcaatccgatctttgcccgagtagcgaataatgcgaatggccttacgcgagacggtctcgaaatcatccatattcgctgcgaacaacaacgccccgagattggttacagcgtattgcccgctatctaacgtcttaacgatgttatctgtaacgagataatgaagtatggacgacccaccttccggtactggaataccggtctgagtaaagtaacgagcccaattgattttatgcagcacttcatcgcggcttagccagcgcaatgctatctgatcctcaaatgctcctgatcgagtcaaatcccacaaccgttgttcacgttgggaatttttctgcagaggttgggtcgaggttcctgaacgaatatattcgacattatcgaacgacaccggataaccgactgccggccaaatacgcagcacaacgacatgtttgccatctacatcgactgagaggaatcggaactcagcattgctggagagttttacacggagccaaatttctagttcctgattgcctctttttgccgtcagcggatcgaatgatgtcccgataatggcatgcgtcgaatcctcaacaccccataccatatacgcataatcttgcccctccacaattgcggaattagcaagtgccgcaatatcacggccaatcatctcgaatcgggcattggaatccttgaactcaatcgtctgcgtctctgaaacgtgaccgatgagttgtttcaccagttcaacgtaatcttccggcatgatgcttatcctttccgcggcccctctgccaagtcgttatctcaagttcttttccatccagtgtaccccacccaagcaaataccaggcaaataaaattttggcggaattccaacgtttcgcacatgtggagtgcagaatacgcagtaacgaagcaaataaaatcatcaggagagtcgcacaatcgatagctggagtcggtcccatacaatcacaaagcagaccacgtggccaacacttgggaacggccttacggatccgacgtgcatactcacccatgattaaaggggctcttcgggtgtttgtgtgggtgtgaatcatctgtcttgcttactgtctattggcgtccggggagttggaggttgagtccgccgcatttgagcatgaccagggcgatgaggttgtcgaggttccggtagccgtagccgatcttgatggtggtcttgatcctgttgttcacggcctcgagccttgcgttggacagtccgctgacatgcttagccgcgagcgccctgttgtcgatgatgagcaggcgcgagtggctgaaacattcaagaaactccatcgaggcgatatgggcatcgttgcctacgaggatgagcacaagtttgatggggacggggacgagccggcgtagcatcagttcgcttgaactcacatattcatgtatatatgtgtatataagtgtatatttttacctagaacttatggaaggccaaaggaaccgcacatgaacaccgtggattcaaccagacgcaaagaagcgatgcacgccctcaatccattcgcgcccggagcgggaagacaacccaaggaactcgtaggacgcgagcaggaactcgaaatcatggacagaatcatcgccagaacaaaagcgggatactccgaccgcggactggtctacagcgggctgagaggcgtcggcaagaccgtgctcctgctgagaatgaaagacatggccgccagccagggactcattaccgtccgcatggaagccacgggaaacgagacccacgactacgaactcctcttcgacggcatctccaaagcaatactgcgcgagagaagaggaacgctccgacagaaaatgctcgactccctcaaacacgtcaacgaggtttccttcgaactcggggtaatcaaaacgtcaatcgggttcggcaacgaggacaaaggcatatccagcgactcgctgcgactcgaaatgatggtcgaggaactatgccgcgaactcaaaaaggaaggatcgggcctgttcctgttcatcgacgagttccaagtgatgtccagcgacctgatgggcaccatcatcggactgcagcacagcatgggacaggaggatctgcccttctacgtcatcgcggcgggactgcccaaccttcccggcgttcttaccaaatcacgctcctacgccgaacgcctgttccagtacaagcgaatcggacggctccctgaagacgagaccagggaatgcttcgaaaagaccatcagcaagatcaatgtgcgattcgacgacgatgccctgaaccgtctcatagagctctccaaggggtatccgtatttcatccaagcatatggttctgcagccttcgatgaatccgaatcatcgccaatcccattgtccgccgtcatcaagggcgaacccatagcgcaggcatcactggacagcggcctatacgaatcacgctggcaacgggcccgcccactggaacgggaatacatgagggccatggcctcgctcgaaaaaagcgtgtgcagctcggcggagatcgcggaacgactgggacgtccgcctgcggatgtcgtacgggtcagaaaaggcatcatcgattccgggctggcatatgcgccagaacgtgggctcttggcattcaccgttcccggcatgggtgatttcattcgcagagccgcaccgtcggaggaacagacctatgacgaccgagcatagagaaaacagaagcctaaggactacaggaacctattacacgaccacatcgtggcatgacgcaggggatatgaaacgtacccggtcgctcgttatgagcgccggggcgtttgtggttgtttgacgaaatcgtccgacggggtcttgaattcgtcggagacggcgcgtttcaggactccgtctatctcgagccgaagccgtatccgcaatatcttcgataccattccttgtatcttttccctaccttttcctccggaaaagcgatcttcccataagcgtccgagatggtgagagcaagtaccagggcggcaccacagcattccgcccgcagcgccttcctcacttcatcggcaaggcatatctccatgggattcgtcatctgcggcgcaagtcttctattccctgtcggcatccccccttccggtccttgtgcccgttcaaggtcaagatcgacgagaagatgcacgcgaagatcgttgacgagctcgacgccaagctcgcttccggcgagatcgtcgacgatgaggcgcagaccgtggaggccgccgaagccggagtagacggtacgtccacaacacggcaactcgaccggtacaaggacaatccgtaacaagtccatacggttcatcgcacgttgaacatcagccgaacggcgaatgatatttgatgcgcgcaccatgaacagtgcctgaatcagccctcgtttcccaaaagcggcggatagccttacaaaggccatatgcgtaggtgcattgcaacggcacattcgcatcgtcgttgaaataggtgctaaggagaacctggtcatgcatatagggagaatacgcaatatcatcaaaccagcggtggcgtgcatagcgcttgccgtgttcacagcgccgggtacggtagcctccgccgcagcgtttgaacgtgaaggcgccccattggatgtggtggccgattggaaatttcagcaggcgcattccaccggttccatcgacggtggcaacctgatcatcaaggatatgtcgggcaacggcaacgatctgcatatgcagacctacgggaaagacgattacaagctcagcgactatgtcaactggtcgtcgaattcgatgaacggtgacggtggtggcagcctgaaactcaatggcgacagcgatctggcgcataagaaggctcatcccgagcagcgagaccccaaaggcgcggatttcatcaccgcaagcgacgctcccatcaacaaagagcaatttgtcaacggatacaccatggagttcgtgtactaccttcccgatgacttcaacgccggcaccgattcgtggatggggcttgcggccaggcaatccacaaacagcaacatggatgaacacgagatggggtcgatgagcctgtcggtctccaactgcaaggaaacccagttcaaggccgccaacaaggacaatgagtcgaccatgaacaccgatgatcccaacaacggcgtcaccagctggggtgtcactatggatcacggtggcgtttggtatcacatcgccgtcgtatccgatggcacgaacgtggtgacatacaccaacggtgccaaagcgttccgcaatatcaacaagaacggtaacggtctgtatgccgatccgaccgatggtcgcttccgcatcggctcgtcgtattacaacgacactttcgataccagccaatacaacaaggacgactttgacaagttcttgcgcggcaacctgcaggaggtgagattctcccgcggtgcgttggcacggggcaactggatcgtgcccaacccgaccgattatctcaaggattatggtaccaacgatcgttttgtgctggacaaccccagcgtacatacgatggctttcttgccggacacgcagaatgccatccgttgggtgcctacggtgatggaccgagccatcgaccagttcgattcggaagcctccagtctcaacttgaccaacatcgtgtccctcggtgacgtggtggacaactgggacagtgacgcgcaatggcaggcatcgtccaaggtgttcgggcgtatgcagaaagtaggcgtccccttcctggagcagccaggcaaccatgattacaatggaggccggcatggctacggagtgcccagcttgcgcaaggcggacaattacctgaaacacttcggacccgactccgatttcggcaagtatcaaaaggaacacggttttgcatactcgcccgatggcctgtcctcataccatctggtcgacaacggctcctacaagtatctggtgatgaacatcgacatgggcgcggtggtcagcaactcgtcctcggcaagcaatgacgatatgcgatggttcgagcaggtgctcaaagagcacccgaacaacccgactgtggtggtgagccacgatatcttcaagtgctccgattcacgtccgaatgaaatctccctcgatgatgattccggatacaacggtgaagccggtgacgatgaaggtgccggctcaaaaatatggaacatcgtgaagcggtacaaccaggtattcatgatgtactccggtcacaatcacggatccggacaaatgaccctgaccaatgatgccggcaatccagtgttggggctattgtccgactatcaattcgcgtataacggtggcaatgcgttcttccagtacgtcggcatggatgaagcgaacaacaagatcaccatgcgtacgtattcgccatactcggcatcgctatccacggccgagcgttcgttcttcgatgtcaacttcctgaccggtatcggcaacacctatgacggatcgttcgatttcaccaaacgattcgccggctacgaacattcctccggttatgacacgcagcagtcggtgatttccttggtgcgcggtatcggtgcgttgaacagtcagacgtcggcgagcgaagtacggaaactatatactgctctggccgcattgccggataatgtgaaagcgcaattcggcgatccgtcggatagtggctctctggcaggcagactcgctgccgcatacaatgccgcgttccccaagccggaacagcccgacaccaaacccggtgccgacaatcagaccggaagccaaggcggacagtccggaagccagcaagggcagaaggacgatgtccatggcaagggacagacgaatgccggcccggagacaacggcctccactggtgccgatgtggccccggtcgtcgttatcgcgatgatgacgatcttgttggccggcatgcttgtgctcataaagcgcgagcatcatctttcgcactaaccgattactggtgcacaacctgtcgacgagcgagcggccagtagttgggtccgatgcagagcccacggtactggttgctcgctcgtcgaatcaaagtcacgtcgacgcttttctacgtttccggtacgtctacgtttccggtatgttcatcatgataacagcaattctttccctgaccgactccatcgagtatggtcaggaagatcggcaagtcagaggggccggaaccggcggtgtgtcgcctatcggccaggagtgtccatcagctagtatcggctggtatccgatatgggccgtggccctgcgccacctgccaaaggaggtaatcgtgcgtgcgcgacgtgacttcgcatggccaaaactgctgaccgcggacggacgcggcatcgccttcggcggcgactacaatcccgaccaatggccggaggacgtctgggatgacgacatccgcctgatgggccaggccggcgtcaacaccgtggcccttgccatcttcagctgggatcgcctccagcccaccgaagaccattggaatttcgactggctcgatcgcatcatcgacaagctcggccaggccggcatcgcggtcgatctggcatccgcgacggcgaccgcgcccctgtggctctacgagaaccatcccgaggttcttccgcgagacaagtacggtcacccggtcaacgccggttcgcgccaatcctggagcccgaccagcccggtgttcaaggaatacgcgctaaccctatgccgcaaactcgccgaacgctacggcaccaacccgtatgtgacggcatggcatatgggcaacgaatacgggtggaacaaccgcgacgactactccgacaatgcgctcgaagccttccgcgcatggtgccgccgcaagtacggcaccatcgacgcgctcaaccaagcgtggggcaccacgttctggggacaggagatgaccggtttcgacgaagtcctcatcccacggttcatgggcgccgactcgatggtcaatcccggtcagaagcttgattttgaacggttcggcaacgacatgctgcttgacttctataaggccgaacgtgacgcgatcgccgaaatctgccccgacaagccgttcaccacgaacttcatgatctccaccgaccaatgctgcatggactacgccgcttgggcggaggaagtgaatttcgtgtcgaacgaccactacttccacgaaggcgagtcccacctcgacgagctggcctgttccgacgcgctcgtggattcgctggcgctcggcaaaccatggtacgtcatggaacattccacttcggcggtgcagtggaaacctctgaacacccgcaaacgcaacggggaaacggtgcgcgactccctggcccacgtggccatgggcgccgacgccatcaacttcttccaatggcgcgcatccgcgttcggcgccgaagcgttccattccgccatggttccgcacgccggcgagaacacgaaactgttccgtcaggtatgcgaactgggcgcgacgttgcaagcgctcgccgatgccggtgtccaaggaagcgaattggcgcatgcggacacggcgatccttttcagcgccgaatcggagtgggccacccgctccgagacgttgccgagcatgaaactcaaccattggcatgacgtgcgtgactggtaccgcgcgttcctgaacgcgggtgcccgcgccgacatcgtgccgcttgcctacgattggagttcatacaagaccatcgtcctgccgaccgtgctgatgctgagcgacgccgatacgcgacggctggccggtttcgtacaggacggaggccgcgtggtggtcggttacgcgaccggcctgctcgacgagcgcttccacacgtggctcggcggataccccggtgcgggcgatggactgctgcgctcgatgctgggcgttcgtggcgaggaattcaacattctcggtaccgagacggaagacgagccgagcgagattcggctggcatccaccggggattcgcccacgatggacggtgccgtgacccgcctgtggcagaacgacgtgaccgtcgccggaccgcatgtgcaggtgcttgccgcgtatgccggcgaagaagcgaatgagtgggagcttgacggcacggccgcgatcacccgcaacacgtacggcgaaggggaggcgtatttcctcggctgcgatctgggcgtgagcgatctgacgcgattcgtgggaggctggcttgccgcgcgaccacaggatggccggcagccggaagccaacctgcggtcgcccgccagcggcgtgacctctgacgttctgcacaccgtgcgtcaatccgacgacgccatattcgacttctatctgacacgtggcaaatcggatgtcgaactgcgcgacatcgccggggagccgatcgtcctgttccgggcggaacggggcagtgacggcggcgcgtatacggtgcatcgcaatggcgttctcgtgatgaaacgcccgaacccgtcggtgtagtcagttgcggcgaaacaggagggctgcaggacggtgccgacgtacatggttgcccggattctccctttgccgctgcgctgcatgcctcagcagatgttccacggccgcatcaacggaaagcgagttgtcggactccagcttgaatggtttgctggtgaagaactcctgtggaatctacagcgcttccataagctgctcgaattccggggtgggctcggcctcgaagggatcgaggagtatggcttcccggcgttcgggggcggtcagggtcaggtgggtccagtcggcggagaactgggctccgacgttcagggccgcgtccacgaaccggccacgcagggcggcacgggtgtcggtcggcgggttgtgcacggcgtattccacgtcgtctcctgtcagcagctcacgcatttggttgcgggaagtcagcgaaccgtacaggcggccattggcgatgtcgtggtagtcaagctcaagctgttccatctgggcgaaggtgacgtccgggcgacggcgtttgagcgcatcgaacagacgcttcttggcggcccagtccacgcggtcggcgagcgcatcgtatgcaccacgctccagcgcgtccagaacgcggctccactcccccataatcgtgacgatcgtggtggccggcagcgaacttgccagcgcatcgccatgggtttcgatgaaggccttgaccgccgcataataccggcgctgcagacccagtgcggacacggattcgcctgattcgagcgtcagttcggcgtgcgggtcgtcgaggaatcggctgacggtgcgattggccgcagccgggtcggcgaaggcgcagtgttcaaaaccggacggggtgccgaggcggaaggcatcttcgatcgcgcacagcacaaggtgcgtgacggcgagcttcatccatgtggaccattgcgaacggttcgagtcgccgatgatcacatgcagccggcggaaggagtcggggtcggcgtgcggttcgtcgcgcgtgttgaccatcgggcgggagcgggtggtggccgaggagacggcctcgtccaggaagtccgcacgctgggtgatctggaagccatccggtgtcatgcggccggcaccggtgtacagctggcgggtgataaggaacggcagcagctggtgttcgatggtctccaacggcacaaagcggcggaccaggtagttttcgtggcagccgaaggcgtggccggcggagtcgacgttgtttttgaacacgtggatcgtggcgtgttcgctgtaggattcgcgcagcttgcgctgggccttcagggccagattgcgcatcacatgttcgccggcaagatcctgccccaaggcctcgcgcgggtcacgggcctcggcggtggcgtattcgggatgggatccgacgtccagatacagacgtgagccattggccagatacgtgttggtggagcgggaacgggagacgatgggctggaacatggtcatcgccacctggccggcgtccacggggcgttcggcaccggtgacggccacgccgtattcggtttcgacgccgaaaatacggcagaacccgtccatctcggcggatggtacgggttccgtggcgtgcagggagcgggtgccgctgtcacgcagttggggcatcactcgccgcctttttgcacgaagctgttgacgtattcctcggcgttggtttccaaggtggattcgatgtcgtcgaggatgtcgtccaacacgtcggcctggtcggtggactcggtttgggtggcggcctgcgtggtggcgagggcgtcgtcttcctgggtcacggcctgctgtgcttgaggttgttcgaattgttgtggcatgttgtcttctttttgggctgtcaaactcccctcagtcagccttcggccgacggctcccctcacccgaggggagccggaggagtcaaaaaaattatcgctggttgatggagtcgggccacggatactgctgcaggtaatgctgcagttcgcggatgatgagtccgttggaggccactacatcgttatcgtgacgccagtggatacgttcgccgtcccaacggctcagcgtaccctgcgcctcccaaaccaccacggtgccggcggcgatggcggggatatcccacacgtgcagcatcggctcgaagtaggcgtcataggtgccgtcggccactttgcacaggtcgagcgaggcggggcccacacgcttgatgtcggccgggcgtccggcgagcgaggaggccacgtcgagcgcgcgctgcgattcgtcgggcaggaaggacatgccgtagctcagcacggaaccgtccagcgaggaggtcatcgacggcacgaccttgtcgcgcttctcaccgaccgcggttttgtggatgcgcacggcacccgctcccttggcggccaggtaggtcaggccgagggccggggcatgcacgatgccgatgatcggcttgggctcattgtccgggccgaattcgaacagggcggcggttaccgtccattcgctcatgcggcgtatgtagttgatcacaccgtcgatcttgccgatgtaccagtaacgctggccggggcggctttcggcgggtcgggtggtccagaagccgtcgaagtgggcgatgtcggcgattctggcgctcataaagcgcataatcttgctgtcgacttcgagcttatagcggggaccacgatccgcgttctcggtgctcgactgggcgaggttacgcggattgagctggtcgtggagggcatgctggccggcttcttcgagaaggccggcgactttgagcgcaaggttgcgcaggtcctgtggggtctcttcgcgtgtttcttccatagctatcaagtctatcgttcggcgttgatggccagcgacttcagcagatcgatggcgtgttcggctaaattgagttcggtttcgcagtgcgccttggtgaaggcgagcggatcggagatgtcgagggagaacaggtgatggtcggtagcggccatatggccggcattgccgtagaattcgacagcctcgccctcgtctgcggcgcgcgggtcgcgaacagtgagtcgggaccagctggcggcggccacctcatcgccgaatcgtgcaacgagtttcgccctgagccaggcgcgggtgtctgccggcggttcggtggcggcgcgtgcgatgtcggcggcgctcaccacccgttcggtgcggggttcgagtttggtgaagatgctgtccgcggggtcgagcgccgcccatttcagttcaatgaccttcagtcgcggatcattccatccgttagccacgctgggcacagctgccgcggtgattttgcggcgcagtttttcgagcagctgccatttgagcagccattcgatgcggctggcctcgccggtcatggccaggcgttcgtcatcgtcggcggcatggcggatggaggcgcagtcgatgagcgcctgctgccacatcgccatgatggatgtggtggatttgtccggccaggcgggctcgccggcggtgtcggtgccttcgaccagtgcggcgacctggtagacggcttggcgcagtttgagctggataagccatgcgttggtttcgccgccgttggccagcggcaggcttgcgcccagcgtcaggtcatgggagacggtgtgcatggcttcgaccgggtcggccagttcgagctcgtcgaggaagacgttcagatcgaatccggcttcgtccgcgtgttcgagcagccacagcagcatgctcgtggtgccgagtttcagggcctgcggtacctccatgcggttagcgtcgccaacgatgacgtgcaggcggcggtatgcgtcggtggagtgggattcgtcgcgcgtgttgatgatcgggcgttcgaaggtggtttgcagaccgactttggcatggatgtagtcggcgcgctggctgagctggtagcccgggatctcgctgttctcgccgattcccacgcggccggagccggcgtagatctggcgggtgacgaagtggagggtcatcaggcgcgtgaccaaatcgaatggcactgagcgggccatcatatagttctcgtgcgtgccccaacaggagcccttgccgtccacattgttgcgatgcagggcgacgggggtgccggtctgtgtgcgggcgcgttcggtggcggcctgcatgatgaggtccccggcgtggtcatagcggaccgcttcgaacgggtcggtggtttccggtgccgagtattcggggtgggcgtggtccacgtagacgcggccgccattgggggcgatcacgttggtgatgttgagttgtggggcgtcggtgagcatgtccgggcgggcggcggcgcgttcgaggcgagtgccgcgcgcgtcgttgaccgggtcctcctgccggtagtcccagcggatggatttgctgtggctgtccgcggcgccgttcaccacgtcgaaggacagttgcaccggattgtagcgatccggggtgttcagggataccgcgtattcggtttcggtgcccatcactcgtttgacggtcatgtagcgctccttgagcttgagctattcggcggtgcggatgcggcggatcgggtccatgccgttgatgcgcgaccattgttcggggtccacgtcggccatggaatcgcgggtctcgcggtattcgtcttccacggcggcggcgagcagcggcacggtgagcgccacgtccgagccggtttcgatggattccttgaccgctcgggtcttggcccggtccacgatgttcttgagcatcgcgccggagaccacgtcggccaggaagagcgcatgccactggccgttctcctcctgcacgtcgcatagatggcggcgttcggaggttccgtagatgtcatgcaccagcacggcggacaaggcgtgcgcgtcgacgccattttccagaggcaggtcgtcggtgaggtaatggtccacgatggcgatggcctgattggttttgggccggccgacgcgaatcttgacgtcgagacgccccggtcgcagcacagccggatcgatcatgtccacgcggttggaggcaccgatcaccatcacattgtcgagtgattccacgccgtcaagttcggagaggaactggggcacgatcgtggtctccacgtcggaggagacgccggagccgcgggtgcgcagcagcgaatccatttcgtcgatgaaaacgaccaccggattgccatccgcggcgcgttcgcgggcgcgctggaagatcaggcgaatcagccgttcggattcgccgacgtatttgttgagcagttccgggcccttgacggacaggaacacgcctttaacgcgggtttcggccgggctgatcgagccgtcgccattcgaatcgtaaccaccctcgcacagggcgttcgccacggccttggcgatcatcgtcttgccgttgccgggcgggccgtacagcagcacgcccttcggcggcttcagatcgtagcgctcaaacagcgcacgatgccggaacggcagttggacggcgtccctgatacgaccaatctcactatccaagccgccgatgtcggcgaacgtgacgtccggggtctcctccagcaccagatccttgtcgccctcggcgggcagcgcttcgatggcgaggcggacggacggatcgacgatgatgcggtcgccctgattgatgtccgcatacgcgagcgcgccggaacggcggatgagcacgggattgccggaggcgtcggtaacgatcagtcgaccatcgtcaagtacctgcttgacactgcgaatctggcccacggtgtcagcgtcgcgctgctcgaccagcacgagcttctcgttgagcatcacggtggccccggcggtcagacgggcggcgttgacgttggatgccacgggcaccaccatgcggcgggtgccggaaatgacttcggccgacgcgtgctggatgccgtctgcgtcggtgcgggtggaatcgaccttgaccatggtggcgaaggtgagcggcggctgagcgagctgggcgagccgtgacttcgccttggtcagttccttgccggcacggttcaatgcttcggcgagcgcatggttcttggccatcaggcgatcgttcagcgcggcgagatcttcggtgtcgctcatgcgggttcttcgcttcccttctatccgggattttcggcaacttatggcagtcggcagaccctattcgttgccgtcggcggatttcctgttacgtatcacagtacgcacttttcgcaccacgaaccatacgatgaccacaatcacggccgcgatgaccacgtcctcgaacacgccgagcgcgccctgaatcgagcaccactggtcgccgagtagataaccggcggaaacgaggatggtgttccacacggccgagccgagcagggtccagccggtgaagtgcaggaagttcatgcggttgaacccggcgggaatcgaaatcagcgagcgtaccacgggaatcacacggccgatgagcaccgaccatgtgccgtatttggtgaaccagtcgttggctttgctcacgtctttgcggctgacgccggggattctgtctgccgcgagattgatgcgatgcaggcccacccagcgggagatgccgtacaaggtccaggcacccagtacggagccgatggtggcccagatgattgcgcccggcagactcaaggtgccgcgtgcggcggtgaagccggcgagcggaagaatgacttcggacgggatgggcgggaagatggattcgagggcgatggccaaggccacgccgataccgccgatggtttccatcagcatgatcagccagtcggtgatggtgccgatcaggccgggttcggtggtggtgcagatgggcgtagggtcggtcgcaagaatggtggcggctgccatggaaaaactcatagagggcattgtcccaaggttttcccagaatcaggagcatgacgcaagaagatgtgcattttattgacaagtccgccgagagcgaagttgggagcccggctggttctgcggtttttgtgccgacgctgagcgagcccggcctgctggttatggatgtggactccacgctcattgacgaagaggttatcgacgagttgggcgtggtggctggctgcggtgaggagattgccggagtgaccgcacgcgccatgcgcggcgaactggagttctgcgacgccttgcgtgctcgtgtggcgctgctgaaggagctgccggtttccgcgttcgatacggtgcatgacaagctgcatttcaccaagggtgcgctggagcttatcgacacgctgcatgaacacggttggaaggtcggcgtggtgtccggcggcttccatgaagtggtcgatatgctggcggccgagggccatatcgactattggatcgccaaccggcttgaggttgccgatgggtgcttgaccggcaaggtgctcggcgaaatcgtgagcaagaccgtgaagttgcacgtcttgcagacatgggcggaccgtttgggtattccgatgagccagaccgtggctgtgggcgatggcgccaacgatattccgatgattcaggccgccggcctgggtctcgcgttctgtgccaagccaaagacccagctcgccgccgacaaagccatcaacgaccgcgacctaacccacgtactcgattacctgcgccggtaaaattttaccgacctcggctccggcacttatagttgagccatgactacttcaggcgcagaacagttgacgcttgcggggctggctccccgcaagcggcgtaaacgtgcgcctgcggagcatacgccggccgagcagcatcccatagcgcaagtcgtgctggatgtgcaggcgctccacctcggtcagacattcgattacttcattgatgaaaaagacagcgaggccgcacaaccgggtgtgctggtgcgcgtgcggtttggcggtcagagggtcagcggcgtgatctgggcacgcaccgataccagcgatacgccgcgctcttcgattcgctatatcgagcgagtgctaagccccgatgtactggttcccgcttcgatgcgtgaggatatcagtctggttgccaaagcctatggcggcacacgggccaatattctgcgtttcgccgtgccaccgcgcgtggccaaggtagagaccgagcagcggttggccgcatcgttccgtcggccggtcggcggctcattgccggataatacgcagggtggttttgccgggcgtggcaccaatcccgatgggaccaaacctgctggctctacctttgccgttgccagtaccgtttcggagggagctgcgcaggggtatcgtcgtctgaccgccaattacgccgatgtcaatgtgcttcatgacgcgcttaccggtcaacgtttccaatcttttgtgtttgattcgttgcccggtgcacaggagtggcaacgaaacatggcatggatggtggccactgcgttgagtgccggtaaggctgccgtagttgaattgcccaccatgcgcgaggtcgaagacctgatgcctatgctacgcaattatggactcaaaccgttcgccccggcacccgccggcggctgggtgggcgacgtcgccgtgctcaatgcggagaccatgcctgcggccgaccggtatcgcacgtatctggccgtggcgttgggccaggtgaaggtggtgatcggcacccgcgcggtgatgtatgcgccggttgcaggcccggcactgttcgccattctggaggatgccgcctatcagaacatggacggtatgatgccatatccacaggcccgtggcgtgatgcggctgcgcgccaagtcccatggcggcgtgttcgtggccatggccaatgcgcgcaccccgcaaagccagtgggaaaacaccggcccggatacggtggagaccccggtgagcggctattccaccgcgattcacccgctcgcctcgccgctgaagaatgcgacgccttgggtacgttggctcaatcgcgatgagcttgcgcgtcttgccgacccgtccatcggcgcacgtgtgccgcatacagctgtccgcgtgctttccaaagcgctggagagcggcccggtgctgttgtccattccgcaagacaatgtcagcgagaccttgagctgtgcgaaatgccatcgtcaggtgcgctgcgccaagtgttccggaccattgcaactgccggccgaccgccgggactccacaccgcgatgccgctggtgcggggctgccgccatcaactggaagtgtccgggctgtgggcatgaacgtatgcgcgtggtgcgggtgggggctgccggcactgcggcggagctggccggattgttccgtggcgtgccagtagttttgtccagcaagacgcagggtctggtgcgcgatgtggcttgccagccgatgattgtcatcgccactcccggtttcgaaccgcgcgtgcgtccggtcagtgccgcgcagggaacatccggtcatgagtatcgcgcagtggccgtgctcgacgcttggaccagcctgtatgcgttgggcgtggatgctcggttggatacgttgaccgcgtggatgcgtgcggtgtcgttgtgcgcgccgcgttcccgtggcggccaggcgttgattctcggcgaaaccgacccggccatcgcccaatcgctgatgctctgggattcgaggattcttgcagccaaggatcttgaggagcgtgtggagaccggtatgccgccggccgtggccgccgcctgcgtgtggggccgccgtgatgcggtgatgacgctgatgcagcgtatcggcgccctgggcggcgattggacggcctgcggcgagctgcccggcatgttgggcccggtgccgatcgcgcaaccggacacggtcgacgcccgggagctcgaagccacggccgaccgggtgaaggcagtaatccgtgtgccgcagagtcggcgagccgagctggcggcccgactgcaccgggaaaccgctcgtcatgtggcgtctcgcgaacccggcgagcttcgcttccgagtagatcccaaagacctgatctaatcgtcttcaacacgtgaaacgataattacagaacgaacatcgctataaggaggacaccatgaagggctggcctggagagccggatatggattacgacgtgctggtcgcggacggcgaggccgccgagaacgccggcaagccgatcaccgacgtgatcttcgatttcggcaacgtgctgatttactgggatccggccgccgtactcatcccccgctacagccagaagaccatcgacgaattcctcgacaacgacatctccggcttctacgatgccaacgacctgatggacggcggcaccagcaccgacgaggccatcgccatcatgcgccgtgacaagggcgataagtgggcggacatcctcgactactacatcaagaacttccgcgactccctgaccggcatcgtgccgggcgcgcgcgtgctggtcaatgacctgaaggccgccggcatcggcgtgtggggcctgagcaactgggaatccagcctgttccacgtggccgaggaacagtgcgatattctgcagcagcttgatggcaagctcgtctccggttttgtcaagctgcgcaagccgcacaaggaaatctacgaggccgcgttgaaccagttcggcatcaatgccgatggcgcgttgttcatcgacgacaaggccatgaacatcgtcggctcgaatgcggccggcatccgtggcgtacgtttccaggatccggtcaagctgcgtgaactgctcatcgccaatggcgtgaacattccggccgtgcagtgagcatcgacatttcaaggaggaccatgctcaaactcgtattcgccggcacccccgacgtggcggtgccctcgctcaaggcctttgccaccgacccacgcttcgacgtggtcggcgtcatcacccgccccgacgcgcctaccggtcgcggccgcaaactcacgcccagcccggtcaaggcgaaggctctggaactcgggctgcccgtcatcgatctcaaaccccgctcccccgaattcatggaggcgttgaacgacctgcatgcggatatcgccgctgtcatcgcctatggcaatatcctgcctaagaacgtactcgacgcagtacccatgggctggtacaacctgcatttctccaacctgccaaagtggcgtggcgccgctcccgcccagcgtgcgatttgggcaggcgacccgaccaccggcgccgacgtgttcaaggtcggcgagggcttggacgatggcccgatcgtcgcttccctgaccatcgaactgaccggccgtgagacctccggcgaactgcttgaccgtctggccgaagaaggcgcacccatgtatgtggatgctctggccgccgtcggcgaaggcaccgccacattcaccgcgcagccggccgaatgcctggaatatgcgcacaagatcacggtggaggacgcccgcatcagttggacggacgaggccggagccatcgaccgccagattcgcgcctgcacgccacatcctggggcatggaccgaactgtttgcggaggggccaatcgccgataatgacgggtcaaccgctaaatccctcaccctgcatatcctcgccgcgcaaccggccgaccagtccaatcccaacactccggccgatctcaagcccggcgagctgaaggtgggcaagaagaacgtgtgggttggtaccggcagcacgccgctggaactcatccaagtcaaggcgcagggcaagaaggccatgcgcgccgccgactgggcccgaggcgcacgcctctcccccgccgcctgcgtgcgataacaagcaatatcgctcccgtcatcggaagcacagcaaaaagcccggcatcttcgcgaggaagataccgggcttttcagctatacaatcggcgatcagtcgagaccggagagcttgttgatcagctccgggtcacgcgtcgcacccttgtcggccgagcgggcgaaggcggcgtacgccttcagcgcttgggagacgtggcggttgcggtgagccacgtagccgtcgccggcctcgagttcacggcgacgctcgtccaactgctcgtcagtcagttcgacgttcacggaacgggcttcgatatcgatatcgatgatgtcgccgttcctgatgagcgccaccgggcccttattggcagcctcaggcgccatgtggccgatggccagaccggaggaaccgccggagtagcgaccgtcggtgagcatggcgacctgcttgccgatgcccttgcccttgacgaaggaggtcgggtacagcatttcctgcatgcccgggccacccttcgggccttcgtaacgaatcacaagcgccatgccgggcttcagggtatcgttcagaatgacctcgatggcctgctcctgggagtcgaccaccagagccggtccacggaacttccagatctccggcggaacaccggcggtcttgaccacgcagccgtcgggggccaggttgccgcgcagcacggcgaggccgccttcatggatttcgggatgatcgatgtcgtggatggcgccgttggtacggtcgcggtcgagcgagtcgaacagggtggtgtgcgtccacggctccggggagatgatgtggccaggagcggccttgtacatctgctgggcttcctcggtgcaggtcgggcgcatgatgtcccaatcggccagcttggcttccagcgtcgggtagtcgatggagtgcacgttggtgtgcagcttgccggcgcggtcgagctcgccgaggatgccggtgatgccgccggcgcggtgcacgtcggaaatctcccacttgccggacggcgaggccttgcagatgcacggcacggtgtgggaaatgcgctcgatgtcgtccagggtgaagtccacgtcggcggactgggccatggcgaggatgtgcagcacggtgttggtggaaccgcccatggccacatccatggtcatggcgttctcgaaggcttccttggtggcgatggagcgtggcagcacggaatcgtcggaatcgtcgtagtactggtgcgcgatcttgacgacctgcttggcggcacgctcgaacaggtccttgcggtaggagtgggaggcgaggatggtgccgttgccgggcagggccaggccgatggcctcggtcaggcagttcatcgagttggcggtgaacatgccggcgcaggagccgcaggtcgggcagacggtcttctcatagttgagcagttcctcatcggagacgctgtcgtcggcggtggcgtacatcacgtcgataaggtcggtgctcttgactgtgccgtcggcgagcaccgtggtgccggcctccatcgggccaccggagacgaacacggtcggaatgttgaggcgcagggctgccatcagcatgcccggcacgaccttgtcgcagttcgggatgcagatcagggcgtcggcgcagtgcgcgttgcactggtattcgacggtgtcggcgatgatgtcgcgggaaggcagggagtagagcatgccagtgtggcccatggcgatgccgtcgtccacggccatcgtgttgaactcgcgcggaatgccgccggcttccttgatagcctcggaaacgatgcggccgaccttgttgaggtggacgtggccgggcaggaactcatcgaacgagttggcgatggcgatgatgggcttcttgcccatgtcgtctccgctgacgcccgcagcacggtagagggctcgggcgcctgcaaagacgcgccctgacataatttttgcagatcgcatttcagtcatggctctattcaagcctttgcgagggacacgccgcttgtcaagagtcgaataatggaattggcaaaaacgtaacgtttcttacacatattttttggaatacattcctctggcgagagtccggtatagggctgacagaagtcccccaaacggctacacttgcttcggctgagatagattttccaatgtttggagataagaacaatggcttttggtactgacccgacacccgacggtcttgcgaacccgccgatcgacgacctgatgaagcacgccgattccaagtacgcgctggccattttcgccgccaagcgcgcacgccagatcaactcctacttcacgcagctcaacgagggcctgctgcagaacgtcggcccgctggtcgaataccagaacaacgagaagcctctgtccatcgccttccgcgagatcgacgagggtctgcttgaggagaccttgggcgaggacgacgccaacgagggcaactgatcgattccgacaattcgtttggattgtttggacagttcgtcgccgaatgatggtttgagagttctctcacaactgattttgagcgacacgcttgcctgagttatcgcaatcagctataactcatcatcaggagcgaacaagacgtaaggctcgagccaccgcgctggttggcacgggcctttatttatgcccgcttccgcagtgacaagtaaaaattgacaccgtatcattgtgcctcgcatcccgcggggcgataagtcctgaagaaagggatgatatgacagaagaacatcggcttatctccgccgaatccgtgaccgaaggccaccctgacaaggtctgcgatcaaatctccgacgccattcttgatgatctgctggtccaggatccgtccagccatgtggccgtggagacctccgccgccaccggcgtgttcctggtcttcggcgaagtcacgtccaaggggtactgcgacgtgcagtccaaggtccgcgaaaccctgcgcaacatcggctatacctcttccgaagtcggccttgacgccgattcctgcggcgtggtcgtggccatcaccgagcagagcgccgaaatcaaccagggcgttgcccgtctgactggcgatcaggagaccgccgccagccgcgaagaacgttacgaagcacagggtgccggcgatcagggcgtgatgttcggctacgccaccgacgagaccccgacgctgatgccgcttccgatctacttggcacatcgcctcgccttccgtctgaccgaggtgcgcaagtccggtgaagtgccgcacctgcgcccggacggcaagacccaggtaaccattgagtatgacgataacgataagcccgttcgtctggacaccgtgctgatctccacccagcatgatcctgaggttacgcaggattggcttgctgttgagctgaagaagcatgtgattgacccggtgcttgatgaggtgctgggttccaaggtgccgcatgacaactaccgccagctggtcaacccgaccggttcgttcatcctgggcggcccggcggccgacgccggtctgaccggccgcaagatcatcgtcgacacctacggtggcgctgcccaccacggcggtggcgcgttctccggcaaggacccgtccaaggtcgatcgttccgccgcgtacgccacccgttgggttgcgaagaacatcgtggctgccggcctggcccacaaagtcgagatccaaatcgcctacgctattggtgttgccgacccggtatccgtcaacgtagagaccttcggcaccgagcaaggcgtgacgcgcggccagatcgccgccgccgtacgcaaggtcttcgacctgcgccccgccgccatcatcgacgagctcgacctgaagcgcccgatctacttgaagaccgccgcgtatggccacttcggacggaccgacgtcgagttcccgtgggaaaagaccgacaaggtcgaggagctcaaggccgcgattgctgcggagtgaggtgttctaattagggcagagagaccatgagaatagtgggctttccgtgcaatccactatgacgagccgctcctcgtgttcgccgcctcgaaggtgaggcgcgagcgctgattcctctcgagccgacgcatcgacgcggcccgagatggaccaaaatccagaataaccgacattcgccgctgttccgtttttcgcccaaggcgtatctctccccgtatcttgaggtgcatcatgtattgtcgcggctaactaaccggcgaaacgcggcatgtttcgcattttgggcgaaaagcccaaggcccacaggaggtattgatgacgttcgttgcacggtcggtgcgctatgtgctcagaaaacgagtgcgaaccatagtgctccttatagtattgaccatcataacggcgagcatgctatccacgatcgcggtttctcgggcagctcaacaggccgccggacgaatcgagaaggaagcggtcggcgggttcgtgctggccagcaacctgcagggcagcatgctcacgcctcgcggaggtggcatggtgcgtcccgccgacgtgcgcaggatcgcccaactgcccggggtcgattcgtatatggtccgtcagaacgccaccgccgatctcgtgggggcgaatgtggcgaaggtccccggcggcgatgattacgatgcgaccaaggagcagcagttcggcaacgccgccaacgtcataggcacgaatgattcgtcgaaactcaacgtgttcacgtcgcgcacgctcggcatggccgaaggacggcatctgaaggcctccgacaagtacacgtcgatgatccatgaggatctcgccaaagccaacgggctcaaagtcggagacacgctcacgctcaaggccaacgcctacgacgccgacaacgaatcacattcgacggcgaccgtcaagaccaccatcgtgggcatattcaagggcgacagcgccagaaaggtatccagccgagcggaactcaccgccaacaccatctacaccgatctggataccacacgcgatctgtaccagtacaaggacggcaaggaaatataccaggacgccaccttcgtgctgtccaagggcgttgacgtggagaagaccatggacgccgcgaagaaactcccggtggattggaacaactatcagatcacgcgcaacgaccagtattcgtcgagcatgctgcatgccgcccgcggcgtgcgctccatgatgcgcggcgccctgatcggcgttaccgtctcggccgtgctcgtgctcagtctcatgctgctgctgtggatgaacgaccgacgtcaggagatgggcatactggtgtcccttggcgtcggcaagccctccctggtcgcccaatacctcgccgagatgatgctgatcggtctgccgtccctcgtcctcggctggctgtgcgcgcagggaatggcccaatggctcggcaccacggcgctccattccgtgaacgcctccgctgcgaaggagctgagcagcatggggcaggtcggcggcgatcttgaatccagcatgtcggtgcgcaccctggattcgctcacggtgtcggtcgatgggaccgccatgctgtacgtggcgctcggcctgctggcggtgatgctggtgtgcgtcgcggtggcgtgcatgccgatgctgcgtaaatcgccgcgagacctgtcggagattcgatgatgagcatgaatgtgtggaagcgtgccacgttggcgatcgtacgcaagccggtacgcagcggcatcatcggtctgctgatgctgatggtcttcacgagcctggtggcgcaggtcggagtctcgacggccctgcgtaccatgtccgacagcatcggcgcgggcatgggcatagggtttaccgtcagcgccggcgagaatcccatcagcgccgaggaagcgagccggttctcgcatatccccggtgtgacgaagaccgcctatgcgacgaagaccttggcgcaggtggatggcgcgcgcccggtcatgccccggcagggcccccggctggactccgatctggccatgcaggtcagcgtgctgggcaccaccgattcctcattgtccgaggaattccagagcggcctgtaccgcctggagcagggccgccatatctcgggcgacggcgacaacgtgctggtccaccgcgacttcgcgttgcagaacggcctatcggtcggctcgacattccgtctccggcaggaggggcgcaacgccacggtgcgtgtggccgggatcttctccggcaacgtgcaggcccaaagccccctgccctcggacacttccgagaacctcatctattcgggcaggcgagtgacctccgctctgaccggcaacgaccggatcggcatgatccgatgcctgtcggataatccgcaggacctgtccgcggcggtcagtcaggccaagaccatggccggtggcaagtatgacgtcaccgacgattcggcccggctctccggcgtcctgcaatccgtgcagacggtgcgtgatctggtgcgcatggtgctgctgtccgtctgcctcgcggacgtactggtgctggcgatggcgctggtcttctggattcgctcacgcatccatgagataggcacgcttctggccctcggcatcgacaagatgcggatagtcgcacaactcgccatcgaaaccggactcatggcggcggtcgccgccctgtgttcgctgggcaccggcgccatgctgtcgggatacgtgtcttcccgactgttgcgcgattcgggcgtcgcgccgttggaatcgttgcacgtggaggccttgccgcctgagcagacggtgctcatcctgctgctcggatgcgcggtcatcgccgtggcccttgccgtgtcatgcgccgccgtgctgtccaaatccccgaaatccattctttcctctatgcgttaggagtcaccaatcatgtctaactgtctgcaactggaccatgtcgattacgcctacggcgcggcgaagatccttgttctctcggatgtcagcgcggattttgaatccgggaagatgtatgcgatcaccggcccgtccggcgccggcaagagcacgctgctgtcgctgctggccggcctggacgccccctcccggggagtggtccgcttcgaaggggaggacatcgccgcatcgggctatgcgaagcaccgtcgggagcacgtgtccctggtgttccaggaccataacctgatcgactacctcacccccgaagagaacctgcggctggtcagcgccaaggccgatatgaagatcctcgaggaactgggtttgagccgtgaggaatccaagcgcaacatcatgcacctgtcgggcggccagcgtcaacgggtggcggtcggccgcgcgctggtcgccccgggccgcgcgatcctcgcggacgagccgacgggcagcctcgacccggagatgaccgacgaggtgattcatctgctgcagcacgccgcccatcagctcggcaaatgcgtgatcgtggtgacgcattccaagcgcgtcgccgactccgccgatgtcgtgctgcgtctcaggagcaagaaactgatccgggcgtgacttacctgggccgggcggcacccatacaccgcttcggcatttcggcaccccggcgacccgctttgcgctgccacctcccttacagagggaggtggcagcgcaaagcggtgacccgcagtcgtaagactgcgaaacacacagcatcggccacaggccgattcctacagctgcttcgccacccaatcgacgatgtacggggcgacttcctcaatctggtcgatggcgacctcgaactcgtgcttgccgccgtaccacgggtccaccagatcgatctgatcttcgcggccgggcttcggcttgggcagattcgggtcgaagctgcggtacatgtgcacttcggcgcgcttgccggacggcagcatgcgcagtagggcgcgcatgtgggaggcggtcatcggcaggaacaggtcggtacggtcgatttcctcacgtgagatgcggtgtgcgaagtggtcacgcggaatctcatcaccatagccacgttcgcgtagcacgcgcacggcacgcgggtcgatcgggtggctccactcctcgtcggacacaccactggattccacgttcacctggtcgccaagaccgcgctcattaaagaagtgacgcagaatgatctcgcccataggcgaacggcagatattgccggtgcagacggtcattacggtgtagggttgggtattgctcatagctttgaataaatcctcaatcggacttcaacgggccgcacacggcccgactgtattgttggggtcgaatgaatatgaatccggctcatgccgctataaagggcataagccggattcgcatgctcacttggttttagccaagatacggaaacgataggaatcgatgccggactcctccttggcgggcgtatgccactcgcccacttcggcttcccgccacatcccggcctcgaccagcgacgccatatcgggcgcgtagctgtcggcatccacggtggcggccagatcagtcacataggctttgtccgcgaacggcaaagcctcggcgaacagctgggcaccgccgatgatccaaatctccgaacggtccagaccgtcgtccggaatcgcctcctgacgggccatatcgagcgcgtcgtcaagactggtgaccacagtggcccccggcgcacggtacatcggatcgtgggaaacgacgatgttgtcgcggttgggcagcggccggtacttgacccccagcgattcccaagtcttacgacccataatcaccggatgggagacggtcagctccttgaaatgcttcatatcctcggcacagtgccaaggcatgccgccattgaggccgatggcaccggcgcgaccttccttgtcgcgggcttcggcccagataagattcaccgagaaggtcttgggataatcgtcaccccagtcttcttcagtggcagacagcccggcagatccgggctcgggttcgtgatagccgctacggctactgtcatgctccatttcgcttactcctcctggattgcggaactgggccttagtgtagtggacagcgaagactcggggtccgtcaccttcacagtcttcgctgtccacgaaatggtaatcagcatcagaccgcaacaggtgccttaatagtagggtgatgctggtagccgacgaccttgaagtcctcatactggtagtcgaacagagaatcggccttacggatctcgatggtcgggtacgggtagggcttgcggcccagctgctcaaggaactggtcgacgtggttgtcgtaaacatggcagtcgccgccggtccagacgaattcgcccggcttgagcccggtctgctgcgccatcatcatggtgagcagcgagtaggaggcgatgttgaatggcacgccgaggaacatgtcacaggaacgctggtacagctggcagcttagcttgccgtcggccacgtagaactggaagagcgcgtggcagggcggcaacgccatcttctccacctcggccggattccacgcggagacgatcatgcggcgcgaatccggatgatgcttgatgaggtcgagcacattgaagatctggtcgatggtgcgattcgggtcctcgggagtcggcgcgggccaggaacgccactgcacgccatagaccgggcccagatcgccgttctcgtccgcccactcatcccaaatatgcacgttgtgctccagcagccagttgatgttggaggaacccttcaaaaaccacagcagctcataggccaggcctttgaagaacacggtcttggtggtcagcaacgggaagtacttcgacaggtcaaagcgcatctgctggccgaacagggaaatcgtgccggtgccggtgcgatcggacttcagcgtgccttcggtcaggatcttgcgtaccaggtcctcatagggcatcggaatgtccgtttcgggacgtgcggggatacgggagcgaatatctgcgagttgttcttcggtcaaagccatgtgcaccagtgtagcttaggggcataatagagaagtccaatgatgcgggagagcggccaggtgccgcgctcccccgctggcatggcgatgggccagatcgtcggcggctgaaaataaaggagcagctatgggtaagcgactgtgggttgagcgcaacaaagacggttcgtgggatgcgttcagcgacgatggcgcacacattaagttcggcaaggatcgcggccagttcacgccgggcgatctgatgaaggtcgcgctggccggttgcgccgcgctgtccagccagttcgccatcgaacatacgctgggtgagggcaagggtgccaagattgtggtggatggcacgtacgaccctgagaacgacgcctacaccggtttcgaggagcaggtggtgattgatgcttccgacgccggtctgtccgaggaggatgccgacaagctcaaagagcgcgtcacccgccatatcgacaagggttgcacggtcaagcacacctacgtgcaggagaccccggtgcgcatgaacgtcactgtcaagcactgaaacgggatatatacggaaagaggctcccgctggcgggagcctctttccgtatattcggactttactggcgatcgggatcgatggtcttctcgatctgctgggcgacttcgggctcggctgcggacaccggaatctcctcgacgccggcaatctcctccagcgacttggtgggtatctcggcgggcgagctcggtacggtgtcgagccgagactccgcggcctcaacgtacttgcgcggcaccacgtacaccgggccggccgcatgctgcagcagtccctggctggtggagcccagcagcaagccagtgaagccgccacgaccacgggaaccgacaacaaccacatcgtgatcgtagctggccttggtcagtgcgctgacggccgggccggaaacgatccgcttgttgatcttcagatcaggatgcgattcctgcaacggcttgatccgcacctcaagatcgtccttgtaggactccatgacggcgtcctcgccatccacgcccttcatgttcggcacagcggaaatcacgtccagttccgcaccccagcatgtggcgaagtcagcggcgatatccagtgccttcagaccccacttggattcgtcggagccgacagccaccttggtgattgtgttgttcaggtgcatcaggttaccgtcatcatcggtgtacggcaccaccacaatcgggcagtaggcgtatgccggcagcgacgaggacgtggtgcccagcagacgctcggccagaccgcccttgccacggttgccgatgacgatcagattgtagttacgcgacagttcgacgaacaccgatgccggatctccggtaacaatcagtgtggcggcttcgacgccctgctcgtctgcgatggccttggccttggacagaatctcctgagcatcggaatgtgcggcgttatcgtcccccatcgccgtgtaggtggcatcgaacgaaacggcggcatagctcggcagggaatatgcgcagacgatctgcagcgtcagccccgcgtgctttgcataattcgcggcccaccatgttgccttgtaactggcatgcgacccgtcaacgccgacgagaatggccttgtcgttaatcatgacgacctccttgaaggtatccgcggcacgaataccgcgtatctccaacaataccccgcgacactcggtttggccggtatcctccgctcaaaaagatattcgtgtatacgaaaaaaggcacatcccaaaggacgtgccttaatacgaattcgcttaccgcataattcttgtcacatcacgcggcgaatggaatatccagctccaccgaatacggaaacgccgcttactgccgttccctgcaccgggttcatagcattcatcacctgtccgttaccgatgtaaatggccgcatgagtaccattcgcaagaatgtcacccggcttggcatccgccaagcttgcgatcggagtacccacagtggcttgagcaccagaggttcgcggcagggagatgccaaactgggagaagacgtactgtacaaaaccagagcaatcccatcctgccggagtgttgccgccggcaacatacggatagccttggaacttcagtgagaagctagcaagctcagcgccagtgccagtcatcttacccaagtcaacctgtggaatcgacgcacgctgttcagagcggctggctgccgcagcagcagcggactgggctgccgcagcttcatcagcggctttctgagccgccgccgcagcagcagcttctttctcggcctgagactcggtctgtggcacatcaagagtctcaatgccaccccatttagagttcttgtcaaccgaagtggaggtggcttcggcgaacagattcttcttcaccgaactcgtcttcgggaaagaacgtgaggacaccacagcactcgtctgcgcggaatcggcagaggcaaacggggctacgcatgcaaacatagcacccgtggcgataaccgccactgatgtggaaataatattcttaacgttcgtcatcagcgccttaccttagcacacacgggtcgattttataacaggaacatcatttcgaagatgatgtcgcgggtgtatcactcggcaggagaacgcaacaggcctcgggtaccgattggcatccgaggcctgcaatatatcaatcaataagactacatcacgggatacgcaccacgatggtgagcttttcggtcatggcactagcgagagccacgctatggccattccatccaccatggaccgcctgaccgttgccgacatacaacgccacatgatcgtagtgtgcaccaccgttccatccaccggtgttggcataaatcagaatatcgcccggctgcagggacccgtctgtaactacgtggccaccaggaacattgacgtactcttcaggccaaccgtggaagttaatgccacgggccgccaacgcttgactgaccaatgcggtgcagtccatgctctgtccgatcaacgagtaggcacggtcaacggaagcagcggcaccagcggaaaccgaaccactggcatcggaataagtaacagaagagcgagactcattacggctcgcggcgttggcctgatcccgagtcgcctgagcctcggcctccgcctgcttcttggcctcctcttcggcaaccttcttggccgctgcggcatccttttccgcctgagattccgtttgcggcacatcgaggttctcaatgccaccccaatcagcattgtcctcaacgctcgtggcagtggcttcagtcgtcagatctttgcgcacctgggtatacgaggggaaggacttggtggaagtcacagtaacaccctcagctgcagttgccgtaggaacaaacataaacaagcaagcacaggagacaatcgcggcaacaatggaagaagctacagttctagtcttcatagaaccatcaccctacacggtgcgcattaactcgtacaggatggaagaaataaaacaccccggagctattgggatatatcggcgtgtcggcataggtcagttcggactaatacgcgtccgcaacatttgcaatgtcatttcgcgcgaacgattgccgatagggcgacgtcacatccgaacagtaatcatcgaatgtaagccaatgaaatgaatcagtagtgaacgtactggagcttaccggcttcggcggcgctgaacgtacgggtcgaaatcacgcccaatcccttggcattggattcggagatctcaatggagccgtcggcattgatcttttccagaacggcaacatggccgtacgtgccatcggcattggcctggccaggagcgaacaccacagcatcaccgacatggcgaggagtgttgtccacccaatagcccagagcggaagctgacgccgcccactcgccaccattgccgaagttgccgctggaaggcagtcccagttcggcacgacgctggtacgcgtaccacgtgcactgaccccacggatagttgttggagttggtgccaacggcatggttcgggttgaagccagccggcacagcatcgccatcgacatccatgagagccgacaccacaggattgttcgcattattgcgattcatcagcttggcgtccaaggtgctgtctgaattgctcagcccccaaccgccttcattggtggactgtgcggtaacggaggatgaactcaaatccatacgtgcttctgaacgagaagccgcagtcacatcgctgatgcgcttaatctgcgtggtcgtcgtggccggatcagccacgaacgggttcgcggcgtcttcagtgttggaaaacgcgagagcgcctgcggccgtgccgaccagagcagccagtgaggccgaggcaagaatatggctacggtgttcagcggcacgagcggcctcacgaatggaacgacgagtctggggagcgatttcgttgatcttctcggcaatggccggatcaagccccaaaacaacagcgtcgctaccagcggattgcaccgcacgcacagcacgaacggaatgagaacccttgccggaggcaaacagtgccttcgctaagctgaacttctggcgcgagaccgtggtcgctttatgcgaagcatgcttcatactacgttaactccttggatgggttcggcggggtcattgcgatgacctcgtatgaccgtcacgattgagtactgtacaacaaacagaggtcaatcctcaatgcgattccccgccatccaggcgtgtcaaacgatttatgtaaccgcgcggcagggtgaaagactgccttgtttccgcccgttcacgaacctcactatccggttatcggaagaatcactaactcatgtcattccgacacaccgtagccatgatgtgctgcgtacattctgcactgcattccgcattgccaccactgccgcccggcaccccggaattccgcagtagccccgcagtaatcccgcacaccgagcattatccgcgatattccccaacactggtctacccttgaaaccatgactatcacactgagtattcccgagtcgctgaagcccgaagatggtcgtttcggctccggtcccagcaaaatccgccccgaacagatcgccgcgctcgatgccggcgccaccaccctgcttggcacatcacatcgccaggcaccagtcaagcaactggtcgcttcgattcgtgaaggtctgcgcgagttcttccacctgtctgaagggtatgaggtggcgcttggcaacggtggcgccagcgcgttctgggagattgcctgcgcttcgctgatcacccgtcgcgccgccttcggcacgtatggctcgttcagtgccaagttcgccgcgtccgccgcgaacgcacccttccttgaagacccggtgctgttccccggcgagccgggcacttaccgtctgcctgagctcaccgagggcgtggacacatattgctgggctcacaacgagacctccactggtgtggccgccccgattcgccgcgtggccggaagtcgtgaagccggtgccttgaccgtcatcgacggcaccagcgcagccggcgctttgcctgtggacatcagccagaccgacgtctactacttctcaccgcagaaggccttcggtgccgatggcggtctgtgggtcgccatcctctcccccgaagctatcgatcgtgcggcaggcgtcgaatcaagcgctcatctggaaggcgcacatcgctgggtgccgccgttcctctcgctgaccacggcactgaacaactcccgcaaggatcagaccctgaatacgcccgccgtggccaccctgatcatgatggaaaaccagattcgctggctcaacaacaacggcggcctcgcctgggccaccacgcgttgcgccaagtccgcatccatcctgtactcgtgggccgagcgctccgaatacgccgctccgttcgtcgtcgatacggactcccgctcgaacgccgtggtcaccattgatctggacgagcgcgtccaggcctcccagatactgtccatcctgcgcgagaacggcatcgtggacgccgccggctaccgcaagctgggccgcaatcagctgcgcgttggcgtgttcccctcggtggagccggctgatgtcatggcctttaccaagtgcgtcgactatgtggtcgagcacctgtgatggaggtctatgcctcgtatggccgaccatatatgccatgcacattgatcggtctcaactgataccgattgaataaatcgtagggagggatgtttgacgcccctccctactcttactacagtgcatgagtatgaagttcgcgcctctcattgaccctgccgtccgcaagcccgcacccaagcccgtacgggtggatctgcgtaaggtgtttgccatcggtaccggtctatggattgtggcgttgattgtcgtgctgattctgctggccgtgggctacagcgtaatgccgttggtgattatgtgcgtggccggtgtcattattggcttgctactgctgatttgggaatacttcgaccgctgggactaccgccgcctcggacagtaatacagttcactgcgccaacggcaacgtcaggctgaacgtactgccttgcccgggcgcgctccatacagtcacatcgccatgatgggtcagcgccacatgcttgacgatggccaggcccagtcccacaccctccgccgtgcgattgctctgttccgcaccccgatagaaccgctcgaagatgcgcgcctgatccttcttagcgatgcccgtgccttggtcgattacgcgaatcaccgcacggtcgccattcttgtctttggatgcggacacgctgaccacgccattttccttggaatagccgatggcgttttcgatgagcttggtcacggcgccgtcgatctggtccgcttcaccattgatgactagatcatcgtcgcccttgatgttcagctgcacgccagcctcggctgcctgcggctctagtcgcgccgccgtggccctgagctgttccataacgttcagtcggttggcggaagacggcgtaatcggctcctgtgcgcgtatgagcagtagcaaatcggacaccatatggttgagcttgctgcagctggaacgcacctggcgggcatcggcagccacctgctgttcgtccagattgccggactccagcgaatcggcgagtttggccagagcttcggtggggcccaacaattgctcggacacattggtaataaacgagtcacgcacttgagcgaaacgaatcacgtcactgacatcggtaatcaacacgataacgaactgctcgttgatacgccccacagtcaccttcagccagttggggcggtggacggactgcgtggcgacgtgatcgcccttgttctgggccacgacgtaccgctccggagtatcggtggtcaagtcgaactggcgcttgccaccggacttgcgcgcctcgtgaatggcatccagcacctgctgctgggcaatggcgtcatccgacaccacacccaggcggtaggcggcgggattgcagcggaccacctcgtcgtgctcgtcgaccaccacggacgcacccggcagcatggacagcagcgtggcagtgtcgtcggacagatcgtcattatcgtcatcatcggccagcggcgattccacgtacactcgatgtgtcgcaaatcccacgatgagcgtgatgattcccaccacaaataaaacagccgcgacaataagagcaatcgcggcgacgagcggcatctgtgtcatgcccccattctttcacaccacacgctgggattgcggtttcccggcacgccggtaacatgaatttcaggtgaacaacccaatgaacagtagaacaacttgaggttgccattacctacgttgaagtggggagcaagtactggaataatacactggtacaggttgcagtaagcaagcatgaaaggctagagaaatgcgcgttattttcaacgaggagctgaagcaggttgccgatgacctcgaccgtatggcgcaggacgtgcgcaaggcgatcaacggcgccggggaagccctgctgaaccaggacattgaggccgcacagactgtgattgacggcgacatcgagatcgacgccctggagtcctccgtgatcgaccagtgcgtcaagcttctcgccaagcagaacccggtggccaccgatctgcgtgtggtcgtttccaccatgcgtctggcttccacgttcgagcgtatgggcgatcttgcccgccacgtggccgaggccgcccgccgcacctatcccgccgccgcgattcctgaatccgctcagccggtgttcgccgagatgatcgacttcctggacaacaccgctgaccagctggtggctatgctctccgatcgcgatgccaagaccgccgaggccatcatcctggccgacgacaagctggacaacctgcaccaccagaccttcgatctggcgctgtccgatgacatcacccgccagcagaccgtggacatcgtgctgctgggccgtttcctggagcgcctcggcgatcacgccgtgtccgccgcccgccgtgtggtgtacatcgtctccggtttcgaccccaccaaggaaccggcccgcgacgagggcaccgacatcgactgattggtggcctgtcctcacattgggcgaataactgaacacttgtcctcctatggtttgaggaggatgcccgaaagcggcgatccggctacggctggacgccgttttttgttgcttttgggcggtacaccggcgtatccatggggcggcaaaacacccatagggcggtaacttgcccatggggcggtttgaaggatatgtgaaaccgcggaattaagccattctggcataccgccccatgagggttttaccgccccatggggtgatcaccgccccatggggatttggcaggcatagcaaaggggagccgcacgttatgtgcgactccccttacagcttgtaccgtgttagcggcttaggctcacttctggccctgagcggcgacagcagcggcaccggcagcagcagcctccgggtccaggtactcgccacgcggcttgatcggcttgaagttctcgtccagctcataaagcagcgggatggcggtcgggatgttgaccttggcgatctcttcctcagacaggttgtccagcatcttgacgatggcgcggagggagttgccgtgggcagcaatcagcacggtctttccggccttgagctccggctcgatagcggactcgaagtacggcttcacacgctcaacaacgttggccaggcactcggcttccggaaccggatcgccggcatagcgcgggtcgttgttctgggcgtactggtcgttcgggtcgatctcgggcggcggggtggcgtaagaacggcgccacagcatgaacttctcatcgccgtactcttcgcggatctcggtcttgttcttgccctgcagagcgccgtagtgacgctcgttgagacgccagtcacgctgaaccgggatccacagacgatctgcggcatccagagcgatgttggcggtattgatggcgcgacgcagcagggaggtgaacacaatgtccggaaggacgttcttctccttgagcagctcgccgccacgcttggcttcggcttcaccctgctcggtcagcggtacgtcgacccagccggtgaactggttggttttattccatgcgctctgtccatgacggagcagtactagtttgtaggtcatggttgccagtctaccgcctcgcacacccaaagacgagtgttttctcgattattcgagttatgtttatgcaacatctcacattccgttgcacaaccatctgcgttcagctacggaaacatcaccatcagggcaaacataacggtatcccattcatcattcccgacttaccggaatactcgcataaagaatccattcgccatactctttgctggtgttgggcacacctccgatactgtcaatccattgggcatgcatccgcagaccattcccgggtccccttgaaccacgatcttcggaattatcgaccgtcagatttgcaatgccattggcctgtgtgatgattacctcatcatttttttcttcgatagtcagaaaatacggaacgcctttatccgcatatctactgatattggtgtagatctcagtaatcagccccgatatccgggctctcacggcagctagaacacaagctgttccagctgccactttcgacgttccgccaaatgctctatttatttagaaatacacttcggagggtgcgtgatcgtctcgcccatcagcatcaagggcggggcggcaaaacgaccgttacggcacttcgacaccaggagcgccaacgaacggcttgtgttcaatctgttcggcagcttcgcccagttcgaacgcgacctgatcagcaaacgcaccaaggccggactccaggccgccaggagccgggaccatcagggaggccggccagccgcgctcgacgacaaacagcgtaaagaactccgacggctccacaggaagggcgaccttaccatacggcagctatgcgaactgttcgccatctccaaaaccacactctaccgaaacctcaaacaataagctgattggttccatgccgtgaatgaaaagaattataatcggtcagtgctatgagacgcttttgaagcgtatccctccgtggcctatagttatagccggagaggttcgcattaattcagtctacggactatcgcgttcgtgagcaacagacgcgctgttcatgaactgtataatgcccgatggcctacgcactttaatccgggccggattctgtcatgacattcagcttacttcctatggcattgattctggatatgtcgaggtggcgttgcgtagactactcgttcgcggttacatactttattctaatcctcgcggagatgagcatcctggcacctcgcctgtcggggaggctgctggcgaccttaagaccaatcttccggttcaacctttcaatcatgttgttgaaagcgtattctgcgccggcgctcgggcaagtaacagccgggaaacgcggggccgctacgtcgatcgcccctgaaacagaaagccgcctcccagtgcctctgaacatcaaatggtccgacttcgtccgtttcctcacaatcgtagagcttgtaatccgcagccatatccaatatttagatgacagatgatgcttaatagcccatttcttttgcatcggaatattcctacacattggccatctgcatgagcttccccgttatccatcgatagtctagaacaattattttaattcaatagacaaattcatgtcggtaaaaccgtatgaatttttgaagcaataagactgtatcttgtatttatatagtgattcgctttggcgcgttacttgttccagggcttttctcaccagcgggtttccggagcatagatgctgcgcagccccaaaggagtatgctcttgcagtgttctcaaggttaaatttttccggatcgggaaaaacttccgggtcgcgattaatgctgtataaatcaaaaattaccaactgccttggtctaataattttttccttaaaaggtatttcatgcacgcatgtcctgcttattgtcgtgaatggagggaacaaccgaagactttcaagggatatttgccctgcttttgcattgagctcttcctctaaatatgggtgagtcaacagattgaacgccaggaaatcaagcgcagctacgaatggggcaaaaccatcggttactagattaatgatgaggggatatcgtgtctcctgaggcaagtcaagcaattcgttgcctatgtacagcggctcccctacatgcttatcttcgatttctttgacaacctgatacgcgtattcgattgaatgcgcgacttgttcgatatcgtctagcgtaagccgttcgcgcagtaagaacgagttaatggtttccgatgccgagaccattcttgaaatgtcttctacagagacacccaccagttgagcaaggataccgtacacataaggccttgcatactctgtagtgaagtcacaatttttattgatttgcggccatgtgtaatttatggcgtgataacgagtattaatgattgttcccactaggcgacgaagctgtttatgagactctccgtcggtgaacataacccagttggaataaaaattctttaatgtccgtatagtttctatcttcagagggagtttatctatgacagttttagtgttggctttgagccgctcatctcttatcaaagtatgaaggttacgcacattgaacacaaaccatgcattaaattcctcgtcgaatagcagctgatctgtatttccggcaaggacggttttgtaaaatttgaaccgatcttcaccgagacgttttccaattatcacttttatctagtcctttcttagatttgcgattccgcaaaaagtactgttgcctcgtgcagtgtgaaattagcttgcttgtttgctgccaagtagaaatcgataaaatctattaacttgtcgggataatgccgattggggaatttctcgtccaggaaagcaactatttcttcaaacagcaaggaaggaaaacattgattttcccctgattcttttacgaaattcagggctatcaatcgaagtgtctgcatatccggttctttcaattttaaaaaactaaatcttctttcgaaagcaccatcagcatacaaggtcgtagcctcttcaggtgtagtcgcacctacgaccttgatatcacctctcgttataataggtttcagtaggtttgcggcggaaatacctccttctgaagcaccggcatgaataagggtgtgaatttcatcaaaaaatatcgtggaaccctctttctgcgccgtctcaagtacatgttgcatgcgtttttcaaattctcctctgtattttgttccagagagcatttcggcagccgatacagatatcagaggaagatgatgcgatttgaagtagtatagaataagcgatgttttgccaacgccaggttctccgattagaataacgttattcttgtatcttctgtttaaatatatatccagtagttgaagctctttttctctaccgataatagtttccatagaatttgaactagtcagatcttgtggaattctaattgacttgagaagagcacgcgcatcggattcgattgactgtagatagacaaggatatctcgcggccgtgcattaggattcgattgaagatacaaatcaagtttgtgatccagatacggcgaatcatgaagcagcttgaccggtatcttacctttcaactgcgggtcagatatgccgtcgttcatatccgttaggatttgtaggaaagtttgactcataatatatttacttactgaactgtccatcatggaatgaccagttccaagtgtcgaggacgatttgtctctctactactgatggatccattagcttgcctatatacttaatgatttctacttccatcatcttggccgcaagagcgttatccgtatctacaatcgcggtctcacgatactcgttgatgcttgccactttaggattggaggtatctacgtaagaggacggtacaagttctgaatatgatttggttttaccgggaataatcaagggtcctaaaaatattttgctatcggcgtatggccctccatataggacaggggtgcctgatagtttactgaattcatcaacaatatatacaagctttccgagaggcttgtctgcgcaaaccgctatcaggtcaaactggtcactttttagttcttccgttaaggaattgacactagtgacttctaaattatggccgacgaccgttgcatccggagcgacctctgtcaagtttttgacggccacttcaatcttggattttcccacatctttttcgcgataaagaacttgtcgactagtgttggacaattcaatctcatcaaaatcaataagatgtagggtgcctaccccaatctgcgccaagccaattgccagatacgaccctataccaccagcacctaagattaaaatcgatgcggcatcaagtctctcctgctgtttgattgcatcatttatcgtaaagttgggaagaactgcgtagtttcgtagttgacgatcatattttgcaagttgcttgggtgtgagagtggtatctaaggcggtgatatccttgtattcttttatgacattattctcgaataaacgttgcaccaaagatgcaatatcgtctacttcataaggagtatcaagaagagcagtggacacatcatcaacagtggcgggatttttaaaaatattcaaaatcgttaggataacgtcactgtccttctcttcgaacatgacgttttcctcatgtggcagggcaatatgaagacgtttactaggcgtcaggtgggcatatgccacttcattaagaatatattgtttccccatgttattctacctttcaatttgaaaagagcgcgtactttgcttgtacgcgctctctgatccggctaggcaaaaatgacggcagcgcgaacagcagtatcgtcttcttcgctcgtcttttctacagcgacgtttttagccgagataatggtcttttccataattcctccaactgatatttctgccccgcactctgcgagacgacacgatattagctctatagcaaaagcgccacgtgagttttacttattcaatttttttatatatggctcatattctgggttaagtaaagaaaagtgtgtcttaaatccagggtggggcttactcccgtcttgcgtgtcggggtgtgattaacgtttccgtcgttaattcgtccgggtgcttgacttttcgtgttgacttgttccatgagcaagaacaagtcctcgagggcgaggaggtgcccgttgtgcgggcgcgcgatgcgcaggaacggtttcacgggcgccggctcgcaacggtggcggtgcgacggctgtcggtcgagctccacggcgaggcgggatgattcgagacgcatggcggagttccgcgcgttcctcgcgtgggtgacgggcaaggagtccatgggcgaggccgccgaacggcggtggatggacgtgcccgtgcagcgctgcctggtgcatgtgttgcgcaacacccgcgtcgacctgacgaacaggcccaggggcgaggccggcagggagctgctcggactcgcccgcaggctcgtcagggtgacgacggccgacgaggccgccgcatggctcaaggagctcaacgactggcacggcaggcacgacgatcacctcaaggagcgcactgtcgccaaacaggatcccatgcacgcgaggggacgcaagtggtggtggacgcacgaacgcctgcgccgcgcctacttccgattggtcaggctgaaccgggccggcgtgctgttcgcgttctgcgatccggccgtcctcaagggcggcggcccactgccgtcggcgaccaaccagctggagggcggcgtcaacgccgtggtcaagcgcgcgctcgaccaccaccggggattgtcggaggagcatatgagacgctgccgcgaatgggcgatctacatgctcacggagcagcccgaccccatggcgctcgtcacgcctgaacactggaggatgaggaaggggaagccggccgggaatgacgggcccatgcccggcaccatgacggccgtgcaggaaccgaccgacggcgtcgacgcctacgagagcgggttcgggatcagaaagggatgggccgggcgatcaacctgaccatgacacgcgggaatagacacacttttctttacttaaccccatatgattccgtccaagtgtttatccggtaatatctgaaccagtcgtgtttctcaatccaaaagactccggaaaatgtctacgttaagcctatgtgctgtttctctaggtgtcagaatcctctaagccgacagtcctttagattaagtacgtccgctcggaactcttttcgggtgcacacagctgtacagaaagattataaagagattcatcgggcatgatgcatgtataaatgctcgtgcttggcgttgtcctctacaggtaagatactagggcctcatgcaatcaggcaggggaggatttatgattaagcaggatacgttgacccgcagggccggtatcgcctactacgtaagcaccgcgttcctcatagcgtccaagtcgttcccccacgccgtcctgaccgtgctgctcctgcacaagggtctggacctcaccgagatcatgttcgtccagacggccttcaccatagcggtgttcctcttcgagttccccagcggcgtgatctccgacctctacagccggaagatcgtgtacctgacatccatcctggcgtgggtagccgcatgctccgtcatcatcttcggaaccggcttcgctatgatgtgcgtggcctgggcgctctacggcatcggcgaggccctggcgtcgggcacggtcgacgcctcgctgatcaacctctacaagcggctctcccctgacccggacgaggagatcaagacattcaaacgcatctccaaccagatatccatggtctccatgatcatcggcgcgatgctcgggtccgcactgtatttcacgatcggctacaacatctacgccgtcgcgatggcgcttgcatgcgcggcggccctgccgatcatgctcgccttccccaaggacgagcacgacgcccgggagaagaagccgacgatcatgtcccaagtgagggacggactgtccgaactcaggaaggacaggcggctcacgttcctcatcggcatggcggccgtgagccagatcttcttccagacccacttcaacctctggcaggcctacctgctcctgatgggagtgaaagacaagtacctgttcgtgttctacctggtcttccaggtcatagggatagccgcgtacgcgattcacatagacggccgtctgaggcgcctcctctatcttggcatcccggtcgccctgatcatgcccctgctaatcacgtcggaatcacggatcgtgtcgatcggcgcatactgcatctccgtgttcatcttcatgttcctgcaatacatgtgcgacgtgctgttctcgatacgggtctccgaggaaagaatcagcaccctgatcaccctcaactcgacgacctgcaggatcatcggcttcctggtgctgggactcaacggcctgctcctgaaacagataaaactcaccaccctgatagtgggctccttcgagatcgcgacgttcctctccatcctcctcggcctgctcttcatgctcagtttctcaaagaaaaagaaggaataatacggggctgcgaacgttttaactatacggttttgttgccgcaattatagtgcggcaacaaaaccgtatagttatttgccttataatcccttaatctctatccacttgccgtgtaacgataaccatcaagtacttggtttataaatctgtcagtgcgtccgtggcacgataggacaacgtgaatgtacaaacaagcagagataagcccaacacctgatgtctgacgactgtttgttgaatccccagggcacgttttacgcggatcttagctggataaaaccagccggaatttgtacgtctgacatgccatttacagactttggcaacactggctgcgagcatttatgaagttgactgtcatcccttgatagatgtaccagctatatttatgatttctttcgtttgcctgacgcgtcgctctgcgactcggtcttacgtgtatcatatcgttcctcgcttcggagaccttggccttcctgcatgacaacaaatagtggcggcgggctggaatcgttgttttccgacccgccatccactgccccggcatctcaccgcctaaaccaatatcgacgaagtcacgtagaccagggcgagcgccagcgaggcaagtgtacagagcggcagtgctttgcggtaggtttttcttacgattgcgcatgatgcggcaatttgcgccgcgcacagcatggcaataactgcgattatcacgattagcggaatgctactggttgcatatatcgacgattgcaacagatggtgcaatgcaagcaatgtcggaataatcaggattacgatagtgacgatagtgccgtttcgcagccccattgcagtcatccacgtatgttttccgtgattgcggtcagattcgatgtcgcgcagattgttgacgcacagcacagcaaccgcgaccaatcccgcagctgaaccgccaagcagtccactcgccgaaatcttgccagacaacgcgaacatggtgccacaagtggcaaccaatccaaagaaaatgaatacgaaaacctcacccaaatagtggtagccgtaggggtgtttcccaccaacatagaaccagccggccgccagacatgcgatgccgaccagaatgaaccaccagtatccggttagcgcgatgacggccagaccgcacaggcaggcgatcagtgcgttgattccggccgcggccagcactttcctaggattcacaccggaagccacgagacgggcgggaccgcgtgacggcattgttttgccggagatcgcagaatcgcctgcgtctttcaccggaaccgagcgccctgcatccgtaccgcgaataccatctgaataatcgttggcaaaattagccgcaatctgcagcagcaatgccacgaaaccgcacaacaccgccaccgcaacacgatgctcgcccgcatcgcgccaagccatcgacgcaccaatcaacaccggcgcaatcgacaacggcaacgttttcagccgcgccccacggatccaagtcgaaactctcatgaacgccattttagaatcatgctcattgcataccttcattcattcccagaataggagatatgatactggcgaatgccccggaacgtcactcatgagaaatatcatgaaaccccgaggattttcatctaaaaacgcaaaggccgtctgacgttggaagtcagacggcctttcatgaaattacgcgcgaagccgatattgaattaaggctttgccttaattcagcggcttgaccagcgggaaggtgatggtttcgcggatggtggcgccggtcagggcgatcagcagacggtcgatgcccatgcccatgccgccagccgggggcatgcccacgccgagggcctccaggaagtcctcatcgatgtcgcaggcctcctcgtcgccggcgagcgcgtccttggcctgggccacgaagcgttcacgctgcacgaccggatcgttgagctcggaatagccggtggccagttcgaagccacgcacgtacagatcccacttctcgaccacaccgggcttggtacggtggcccttgaccagcggggaggtctcgaccgggaagtcgcgcacgaaggtcggctcgtacagcttgtcctcgtagaagtgctcccataggtgttcgacgagcttgccgtggttctccacgtcgtcgcgttccacgccgagcttgtcggcgatctcgcccagatgctccacggaggtgccggggttgtccgggccgccgttcggcacgatctgctcgcccagcgcttcggacagggagtcgtacatgctgatggtcttccattcaccgccgaagtcgtattcggtgccatccagcaacgtcaccttgtggctgccgaacacgtccatggcggtcttctgcacaagctccttgaccagctggccgatggaatcgtatgtgccatacgcctgataggcctcgaccatggtgaattcgggggcatgggtggcgtcgacgccctcgttgcggaaatcgcggttgatctcgaacacgcggtcgatgccgcccaccaggcagcgcttgaggaacagttccggggcgatgcgaagatacaggtcaaggtcgaaggcgttcatgtgcgtggtgaacgggcgggcggccgcgccaccgtgcagggtctgcagcatcggggtttcgacctcgaggaagtcgtggtcgtcaaaggtgcggcgcagggaggccacggccttggaacggttgcgcaccatgttgcggatgttctcgtccgcgatcatgccgatgtacggcttgcgggtgcgggtgtcttcgttcaggtccttgtgcagggccggcagcggctgcagggccttagaggcgatggcccactcagtggcgaatacggacagctcgccggtcttggaggcgatgacgcggcccttcaggtacaggtgatcgccaaggtcgaccagctgcttgaactgtttcagggagtcggcgccaatctccttcttggagatcatgccctggattttggtgccgtcaccggcggaaagctgcacgaagcacaggccgcccgcgttacgcaggaacagcacgcggcccgcgatgccgaccatgtcttcggtctcttcgccagcctcgagcttgccgtcatacttggcgcggaccgcctcgatggtgtcggtgacgtccaagtgcaccgggtagggggcgatgccggcctcaagcatcatcgcgcgcttggccacgcgcatctgcacctgctcggggtgagccagcgggccgaactccttgttggaggggtccacggcttcgtccagcgtggcaccggacttgatcttctcgcggatggtggcgtcctgcttgagcagcatttccgcacgttcgacggtgctcatctgcgggacggccggggtttcgttctcagtgttttcggtattttcgacaacttcagccatgattcatcagtgtacgcaaggccggcgattatgagcccggcagaccgcacggccatctgaacacccgctcacatgacgcaaaaccggctctgcacaaggcttgagagacctgtacacatggcgaatccatcatcacgcaacactcgcgacatgccgatttgcattgtccaccaccacaatgtaatatctacgtctgttgccaaacgggctgtagcgcagcttggtagcgcgcttcgttcgggacgaagaggccgcgggttcaaatcccgccagcccgacaactggaccggattgttgaggaatcagcaatccggtttttcgtttcttgccccaacaatcaaaccaagcgatcgaacagcggtaaacaacccgccgcacacagcgacaaaccggcgcggcaagccccgtatttgttggcggaccaccgtaatatatcgctcgaatcaatcgattgccgcactgtttttgtaagtaatactgaagtagttagaggaaccatgaagaagagtctgcttgcactggcttcgggcgcgttcattctcggtgccgccgagttcgtgatgatgggcattctgccgcaggccgcggccgccaccggcgtggacatccccaccgcaggccattacatttccgcgtatgcgatcggcgtgtgcttcggcacgctgattctggtgttcggccgcaaggtgccgccgaagaacctcatcatattgtttatggtgattgcgcttatcggtaatctggcctccgcgttctcggtcaatgccgccacgctgattgtcgcgcgcttcattgccggcctgccgcacggcgcatttttcggcaccgccacactcatcgccaaaaccttggccgacaagggcaaagaagcacaagccgtatcggtaatggtcaccggccaaaccgtagccaatatgctcggcgtaccggcgggcaccttgatggctgagttcctatcctggcgcctcgcattcggtattctggctgcatgggcggcaatgaccatcgtgctagttctggcatggatccccttcgttgcgccgattaaggacgccggcatcgccggtcagttcaaattccttactcgtcgtggaccgtgggtgattctggccgccgtattcaccggcaacgcaggcgtgttctgctggtggagctacgtctccccctggctgcagaagaccggtggctggtcgtctaacctggtaccgctattgatgatgcttgccggcttcggtatggtgataggcggtcttatcggcggtcgcatcacagataaatggcgccacgccggcactgccgcgctgggtcagacgatttcctgcatcggcttgctgatggttttactactgccgggaaaccagggcactaccgctttgctgaccttctggatcgccttcggactgttcttcatctccgctccgcaacagctgctgatgaccgaagccggccaaggcggcggcgagctcatcgccggcgcagccgtgcaggtggccttcaacttcggcaatgccatcggctcgattgtcggcggcgcgatgctcaccaccttctcgatgaactatcgctataccggtctgggcggtatgccactggctctgcttgccgtagggctgctggccttctactcgtggcgctgcgaaaccgataccgacgccattcaccgcatgcgcgaaatccaagtatgagaccggacgtcacattcacgcataatcagcggaatgtgacgttgctctcttcttactgaagttcatctgcggttcgttttcattacacacgtattccaccttgcctttctaagttctcactatgaaagagcgtctttcctgatgcctcataaaggaagggaatacagtgaaacccatcaggttcacggcgaggatgatcgccgcactcgtcgcaatcgcgacgctgtccagcgttgcgattgcgaccacgacggcttctgcagatgaatccgtaccggcagcgtccacggtcggtatcagcggcatcgccgccagcggcgccacggatgcgttcagtgaaaccaagtacgcggccaccaccgaaggccgttacgaagcctcggtcgacgcgaatgacgtcaccggctatgcagccgttccgcagacgcgtgcggccaagccgaatcttgtgcagctgcttggcgaatatgacagctactggcagccggccaccgaaaccgctggcggcaaggtgctcaacaagaccgtgctcgatcacgatgacgcctacatccaacagatcaacaacgccgccgccgaagacggagacggcacgaccgctaccgcacagcagcagcgcgctctggtggacgcggatatgagcgccgatgagaccttgccggactccctgggcccggtgctcggcgaatatttttccgccggtctggccgacggcagcctgaagaaggtcgcggacatcttcaagtacgatacaatctccacctctaccgccaagaagcacttccagcatcctcgtcctttcgaggatcgcaccaatggcggcaagaacgacatcacgaacatcaacgagaacatcatgcgcgtccccgactggactgacgcccaaggcaacgcgcattccgccgaatacgacgggctggccggttccggttccttcccgtccggccacaccaccggcgcatactcctggggcgtggctctggcaggcatgctgccacaacttgctccagagatcctgacacgcacctccgaagcaggcaacaaccgcatcgtgctcggcgtgcactatccgctcgacatcatgggcggccgcatcgacggcgaagtggcaaacggctactactggggcacttactacgacaagtacgtcaagccggcatccgaccagctgcagtcctatctggcagccaagtgcgtggcggacggccacgccaccaaacaggacaccgattacgcgactgtgaccgaatgcgtgaacaaccttggcgcgaacgcctccaacggttaccagaacgcctttgtggatgccgtgagcaaggagcccgtcaccgaccgcgcctcggcgttgcgcgtctacacgaaccgtctgacctacggtttcggcaagaccaccgccggcaccgcattcaccgcgcctgaaggctctgccgacttgttgaagatcgcgtacccgaagttgcaccgcgaccagcgcgaagccatcctcgccaagaccgcgattgacggcggctacccgctggattcctcatccgacggatggcagcgcatcaacctagccgcagctctgagctccaccgtgacgttgaacgagaacggcgatgtcgtcaaggtcgagcccggcgcagccaccccgtccgtgatcggcgaggaatacgccgacaagggcaaccacccggattccgacaacggtggctccggcaaccccagccaacccggtaaggacgccaagcaagtgaccgtgttcgacatcaccgacttccacggacacatcgaaaccggccagtgggtcgaagccgcttatcagaagcttgccgtgcagcacaacccgggcaacagcgtgttcgtctccagcggagacctcgtgggtgcttccccattcgaatcctcctatttccaagacactccgacgctgaacatgacaaaggcatgggatctgagtgtgagcgccttgggcaatcatgagctcgacaagggcactgcagacttcaacaaccgcatcgccgaaccgaagtacggcatcgactgggtcgccgccaacatcaccggcggctcgctgacttccgaccgtctcaagccgtataccatcaagaccgtcaacggcaaaaaggtcgccttcgtcggtgccatcacctccgatctgaagaacgtagtctcccccagcgtgatgcaaggcgtcacggtgaccgacccggttcaggctgtgaacaaggtggccgaccagctgtccgatggcgatgagtccaacggcgaggccgatgcggtcgtggccctgatccatgaggatggcgacaccatcgcctccgacggcgacggtctggacgctaacgtcgatctggtctacgcaggccacagccaccgcaacgagtacggcaccaccaccaagtccggagcgccgatcatcgaggccggcaagtacggccaggatgcagctgtccaggatctgtacatcgagggttccggcaaggattccaaggtcaccgtgcagaacgcctcccagtatgacgtgacgtacgtgaccaacaaggacggcaccgctccggccaagggattcgagggtgacgacaacggcccggccgccaaggtctacaagcaggctcaggcggattccgccgaggctggtaagaaggtcgtcggcaccatcgacaagtcagcgaatttcgccaagggcaactggagcgccgaaacccagctcggcacgctgaacgccgatgccgcactcgaatccgccaagaagacgcccgtgggcgagaaggcctccatcggcttcatcaatccgggcggtctgcgcaccgacaacctcgatcttgacggcgacaagcagatcaccgtcaaggaggcgtacagcatgttgccgttcggcaacgataacagcgtggtcaccctcaccggcaagcagctgaaggacgtgctcgcccaacagtggcagatcaaggacggcaagtccaatgtggtccgtctcggcatctcctcgaacgtgaccttcgtgtacacgctggtcgaggacgccaacaccaaggcaccggtcgccaccgtctccgacgtgttcgttgacggcaagcagatcaaggacaccgacaccgtgacggtcgccggcaactccttcctgctgaccggcggcgacggcttcaccggttttaccgcgcagggtcagccgcagctgaccggcacggtggatgtgcaaggtctgatcgactaccttgccgatcacaaggatgtcaaggccgatgactcgcctgcaggcatcgagctcaagtcctcctccgttgaaggcaccaaggcatccctgaccttcgacctgccggtctacgcgaatggccctaagccaatcgccctcggcctgtatgtcaacggcgtggacttcggcgtgaccaagctcggcagcgccaagccggctgagttcaccgtggccaagacgctgagcgccgatgaagccaagacgttcggcggcaccgtctccaccgtcaacccgcagctgctttacacggacgccgagatcgccgccgccgaaaaggagcgcgccaacggttccggcgaacaaggtgggaacaacaaccaaggcggcaacaacaaccagaacggcaaacccaacgccgacaagaagccgacggccaagccgaacaagaccgatctgccgggaaccggtgcttccatcgctggaatcttagccgcagtcagcctgctcgccgccgccggtggcgtgaccatcgtgctgcgccgtcgccagcaacgctgaacgattgtccgacgcctgtacaggtacggcaataaccgataactgaataccgaagaatagccccgcacgtcatagcatgcggggtttttccatgcctgttgagcctatttccactgaggacggcaacggggaaaacgacaagcacatacaccagctccggcagccgccgcacactgtaacgacactcacatcggcggtctccaaatcgttcacagtacgctggaacctagcaataatcggtatctcacgacgaaggagattatgtatggccgatgatgcgatggacgcgcggctggagcaggcactgctcggcatgcaggcgaaacacgcacatgatttcgatgcgcctgaaaacggcccggcggctcagggcggcaacgaactgcatgactttgacgtgaacgaattcctccacggcctcgacgccatcttcgacgcccacaacgccgcagaaaaggcgggcccgtatcttgaacaagcggcggtcgacgcggaaaacgccggagacgaagccggactgctgaccgtactcaacgagacgatggggttctaccgctcgcaaggccgtcacaaggagaaccagtggatcgtgcagcgcgcgcttgagttggccctgcacatggggcttgagggtaccgaaagctgggccactacgctgatcaattgtgccactgccatgcgcgcggccaagcggtacgatcaggccgaggatctgtatcatcaagcgttggattgcgccaataagaacttcgctcccaacgaccgacgcctggctgcgctgcataataacctctccatgttgtacagcgaaacgaaccgattgccacaggcggaaatcgagctcaggcaggcgttgcacatcgtcgaggcggcgagcgtgaatcctgatgccgacatcgacgtggcctcgtcgaacaccaatctggctctggtactgctgcaggagagcaagctcaaggaagcgcacatccatgccaccaaagcgttgaccatctatgagactggcaagctgacgcactcggcgcattatgcctccgcattggctggctgtgcgcaagtgctgtatgtcgaacaccgatatggcgaggcggcctctcattaccgcagcgctttggcggtgatcgccgaatgctatggcaaggacaccgattactatcgcgtcaccgaggcgaacctgcgcgaagccgaggcgcaaatcggtaacgatgacgtgcatgcagcgaacagcgccgatgcaaccagcaccgaaactaataccaacaccgatgccactgccgaaatcgctgtgtccggtctcaaattggcacgcgcgttctggacacaggtgggcaagccgatgattacggcacagtatccgcaatacgtgggccgcattgccgccggactggtggggcatggttcggaatgctatggctttgacgacgcctattctcaagaccatgattttggcccacgcttctgtctatggcttaccgatgatgattatgaggcaatcggcgagcagctcgaggccgattatgaagcactgccacgcgggttcacgatggacgcgcaaggccgtgtgacatttatcgatataccgttctcccccaccacgccccgcgcacaaggtgccaaccgccgtgacggcgtgttccgcatcggtgacttctttgagtcgatcaccgggtatcgcactgcgcccgcgcaaaccgcgccgcacgagtggctgatgctggctgaatcgactctggccgcagccaccaatggcgaagtattcgcagaccccactgggcagttctccaaaacacgccaagggttcaaggatatgcccgacgacgtgcggcttgccttgatttccaagcgattgggcatgatcgcccaggccggtcaatataatcttccgcgttcgttgaaacgcggcgacagcgcggccgcatggctgtccatccacgagttcgtgcaggccaccgcctcgttggtgttcctggttaacgtgccgatggtggtgggctatatgccgtattacaagtggcagttcgcagcattgcgcaagctgtctggctcgatgttcgcgctgttgccgaacgtgggcgaacagttggaaaccgtgatgcgattgagttcggcagcctgctatggcggggccggattcggcgaaggcggcaagggcgcggctacagcaatcaagaaaatcaacgatatcgtggagcagattgcggcggatatcgtcaaggaactcaaacgcgaacacctgaccacgtccggcgagaccttcctcgaatggcagcgcccgtatgtcgaggaccacatcgcctctgatgatccggtgcttaaaagtttgtagattcaagctccctctgtcacggcttcgccgtgccatctccctcatcagaggattagtgaaaggaacgtcgatgaccaacgaactgactgatgatgaactgcgcgaggctattgtgctccatgaatgggatcagttccagcgcaccaacaatgagggtggacgcgcggcatgccaaggtaactggccggtgttccaccagatgcggttggcccagttcctcacatgggaacggccattactcaccagctatgccgctgatcttgacgcggccgaccacgtgggccgcaacctcgtgaccgaaaaatacggccgcatgatggcctccaccgcgccggaagatttcacgaagaacatagagccgtatattccgcgtctctctgaagagcgcgtggcccgtcaggaacaggtcatcgcccagcaggtcgcctgggccaaggatttccgcgagcgctaccccaagctcggcgaggcgatgcgcgtactcaccaccaccgacgacacaccatctgccacctcattcgaaacctatctgcgcggcgagcttggtacgtattccgaccagaccttcgaacgttacgaagcgatgattggcgagcgggccgcagccagcctgcaacgcaatatcactgaggaaaccttgttgcacacggtccagctcggcggtttcgacaccttggaggaggccgaagcctcccaagcgtaatactcagccattcactgtgtaccggacaccccgactgatgtacgccggccggccacacccaggccaacgcaatctgccgatcgccccacacccagaccaccaacgcagcttgcccgccaggccccattgaccggcgcacatcggcagaattacagcgagaataggccccagaatgccagtgtcatcagtgtggtgagagtgccgagcgctaccatcacgcatatgacgcgccgtacaccgacgatatcggcgcggcaataccagacacgttccatttcccaagcaaacagcaccaccaacagcatggtcgctattcgcagcaccacccatccgacggcaaacagccgcggttgaggcataaccaatacagccgatacgcctacggcgctcatatagccgtacaacagcccagtaatcaccatcaccgctgtgccgataccggcagataagccggcaatgccgtgcaacatgagccgcggggcgacccccagcccactcggcgtcgcatgcatggcccgcacagtcgccacactacgtcgcccggccagcaacgtctgtagccaagaaaacacagtcaggccaatacctaatatcgccgccatcacgatcagcacgggccctgccaccatcagaccggccagcacgccgagcgagccgacgataccggatctggtacgttgcggcgcggcgaagcgctggtgaggtgttgcaccggcgacttggggcgttgcccatccatcggctttggttccggcggtcacaccgttcacccaattttccagcgcttgcgtatagccttcggccaatggcaggttcggggtgaataagccctcaccagcccgcatctgatggttgccggcaaaatagcgtacggtgacgttctcgttgccggacttgttggccgtggcgatgatccgctgcgccccctgttcgatgggcatggccgtatcgtaggtgccgtagttcaccagcaccggcatggtgagggatttcagataccggtcggcatcaaagtcggcataggctagatcgaatggcgcgtagtccagcgacatcaatttggccatgtctttgaccacgggcttgggcgcgccggcctcatgcgtataggcgctgacagccatggccatttgctcacgtccattgaacaccggtgcggatgtaagtatggcaaaggcaatgtcttgccgtttcgaggttagaatcgtggcaatccaggtgccttcggattcagcgtagatgccggttttggcggggtccacgccgcttatgccacgcaacacgtcgagcgaacgcccgtattcgcgagcaaaacgcgggtagtcgcgatgcagcacggtgtagttgtcgttgcgcttggccggcaccaaggtcacgataccggcagaggccatggcgttggcgatatcgccgaaatcctcggcaccgctggtaccggacccgtgaatgaacagacaagccgggcgtggcccgggagcgtcgaccggttcacgtagtacggcgggtagcgtgacgccatcgccggtcttgatggatagtcgggtttcacgcgtacgatatcgcccctcgtggggaatgtccgcatgggcaggggtgatggtggtgtcggcagaagcgataacgatgtgcttggtgtagggccgtgtgttccattgcggcatcatcgcccagccaagtgtggcgaataccagcgtcatcgccatcgcggtggcgatgacgctcactacccgccgcgccgaaatccgcttcatagttactatgcctcccccatcagcatagaacggtcggctcccgtcataatgtgattctactgggaccgtaatgcaatggttgtaacgttattttctcttcttgacggcaccgactatggcccatacaacggccactatcaccagaataagtcccactacggcgcagataatagccgtcagcaattgcggattcggcgagaacagcgaaatcatccgatccggagatatgtacccgaaaaccagcgcgatcacgccgataatcacgcctaatagtccgaataccacagtaggcgcgctgatgctctgtttctggatgttcttggcactcttgacatccttagcattctggacgttcttggcgctccccccaggctggcatggtttgccggcggtctgagactgctcataggaaggttgcgctgaagatgctgcgtacatcggtacatcatcggcagatggaatcggcccaccatccccctccacggcatcggcaactgcttccagggcaatccgatctgtggatggttcgatgggcgatggagaggcagttgtcacctgcgtatccacatccgagaccgacgcatccgcatgattgtcggtgacgggcagcacagccgtttcgtcatcatcagctgcggatggcagcaccgtggtatcggttcggtcatcgacggtcaccatggttgttgtcgcggtggtcgcgtcggtttcggaaggtatggccgtggtcggtgtcgcatcctcgatggaggcgaattccttggtttcatcagtcatgattccatctcctggttgtaacggcttgatcattccgattgttcggttgtgttcttgcttgtactgttgccgtcgtatatatcggcaagcggctggaacgtggagcctttccaaccggaggcgtacaccacgttgacacgtgcttccaccgcatagggaatattgatttttaattctgggccgttgtccggcatggcggatcccttatccaaccattcgtaatcaggcccattcatgggattggtggcgctttcagcttcgaagaaaccaaagcttagacccatgtagttgttgtataccatctcgtatttgccgccaacgccactcgaagtggagtaggagtcggcggtgccgaaggcgtaagtgcaggaatccggcagaacgatatgcacttgcgcctgtgttgcggctatggtgatggtaccgaccgggcaattactgatggaagttttgccatccagcatcttcaccgtgtgcggcccatgtatcttgccccaatcggaccaatcaatgatcgcctgatcggtgttgtagttttcaccgctgaacgccacaccttgctgcaatgtttcgaacgtggcatcgctggcatcggcaacgaagatgccatccttttgcacatcgttcatgccatcgctgtttctcgcactgacagattggctcagtgaaacaacagtattgatgccgctggcaccaaaatcacggtagtacacgccagacgtgcctgaaacgatggtcatgcagagcgcgcatccaccggcaaccagtccgagaggaatcagaccaccggtacgccgtcctttgaatccgagaatgatgaccaccagccccatcactatgcatactgcggcaatccagatggtgctcagacgcataatgccgataatgcccatgtcgtttacccaaatcagtcccatcagaccggcaaaggagaggaaggtaaggcccagtatgctcaagaccacgattgggcccgccggcttgcggcgcttggactcggtgggggcataggccgtcgcattcatacggtcgtgggcaaacggcccgttgggtactgtgctgggcatcacgccgggcaccgcgccgggcaccgcgccggtcaccgactgatagaaaggctgtgaaacactagtctcggttcgtgaaacaggttgtgaaacaggttgcggagctgaatacaaaggagattgagggaccggttgcgcggctggatatgagacaggctgtggagctggatatgacacaggctgtgaaaccggtcgcgtcgcagatgccctgaatccgtacccttcctgctggcgaatgccgctcttggctaacaaccaaagcgctaaggcggcgagcgcaatacaaacccaccccgcacctggaatcacgattgccacggcgaggaacaggaagcatccaagacaattccagtcccattggccggcaatgaggtcctcggccaagatgtgcccatcgcgtacatccggcatcagaaaccagccgagtgcgtacagagctgcgccaaaaccgaagaacaatgtacatacaatcaccaacgcacgtactagtgtggggctccagccaagccgtaaagcgatgccgctgcatacgccgccgatccaccggtcgtcgccgcgaaccagtccactggatcgcacccaagtgaagaagcgtcgcgatgtcttgtttttttgcggaccaggctgcggctgtggctgatacggattcgcgtttggattgctcatgattccattacaccgcccgaccactgccacaacgctcggggaacaccctgattgttccctgaacaccgggtaaaaccccggtcgcaacgccctgagcgcggcacaataggagtatgacgtcatctcccgaaccattgctgcctgcgcgcatgccgttgatgcgcccccggcagggccgttggctcaccggtgtgtgcaagggcatcgccctgcacttgggcatcggcgtggcatggattcggattgcgttcatcgcactgaccttcctctacggcgcaggcatcatcgcttatgtattcctgtgggtgttcatgcccgccggagacccggtgacggctgcagctcgcacagtgcccgttgatcaggcgccgcttgcgcgaggcaatcagtcacttgccgcccatgacgacgaatcggctgccgcaccggaatcattgtccgaggccatccaacgtgctccgaaaccggccgtcgtggcattggccggtttcgcgttgatggccaccggactgctgctcaccagcaccggtgcggatgtccagattgtgcttccgctgctggtagggttgggcggcatcgcactggcatggatgaatcttagtccgcgaggcacgcagctgttgtctatgttgggcggcatcgcactgattttcatgggatgggcattgtatgtgcataatgtcagcattcctgggtggggcgcctctcctcgacgcattgttgccagcggattcatgatgatcgtcggtatcgtggtggcagtgatgccgtgggcgaacgcgatgctgcaacgactcacccacgagcaggcattgaaggagcgcgaagaggagcgcgcggacatgaccgcccatctgcatgatggcgtgctgcaaacgttggcgctgattcagctgcactccgaggaatcgaccaccgtattcgccctggcgcgtagccaagagcgcgagctgcgcgaatggctgtatcaggaacgttccacatcggatcgttcggtgggagccggattgaagcagatcgccgccgaagtggaggacgagcacggcaagccgattgaggtggtcaccgtgggcgacgcgcggccgagcgcccagaccgatgcgctgctggacgccacccgtcaggcgttggtcaatgcggtcacgcatggcggcgagccggtgtctttgtattgcgaggccagcgacacgatggttgaagtgttcgtgcgcgaccatggcgaaggcttcgatatggacgccattccgcccgaccggctgggcatccgcgaatcgattatcggccgcatcaaacggcgcggcggtacagtggagatagtgtccagagccggctggggcaccgaggtcagaatgcatatgccgatcgcgctgaaagcggcgcagggagaacatcgatgagcgagaacgagacagccaagattcgtgtggccgtggtcgatgaccatgagatgttccgtgcgggcgtaatcgccacattgcgcgattccttcgatatcgtcggccaagcggcggacgtgcccggttcggtggcgatgatcgcacagaccaagccgcaagtggtgttgctggatgtgcatgtgcccggcggtgaaggtggcggcggtgccgagatcctcgccaaatcgcgctcctactcccctactaccgtgtttctggcgttgtcggtttcggatgcgccgcaggatgtgggggcggtgattcgtgccggcgcccagggctatgtgaccaagacgattaccggcgctgatttgatttcatccatcaagcaggtgcatgagggctatgccgtgttctcgccaaaactggccggttttgtgctttcggccttccagggtgtgccggcggcggggtctgatggcggcgctgatggtgcggcacgggctcatgatgaggagctggaccggctgtccgcccgcgagcaggaggtcatgcggctgatcgcgcgtggttacacgtataaagaggtggcggccgaactgttcatttcgatcaagacggtcgaaacgcacgtgagctcggtgctgcgaaagcttcagctttcgaatcgcaccgagctcacccgctgggccgccgataggcgcattgtgtgataaacgacagatgagctccctcatcagagggagctcatctgctcatatcactccgcgtcgcggaaaccgttggggttcttggtctgccagttgagggaggaggaggccatgtcgtcgatggtcagctcggccttccagccaagctccttctctgccttggaagcgtcggcgtagcaggcggcgatgtcaccggggcgacgcggcttgatcgtgtacgaaatcggatggccggcggccttctcgtaggccttgatgacctcaagcacggagtagccgtggccggtacccaggttgtagacgaacacgccttccttgtcgatgtggtcgatgacggccacatggcccttggccaggtcgaccacgtggatgtagtcacgcacaccagtgccgtcgggcgtgtcgtagtcgtcgccatagacctggacttccttgagctcgccgaccgcgaccttggccacgtacggggtgagattcgccggaatgcccttcgggtcctcgcccagcaaaccggattcatgcgcgccgacggggttgaagtaacgcaacagcacgatggtccaggaggggtcggccacatgcacatcgcgcagaatctgctcctggaacagcttggaggtgccgtacgggttggtggtgccgccggtcggcgtctcctcggtgatcggcagttccttcggcgaaccgtacacggtggcggaggaggagaagatgatcttcttgacgccgtgcttcctcatcgtcttcagcagcacgagcgtggagtacaggttgttgtcgtagtattcgatcggcttggccacggactcgcccacggccttgagtccggcgaaatgaatgacccagtcgatgtcgttctcggtgaagacacgctccatgagcgcctcgtcgcgcacgtcgccatcataacgcttgaccggcttgccggtgatttgctcgactcgctcaagcgcgacgggagacgaattgccgtagttgtctacggaaatcacatcgtagcccttgttgagcagctcgatatcggtgtgggtggcgatgaatccggcgccgcccgtaaccaggacagtggtcatgtttcctcctttggaaggacttgccttcggtttgccttcagtattgagcttacttcacttgacctgtttcacctagcggcaaaaccaaggctttcgaggaatgtttgcgtggtggctttctgcttgaagacggccgtgttgccgaggatgcggtagcagacgctgccgagctcgtcgtgtatggcttggcgaatggcctcgcggtcgcggtttccggccaatgtttcagcgagttcgccccattcgagactgaattcgctgacttcatcgggcaggtcgcggccttcggcgagcgcctcctcgacgatgccgagctggtcgacgagccgtccgggcaggatgaacaggccttgagcctcgatcagtccgattggttcctgcttgaccggccagtattcggggtgtgcatggaagataccttccggatactcgtcgctgatcgcattgttgcggaagatgagactcatctcatagccgcgtttggtgatgattgcgctgggcgagagggcggattggcggttgccgtccgcgtcatggctggcgatgccgttcgccgcgtcgtcatagccgacccatgcctcgcggatgatgtcggatacatcgatgatgctctggcggtttttcgacaccacgcgcacggcggtgccgggccagtcaaggatttcaaccacggcgtccggatagtcggcgagcgtgaaggcggaccaggtggcggccttgtgcatcggcagcagttcgccgccaccctggtagtggtcatgggcgagcaccgagccgccgatgcgaggcagcgcggcgttgcatccgaggaagtatccggggaagcggtccacgaagtcgagcaggtggccgaaggtatcgcggtccacatgcatcggcgtgtggtcggtgttcacgcagatgccgtgctgatcgaagtagccgtagggcgagaactgccagaaccatgactcgccgccgagcgtgaccggcagggtgcgcagggtgcgcttgtcacgtcccgcaaaaccctcgttctcatggcagatcgtgcatttcggatacccgccggccacggcgttgcccgccgccgccttcttcatgttcttgaattcgggtttagcgaggttgatggtaaccgtcagcccgtgcgagtcgaagcgcgggttccggtcgagctgggcgcgcttgacatagttgttggccacgcagtagtcgtagaaccattgcatcgcggccatgccgccgtcccgatgctcgacaagcaggaaccggtcgtcgagatcggcggggttggcggagagcagccccatgacgatgtcggcgtacatcgggccctcctgcgcttcaaacaagccgcaatccaccgctgcggcgcgaaaagcggagagcaaggcgtcgggaacgatgcgggcgcgaccgacagacccctcgggcccctgtgcgcaacggtcctcctcaccgcggcacggacgacacgaggtcgcttcggcaccgggataggaatccagatcgaacagggcgaaaatccgattccgcgcccagtccgcgttgcggggatcgaggtcaaggtgggcgagcgcatagtcgatcagcgcgtcgatgcttgcgtacaccgtggtcaaccgatcgttcatcgcactccctccgcaacgcgggctcggacatgatgcatctgccgggagctcacttggtcgtctccatgacgtcggccacgatggcgcgggtctcatcggctcgctgctccatctccctcacgagcttgatctgggtgcgggagcgcaccaggttatgctcggggtacttggtggcgaagtagacgtcgccttccaggtagtcggcgagaaagcgcatgccgcattccatggtgagcaggttgccgctgaacggcagcagttcggcctcgcgcgcggtgatgctgtcgcgtagttcgcccacgaagccttccgtgtaggcgcggaacagctcggtgctgaaatgcaccttgtccagatcccgctcatcctccaaggccgtggacgcgccgaaacggatggaatcgccgaagtcgaagagcatggaccccggcatgatggtgtctagatcgatgatcgcacgggccttgccggtggtggcatccatgaggatgttgttgagtttggtgtcgttgtgggtcacgcgcagcgggatcgaaccatccctgagcccatccatcacgacggcgtactggtcggcgtgactcagatagaactcgatctccgggccgcacccggcggcacgcccgagctcgtccgcggcgagcgccttcttgaagtcctcgaagcggtgcggggtgtcgtggaagtgggcgatggtctcggtcagctggttggcgtcgaacccggacaggaagttctggaaatcaccgaacgccctgccggcttcgcggaacacgtccgggttcggcacgaggttgtatgacatggtgtgttcgatgaacttgtagacgcgccatgcgccgccgtcgatctcggcccaggtgtcgccggaggtggtgcgcacgatgtccagcgtctctttgccctgagccttgagagtggaggtgaccagctcgacattgcgcatcagattcaccgtatcggggaagatgccggtgttcatccgttggaggatgtagcgggggccgtccgtggtcaccagataggtggtgttgatatggccgtctccgtatggttcgatgctgtcgacggtgccttccagcgcgaagtgcgaagcgacgtcgaacagggcttcattggtgttgttcatgatggttccgttcgtcaccaagccaatcaggcttcacgccaggcgataccgctgtcaggcaggtcgaagtcctcggtggtgccatcggccaaagtcaccgtggtcttctgcggctgatcggtgttgttgatcacgcaatacaggccctgctcggggaagtgcgccacctcgcactccgggttggacgagctccaggccgcatacttgtcttcgttgtgggaggcgtagaacagcacgcgttccagcagtcgggcgttggccgccgaataaggcagtccggagatgtacacgccgcggcccttgccgtagtcgttggccgcgagctgcacctgaccgccgtccgcacgcagcagggtcacgttctcgttgaccgggtacgtgttgagcacgggttcgccgaaatcgatgcctcccaacggcttgatggactggccgccgccgcagccgctgagcggggtgcggtaaccggcctgctcccatgcctcacgggccgccgggtcgaccggcacatcggcggtgatgaagtggtccggcaccaccggcgggaagtacttgtccacggagagggtctgatagcgttcctcgtccacgccaagcacatcggccaattggaagaaacgacccgactggaaacgcggcgccgaactcggctcgcccacgcccacgaacgcgccgccgccacgcacccaggcgcgcacggtttccacgagcttcgggttggtccacacgtcgccgccggtgaatgcggtgtcgaccgggcctccgttgatgattacgtcgatatcgctatcgatgccatgcgcgagtacgtcgtcgaagctgatgaaccgcacgttcacgcgcatgccggacagggattctaggatgccgtagtaggaataggtctgcttgttgggcagggcgtgcgccacggtgaacgccatccaggagcgcatcttgccccaggaattcagaatcgccacgttgagctcaccttcggcggccaccccaccggtgcggtcatggatgtcgcggaattcgttggcgatatgggtcaccgtgtccacgaacttcgggaacttggcggccagggagaggtagccgccgtagcccatgcggccgatcggcgagcgcaggatcgcgcggcgggccttgcgccagttgtcgaggccttcgatgctcggatcgttgccctcgtagaacgtgtcggggaagaagtacggcaggaagcggccttcggtgtacctgacacccggaatatcggcgatcatgcgggtggtggtgccgtcgccgatggatccgaccacggcgtccaggccaagctcgtcgaatccatccttgtacggttcggtgccgatccactggtcgccgaggaacatcatcgcctctttgccggcggcgtgggacatgtcggcgagctgcttgacgttcttacgtacgaagcctgaaaggaagtcgatccagtcgcgctgggcctttctgggcacacgccaggcggagttgtaggcgccgccgtccacgaagtcctccggacgcaggcggtagccgtacttggcttcgaaatcatccagcgcacgcgggcttacggtgcaggcgcagccgaaccaatcgacgaccttctcgcggcgcttctggtcgaacaggagcgtgaactggtagaagaacgtggtgaatcgcaccacatcggtctgcgggctgtccttaagccactgctcgaacgtgtcgaacacgaacttgcgggtggccggatggtagatgtcgaacgggatctcgtgttccttgtcgccccagtcgttggtcagatggttgtacatctcgaccgggtcccagatgatgtaggccaggaagctcaccgtgtattcgtgcatcggcacggccacggtcacgtgcacggtgtcctcgcctgggtcgagcgtccagccggacgggtccacgacctcacccgtggtgcggtccacgacttcccagtacttgtgcgggtcggcgtcgcggttaggcttgagctgttcctcgaagaagccgtccatcagcggcacatccaccgcgttggactcggccaggatacgggcggtcagcaggtagacctgcggggtctcgtccatgtgcagggtgatccactcgttgtgggcgcgggtcgggaagtaggcgctgtagatcttcttgccgagagcgagcactgcctcgtccagatgcgtgccgtcggagttgcggatggcgtccgcaccccacaattcggcgagttccttggtcttttcggcgaaattctcttcactgggcagcgtgaagcggccggtgttggtcatgagtgctcctttgtgaggttgatcatcaaaaactacagggcgacgaattcgtcgcatacaaaatgaccggcgttatcgcgggccctgggaccctgactgcgtagatccttgacgtttacggtgacgccggacgattggaatcgtgtcactggtaatgagggtagggggacgttgcccggcaccggaaggagtgacacgacataccgggcagcggattggttagcccttgacggcaccggcggcgaggccggactgccagtagcgctggaggccgaggaagagcacgatcacgggcagcacaccgagcagcgcacccatcatcagggcgccacgatcggtgaacgtggccagcgagaccatgccgtacaggccgagggtcacgggcttcaaggtgtcggaagacaccatcatcaacggcagcaggaagttgttccacgtggccacgaacaggaacaggaagatcgtcaccatggccggggccagaagcctcagcacaatagtgaagaaaatcctcgcctcgctcgcaccgtcgatgcgggccgcctcgagcaactcatcaggcaccgagctttgcgcgtacgtacggcccaggaagaagccgaacggcgaaacgcagcacgggatgatgatcgagagcatcgtgttggtcaggtgcagcgtgtggaagatcgagtacatcgggatggtcagcagggcggatggcatgagcatgcaggccataatgatgccgatggccgcgttcttgccgcggaagttgaattttgcggtggcatagccggccatcacggacacgatggtgccgaccagtgcggaaacacccgagtagatcagggagttcagcacccaacgccagaagttgcctcgggtccagccgagcagcttcgaatagttggtggcgatggcgtcgggcagctggtcgagcggcacggcgaaccacatgccgttgctgccggtcatctgggcgggcgtcttggtggacgcgatgatggcccagtagatcgggaacaggaagtaaatcagcacgagcaccaacacgatgatggtgatggttttcgtggccacggacggccgcatggagcggggtaggtcgtactgcgcggcctgacgctgcttttcgagtttgcgctcggccttcctgcgggcgcgttcttcagcggttgcggagctcatcactcgttcaccttcctttcggccagggtgtacagcacagcgagcacacctgcaatcagagccatcacgatggcgatggcggatgccgggccgtcgccagacggggtaatggtgccttgcgaagtgttcatggccatcatcatcggggtatatgccttggaaatacccgggtcggcagtggacatgatctgcggttcgttgaacagctggatggtgccgacgatggaaagcagcatagccagcagagctgcaccgcgcacgttcggcagcttgatcttcgtggcgatctgccaaccattggcgccgtcgatacgcgcggcctcgtacaggtcatgcgggatggcctgtaaagcagcgaggaagatcagcatgttgtagccggtgaaggtccatgtggtgatgttggccatcgagccgagcacgatattgctggagaagaagtccacgttgatgccgatggcggcgagccccttgacaatcggcgagatttggccgttgtacaggtagacccagataatcgatgccacgacgccggggatggcgtagggcaggaagtagcccagacggaaaccggtgacatgcttgaccacgaacgagtcgatgacgatggccaacgccagtgcggcgatgatcatgatcggcacctgaatcagggtgtagaccagcaccctgcctacgccggaccagaagttgccggaagtaataacatactggaagttctggaatcctacgaatttattgaccagctcgccaccgccgtatgcgccaccgccctcggtgacctgacggaagaagctggaatagatggcccagatgatgggcaggatgaacacgaaagcgaacaggacggcgaacggtgccatgaatgcccagccggtgcggttctcgcgcttctgagcgccggaccgcttcggcttggctgcggcacgcctaggtgctttgcccttcgcatgagtagtggatgcagtcataatacaaaacctgtctttgcaaagaacagtacaacaaatgacaagggccacagcgcccttgcagcaataccctcaaacaatgcgaaaggccggagtatgtgccccggcctttcgctatggtgatgcgaggcatcggaggtcttggatggccggctatttcaagccggcccgttgacaagacctagtgaggtcactccttgacggacagaccgaggttcttcagcgtatccaccgaggtcttctgagcggtgtcgaacacatccgaaaccttggcagaaccatcggcagccttggcggcggtctgtttcattgcagcgccgactgcggagaagccaggcatgtaggtgaagtcacccatgttgtcgttcgcggtcttgaactcagccatgacatcctgtccgctgaagtagtcggaccacttctgcggggtcttggcatccgcggtggtggcggccacgacgaggccctgggagacaaggtcatcaacctgggtgttgaaccagtcaaggaactccatggcttcggccgggtgcttggaacccttgagcacggccacaccggaaccaccatcggagccggtcttggtgccattgccgaaccagtcaccgagctgggtgaccttccactcaccagcaccagtgccaccggcggaatcgatgaacagcggggcttcccaagcggcggccacggtgccgatcagctgaccggactggatggagttatcaaacgatgcatcccaacgcgggttggtgagggcggccttgttgtcgatcagctgctggtagacatcggccacggccttggagcccttagtctgggtgttgacaacccaggagttgccgtcgaccttgtaccacggaccggaagcgccggcctggccggacatcatcatcatggcctcatcaggctggaaggtcatgatgtacttgccctgggcagcggtcttcttggcggtctcgatgagctcgtcagcggtcttcggcacggtgatgccgagcttctcaaattcagcggcgttgtagaagtaagccagcgggccggtgtcctgcggcagaccgtaggtcttgccgtccacctgcatcagtgcgaacggggcggaagcgaaatcgtccttgtacttggcggcctcatcggtgacatcctgcagaaggcccttggtgaagacctcaggaacctcggcgtaaccgacctgagccaaatccggcgcattgccagccttgacgtcggtctcgagcttcttgatcatttcggaggcattgccatcgaacttggtggccttgacctgaatgttcggatgctctttattccacttggccacgatgtcattgaccaaggtcatgcctttggaatcaggcagacgatgcatgtaggtgatgttgaccacaccgccatcgctgccggacttcgtgtcgccagcagtgtcgctgccgccgcaaccggccaagcccattcccattgctgctaccgcagcaaaagcagccacgatgcgcttattatgcgataccatatctctactccttcgtaatggaatcatcacctcagtgtgatgactgattgctaatttaggcctttgctcttttattgtcaacccaactaacaattaccgcgcgtcccgttgaggtgagtgacattaaaccggttcgacgctcgactgtgcgggtttgttcatttcattaactcacggtcagactaccgtgcatcgtgatatgattcatcttgcaaccttgttgattaaaggcgcaagccggtaatcaacgcaaaggcccgatgctgcaaacgtcgggccttctcttatcggctcacgccgattggcccgtcatatcaacggggacaccgcatgttacggcatcacaaaccaatatatcagcaccccggtggcaatcaagaagacaggttccagaaaaagaaaaagggcctgggcatgttgcccaggcctcggttcgcggacagggcgagattcgaactcgcggagggttgcccctcaacggttttcaagaccgtctctttaggccgctcagacacctgtcccgatgcacgttcatacgcgcaagtgttcattatacaggagggagggattaggctcccctttgtagttttcgacgacaactccccacagtcagctacgctgacagctcccctcagagaggggagctagagcaaaaggaaaatcaggcttcccacttggtgggctcgatgacttccttgccgcccatgtaggcgcgcatggccttcgggatctcgatggagccgtccttctgctggtggttctccatgatggcgaccagccaacgggtggtggccagcgtgccgttcagggtggagaccgggcgggtgccgccgtcttccatacgctcgcggatgttcagacggcgagcctggtactcggtgcagttcgaggtggaggtgagctcgcggtagcggccctgggtcgggacccaagcctcgcagtcgaacttgcgggcggcggaggagccgaggtcgccggctgcggtgtcgatgatgcggtagggcacctcgaccttggcgagcatctcctgctccatggccagcaggtgctcgtgctccttgtaggagtcctcctgcttggcgtagacgaacatctccaccttgtcgaactggtggacgcggatgatgccggaggtgtccttgcctgcggcgccggcctcgcggcggtagcaggaggaccaaccgcagtagcgcagcgggccgttgccgaggtcgaggatctcgttctcgtgcatgccggcgagcgccacttcggaggtgccgaccaggtactggtcatcgggctcgcgcagacggtagatctcgtcggcgtgggagttcaggaagccggtgccgcgcatgacctcggggcgcaccagcgtcggggtgatggccagcgtgaagccgtgctcctcggcctgatccacggccatggtgagcatggcgatctgcatacgggccacctggccacgcaggaagtagaagcgggagccgccaaccttgacgccacggcgcatgtcgatgccggccacgccggcgccgagggtcaggtggtccttgggctcgaagccttcggccgcgaagtcacggatctggccgaccttcttgacgaccacgtagtcgtcctcaccgccttcgggagcttcgggctccacgatgttggagagcctccacatggcggtggtgtattcctcggcggcggaatcggccttggccttgtattcggcgaccgtctgggacagttccttggtctcggcgatgagcttggccttctcgtccgccgggacggaggcgaccttcttgccgatttccttctgctgggcacgagcctcttcgaaggccttcagcgcttcacgacgtgcggtgtcggaggagagcacttcgtcgacgagttccacggactcgccgcgcttgcgctgggattccttgacgatatcggtgtgttcacggatgaattgaatatcaagcatgggcaccagactagccgcgtaagcagacaccgacaatggccgaatgtgcgggagtaacgcggaaatcacagggaagcccgggaaagcccgcgggcgggtccacccggccaatttcgtcagatgagacgcgattgaaccatgatcgcgtcccacgggctgttgcgtgcaggaaatgttcacgtacggcgcaccatggccgtaaacgacctccccaccgataacaataggagccatgcctcagcctgccctcaccgtgtttctgatcatcgccgcaatcgccattgtggcggcgctcatcgccgtcaccgtcatcgccctgcgcgcgcagcgccgccgcaagctggctcagacgctggagaagcgccgggacgacgaggtgcagtacgccttcatcgtgaatccgtccaaaccgcaggccgaagcccgccggctgcatatccagaggttctgcgaagccaaggggctcaatcgcatccgcttctacgacacccagcttgacaaggacggcagagtctgcgcgcttgaagcgctggaggacggcgccgacgtggtgatcgcggtcggcggcgacggcacggtgcgcacggtggcgagcgccgtctccggcaccggccatgcgctgggcatcatccccatcggcaccggcaacctgtttgcccgcaatatgggcgttcccgtggacgatatcgacgccgcgctgaccgtggccacctcccacggctcccgcctggtggacatgggccgtctcaccctgctcgaccacccggaggacgaccacggccacgccttcctcatcatcgccggcatcggcttcgatgcggccatgatcgacgacaccaaccccgagctcaaggcgaacatcagctggctcgcctacttcgtgggcggcgtgaagaacctgttcgcgccgaagttccgcggcacgctgacagtcaccagcgccgacggctcgacccacaccatcaagaatctcgatttccgcacggtgatggccggcaactgcggccaaattcccgtgttctcgctgatgccggcggcctcctatgacgacggcctgctggacttcgaaatcatcgacaccactggcggcatcctcggctgggccaacctgttcggcgacgtggtgcaccagacgatcatcggcaagcccgagcagaacccgctgtccacgaattcgaccatcgagcaggtgcagggcgtcagcgccgaaatcacgctggagaagccggccaaggcacaagtggacggcgacatgctgccggaaacccgccacatccgtttctcggtggatcaccgcgcgctgatcgtgcgcgtgcccgacgcctccgcgttggaaaagaccgcgcaggccgccgcttcgaacgccacctcggatttcgccgaaatgaccggcacacttgagccgattcgctgattcactggctcatatgcgccagccgcggatggtcgggaatatccgaggaacgattctgattcgtttgatccgtgactcgtgccacatgcaatgtcaggtaggcaacctcgtcttcggtcagcatggtatcgaggcgcagctcaataagggatgcgataagtctcgcgcatttcgaggcttttgcgtaggagctcataatcgaggaaatgattgcctccggctccttgctgagctgctcatgctgatgaatacgcacgaacaaataccgaagatgggtgatgaaacggccgacattaaccgaatgctcatccagctcgatgttataggtgctttcgatgacggcgagcaactgttggatgacgccggtcatcatatacgtaggagaaaggtcgcctgtggagaagccggcaggggatgcggacggaaagttggacgcttgggcgtccggattggagtccgcatgttttcgatggaggatcggcgcagggccgttgacctgtatttcacggagggcatgaccatcaggaaggtcattgccgagcttggttacccgtccgagggcgcgctggtgaaatgggttcgcgaggacccgcgttacacgggcgcgtgcaggcgttcgtatacgctggaatgcaagacgaatgcggccagacgcgcgctcgagggcgagcccctcgcccgcgtggcgcgcgacgcgggttgcacgccgacgagcgtgtaccagtggatgcgccgctaccggagcgaggggatactgggactgatggacaggagaaacgcgccgatgccggccgaaccgatgcccgcggccggcgatgacgtggaggagctgcgccggcaggtggaggtcctgcggctggagaacgcggtgatgcgggagacgatcgatgttttaaaagccgacgacccgcgcctcgacccgtccatgctgacgaacagggagaggacgcgggtcgtcgacgcgatcaggggtgaattcggcctggcggcctgtctgaaggccgtggggctgaaacgcagcacctactattacgagcgcggcgcgatcgccgcgggcgacaggtacgccgtgctgcgggcccgcgtcgccggcctgttcgagcagggtgggcgcgcatggggataccggaccatccaccgcatgctgcgccttgacgagtccgacccgatcgtcgtctcggagaaggtcgtcaggcggatcatgcgcgagggggccatgcggcccgtgtacctgaagcggccgaagcggtggagctcctacgccggcgagatcggcgaggccccggcgaacctcgtggagcgggacttccacgccgacgcgccgaacatgctgtgggtcacggacgtcacccagttcaccatggacgggtacaagtgctggctttccccggtggtcgactgcttcgacgggatggtggtctcctggaccttgtcgcgctccccgaacgccgacatggcgaaccggatgctccttgacgcggtcgccacgctcagggacggggaacatccaatcatccattccgaccgcggctgccactaccggtgggacgaatggatccgcatctgcgaggagcacgggctgatccggtcgatgagcgccaagggatgcagcccggacaacgcggccgccgaggggttcttcggcaggctcaagaacgagttattctacgggcgggactggaggggcgtgggctacgaggagttccgcgaacgcctggccgcctacctgacccactacaatgaaaccaggatcaagaagtcactggactggatgagccccgtgcaataccgcagaagtcttggactggccgcctgaccgtccaaaaaaacatccgcacccccgcattcacaaaatgcagcgcaaaagcaacgctctcgctgggatccagcgcatcgtccaatctgcggttcagcgcggcgagcagtgcgcagccctgctggtattcacgctcatacagcgaacgaatttccgagttcagcggatacggcacaggcggaatgccgttcttggcgcggcgtaaagcaccgcacacatgatccgcgagcgctatgaccaacgtcgagctttgtgcagcctctgaactcaggccaatcccatccatggtctcggaaatgagacgaatgatttcaggaggaatatcgcccagcaactgggccatatggtcagggtcacggccttgagccggcacgaacacacgagccactttggcatcgtcaactgtcatgccgggcttggccttgaaccccaggccccggccggtaaggatgacttcgcgcccccgatccttcgccaggacgacgttgttattgaagacgcgaagtatttccatgacatcccttccgttcgggatcttcaggttacggttgcgaaccgaccatgattactgttcgatggcgatgacttcgtcaccggccgcgacgttcacatccgtcttcggagtaacggacttgagcgctgcggtgttcagtaccgtaaccagcgtagtggtgctgaatccagccttcttgacttcgtcgagatcgacagtcgccaacaggtcaccggcgttcactcggtcacctttggccacattcaccacgaaaccattgccattcatcttaaccgtatcaatgccgacatgtaccagcacttcaataccatcgtcggtcttgagaccaaaagcatggccagtctcagcaacggtctgcagcacaccggacaccggagccttcaccgcgccatcaaccggctcgatgcccacaccctcgccgagggcacgagaagcgaacaccggatctccggcatcgtcaagggacaccacatggcccgcaatcggagcgaacacggcggaagtggcggtcgcagcggcagccggggcatcggcaacggcaacagcggcggttgcggtagcggtggtggcgtcaccaccgttcacagccttggcggactgagccgcggcacgggccttggcttcggctttctgctccggagtgcggtagtcaagcatgataatcataatcatggcggtgaagaacgacactgcgatggagacgccgtaaacccacatctggttgaacaccggcacggtgagcagcgaggtgaaggcgaatgcagtagtggtcacgccgtgcacggtctcgccggaggcgacggtggccgggaagagccagcccatgacggcgattacgacgccgcccacgccgcagccgaccagcatacgggagtagatgagcttgtaacgcaggtggatgccgtagaggctcggttcggaaacgccaccgagcaggccggcggcgagagcaccgatggaggtctggcgcatgtccttatccttgtcacggatggagaggaacagcacaccggcagtggcaccgaagcaggcgaagttccacacgcccatcgggccctgaatgaagtcgtagcccagggtgttgatgttcatgatcatcagagcgttcagcggccagtgcagacccagcggcaccaggaacgggtacagcagcgggattgcgatggcgaagatgaacggagcgtgtgtgttcatccaggcgagtccggcgccgaggccgttgccggcccacacaccgataggtccgatgatgaaagcggtgagcgcaccgacgatgatcatggagaagaagggcaggaagaccatctggacgctgtccggaatgatcttcttcagaccgtggtacacgaccgcgagcacggcgaccatcagcagcggcacgaacacgtttccggagtagtcggacagctgcatcggcaagccgaacaccgtggcggtgcaggaggaggtgcccagcgtggtgttcttcacgcacttgacggcgtcgccccaggtcttggtgtcagacagggatgcgaactgcggggtcatgagcatgcccatgattgcgccgcccagccacggatccactttgagcttgttggcggcattgtaggcgaccataatcggcaggaagtagaacacacccttccagatggcctgcacgaacaccaggccagtggtggcggtgtcgttcggaatcaggcccaaggaaatgcacaggttgacaattgcgatgatgatggacgcgccaagcaacacacccagaatcgggcggaaggagtcggccaggtattcgaagaagctatcgagccatgcgaccttgccgcgggccttggaacgagcggcggccttgacctccgcatcggtcggctcatcggcattgtcgtcgacggtgccggcgccgagaccagccatctcgggcaggtgcatgatctgctcatacacggaggcgacctgaccgccaatgacgacctggtatcggtcgccggactgctgtacagcacccagcacaagcttgttggcgtcgagcgtggcgttgtcaaccttgccggcgtcattgagttcaaaacgcagtcgcgtggcgcaatgcgtcagcgacttgatgttggccgcgccaccgacactagtgacgatcgccttgatatcgtcttgatgcgacatctcttactccattccttttccacggttaagccagcacctaccagaggaaccaccctgttcctgagcatctgcgttccaggaaccggcagtcacgccaaataacagaaaagacctgagatgtggacgccatcatgaatacacatgactacgtcaacatctcacgtcttgcctcaacattcgagtagcaaccctgctaattactgactgaacagcgattataacgagctgaaaacaatccggcaaatcacacatatggtcagagcctgcctatacctcgaaacataagacgagagtaaggaagaacaggctttaatcggcgatgaacatccggcgtgtctttcttggacgatgcatccgcaatgagacggcacgcaagcccacgcttaggctctttgcgccagatgcgcgccaccgtcatacacttattcgcacaaaagttgacaacttttaacataatcttgccccagacggcaaaaaacgtggcagaatgaaagtatggtagcaaacaatgcgggtcagcccgccaccccagcagatctgattaatgtcgatgaggttatcggcaaatactatgacctcgtccccgatccggaagtccccgagcagcgtgtcatcttcggcacctccggccaccgcggatcgtccctgaagacctcgttcaacgaggcccacatcatcgccatctcccaggccatcgccgaataccgcaagaaggccggcgtcaccggcccgctgtacctcggctccgacacccacgcgctgtccggcccggccaagaagaccgccatcgaggtgctcgtcgccaacggcgtgcacgtgcgcgtcgactcccgtgacgacttcgtgcccaccccggtggtctcccaggccatcctgacccacaaccgtgcggccgacggcaccccgcgcttcgagggcgagggcctcgccgacggcatcgtcgtcacaccgtcccacaacccgcccaccgacggcggcttcaagtacgaccccgtcaccggcggcccggctccggccgagaccaccaacgccatcgccgctcgcgccaacgagctgctcggcgacttcaagtccatcaagcgagtgccctacgaggaggccatcaagtccgagtacgtcgagggcttcgacttccgcgagcactacgtggacgacctggagaacgtcatcgacttcgacgtgatccgcaactccggcgtgcgtctgggcatcgatccgctcggcggcgcttccgtgaactactggccgctcatcaacgagaagtacggcctgaacatcggcgtggtgcgtcctgaggtcgacccgacctggcgcttcatgaccatcgaccacgacggcaagatccgcatggacccgtcttccccgtacgccatgaagggcctggtcgacgagctcaacgccggcgcttgggacaagtacgatctggtcggcggcaccgacccggacgccgaccgtcacggcatcgtctgcccgaactggggcgtgatgaacccgaaccactacatcgccgtgtgtgtggaatacctgttcggcggcaaccgtccgggctggcccgagggtgcggccgtgggcaagacgctggtctcctcctccctgatcgaccgcgtggccgcatcgatcgacgcgaaggtcatcgaagtgccggtgggcttcaagtggttcgtggatccgctgttcagcggcgaagtcgccttcggcggcgaggagagctccggcatgagcttcctgcgcaaggacggccgcgtgtggaccaccgataaggatggtctgatccccgacctgctggccgctgagatcaccgccaagaccggcaagaacccggcccagcttcaccaggagcaggtcgagcgcttcggcgagtcctggtacaagcgcgtcgacaccccgaccacgctggagcagaaggccaagttcgcggcactgtccggcgacgacgtgaccgcctccaccctggctggcgaagacatcaccgccaagctgaccgaggcaccgggcaaccacgccaagatcggcggtctgaaggtcaccaccaaggacaactggttcgccgcccgtccctccggtaccgagaacatctacaaggtgtacgccgagtccttcgtctcccccgaggctctggacaaggtgctcgacgaggccaccgtcgtggtcgacaaggccctgagcgagtgaaatcgctgcgttagtcgcgttcacagcaaccaataaggctctgcattggattcatacaatccactgcagagccttattttttcgaccactgaaacacgcaggtcaacggttctcctcatgcaccatgactgcattttctcaacatcactgcagggcaggacggccatatggccgcgaaacgttcgactgcctacattatgaccgagtttcccatcatcattgtggggtcacagcggccagatgaccaccgaagcgttcggtcggcttgcatcatggtcgagttttaacatcgttgtgggacgccacgacgaatttgcccattccagagttgccatcccacaaaagcgtgggacaacagctaagtcaatcgttttacatttcccccatcccacacactcaaactggaaaccccggaaagacgccattcctgccacacccgtcacagccattacccgaggggccgtgggacgccatgcaaaaatcggcaaaacacgcgtagcgtcccacacccattggcgcaaatccacgctcaatgcaccgacaacacccccaatcgaccactatgacacatttccctccacaatcgaacactagtcattcacgaaatccatcactacgaggcatcgcaatcgaacggcatgcaatatcaagcacacaccacaacaacaggtcgtacaaatattgcctttacatcagtccgtttcgaacatcatggtcacagcaggctctgcgccaactcttcaagagacatggcaactacatgaaactcgaatacggcaccgcgcgaagcaagcgccctcgccacgttgaaagcgaattcagcacgagcatcctcgttagcgatacttgccgccgtggcgacgaagaccagccatctccgcccgaccagcacaccccttttctcttggtcacggcgccattgagtcttactcgtacgatgatgatcgccatcatattcaacagcgaccttgaactctggccacgctaagtccaacgttatgggagctccagatgcaaaagccgcgtccggcaccacatagttcgcaaccggctgtggaatcccatgcgctaccagagagagtcgttcttctgattctttgggcgaatcagcaccaggtgatatcagaggcaatgctcgaacgcaggacggacgccctctgaatcgggtaaattgctccacgaacttcaccagatcctgatagattgcagcagcatcacgatccttagccaatactggctgtttgctcgtagcagtgatgacggcatccccgagcacaatcagagactcaaaagaaacatacggggcaagttgagcccatacgtgaaacaggtccagcgcaaacacgtgttggttcatttccacattggcggctttagccgcatgtttccaaatatgcgtttgcagtggtgcatggcgtgtacgaaaccgcttgctcttaacgctggatacagtgtgcagcttggccgagtcgaggtcgcaatcggcgggaatcggtacggattgcagagcgagggaagtggtcatgccgaaaagcagcttcttgcccgcccgtttcgcttcctcagtgcagcgtgcgaccatgtcgcgtttgcgctgagcaaggctttcgctcatggtcagtgccgccgcagaatcatgtgcaccactgtttggcgatgacgagtcgcgagaagtcgggtatttcgagtcagcagaaaatgaccccgcaaattcgggcggaacaaaaactgcctccgattcttccggaggcggatcgtacatagagtctggcagagctccatagttggtgatgccgtcggtcatgctgttcatgacaccaccatatgggtagtgggtgcggaaacggaagccgatccgaggtatgtggtcctagcttcacttacgcacatctattgtggataaccatgtagacacctcacttatacacatagttatccacctcttcaaccctgatttgacacactaactgcatctgatatgattattgtatcattactgtacacattatagttacagtatcgactcgacaaggaggtcgtttcatgaacggcgaccattcactggcagtgcacgcattggtctaccttgaccatcgcgccacacacctgcccagtcatatcctggccgaaaacatatgcaccaatgcggcgcgcgtgcgcaaagtaatgcgaccgctcgcctcagccggactcatcgccactaaagagggtgctgaaggcgggtacgctctggcccggcccgccgccgaaatcactttgcgcgcggtagcggaagccaccggcaccacttttgtggaagcgaactggacaccgggcgacgtacaagaggattgcttggtgtcatcttcaatgggcgcagtgatggatgacatctatgccgggctcaaccgcacttgcctcgaacaactcgaacacaccaccatccacgacatcaccgaacagatattcagcgagcacaaaggcgaataatcccgcggccagcatcagtcgacaacgcttcggcagtcaaagaagaaaatcggcacagcacggcgcacaacacatcagcacaacacactcttaccactcgaatacgtaaggaagtaaccatgtccaccagcacacccaatgccatcagcacgcccgacaccatcagcacgcccagcacctctcccactatcaccaccgacgccctgatcattggattcggcaagggcggcaaaaccttggccgccaagctcagcgcagccggccgcaaggtcgtcgtcgccgaggcaagcgccaacatgtacggcggcacctgcatcaatatcggatgcttgccgtccaagtcactgattttgtccgccgaacaggcgcggcgggatggcgcgaacagtactcccgaaacccgcgaagcagcgttcgaggctgctatcaaggagaagcgccgcgtcacttcgatgctgcgcgacaagaactatcacaagctcgccgaccaagacaacatcaccgtaatcaccggccacgctcacttcaccggccctcatagcgtggaaatcgccaccgctgagggcccggtcgccgtgaccgccagcaagatcttcatcaataccggcgccacgccgcgcattccggatattcccggtatccgcactacgcccggcgtctacaccagcactggactgatggatctcgacgatatgccgcagcgactggcgattatcggttcaggattcattggacttgagtttgcctcgatgtttgccgatttcggcacggcggttaccgtgctgcagcacaatgccgagttcctgccgcgcgaggatgcggatgtggcggccgcgattcgcgcacagctggaagcgcagggcgtcaagttcctgttcaacgcggataccaaggccatcacgcctgctgctgacggcggcgtcaggttgtccgttgcggtgaagggtatgactcgcggtgcatcgcaagcttgcgattccacccccgccggcaccgggaacgctcataccgatatcaccggtgccaccggcaccaccgacactgcaacaaccaccagccccactagcaacccgaccgatcacgccacgatgtcacacgttcaaacgaaaccatcagacgatggcgagccgcggttcgccgaaccggctgaagcccgattctgcctgaccaccgacgcggtactggtggccaccggacgtacgccgaacgtcgagggactgcatcttgaggcggctggcgtggagctcaccgaacgcggcgccgtgaaagtcgacgagcttctgcgcaccacagcagccgacatttgggctctgggcgatgtgaacggcggcccgcagcacacgtacatttcactggacgactatcgcgtggtgtggtcgcagctcaatggttccgcccgtccgtacacggtgaaggaccgcaagcatgtgccgtcgagcacattcctcgccacgccttactctcgcgtgggattgaatgagcgcgaggcgaaggcggccggattggattatgtggtcaagcgattgccggtggccgctgtgccgaaggcccaggtaatgcggcgaccggatggtctgatgaaggcgattgtggaacgcaatactggccgcattctgggtgcgatgctgctttccgtcgagtcgcacgaggtgatcaatatcgtcaagttggcgatggatcttgacgcgccggccagcacgttgcgcgatatagtgttcacgcatccgacgattgccgaggcactgaacgacttgttcgcgtagtttgtccgcagagcacgcccgcgtagtgcgacccgcgtagtgcgacccgcgtagtgcgacccgcaacagactcccctaatgcgcgcgaaggtcctcatcgatgtaaaccgatgaggaccttcgcgctgttgtcatgatacgtacgtgacagcaattacatccgaaccagccgttacttcaagccgagcttacggtccagaatgtcggaggcctccaatcccaagcggcgtcggatgaaccagccaagaccgagtggcaggcccgaagccaaggccacgccgtctgaaccgagtgccacggttttggcgttgtctgcgataagcatggtgcccttggatgcggccatggaggtcgaaccatcgctgtccgcctctggtttgaggatttcgacgttgccgtcactggttttgcacagtcccttattctcatttcagataccggatgcaccattgtcgccgacctcacccgcagagaggacatgtcttgtttctcttgtgggcgctcactattcacgcgcgatggcatgtttttcaagcaaagtcaataggtgtgatgttattcacactcttcactacgttgttttgcctcgcactgggcaaccccacttcagcaagagattgcacagcttgcgttagggtggagaacatgactatcacagtatccacagacggttccgcattagggaatccaaacgggccaatgggctgggcctgggccgatcatgagccgaacaccggcggcaagcccggccataagcacgacgaccacggctacgacgccggcggcgcgaccaacggcaccaaccagattggcgaactgtgcgcagtgttggaagctttgcgagcgcatccgggccccgagccattgctcatcgagtcggattcacagtacgccatcaattgctcgaccaagtgggtcaaaggctggaagaagaacggctggagaaattcgcagaaaaagcctgtgaagaacaaagagcttattcaggcgatcgaccgtgaaatctcgcaacgccctggcccggtggatttccgatgggtcaaaggtcacgctggcaacgagggcaatgagttggtcgatgaattggcacgcacctatgcgggcgattgccgttcaggtgcgcgcgatggctatctgccgattgaaggctggcagtcgctgctgggctccgaatacgcacatggcaccgatgtgcctccagacgtgcagttggtattggacggcaaggcagatgcggcaagtttgcgcaaaccggctgcggcgacggatccgacggatgtcacaaggccagagaccaagtcttcgtcacccttagcggcacaatcagcgcaacctgtacaatcagcgcaccccgtacaccccgcaaaacccagtgggctgacggtatccggtacgctgaccttctcccccgcgccgaaaacgagcccgtatttcaacgggcagccgatgccgatcaaaggcagcatcgaaatcgaaggctatgtggacggcgacggcaacctgaccatcaccaacgcaccattcatacgacactaacacccaaacacacgaatatgtaccgcaatcggacacgatggcacaaaatcgctcattcgcgttaggataggagataaggcttcacgccgttgatccgtgcggcggaggcaaggatggcaaaggagaaaccatggataaggcacagcaggatgcgctgaagaaggcggccggcatcgaagccgccaagctcgttgaaaacggcatgatcgcaggcctcggcactggttcgaccgtgaagttcctggtggacgagctcggccgccgtcatcaggaggaaggtcttgagttcactggcgtgaccacttcccgccgcacgcaggcccaggccgagagctacggcatcaagatcgtggacatcgacgacgtggaccacatcgacgtgaccattgacggtgccgacgaagtcgacaagaacttcaacggcatcaagggcggcggcgctgctctgctgtgggagaagatcgtggccaccaactccaaccagatcgtgtggattgtggacgagtccaaggttgtggacaccatcggcaagttcccgctgccggtcgaggtcattccgttcggcgctggccacgtcatcaagaagttcgaggcctgcggctacaagccggtgcttcgtcttgacgccgacggcaaggaagtgcgcaccgacgagaacaacttcgtggtggacctgcacctggagcgcatcgatcacccgcaggagctggccgaagacctgatcaacacggtcggcgtggtggagcacggcctgttcctcaacatggtcgacaaggtcatcgtcggcgacccgaacggcccgcgcgtgatgaccaacgccaacaagtgattgtctcacatcactaagcttttccaagcccgcatctgcacatcgcaggcgcgggctttactgttgcccgaacaaggcaaagagccaagcaaaagagaaaccccgcgaccataacgatcacggggtttctaatgccttgattgcaggtaagactacttacgctggtggcgggtcttacgcagcagtttgcggtgcttcttcttgctcatccgcttgcggcgcttcttgatgacagaacccatctgaagcctccatttcgattaatcgtaaaagttgcaactcgcaccataatacacgtgttgccagacagagggaaccagtatgttgccgatagtccgcatatgccctgaacgcagttgaggcatccacatcagcaatgcgggtgccccaacgttcataagtctgtgcagcagctgacagccgatattagatactacatcgggaacttctgatagaagcgatcgaccgcttccttggtaccggtagcttggaagaccacggtatcgttctgccagatggcaacggcgttcttgctgttggaggcatcggccttcaccacgtacgcgcccgtgacgttgccggaaaccttgacgttgccggatgccgactcatcgccggtctgcgcagcgaccaacgcatcgtactgggtcttggcattgtccgccgacgaccactgcgcggcgaccagcgtgacatccttggcggcatcaccagtggagtaggtcagagtgtacccctcgagcggcgacgcggaattccacgtcgtggaggcaaccgccttggtacgcgcgtaattcagtacgctgtccggcatggccttcaacagctcactggcatcatccggcaaagctgtggcgtcgatagtcggcttggtcggctcggatgattcggttttctgctggctgttttgggtggtagtggaggtgccatcattcttctggatggcccaacccggccacacaaaggccgaaagcactgccaggataatcacaacagctgcggcaaccaccactgcaatcaacttgccatgggattgtgtggtcgaggagttctcactattagtcatgccccgattctctcacagccgcgtgacgctaggcggccgtaatcttagtcgttgtgcgcaagccgcgtgaaactcttacgaacggtaaaaatttaccgtccgctggtgttcgggttagggtgagaccatggcgaaatcaagtgtgcagtatgtatgttccgaatgcggttggaacgggccgaagtggtacggccgttgccccgagtgtggtcagtggggcacggtcgaggaatttcacgaggctcggccggcggcaggctctcgtacggccgctcccggccgaacatcacgcacgcagtcggttacggttgccaacaacgccagatctgcagcccgtccgattaccgaagtgggcacggaaagcgtcgagcggctcggtaccgggtttttcgaattcgaccgtgtgctcggcggtggcgtggtgccgggttcagtgacgctgatagcgggcgaaccgggtatcggcaagtcgacattgctgttgcagacggccggcaatatcgcgcgcgttgtggcggtggacagtacgttccgaggggcaggtcagcggtctgcccaacagtcgagccgggcgcagggcggcacatcaaacacggtgtcgacacaggacaacacagcatcaacgcacgccaacaccgtgctgtacatttccggcgaggaatcacaggcgcaggttcgtttgcgcgcttcccgcatcaacgcggtggagccgaacttgttactggcctccaccaccgacctgtccacagtattggggctgatcgaacagaacaagccggccttggccattgtggattcggcgcaaaccatcgtctcgcaggaggtcgatggcatttccggcggttcgactcaggtgcgcgaagtggcaagcgcgctgatagataccgctaagacacttgacattccagtatttctggttggtcatgtgaccaaggacggttcgattgcaggcccgcgcacattggagcatctggtcgatgtggtctgtcaattcgaaggcgacagcgagactgcgctgagaatgctgcgagcggtgaagaatcgttttggtccgaccgatgaagtcggctgtttcgacatgagcggtgagggcatcgaagaggtcaccgatcccgccggattattcctgtctggagacggccctgatgcggccaacgtggcacccgtggaaggcacctgtgtgacgttcacattggatgggcatcgcagtctgcctatcgaagtacaggctctggtcaccacgtcggtgctgcccacacctcgacgtgcggtcaatggcgtggaccccagccgtatcgccatgctggtcgcggtgctctaccgccacagcaagctcaacctgctgtccaacgacctgtatatctccactattgccggaggccaggccaaggagcccggttccgacttggcgatagtggcggcactggcgagcgccgccacgtcaaaacccattgctcgagccacgtgtgccatcggggaaatttccctgaccggtcaggtgcgcccggtaccgcgtatggaatatcgccttcgcgaggccgcgcgccttggctttacgacggcggtcattcctcctctgcgcaagccagtgcatgtcgagggacttcggctggtggagtccaacacattgtccgacgcattagacgccttgggagtgcgtaaataaccctgagatatgcctcaggcggtaagacgcttggtctcttcgacgttgcgcttgagttcgtcaacgagttggtcggggccatcaaacttgacctgcgggcgcaggaaaccgatgaattcaacgcgaaccttatggccgtacagatcaatccactcatcggtgatgcagtaggcctccactacgcgttcgttgagtcctgttttctcgctgaaggtgggtttggtgccaatggagatggcggcgggccaacggttttcaccatctaccagccaaccggcatagacgccgtcgaccggaatgtagcctgcaatgtcggagccaagattggcggtggggaatccgatggtgcggccgcgctcctcaccgtgcaccacttcgccttcgatggcgtgcggagcacccagaatggcgttggcatcctggattcggccatgagccagcaggtaacgcacattggtggagctccatgcgcgcattgccttggcctggttcttcttgctccatgcacggcgctcggccttggtggcattggccagcgggtcgacgggctctccccatccgctcggggcttccggcttgaaatcgcgcggaatacgcacttcgcccgggccacggtcatcgaccacgtcaagttcgaatacaccggtggcgacggcaagattggcgatacgcttcacatcaccttctcgtcccttgcccatggcggcatcctgcccgaggaccagcgtacgcatgcccagcttgccggtgagtcggccaaggaagaaaatgtatgacatggctgcgaaggccagcgtgtagtgcacgaccagcacatggtccacgccgaactgttccatgcggtgcagtcgatcatccacactggtcaacgcttcggcatccacattctgcgccgcaggttcctcgccatggtgagaggcggcccagccgtgcacgaatgcggggcgcgggtcaaacagaatcaccacggaaaaagcaccatgctggtgcgcgagttccaccacgcgcttgatcaccgcctgatgacccaagtgcatgccatcaaatgcgcccaatgtcaccacggccttcttgtcgttactgaacgagggccattcaatcgagccttcggcgtcaggggtcaggtgcgtgatatccatcagtgtgctgttccttttatccgtgcgatgttattcgtgcaatataggcgttgttgtgcgcggcctgtatcaagctgcacttttcaccgcgtctactttacgcgaggggaatacggtgaccggcttggcctgatgagcgttggcacgctcgataatcgccgccacatcatgcgtttgcggcacaatggcggcagtgggctcgctgattgtacgctcgatacggcggccgaagcgtaattcgctggcctcctcaggagtgatgtcaagcgccggcatcgcacctcgagcggcctgttccatggtgagggcatggtcaagcagccagttgcggcgctcgtcaccggcaagaccttcaggagtgtccaatacgcacttgttgcgcgtgacggtttgcccttcccgattagtgaacgtcttctgatcggtatgtgcggtgacggtatgggttcgcgtgtcaagcatcgcctcaggagcgataagtccgctggcatcgtccggcaacgcgaatcggccgactcgcgtacggcgcaaacgggtcaggtatccgccgacgccaagttcattgccgaggtcgcgggcgagcgcgcggatataggtgcccgatgaacagctgacccgcacgtcaacatcaagtgcgggaatcgctcccgtgttcgcgtcttccctcaatggttcagcggcctgctcccctgctacgaatccgctgcggatattcagcacggtgaattcgctgatggtcaccgggcggggtttgagttccacctccttgccttcgcgagccaagtcgtaggcacgctggccgttgattttgatggcggagaatgtattgggaacttgttctatatcgccggtgaaattggtggcgatggtgcgagtgagcagatcttgccatgaggcagttggtagcgccgttggttcgccgctctggccgccctcggtcagctgcgctgacagcgtttgccagcgggagcgggcttcatcatcgacaagcacctcaccttcggcatcgtcggtagtggtgcgcaggccgaggcgtatggtggcctcgtaggttttgtcatgcgccacgatggcgttgagcagtcgcgtggcgtggccgaaggcgatgaccagcgtgccagtggccatggggtcaagggtgccggcgtgaccgaccttcttgatgtgcaacgcgccgcgcacggcggcaacggcgtcgaaactggtcacgccttgcggcttgtcgatgatgagtaggccgctgggggttgtatgaagcacactactcctcgtcggactcgaactcatcgccctcggcttcggcctcgtcgtcgtgcttgtacggatcggcgtcgccggcgtactgggcggtggcgcgaacacgggcgagttcttcgtcacgcttcttggccacggcgagaatgtcttcgatctcgtgagcctcgccgggcacttcatcgaacacgaattggagctgcggagtcaggcgcaggccagccttgtggcccaccagagaacgcaggtggcccttggcctgatcgagggcctgctgggcgcgcttgcgttcgccttcctcatggccttcgtggccgagctgggtccagtagaccttggcgatctgcaaatcgttggtcacacgaacttcggtgacggtgatgctggcgagtcgcttgtcatgcagttcgcgctcaatggaggaggcgacgacacgctgaatcaaggccgcaatacgtgcggcgcgcgggttggttcctgccataggaatttcctttttctagacttgagccccctctgacgaggggctgccgaacgcagtgaggctgggggagagaaaatcatggaactaccatgtctctccccagccagcctgcggctgacagccccctcgtcagagagggcttaacaatgactacttgcgctcgacttcctgcatctcgaaggtctcgatgatgtcgccgagttcaatgtcgttgaaggtgccgaggttgataccagcctcgtagccttccttgacggactgaacgtcgtccttgaagcgacgcagagaggagatctcgaggtcgttgaccgtggccacgccgttgcgcaggatacggcacttcgtaccacgcttgacctcgccgtcctgcaccataacgccggcgatgttgccgaacttggaggagcggaagatctcgcggatctcggagtgagaggtgacgacctcttcgtattccggcttgagcatgcccttgagggatgcctcgatgtcttcgatcgcacggtagatgaccgagtagtacttgatctccacgccctcgcgctcggcgaggtccgcgacctgacggttcggacgcacgttgaaaccgatgataacggccttgtcgaccgtggccaagttgacgtcattctgggtgatcgcaccgacaccgcggtggatgacctggatgccgacctcgtcggacacctcgatcttcatcaaggaatcctcgagcgcctcgaccgaaccggacgaatcgcccttgatgacaatattgagcatgtcgatctcggactcggcgaacttcttcttgaagtcctcgagggagacgaccttgcgacgcttggccagctgggcggcacgctcggtggcctgacgcttctcggcaatctggcgggcggcgcgatcgtcggaggcgaccaggaagaggtcaccggcggtgggcacggaggtcaagcccagcacctgaacaggtgtggacggaccggctgcctccatcggctgaccgttctcgtcgagcatggcacgcacgcggccgtacgaagtgccggccacgatggcatcgcccacgtggagcgtaccctgctgaaccagcacagtggccacggcaccacgacccttgtcgagtcgggcttcgacggtggcaccacgggcgtccatgtcggggttggcgcggaggtccagctcagcgtcagccgtgagcagcacggcttcgagcagcttgtcgacgtgcaggttctgcttggcggagatgtcgacgaacatggtgtcgccaccatactcttcagggaccaggccaaactcggtgagctggccgcggaccttctccgggttggcaccgggcacatcgatcttgttgacggccacgacgatcggcaccttggcggcctgagcgtggttgatggcctcaacggtctggggcatcacaccatcgtcggcggcgaccacgaggatcgcgacatcggtgagctcggcaccacgggcacgcatggcggtgaacgcctcgtggccaggggtatcgaggaaggtgatcttgcgcggttcgccttcaaggttcacggtgacctggtaggcaccaatgcgctgggtaatgccgccggcctcacgtgcgatgacgttggtcttgcggatggtatccagcagtcgggtcttaccgtggtcgacgtggcccatgacggtgacgaccggcgggcgaggcttgagatcctcgtcatcctgcagttcttcctcgtcaaggttgatgtcgaactgctggagcagttccttgtcttcctcttctgcggagacgagctggatgttccagccgatctctccgcccagaatctggaaggtctcctcatccaaggactgggtggcggtagccatctgacccaggtggaagagcacggtgaccagcgcggcctggttgacgttgattttctccgccagatcggccagggacgcgccctgacgcagacggatggtctggccgttgccgttggggatgcgaacgccgccgatggtcggtgctttcagctcctcatactcatgacgctttgccagtcggttcttacgggcctttgaggacttgccgccctgacggccgaatgcgcctgcggcaccgccgcgaccaccacgaccgccgccacgtgcgggaccgttgctcggtgcgccgccgccctggaaattattgccgccgccttggcccccacggaagccgccgcgtgcgccgccctgaccggcaccctgggagccgccgccctgacccggacggttgtggccccactggccgggacgtggaccgccctgaccaccttggcccggacgaccgccacggaagccgcggccctgcccctggccttggccgggacggcccggacgaccgccacgaccgctatcagcagtcggacgagccatcggatgcggacgcggaatatcacccggcgtcggggtgtgcataccctgcttgcgggagaacgggttgttgcccgggcgcgggccctgagcgtgcgggcgcggaatcgcgtttgaagcggcattgccgccattggcaccggcgccgccctgagcgtgcgggcgcggagccgaagcattgtcgcggttgttctgatgctgccccggctggccattgttcggacggccctggttgttacgacgatcgttgttacggcgatcgttcgggcgactctgacgaccgttctcgcggccttcgcgattatcgcgaccattctcacggttgtcgtgctgaccgtggcggccgggggtcggcatgccggggcgtgcgccgccctgcggacgcggtgtcggtgcgcccggagtcggagcctgctgatgtgccgaggcgggcgatgcctgacgtgcgggagcggccggagtcggtgcggaagatgaagtggaagccggggccgaaggtgcggccgggcggcgctgctgcacgggcttggcagccggcttttgtgcggaagatgcgggcttggaatcacccttggcgttgtccttggcgaactctgccttcagacgccgggctaccggcggttcaatcgtagaagaagcggacttgacgaattctcccatgtccttaagcttctcaagcacggttttgctatcgacattcaaaaccttagccagttcgtatacgcgtggtttcgccactaattactcctattctgtgaccacgcgcgtgcatgggcgtggtcagttggtgatgacggcaagcctaccctgtctcatcgtgcgaccatgatcgtgttacctcgtctctggtgtgggcgatttcgcgcacactgcaccagcccacatacgccaatcaagcatactcatagcgctggatagcgcagacgcagcgagccgcgccattgctgacgcggctcgtatcaggaaataatgcgccctgaagatcattcgccttcgagcccggcggcctattcggcttccggagcagcagcctcggccgcagcctgggcggccttttcagcggcgaccttcttggcatgggcctcggcggattcgatgccgatcttccagccggtcagcttggctgccagtcgtgcgttctggccttccttgccgatggccagggatagctggtcgtcgtggatgaaggcgatggcggtcttgttcttctcgctgatcacctgtacgccggtggccacagccggggacagcgcggctgccacgaacttggccggatcgtcggagtagtcgacgatgtcgatcttctccgggccaaggttctccataacggcacgcacgcgagcgccgccggggccgatcagcgcacccttcgggttcacgccatcggtgttggccttgaccgcgatcttggtgcgggcgccggcctcacgagcgatggccatgatggacacggcaccggagaccagttccggcacttcacgctcgaacagcttgcggaccagctccgggtgggagcgggacaccacgatctccgggcccttgatgccacgggccacgttcaccacgtacacgcggatgcgttcgccgtggcggtaacgttcgccgggcacctgctcacggcgaggcagaatggcttcgacatcgcccatcgcgacatgcacgttggaggggtcggaagcatcctgctggatgatgccggtgatgagcttgcccttctgaccggagaacgcaccgaataccttctcatcttcggcgcggcggaacagctgggtgatgacttggcgtgcagtggcggcggcgagacggccgaagtcacgcggggtgtcatcgtattcctcgcccagcttgggagcggggtgagggttgtcttcggtgggttcgaccgggatttcgtcggcggcccacacggtgaagttgccggaacgttcgtcaagctccacgcgcgcgtgcttggcggcgtgcggggtcttgaggtaggcgaggcgcagggcctctgccagcgcatcatccagggttccggggtcgattccttgctcggcggcgagcttgtgtattcctgtcaggtccagttccatcgatccgtacctcctatgaagttatgcggcgcatggcctatgagtggtcacagttagctattagtgtaggtttccatgcagacacgcttctcttcaggacggtttacccggcgcttggcatccgcactatgcgcgagcgcgatgctgtgttcgctttcggcgtgttcgatgccgcgactggccggacgggccgaggcggaagctcagatgagcccttgcgagaaagcgatgacgttggcggactacgccacccatccggctgaaggcacgccgttattggagcagtatgccaccggtctggccgctcccctggcttggattgacgttgccgggtattgttcgggtcgttttgccgagggaacgttacgtgacgcgcagaccaagcaatggctgacttttctggccgataaattcgggcaggccgcgcctgaggtgacgccggcgcgtcttgatggcgtcacgtccgccaacgttgaccgatcggtattggatgcgatggccgtggccgaggatcgcgccggattcgctatcgaggtcttgaccgcacgaggacagaccgctggggctacgttggcgttgagcgatatgcataagaccgccgggcagcagctggtgtcgctggccaatggcaattttgatgattccggcgcacaatccagttcttccggccaaagcgacccccgccaaaaggtctatgccatcgaccagctactggccaaccccaccaccatcgccgacaaggcaagtggccaaaccgtaccgaccgccgccgccatcgaaatggactgcgcccgcgcgcagatcaaggccgtgaccgaatcgaaatcttccaccgagagcgatacgctgctcatcctcgccgcactggccgccaagcacgcctacaccgcgttccaacttggctacccagcgactgacgccgcattgttcgagtagacacacactgcggcatatgcctttttcccgcagtggcgtataagacgaccagtacaagacaataatctgtagttttcactcatctgtagccgtcgaatatgtcgtcgtacgattatcgcaatacgcactcccacattcccccccgtattatgtgtttgcctctcacatttttcgggaaaaaatgtgagagatggtcgatgaaagccacacgtccgacagccaccggtgacgagtagtcatgcatcttcgtcttgtgggacggcagagaagtttgaccattttctgcgtgccgtcccacaaaaacgtgggatagcagaagcatcaatcgtttgccgtctgcggcatcccgcaccgtcggccttcaaaaccgcagaataacgccaattcccattaccaaccatggtcgtccaggggagacgctgtgggacggcagacaaaaaacgccgaaatccacgtggcgtcccccacacctcgtaaaactctcaccctgaaaagtactacaggcgcaatatgcaaagctacaaccctataccatccgcaactaaatcgaggtacgtgtgtgccgtagcatgctgcggcacacaccgtccacaaagccaatgcggattgtcagtgagcaagtcgagttgaggcacgttccaccaatgtgaaatcggtggtgtacgtacgggccgggcctgagtacccttcgatgcggtcgataagcatgtcaacggcatgcttggcataatcgtcgatatgtggatcaatggtggtcagcgccggcaccgagtacttggcttccggcacgttatcgaagccgacaacttgtacatcgtcaggtacacgcaaaccacgtcgttggttccggggtttaatctcaaaaagggaggacggccgttttggccgtcctccctagcaatggcgggcaaccggatgtcagtcggcgtcggtggtgaccttgaagccgttgtcttccgcgtatgccttgagcttctgctgcgccttggccatggcgcctaccagatcgccgttctcattcatctccggcacgatgacatcgttgaacacgacctccacctgggacatgaacgggagatactcccaatcggtgttgaccttgtccattgaatcgaagtagacggcgttgacatcatcattggcgtagtaaccgtcggtctccttcttattgcgctggttctcatcgtcctgatagacggaggccgccatgaagaagttgccgttgttggtatcctgccatgactggatggcatccttgtcggaatcaagccagttgatgaacgcgagagccgccgcctgcttctccttcgggcaagccgcggagacgctcatcatggagccgacggaagaggactggtaaggctgtcctttccaggacggtggggcagcaaccaccatcttgcctttgaggctcgggttctgttccttgtaggtgttgcccatccagttttcattgatgaacgtggcgtaacgaccgtcattaatcgaacggttgaactcgtcagtgaagacggtaccgccttcaaggacgccatccttcaggcacttctgcaggaattccgtgaattcctttgcttttccgctgttcatagtcagttcgacgtcgtccacggaattaaccttccacagacgcgctccaacggaacggtagaggttagtgaagaaggagatgtcggatcccaggattcccatatatttgttggaatcttctttgtggagcttaatgccctcgttgtagatgtcttcccagctttctggcacctgcaggttatgttcgtccagaatatcctttcgcacatagttggccaatggtgtggcgtcctgcggcgcaccgtagaggccgccggcgtaatgcacctgagcccatgcagtcttggtgtatagcttgctccatgccttttcgatgctatcgttggcaaaattcagcaatgcacccgaaaccgcgaactgctggaatttattagcgctcatctgcacgacgtcgggaatatccttctgggcttgaacgacgttctggaacttggtgaaatgatcctccgcggcaccggtgttgacaaagttgattttgatgtgcgggtacttcttctcgaatgccttgacagtgggctccatctgcttggcggaataggcccagacggtcagttcgacgttcttcgaggtgtcggtcagagcgttttcgacgtcctgcgcggtcacatcgctcttggcctggttcccattagtgctggaaccacatgccgagataccggccgtcattgccagcgccgcgatagcggccacaagcctgatactcttcttcatgattactcctttgtgtgtcatgaattactattttgttgttttcccaaagggcggatgccgcacggtcgccaaggcaacgaatgggtgatcgtagggaccgtgcggccgaaggttcactgcttgacagagccggccgcgaggccagactgccagtacttttgcaggaacatgaatgcgatgatcaacggaacaactgcgataagcgagcccgtgatgatgaggttgttcggaacctgaccgtctgaagttccctgggcacccatcttcagccacatgttcagaccgaccgtcaacgggtagtcgttggtattcgtaagcatgatcagcggcaggaagtagttgttccaaacaccgaccagcgtgaacagcagtacggtgacgaaacctggagacagcagcgggaaaccgaccttccagaagatggtccaagtgtttgcaccgtccagtttcgcggcttcgatcagcgagaccggaatcgaggtctgcgcatagatgatcatcagatacaggccgaacggcgtggcaagctgcggaataatcacggcccacggagtgccgaccagcccgatcttcgaatacatgaggaacagcggcacggtgatcaccgtagaaggaattgacatgaatgccagagtgacggccagcagggcgttacgtccagggaatcgcatggtggcgatggcatacccagcgaaagtggcaatgatggttgcaccaacacctgctaccactgcgtacatgatcgtattgaacagccaacgagtgtagacaccatgctgataagcaaacgtatcctgcacgttctgccagaacacattcttgtcatcgaaccacaggccgaaagagctgaagatgccctcactggtctttgtggaagagaagacgacccacagcagcggcacgaggcagtagatgaccatcacagccataatgatgtgcagcagccagttgagcacacgctgcttgccggtcagcttcggagccggctcacgctgctgcatgcgcttgtaatgcttgcttgccttgagcgccagtttggcgtctctgcgctgcagcgacttggaacgcggtcttgcgattgcttcactcatcacttgttctcccacttgttgccgatgatcttaacgacggcgaccaaggccatgacgatgatgccgatgaccagagagacggcagcggcatagttgacgttctggccattgaatgcgaggttgtaggtgtagatgttcggcgtatagctgctgttgatcacgtccggggcggaagtacgcaagatgttcggttcgttgaacagctggagcgtgccgatcacagagaagaggaccgtcatcacgatggtgctcttaatctgggggatcttcacggaccaagcgatgcgcagctccgaagcgccgtcaatacgggcagattcgtacaggtcgttcggaatgccgatcagtgcagaataataaatcagcatgttatagccaaggaagcaccaagtgcagatgttcgcgatggcgaacaacatgagctgcttcgacaacatattaggagccgctacgccaaacataccggcgatttgtccaaaaagaccatacttatcgccgtaaatgtatccccacatcagcgccgcgatgacgcctgggacggcataaggcaggaacagcaggattcgcggcaccgcgatatggcggatcctctgggagtccaagacgagcgccgccacgagggacagaatcagattcatcggaatctggatcgccgcgtaaatcagcacgttcctaaagccgccccacaaagcctcatccttgaacgctcggatgaagttgtcgaagcccgcgaatgtggtgccaccgagaagggactgcttgaagaagctgagataaagcgcgtagaacatcgggacgatcatgccgaacaggaagaccaccacgtatggaagacaatacaatatgcctatgtattggcgcttcggcttgcgcatcacggaagtatccggttgcgccgttgcatttgtcatagtttttctcctaacccgtctgaatgagcctgtcaacaacatcgtcgccattgccgtttcatccatcggtacgtccttcaatgtacaaggctttaaaaaaaaagcaaataaaacttcatcgcgcgtggcgaaattttcgttatcttgtttcccgcctgagaagggctttattgcaacgatatgcacaaatcgcacccatcgaagaaacagcagccaatccatggctgcagcatccgtctccgctatataggcagcaacacgccgatagaaaagctgttctagagtagcgaaaatttctctactctatatgtaccgtttttgcagcgtcgcatacgaaaagagaagagtcggggggcggtgacgttttgttggacttcgttgtctgaatggtcgttcgcaacgacagcacgcacgttcaggcgacaagcccgagctcgatgcgtttgcccatgatgctcatcccgtattcgagtttgatgcgcttgtccctgtaccaaaccatgtactcgtcgagcattttggtgaacccgtcgatggtgacgcctttgaagctacgcatgtggaagaattgttcctatagcccttcaaaggtgaggtttcgcagaaacaaaaagagtcccgggacaaacccggaaccctaaaggcggataaggcgagattcgaactcgcggaggctttcacctcacacgctttcgaggcgtgctccttagaccgctcggacacttatccatgctgccaaaatggcaacttgttcattatgccacattctgccgacctggcaaatcggagtttcgctgagcaagtctcaagtgtatgccgcttgagacatgtcagatcacaatcccggaattcgcccgaagcgctggcattgcgtttacgcgccaagcactccgacaggaattacatacactccatcatcgcgttgatacgcgaactcgccgacccccaccaacaccgccaagaactccggttcacgggttcgcgcactcggatttctcagcagtttccctttcagtctgcatagatttgccgctgcctcagggactttatcctcactgggcttaatctcgatgccgccccaccgtccatcggacaattcaataatggcatcacactccagaccggaatcgtcatgataataccgaaccggttctatcccaatatcgaggagagatctcgcatacaccaacagatcgcggatgcatagattctcaaacagaaacccaaaagtctgccaatcgccgataagagcagcaggactcatgcccaacattgccgccgcaatggaaggatcggcaaaataccgacgcgccttggtctggagtcgctttggatcccgtgccggcgggacccagccctttatcggatcgatgacgaacatgttctcgaacatggccgtatacccggataccgttctctccgaaatgaaatcgtcaagattttcttcagtaccgtacatatccttacgcaaggttttgaatgtcacagcttgactgatattgcgcgcaagcgaatccagcagacgacgagccacatcaggatccttgccttgcttgggcacactctcagtcagcgtgagtcgcatgtattcccgaatcagaatctgtgcgtcagatacaggcatagccaccgcctccggccatccacctcggcatacggcatccaacaacatctgtgtacttatctctgattttgcagcggcgaacttatgttcaaacagtccactgagacttaccgcacctgtcgagagtccggactcatataaagtcagaggattcatacggatacgtccgattcgtcccgcaccactatggttcggccgattctcattgagaggagtggatgaaccggtcagaatccactgacctttattcgcggaatcatcgtcgacgtgatgacggacttcatcccatatagctggggcgagttgccactcatccacgacatgaggtctatctcccaacagcatcaatgacgaatccgccttagccgcagccaaattgttattgcgatccacataggtaatgctggctgcatgggcccgcgcagaccaagttttcccgcaccacttggtgccggtaatctccaccgcgccaaagatgcgcatatatcgttcgatctgtgcatccacgatacgagggcgataggccttcggcttgatgtcgcccgccagagaatcggccattccgcgcacctcccgttatttcacgtccgccatcgcaataatccgaatttctcaactaccaaaatccgaatgttgcaacgacgaaaacccgaactttctaactacaataatccgaatctcccaactaccaaaatccgaatgttgcaacgacgaaaacccgaatattggtggtggtagaagcggtgacggggccactctgcattgagtggtctctccctcagtctcgctacgctcgacagctcgaacgcaattaaggacagctttccagctgccattttatttgctcaccgtcgttcgccttcgcctaaaaacgcctccggcgttttcttcacggctcagctcatcagagggagcttggatctcgtcctttacgccacctgttcgtggacggaggcgttgacccattgggactgctggacgttgtagccggagaagatgccgatgtcgagcatgcagtcgcggtaatcgcggccgtgggcgatggtgatgtagctgtcgtccaccaaccggttatgcgtgggatccagtccgacccatcggccatcctgatacacctcgacccaagcgtgggtcgcgccctctcccccaagcaagccggcaatgtagcgcgcggtcaatcccacgtgccggcacacggacagcatcacatgggcataatcctggcatacgcccttgcgctgggccaaggcctgttcggcggtggtgcgaatcgtggtggaaccgggcgtgtacacaaacgccttgtagacctcatccatcacttcagtggcctgctgcaccggagtggcgtcggaaggcaacgcagccaagcgttcgcggcatacggcaatcatcgcctccacggtcgggccgggaatggtgagcgctgaattgaatcggtacagcggtttataggcttccttatggatatgcgcattgtccacgaaggcgatgccggtcaccgaatagctgaatatgtcgtgcggctcggggatgaatccggtcatcaccacggagccaaaggagtcgatggtggtttcgagttcagtttcgggctgaatcttcacttccacgtcaatcacctgttggcgagggccagtggcgggaatacagcgaagctggaacctgtgatcggtgaccggtgcgctgaaggacagcctcatctcatagtcgaacacgagttttttcacaacgtctcctgcacttatacacgagccggcaaccggcacattctcgggataacaacactacagccatggctgaggtatggtccgcgcgctcacagcccacgcatatattccggcaatctgctgatacgcatcggccggcactcgggcgcacggttttttcgccataccaccatagcatttgaacccgtcagggcgaacgtcgggttaggggcgcttggcatccatgttcatggagctcagtgagcccatgtctttgatggccagggcgctgacacggccggaataatcgtcaaggtacttcttcagcaggtcggcgacttcctgatatccgcgagacggcagctgaccgaccagccagctcagcccatcggtgaagcaactgggcaacggcatgccgtcgaggatcatcgagtaggaggcgagcttcctaagcggggcttccatctcctccatcgtcaaaccgaagcgcgcgtacaggtcgatgcgctccagatacttgccgatgaagatgaacgccttcagcgtggggtcgaccggcgagttctcgatgccgccccagaaggcgagcatgtcatcggtaatatcgcgctgcttgtagatgtcctcggcgtcggccgcatatttggcggcatcggtgatgttggtcatcgccaactccacgtactgcaacagacgcgagctcaattccgggcgcagaatcatggcgttgttgaatgcggaggttacggccgaccgcaccgaatcagggttggacccgtcgtacaagaagctgttcacaaacccgtcgaagtcctcgaaatcttcgggcaggtcgagtgcgtgagcgaacggacggaaggcatccacatcggtgtccatcacgcgatcgtagaacgggaagaactggttcagcgtggtgaaggcgcgctcggtgtaccgacccagccaatacaggttgtctgccttggatgcggtaaccagcgacaacgagtggcggcgggactggctcagcaggttcgccacatacgtttcggcaccgtactcgtgctcgacgccggattcgggtgccagcacccaggtgtccttgaagccgccgccctgggaggagttgacgatcatctgtccgggcacggacgagtagcgggtcaggcccgaataccacacgtgcgtattcttgccggtgaccacgaaggcacgcagatcgcatttgcgcggcgacatctcaccggtcttcgggtccaccacatcgatatcgcggaactgaatcacctcttgggcgatgaatcgacgaggttcctccttgatccggttggcgagctcctcacgtgcggcggcatccagcgacgaaccgaacaccacgccgtaaccaccggcttcggccacatccttgatgaccagctcgcccatacgattcaggacttccttacggtcggcctcgaacatcggcatatacgtgggcgcgttgttgagaatcggttcctcgccgagatagtacttgatcatctgcggcacgaagtagtagatggccttgtcatcggccgcgccgttgcccggcgcgttgacgatggccacgttgcccgcgcggtaggcggacaggataccgggcacgccgatcaccgaatcaggattgaaggcaaacggatcgaggaattcgtcggacaggcggcggtagaccacgcccacgcggtggcgtttgccggcgtagtcgaggaagtagaccttgttgtccaccacttcgaggtcttcggggaaggccagtgcggcgccggttttctccgccagataggcgtgctcgaagaacgcggaattgtagcgtccgggggtcagcaccacggcgatgccttcggtggagacgaagtccatggccttgcgcagcaggcgcgggtattcgcgattgtcgcgaatgtgcacgtcgcggaacaggcgtggggagatgcgtcgctcgatgtcgcgcacgaacagcgggtagctggcgcccgaggggatacgcaggttgtcttccagtacccaccagcggccgtcctcgccttggaccaggtcctcgccggcgatgtgcgcgaagatgccgccgggaggggtcacgccgttgacctgcgggaagtagccggccgaggtgtatatgtattcctccggcaccacgccgtcatggatgatggccttgtcggagtagatgtccttcagataggcgttcagggcgttgacgcgctgcttcaggcccttctccagctcgtcgaactcgtcggattcgatgatgcgcggcacgggatcgtacgggaagagccggtcgtggtattcgccgttcttgtagatgccgaagcgtacgccgttgcgggacagttcgcggttgatcgcctcgcgacggttcaccagttcatgggccagtctgcgtgctgcggattcgatcatcgtgcctgctccttgctgtggcggcttctgtggcctcaagcggttgggcgttcgagcgtacgctgacgccgcaagccgtaaccgggtttgatggttacaacctaaggcggccccgtttcagcaaacgcgcgagaatgttacaggcaggtcacttcgccgaccgcactcgtctcgccgaccgcgcgcatctcgccgaccgcactcgttacaatgaatggctatgacacgactgcgcattgacttggcctacgacggcggcggattctatggctgggccaaacagcccaatctgcgtacggtgcaaggcaccattgaagatgcgctgcacaaggtgctgcgggtgccggccgatgacgcggccgaaccgttacgcttgacggtggctgggcgcaccgacaccggtgtgcacgcctcccaccaagtggcgcatctggatgtatccgatgaggtactgaatcgctgcgtaggtcacatgaccattccggtcaccgaggcgctgactcgcagactcaaggctgtgctgccttcggacatcgtcattcatggcattgccgtggcaccggccggtttcgatgccaggttctccgcattggagcgcacttatgtgtatcgggtcgccgatcgttcgtccgagatcgacccgcgcctgcgtggatgcgtgcttaccgtggatgaatcgctggatctggagcttatgaaccgcgcagccgcattgaccatcggcctgcacgattttggttccttcgccactccgaatccgggaggcactacgatccgcgaagtcaagaccgcctattggcggcgggtgccgatcactcccctggtgccggatgcgatggcatcgcatgaagcatatcggactccgtcgctggagtccggcctggtagtgttcacgattgtggcggatgcctttgcccgtaatatggtgcggtccctggtcggctcatgtatcaaagttggttcgggacgcaaatcactggagtggtttgccggtaaaatggccgacccagtgcgtgaaggctcaagcgggccgattgcgccgcagggcctgactttggagcatatcgcatatcccgccgatgatcagctggccgcaagagccgaggccattcgagccgtacgtacgttgtagattctatgaaacaatgcaaaagggctggaacccaaacggattccagccctttcagctagcttggcgaaagctattcagctcactcggccttctcggcgtcagcgggagcctcagcctcaacggcggcggcctcctcgaccggagcctcagtagcctctgtggcctcagcctcaacggccggagcctcttcttcggcaaccttggcggcggcttcagcttccttcacaacagccttcttggcaaccggctcggtgacgagctcgatcacagcggccggagcggcatcgccaacgcgcggagcgatcttgacgatacgggtgtagccaccttcacgctgctccatctgctcggcaatctgggtgaacaggatgtgcaccacggacttgttgcggatgacgcgcatcacgcgacggcgggagtgcagatcaccgcgcttggcgaaggtgatcaggcgctctgccagcggacgaaggcgcttggccttcggcagcgtggtggtgatgcggccgttctggaacaggctggtcgccatgtttgccagcatgaggcgctcgtgtgcggggctggaagccagacgcgggcccttcttaggtgtaggcattgggtttactccttatatgtccgttcttcagacaagcaggtgggcatatgcccgaacatccgcttgcctagtgaacgaacgattggtcaaagaggcagatcactcgtcttccggcgagaagaacgtgccaccttcgagattattggtatcgaaggccatcggcgaggacttgaggctcaggcccagggtctgcagcttctccttgacctcatcgattgacttcataccgaaattgcggatgtcgagcaggtcctgctcggtgtgggagacaagctcaccgatggtgtggatgccctcgcgcttgaggcagttgtaagaacgctgcgtcaggttgaggtcctcgatcggaacggccatctcggggttggtctcctcggccaccggggccggaccgacctcgacgccttcagcctgggcgttgagctcacggcacaggccgaagagctccaccaaggtggaaccggcggaagccaccgcgtcacgcggggagatggcgggcttggtctccacgtccagaatgagcttgtcgaagtccgtgcgctgttccacacgggtggcctcgaccttgtagctcaccttgagtaccggggagtagatggaatcaaccggaatacggccgatctcatcgttgtcctgcttgttcatctgggcaggaacatagccacggccacgctcgacagtgaactcgatctcgagttcgccgtcgtcggcgagggtagcgatgtgctgctccgggttggcaatggtgacgccggccggcggggtgatgtccccagccacggcttcgcccttgccgctcttgcgcagatacatgaccacaggctcgtcgtattcgctggtgagcacgatgcccttgatgttcagcaggatctcggtgacgtcttcctggacgcccggcagagtggtgaactcatgcagggcaccggaaatacgcacggaggtcacggcagcacccgggatggagctcagcagcgtgcgacgcagcgagttgccgagcgtgtagccgaagccaggctcgagcggctcgatggtgaagcgggagcgctgcggattcagagattcctcggtaagagtcggacgctgtgcaataagcactgtggttatcctttcagcttgaactcggtggtgcactcaccggtcaggcggttttggatggatttggtattgctgagtgctcagacgcgacgacgcttcggaggacgaacgccgttgtgggcttgcggggtgacgtcggtgatggaaccaacttcgaggcccgcagactgcagggaacggatggcggtttcacgaccggaacccgggcccttgacgaacacgtcgaccttcttgacgccgtgttccatcgccttgcgggcggcggactcggcagccataccagcggcgtacggcgtggacttacgggagcccttgaagccgacatcgccaccggacgcccaggacaccacggcgccggacggatcggtgatcgaaatgatcgtgttgttgaaagtggacttgatgtgagcctggccgaccgggaccgacttgcggtcgcgacgacggggcttacgagcggcttgcttaggtgctgccattgaccctcgtttcctagtaacgaactttgttgttgacgttcgggcgatggggtgaaatcatcccgtggcccgaatcatgccaccgactacttggtggccttcttctttccggcgaccgtgcgcttcgggcccttgcgggtacgagcattggtcttggtgcgctgaccgcgcacaggaagtcccttacggtgacgctggccttggtagcagttgatctgaatcttgcgacgaatatctgcatcgatttcacgacgcaggtcaccctcgatcttgtagttggcttcgaggtagtcacgcagcgtaatcagctgctcgtcggtgagatccttgacgcggatgtccgggctaataccggtcgcggcaagcgtttccttggcacgagtgcgacccacaccgaaaatgtaggtgagggcgatctcgatgcgcttctcattggggatgtcgactccggcaagacgtgccattgcgattccttcttgttgccgtaggtcttgcacccgctcgcccggttacccggcacgggcctacgtacccgtggttcagtgtcgttcccttgcgggaagcactgtgagagagtgccttatttacttagtgccgctggagaatctgctctcagccctgacgctgcttgtggcgcgggttgacgcagatcaccatgacgcggccgtgacggcggatcacgcggcagttttcgcagatcctcttcacgctagggctgaccttcatggttatccttttcttgtgtacctttacttgtaacggtacgtaatgcgtccgcggttcaggtcgtaagggctcatttcgagcacgacacgatcctgcggcagaatacgaatgtagttcttacgcattttgccggaaatcgtggcgagcacgatgtgcttgttctcgagttcaacgcggaacatcgcgttaggcagtgcttccacgacctgtccttcgacttcaatcacaccgtcttttgccatgtgcctctagtcctattccgttggatgattactatggcatatccgaagacacaccaactgtcaactatatacgcacatacccctgtacgaacacttggcgtgtcgcacaggggtatggaaacattgatgtggtatttcggcatcactccggcttgttggccgggccgccgaacctactactcaaggtggctgatgatacggccgctgatctcgtcgatgtcgccgacgccgttgaccacgacgagcagaccgcgagattcgtagatgtcgagcagcggagcggtttccttctcgtaggtctccaggcgcttggcgatggcctccggagtgtcgtcagcgcggccctgctcggcggcgcgcttcttcatacgctccagcagcacgtcgcgggcggcttcgagggccaccacgtggtcgagcggagtgtcgaggtcggcgagcatctcgtcgagagcggtgacctgggcggcgttacgcgggtagccgtcgaggatccagccgttcttgcagtcttccttggccagacgatccttgacgatcttgttggtcagggagtcaggaaccagctcgcccttgtcggtgtagctcatcgcctcaagaccgagttcggtcttgtttttgatgttgtagcggaagatgtcgccggtggagatggtggggatgttgaagtgctcggcgagcagagcagcctgggtgcccttgcccacgccctgggggcccatgatgagcagacgcatggtggtctccttttgtgtcggttattaatacggtttcggctcccttggttaagggagccattgagttatatatggaagaaagattgctccgtcgtggaacagtccactggactgttccactcctcgcgcgcccgcctgcccattgcgggcggccgctgccaagcgggcgtcagccttctttgtggtccacgttttcgaacaggaagccggtgtactggaactgttcggtctgggccttggcctgacgcagggtgtcgaggcccacgcccgcgatgatcaggatcgtggtgccgccgaacggcagcttggcgttgaggccgagggccatgatcagcacggtcgggatcagggccacgaacagcaggtagacggcaccgacggtgttgagtcggttcatcacgtaggtcaggtagcggctggtggcgttgccggcgcggatgccggggatgaagccgccgtactgcttcatgttgtccgcggtctcgtccgggttgaacgtgatcgacgtgtagaagaagcagaagaacacgatcatcagcgcgtacagcgcgatgtaccacacggaggtggtgttcgccaggttggcgttgatccacttgacccaggactggtcggacttgccgaactgggcgatcagggtcgggatggcgaggatcgaggaggcgaagatcggcgggatcacgccggacatgttgatcttcagcggcagataggtggaggagccgccgtacatcttacggccgatcatacggcgcgtatactgcaccgggacgcggcgctggcacagttcgacgaaatcgacgaagatgaggatgaccacgagcacgcccacgacgatgccgaacttcagccagtcgccgttcttgccgttggtgccgtagccgatctcccacagctgcggcaggaagccggagcagatggacatgaagatcaggatggacatgccctggccgatgcccttgtcggtcacgagctcggccatccacatgatcagaccggtgccgccggtcatgatgaggaccatgaccacgaggttccacacggagccgtccgggatgacctggtcgcagcggtagttgaacagggcgccggagcgggcggtcaccaggatggtggtggactggagcacggccaggccgatggtcaggtaacgggtgtactgggtgagcttggcctcgccggactggccctccttgtgcagggcctcgaagcgggggatgaccacgcgcagcagctgcaccacgatggacgcggtgatgtacggcatgacgcccagcgcgaagatggacagctggagcatggcaccgccggagaagaggttcaccaggccgatgaagttctcctgggaggcgctgccgatggtggccatgcacttgttcaccacgttgtagtccacgcccggggtcgggatgaacgatccgatgcggtagacgatgatgatgaacaggacgaagagaatcttcttcctcaactctttggtcttcagggcctggattagtgtcctcacctggatttcctccctatagcgcgccaatcacgcgaaatacacaaactaacgaacgagcatagtctacagtgcctacttcggccacttcatatctcgcggatgttacctgaattatgctccgtcgtactgaacggggggaagcatactcaaaacgatcattgtgttgagactgcttctctgcgctcagaacaacaattctttagaaaagggaacccccgtccacctattggcggacgggggttgtacagcctattgcgctccccgtaggactaatcagtcctcggaaacggaaccgccggcggcctcgatcttggacttggcggaagccgaagccttaacacccttgagggtaaaagccacggtggtctcgccgtcgcccagaaccttcaccggagcgttgtcacgaacagcgcccttggcgatcaggtcggccacagcaacctcgccaccctcggggaagagctccacgagacgagcgatgttgatgacctggaactcgaccttgaacgggttcttgaagccacgaagcttcggcaggcgcatgtacagcggcagctggccgccttcaaagcccggacgcacgtggttacgcttcgtctggcccttggcgccacgaccggaggtcttgcccttggagccttcaccgcggcccacacgggtgcggtccttcttggcacccggggcgggcttcaggtcgtgcatctgcaggatttcgttatctgccataatcagtcaacctcctcaacggtgaccaggtgacgcacggcgttcaccagaccacggttggccggggtgtcctcgcggacaacggtcttaccgatcttgttgaggccgagggtcttgacggtggcgcgctgagccggggtacggttcacgatgccgtggtgcagggtaatcttcaggttcttagccatgagtatcactcaccatccttctcttcggcggccttagcggcagcagcctcttcgcgagccttgcgagcctcggcaatgccggcggcacgggcgcgcagcagagcatcgggagcgacctcgtcgagcgccaggccacgacgggcggcgatctcctcgggctcttcgagctgcttgagggcgtcgacggtagcgcgcaccacgttgacagcggtggcggagcccatcgacttggtcaggacgtcggtgatgcccgcgcattccatgacggcgcgcacggagccaccggcgattacaccggtacccggggcggccggacgcagcaggacggtgccggcagcgtcgtgaccctgaaccgggtgggtgatggtgccgcggacgcgaggcacagagaacatgtgcttcttggcgtccagctggcccttggcgatggcggccgggacttcacgggacttgccgtaaccgacacccacggtgccgttgccgtcgccgaccacaaccagtgcggcgaagctgaaggtacggccacccttgtgggtcttggacacacggttgatggtcaccacgcgatcgagcagctcgtcgccgtggttttcctcacgacggttacgacgctcgccacgacggccttcaccgcgctggccacgacgacccttgcggtcctcgttgttggattcggtcgccacagtgttctgagtttcttcagccacttgggtttccttcgtttcgttgtcgctcacagtgcaagacctccctcgcgggcgccatcagcaacggctgcgacgcgaccggtgtacttgttgccaccgcggtcgaacacgactgcggtgatgccggcagccttggccttctcggcgatcagctcgccgaccttcttggcggcctcagtcttggtgccttcgaagccggcgaagtcggcctgaagggtggaggcggacaccagggtaatgcccttggtatcgtcgaccacctgagcaaccatgtgacggttggagcgggtgaccaccaggcgcggacgctcggggtaccggagatgcgcttgcggatacgcgcgtgacggcgcttgagagctaccttcttgccttttccgagaatagcaacgctcatatcacttaccagcctttccagccttgcgcaggatgcgttcatcggcatacttgatgcccttgcccttgtagggttccggagcgcgcagcttgcggatgttggcggcaacctggcccacgacctgcttgtcggtgccttcgacaaccacgtggttggcgtcggtcaccttcagggtgatgccttcgggcgggttgacggtgatggtgtgggagtagccgaggaagaactcgatgcccttgcccttggcgacggcgcggtaaccggtgccgacgatctcaagagtcttggagtagccatcgtgaacacccttgaccatgccggccatgatggagcgggccagaccgtgcttggcacgggtcggacgcaggtcatcagcggcggtcaggacgatctcgttgccttcaacggcagcggtgatgccttccggaaccacgtaggagtcagaacccttggcgcccttggcggagaagttctggccttcaatcttgacttcaacgccagcagggatggcgatggggagcttaccaatatgcgatgccatgtttcagctctcctttctcaccacacgaaggcgacaatttcgccgccaatgcctcggtcgaggcattccttctgagtcagcagtcccgaagaagtcgagatgatggcgatacccaggccaccgagcggcatcggcagggagtcggacttcgcgtaacgacgaaggcccggcttggagatgcgcttgatgccctgaatggaacgctcaccgttcggaccgtacttgagggtgacctcaagagtctggccgaccttggcttccttagcggtgaagtccttgatgtagccttcgcgcttcaggatctcggcgatgttcgccttgaacttggagtacggcatatccacggtttcgtgcttggccgcgctcgcattacgcagacgcgtaagcatgtctgcgatcggatctgtcattgtcatttgggcttgttgccctttctcgctatggtttccgccgccctcacgcttcttctagaagcgttcgggccgcggaccttcagcgtcgatgtttaccaactggacttcgtaacgccgggcagttcaccgcggtgagccttctcacgaaggcagatgcggcacaggccgaacttgcggtagacggagtggggacgaccgcagacctggcagcgcgtgtaagcgcggaccttgaacttcggcttgccggccgccttgttcttaagagcggtttttgccatatcagttctccttgaaggggaagccgaggtgcttcagcagcgcgtaagcttccttgtcgtccttggtggaggtcaccacagtgatgtccataccgcgcacgtgatcgatcgaatcaggatcgatctcgtggaacatggactgctcggtgagaccaaagttgtagttgccctggccatcgaactggtggccgttgatgccgcggaagtcgcggatacggggcagcgcgagggtcagcagacggtccaggaactcccacatgcggtcgccacgcagggtgacgtacgcaccgatggcctggccctcacgcaggtggaactgcgcgacggacttcttggccttggtgatcttcggcttctggccggtgatcagggtgaggtccttgacggcaccttcgatgagcttggagtcgcgggcagcggcaccaacacccatggagacgacgaccttctggacacgggcaacctgcatcgggttggagtacttgaactccttctcgagctcaggaatgatctgctcgttgtacttgaccttcaagcgcggggtggccggcgcttcgacagtagtatcggtcatgccagctcctttccggacttcttggcgacgcgcacgcgcacggtcttcaccttgccgtcacgcgcctcttccttaacggtgatgccaacgcgggtcggctgcttggtctccgggtcgatgaccatcacgttggagcgatggatcggagcctcagtggagacgatgccagcctgctggccctgctgcgttgcacgcacgtgcttcttgacgatctgcacgccttcgacgatcagtcgatcgttggagagcacctgcttgacggtgccttccttgccgcggtccttgccgcggatgaccttgaccaggtcgccgctcttgatcttggctgccatgtcagatcacctccggggcgagggacacgatcttcatgaacttgtgctcgcgcagttcacgaccgaccggtccgaagatacgagtgcccttcggttcacggccggagccgagaatgacggcggcgttctcgtcgaacttgatgtaggaaccatccgcacggcgggattccttgacggtacggacgacaacggccttaaccacgtcgcccttcttgaccgacccgccaggaatggcgtccttgacggaggcgacgatcacgtcgccgatgccggcatagcgtcgcttcgatccgccgagcacgcggatggcgaggagttccttcgcacccgtgttgtcggcgacatgaagccgcgtttcctgctgaatcattgattctccttagccgagctggttctccccatttaccggggcatcgtggttgcccataatgccccggtaaatggcgagccttgccgaactttacttacttggcgcgctcgataatggattcgagacgccagcgcttggtcttgctcagaggccgagtttccataatactcacgaggtcgccaatgtgggcgtcgttgtgttcatcatgggccttgaccttgctggtggaacgaacgaccttgccgtacagcgggtgggtcgaacgctgctcgagctcgacggtaatcgtcttgtccatcttgtcggacacgacgtagccgcggcgaaccttacggaagttacgctcttcagccataatcacttctccttggattcggtggcggccggctcctggctgatgccaagctcacgctcgcgaagcacggtgtacatgcgggcgatgtcgctcttgacagccttgagacgggcggtgttctcgagctgaccggtggcgtgctggaagcgcaggttgaacagctcttccttggacttcttcaagaagccttcgatttccgcgttggtcttctcgttgagattcttgatggagtaatcagcggtaccgactgccatcagatatcaccaccttcacgtgcgataatgcggcacttcatcgggagcttgtcgatagcgcggcggagggcttccttagcgacgtcctcggacacaccaccgatttcgaacatcacgcgaccagggcgcacgttcgcaatccagaactccggggcacccttaccggaacccattcgggcaccgagcgggtgcttggtcagcggacgatccgggaagatcgtgatccacacgcggccaccacgcttgatgtagcgggtcatggcgatacgcgcggcttcgatctgacggttggtcacgtaggccggggcgagggactggatgccgaaatcaccgaagttgatctcgttgccacccttggacatgccagaacgcacagggcggtgctgcttgcggtacttagtcctcttggggataagcattcttgctcactccttcgtttctgcagccggagcggcctcggcgggagcctcagccttgggggcttcggcggcctgcggggcggcggaacggttgccacggcgcgggcggcgatcgccaccacgacggcccggacggttgttctgctgagcctgctgctcttcgaactcggattcggtcatgtcgcccttgtagatccagaccttgacgccgatacggccgtacgtggtcttggcctcgaagaagccgtaatcgatgagggcgcggagggtctgcagcggaacgcggccctcacggtagaactcggaacggcttatttccgcaccgccgaggcggccggagagcttgatgcggatacccttggcaccggcgcgcatggcgtcctgctgggccttacgcatggcacgacggaaggtgacgcggttggtcagctgctcagcgatgccctgagcgacgagctgggcgtccagcgcggcgttcttgacttcgaagatgttgagctggacctgcttgccggtcagcttctcgagcttggcgcggacgcgctcagcctcggcgccacgacgaccgatcacgatgcccggacgggcggtgtgaatgtcgacgcggacgcggtcgcgggtgcgctcgatgacgatgcgggacacgccagcgcgctcgaggtccttgctcatctccttgcggatctgatcatcctcaagcacgaagtcgcggtagcgttcgccggccttgttggagtcggagaaccacttggagcggtggttctcagtgatgcccagacggtagccaaacggattgatcttctgacccatctttagcgggctccttccttgttagccacgacgaccgtgatgtgggaggtgcgcttgttgatacgagcggcgcggccctgggcacgagcgcggaagcgcttgagggtcacaccttcgtcaacgtaggtctccttgatgtacaggtcgttctcgcggaacggctcgccggccttatcggccttcacacgagcgttggcgatggcgctctccagggtcttgcggaccggcagggccgcagcctgaggggcgaacttcaaaatggtgacggcttcggtcgccttcttgccgcggatgaggtcgaccatgcggcgagccttgcgcggcgtcacgcggacgtgacgagcgattgctttagcttccatgttctattccttatccttagcgacgggccttcttgtcgtccttcacgtgacccttgaaggtcttcgtgggggcgaactcacccagcttgtgaccaaccatggcctcggtgacgaacaccgggacatgcttgcgaccatcatgaacggcgaaggtgtgtccgatgaaatcaggggtgatcatcgaacgacgggaccacgtcttgatgacgttcttggtgcccttctcgttctgctcgtcgactttcttctgcaagtgggcgtcgacgaaggggcccttcttgatgctacgagtcatcttctcgatactcccttacttgcggttcttgccggacggacggcgacgaacaatcatcttgttcgaagccttcttcggacgacgagtacgaacctcgcccttgccccacggggagaccggcggcttaccaccgcgggtacgaccgccgtgcgggtggtcgaccgggttcatggactcaccacgggtgatcggacggtggccgatccagcgggcgcggccagccttgccgagctgaatgttggcgtggtcctcgttgccgacctcgccgacggtagcgcggcagcgcgcgtcgacgttgcggatttcgccggacggcatacgcagctgagcgtaggcgccatccttggcgacgagctgaacggcggcaccagcggaacgagcgatcttggcgccacccagcgggcggagctcgatggcatgaaccacggtaccggtcgggatgttcttcagcggcaggttgttgcccggcttgatatcagcctgagcaccggtctcgatgacgtcgccctgcttgatgcccttcggcgcgatgatgtagcgcttctcgccatctgcgaagtgcaggagggcgatacgggcggagcggttcggatcgtactcgatctcggcaaccttggcgggcacgccgtccttgtcccaacgcttgaaatcgatgagacggtactgacgcttgtggccgccgccgcgatgacgggaggtgatacggccgtaagagttacgaccgccggtcttggacttcttgcgaaccagcgacttctcaggcgtagaacgagtcagctcggagaaatccgagacggacgcgttgcggcggcctgcggtcgtcggcttataaacgcggatagccataatgtagttcttcctttaacttttctcggctagccttcagttaccaaagatgtcgatcgtctggccctcggcgacggtcacgatcgcacgcttctgggaagcgcgctggccgaaaccggtgcgagtgcgctgcttcttgccagcgcggttgagggtgttgacgttcgtcaccttgaccttgaagatctcttcgattgcctgcttgatctgcaccttgttcgcatccggagccaccacaaaagtgtactggccacggtcggaagcggcgtagctcttctcggagacgacgggcttaagaatcacgtcgtgagcgggcttgtgaatagcgaccatctaaatcaggcctccttcggctcggtcttggcagccacgaaagcctcgaaggcttccttggtgaagaccacgtactgcgaggtaatcacgtcgtacgtgttgagctgatcgacgaaaatcgggtgaacggtcgggatgttgcgcacggagagccactcgttgatgttgtcgcgagtgaagacgaccgtggtgaacttgtccgcggtgatcggggccagggcggcgacagcggccttggtggacggctcggtgataccgaactccaccacggcaacgcgaccggcgttggcgcgatcggacagggcgtagcgcagagctgcggccttcatcttcttgggggtgcgctgagagtagtcacgcggctgcgggccgaacacggtgccgccgtggtaccactgcggtgcacggatggagccctgacgagcacgaccggtgcccttctgcttccacggcttcttgccgccgccggaaaccatgccacgagtcttggtggcgtgggtgccctgacgagcagcagcgagctgagcggtgacaacctggtggatcagcgggatgtgagcctggacatcctcggcggaaacgccgaagagagcctcaggagcttcaacggtgccggtggcctggcccttggcgtcggtgacgttcagagtaacgtttgccatggtttatcaggctcccttcacagccgagcggacgagaacgatgccgcccttggggccaggaatggcgcccttgatggcgaggatgccgttctcgacatcagcggagacgatgatcaggttctgggtagtggcggtcacatgacccatgcggccggccatacgcttgcccttgagaatacggctcggagtggcgcatgcgcccacagaaccgggacggcgctcgttcttgtgagaaccgtgagtacggcggtaggacttgaagccccaacgcttgatggtaccggcgaagcccttacccttggtggtgccggtcacgtcgacctcagcaccctcttcgaacaggtcagcggccagttcctggccggcctcgaactgatcgacgtcatcggtgcgcacttcgacgaggtggcgacgcggggtgacaccggccttggcaaagtggccagccagcggcttggtcaccttggtggggtcgatggcgccgtagccgagctggacagccttgtagccgtcagattcctcggtcttcacggcggtcaccacgttggtggacacgtcgacaagagtgacgggcacgaagaagccgttctcgtcccatacctgggacatgccgagtttcttgcccagcagagccttgcgattagacataatgcttcctcctcccttacagcttgatttcgatgttgacgtccgcaggcagatcgatgtgcatcagggagtccacggccttgggggtcgggtccacgatgtcgatgaggcgcttgtgagtgcgcatctcgaagtgctcgcgagaatccttgtacatgtgaggagaacggataacacagaagacgttcttctcggtcggcagcggaacggggccaacaacagttgcgcccgcgttcgtcaccgtttcgacgatcttcttcgccgattggtcgatgacctcgtggtcataggacttaagcctgatgcggattttctgtcccgccattgccgtccgccctttctagcgatgttcgttgtactgtttaccaacctgcttctagggcaccggcgcgcatggcctcccttggacatacgtcctctggcggtcatccgacatcagtgcgcggtttccggctgtcacttcacttgaagtggctcccggcccgcgctcgcttttttaattccaatttgcgagcccaaatcaggcaacttgtttattcaagcattgaggtgggacagcgcggaggaattcgcgcgtgtcgcgctcatgccgttcgtattacctcgcggcatagccgctccgcgtgtcgcctaccaacatccttctgaggcttacctatatatagtggtatagctcacgttggcgaatatggattgattaattgagttggatggtaacacgaattactcttaaggctcgtgacacaatcactggcaaagaacatcaaacctattcgtgagcacggcgccaacgtgttatatcagcacggcactctggccttactcgtgccggggctgctggaaggtaccaccaccatcggcgaattgctcaagcatggcgacaccggcatcggcaccggcgagggcttggacggcgagctcatcatcctggatggcgtggcatacaagataggccaatccggtgtggccgaacgcgtgccggacgacttcaccatgccattcgccaacagccatcgcgcggccttccagtaccagtgcgagcgtcatgatatcggcctagaagagctcaacgataagatcgtcaaggcgaacggccgcgcgaacacgttcttttcggtaattgtgcgcggcacgttcagcttcatcaagacgcgcgcggtcatcaagcagcaggcaccctaccccacgctggtggaggtggccgaccggcaggccgtgttcctgcgccacgacgtcaagggcaccatgctcgggtacttctcccccgtgatgttccacggcgcggctgtggccggattccacgagcacttcctgtccgacgacaagacgttcggcggccatgtgctcgatgcggtgcttgagcgcggcaaaatctacagtcaggtgttcgataccttggtgcagcatctgccggtggacgaccctgattatcgcaaccacgacttcagccaagatccgatagccgaggccatttccagcgccgagggcgatactcaacgagattagtctcgcataaacacaatgtgagccaaatgaacatttccgaacaatcgcacatgttgcataatggcggaagcactggcttctcgcacttcctatgttcgattgtcgcaatgcaggtctcacatctttcttattgagaaccattcgctgcgatatcatgacagatatgacttcccgccgcaagactcttaaacgcgattggttcgacaaccaacctggcgcatgggtaatggttatgctacccgctgcggctgaggaaggagcgctcgctgtggggcaatgccgtgtcggccatggccacggtgatcgcgtcgtttggcagcgctgttgagacggcatgtgttatgcccatcaacgcagcacatgcctcgtgcgcagccgctgatgtcaccgccacacgcgccgccggatttgagccagatattcgaccttcacgcctggtggcctgcgggttcattgcccgtgaacgggctgattgccactgtgctgtttgcgctgacgcagtatgggtcggttttggtggtcaaaaccatgatccgggaacgcggggtggcggcttcgtgggtatggcatgtggcgctattgctgctagccgccgtgccggctggacgcagcccgtatctgattgcgatgactgtgctgctgttggcccgcgccgttgcgttgccgggttacacggcgcacaatcttgaagcccgtggtgaccggcattaccgaggcgtttgccagctttattgcttttggctgcattattgcggcgatttagcgacgcttcagcgattccatggggcggtaattccctcatggggcggtaattggcccatggggcggacggtaaaattttaccttccgcagaatagagccgttttcgtacaccgccccatggggttttcaccgccccatgagtgggttaccgccccatggaggtacctgctggctgcaacaccgcggttggtggctactgctggtgccagcagccgccaaccgcctgcaatcagcgctcggaggcttcctcagtggcggcctcgccctcgcgctcgatgcgcagcttgtggccttccgcctgggagacgccgtagtaggcaccgacggcgatgtccttcatgtcgttgatcagcgggatgcgcgggttggccggggtgcactggtcctcgtaggcgcgcatgccgatctgatcgagcacggaccagaagtagtcctcgtccacgccgcaatcctggaagctcttgttcatgccgagcttgttgtcgcggtagtcctcgacggccttcgccaggttctccacggcttcggccggggtcttgccggtgtcgatgccgaggttgcgggcgatgtcctggtagcgctccggggcgatgtacttgttgtacttcggccaagaggtgggctcctcaggaatctggccgttgtagcgaatcacgtacggcagcaggatggagttggtgcggccgtgggcgatgtggcatagggcaccgatggtgtgggccatgccgtggcacatgccgaggaacgcggagccgaatgccatgccggccatggtggcggcgttgtgcatcttctcctgagcgtcggtcttggccaggccgggctcgccgttgacggactcagccaggttgtcccagatgagcttggccgcgtgcagggccatgccgtcggtgaagtcgttcgcgtacacggacacgtaggcttccatcgagtgggtcagggcgtcgaagccggcgtcggaggccagcttgcgcggctgggtgcgagccagcaccgggtccacgatggccacggacggggtcagcgcgtagtcggtgatcgggtacttgtagccggtcttgtgatcggtgatcacggcgaacggggtgacctcggagccggtgccggaggaggtcgggatgcacacgagcttggccttcttgcccagcggcgggatcttgaacgcgcgcttacggatatcgaagaacttctcgcgcacgtcggagaaggcgatttccgggtgctcgtagagcagccacatgatcttggaggcgtccatcggggagccgccgccgaccgcgatgatcgtgtccggctcgaactcctcgcgcatcatctcagcgcccttttcgacggtctcgacggagggctccggctcgacgtagtcgatgatgcggaaggtcacacggttggagcgggcgcgcagctggtcgatgaccttgtcgacaatgccgagctgttccatgaccttatcgcacacgatgacggccttctcgatgccgtacatgtcgcgcaggtacttgatggcgttcggctcgaagtatgtcttggccgggatcttgaaccactgcatgttgttgttcctccgagcaatgcgcttgatattaacgagattcacggcctgcacgttgccggacaccgagttgccgccgtaggagccgcagcccagggtcagcgacggggcgatggcgttgtagatgtcgccgatgccgccaagggaggaaggctggttccagatgatgcggcaggcgtgcatacggacgccgtactcacgcacgagctcctggttgttggtgtggatggcggcggtgtggccggcacccagcttgagcatcttctcgcacatctcgaaggcctgctccttgtcgtcggccttgagcacggcctgcaccggagcgagcttctcgtgggtcagcggctcgtcgtcggagacttccttgcactcggcggccagaatggtggcgtcggccggaatctcgaagccggcggccttggcgatgaactgcggggacttgcccggcaccacggagttcagcacgggcttgacgccggagccggcggcgcagccgaacatgtactgttccagcttggccttctcttcggcgttgacgaagtaggccttacggaccttgagctccttgatgagctggtcgtagacgtccttgtgggcgatgatggcctgctcggtggcgcagatcatgccgtaatcgaagtgcttggagagcaccagatcgttggcggcacgcacgatgtccacatcggaatcaacataggccggggcgttgccggcacccacgccgagggcgggcttgccggaggagtaagcggccttgaccatgcccggaccaccggtggcgaggatcgtggccacgcccgggtgctgcatcagcgcgccggtggcctggatggacgggtgctcgatccactggatacagttctcgggagcaccggcctcaatggcggcgtcgcgcacaatcttggcggcctcgatggagcacttctgcgcgccggggtggaagccgaagatgatcgggcagcgtgtcttcagggcgatgagggacttgaagatggcggtggaggtcgggttggtaaccggagtgacgccggctaccacgccgacgggctcggcgacctcatcgatgcccatcacgtcgtcttcacggatgatgccgacggtcttctggccggccaagtagttggtgacgtgctcacaggcgaagatgttcttggtggccttgtcttccacgagaccacggccggtctcgtcgacagccatcttggcgagaacgaggtgcttgttcagagcggcgatggaggccttggcgacgatacggtcaacttgcttctggtcgaggttctcgaattcgtcgagagccttcttggcacgggcaaccagcgcgtcaacctcggcctcagctgcggcccgcttctcttccggggtcggcttggcggcttcgaccttcttctttgcttctgccacttggggtcctcctcgatcttcttggggtatatggcaaagttctgggccatcgcctcgtcacctcagttgcaccagcgggataccgcctcagtaaccgaaaatgaccggtgatgcgttgtcacactgcatatgtgacctgagtcacaatataccgaacggtccagcgcgatgcatacgcacaaaatcgacggcgtttcacgtttgatattgaacagtttttgttaagagttgtgcgaaatatcgaacaaatcctcactttattcggcgatttggtacttttcgttcactttttgccgagaatcaaacgcccgcgaacaacacaatacaagaacttttttaaagtaagttttcaaaagcgctcattctctccacatttctagaaaattgatttaaaaaagtacccaaaatcgcctacaaatatacgattgttacctcataacctccgcgtcgaggcacatgaaagccactttcataaagtacacttgcatatatctcatcgcacaaaggggtaactatgagggcaatgccatcgaccgcagtgaaagcgcgcaaccgtagtgccatgacccagtatctgtatggccatagccatgtcaccaaacaggaactggaacgcgaactcggtctcagcctgcccaccatcacccaaaatctgcgcgccctagaggatgacggactcatccgcaaaggcgaactgcaggattccaccggcgggcgcaaggcgcaaagttatgagttcaatcccgatcatcgcactgccatcggggtagtgatgcggtccaacgaactgcgcctgtgcgcgattaacctgtacggcaacgtcatcgaaaaacgcaacgaggccctgccttaccgcaacaccaacgtttactaccagcgtatcggcgacatcatcaacaacttcgccgccgacgtcgaaaagaagcacggcaaggcgctcggcgtctcgttcgccatccaaggcatcctctcccccgacgccaccaccatcaccttcggcaccattatgggcaacactgggctcacgctcgaaaccatcagccaatcggtccattacccgtgcatgatgatccacgattccgatgcctcagccatggccgaactctggttcgactccacgctcaccgatgcggtgtgcgtctatctggagcgacgcccgggcggcgcggtgatcgtgggaggcaagctgtatcagggcccgaaccagtgcaacggcgccatcgaacacatgacgctggtgccgggcggccgcgaatgctactgcggccagcgcggttgcatggacacctactgctcgccggagaccttgtccgaggattacgaaagcattcccggcttcttcagcgtgctcgagcagggcgaacggcatcatcgcgagcgcatggatgagtggctggattacgtggcgcaggccatcgtcaacgcgcgatccatcatcgcgggcgacgtgattgtcggcggtgaagcagcccagcatcttgaagacagcgacatcgaggatctcaaggcgcgcgtcatcaatcgtagcccgttcggcaccgaccatttcaatctgcgcaaaagctaccgcgccgaagatcagaacatcatcggtgccgcgttgcggttcgccgagaattatctcgacgatatctgtggtgctgtggaacgcggcaggaaatcaagggcttccaccaaaagtgacaacacgtctacaatggaggtatgaaaaacccaccgttgcatcgttacgccactcgcccagggctgtacttcactgacgacggtggggctgacgccgttgttcgttccgaaaccgccgatcaggtttggctatgcgtactggagcccattgatgagcccggcgctttcttccaagacgccatccgcctgttcgaggacccgaatatctcctttatccagcagattcatgagttcccggtatgcacgcgcattatcgaacatttgtatctgcgcgagaccctgttccgcatgaccgggccgaactacggcctgtggtacgtgcacctgcccaaagcatgggacggcatgcgttatggctaccgcgtggacggcgcatgggacccgaaacacggcgtgcgcttcaatccatacaaattcctgcttgacccgtatggcaagggcatcgacggctccatggagctcacccccgccgccttctcctatgaatgcgatgtcgtggaccgcaaggtaatcggctcggcatacggtgccatgagcaccgtagactcgctcggccatgcgccggtgtccgtggccatcgacgatcgcgacatccacaagcacgaggccgatccgcagcacccgcatgtgccgtggcgcaaaaccgtcatctatgagatgcacgtcaaaggcttcaccgccaacgcaccgtggctgcccgaatcattgcgcggcacatacgccggactcgcccaccccaccacgctcgcctatctgcagggtctaggcatcacatccatcgaactgctgccgattatggccaagcaggacgagctcttcctgcaagaacacggccgcaagaactactggggctactccactctcagctacttcgcccccgaaccctcctacgccactaaagccgcccaggagaagggcgcggccgccgtgcgccaagaagtcatagacatggtgcgcgcactgcacgaggccggcttcgaagtcatcatggacgtggtctacaaccacacatgcgaaggcggcgtcgaaggcccgacggtctgctggcgcggcctcgacgacctggcctactatcgccatcaaaaatccaataccggtcgactcgaagacaccactggttgcggcaatacgctggatttcaccaacacgcatgtggccacctttgccatcgactcattacgatactgggccaagcgtatcggcatagacggtttccgcttcgaccttggcgtctcgctggcccgtctggaaggcgaattcacccatcatcacccgttcctctacgccctgcgttccgatctgctgctgggcaacctgaagctcattatggagccgtgggatctgggcaacctcggctggcgcaccggccaattctccgtgccgttcgccgaatggaatgaccgcttccgcgacacggcccgcaccttctggcttgaagatgtggacggcggctccgatttcgggcgtatcagtttgcaggagatggccacacgactctgcggctcggccgatctgttcgccaccgaaccagggcgtggcgctccggcctccatcaatttcgtgtcctgccacgacggtttcacgctgacggacctcaccagataccgctccaagcacaatgaagccaacggcgaaaacaataatgatggctcatcggtgaaccattccgccaatttcggcgtcgaaggcgtcaccgatgatccagacgtcatcacggcacgcgaacaggcggccatgaacatgatcggcatgctgctgctctcgctgggtacgccgatgatgctcgccggcgacgaattccgcaacacacaggacggcaacaacaacgcctactgccaagacaacgacatcacgtggctgaagtgggattggatgtattccaccaacaagacacgcgagatgcgccgcttgaaaaccgtgtctcgactggtggcgctgcgtaaatcactggacctgtatcaccacgaggatttcttcacccgactgacgcagctcggcctgctcaagccctcaagccgcgtgcagtggttcctgcccgacggcaccacgccgatggagcgtgactggttcgatttgggcgtacgtagcttcaccatgcgattgctgtccaacagtgaggtggacgtgtgcattgtggtcaacggcaccgctgatgaccgcgcattccgcctgccgccagacactcactggacgcctaaatggtgctcggccgaaatcaacggccgccgagccgggcatggcactcaggtcgaggaatgcgatttgaacggtgacaccgccgtccggacgcagcatgtaccgaacgccagcgagacagtacgcaagctggtcgaagaaatgtccatgcagcgtacggaatcctcgactgagaatgaagcggatgccatcgaattcgcgatgccagtaacggatcacgccgcaaacggcacctcgtccgcgcctcgggatgaggtatcagctgatatgcctgatgcccctgtggatgacacgccggacactcccgtcgacgacaatgtctggaccatgccggcgctgagcatcacgctgatgaagcaggtgtgagtcacactcaaaacggcacgacataaacacaaaggctctccgtggaattccacggagagcctttgtatgctcggtacaggacaagcgaaattaacgcttggagaactgcggggcgcgacgtgccttgtgcagaccagccttcttgcgctccacgacgcgagcgtcgcgggtcaggaagccagccttcttcagggcggcgcggttggcatcacgatcgatggcgttcagagcgcgggcaacgccgaggcggatggcgccggcctggccggtggtgccgccgccgtcaacgaggacgatagcgtcgaacttgccttcgagcttgagcagaacaatcggggagttgacctcacgctgcagcagcttggaggggaagtactcctccagagtgcggccgttgatggtccacttgccgtcacccggaaccagacggacacgggcgacagcctccttgcggcgaccggtgccgtagcccggctcgatcgcggaggtgccggtgccagcgccagcgttggtctcggtggtgtagttggtgagctcctcttcggtctcgacaacctgggagtcgttggtgttttcagccatgattcttatctcctctcaggtttcacttggcctgctgcgagacctgggcgatctcgaagacctggggcttctgcggggtgtgcgggtgctcggcgccacggaagacacgcaggcggtcgagctgcaccttggccaaacggttcttcggcagcatgcccttgacagcgttcttgatgatgcgctcggggttcttctcgagcagctcggcgtaggagtcacgacgcagaccaccgggacgaccggagtgcgagtagagttccttgcccatcttgttgccagtcagagcaatcttgtcggcattgatgatgatcacgtggttgccggaatcggcgtgcggagcgtaggtcggcttgttcttgccgcgcagcagaactgcagcctgggtggcgagacggccgagcaccacgtcggtggcgtcgatgacgtaccagtcatgagtcagatcagctggcttcggagtgaaagttttcactggattaccttttctatattgtgttccgggtctcagctgcttggcgtggcttggtcagggccgcatccaagaggcatcgaacctcattatccgtgggctccctgaaagtcctcgatggcgagtgggatagcgctttgaaggaccccttagggaaacacaacaatccactagtatatcgccgggcttgacatagggcaactggggacactccattgggtttatggcttctcttcccctatttatggtctctctcccacccacttcggctaaccgactcacctacggtgaggcaattccctgccttctctcagctatcgcttcgttcaggcctcgtcttcggacagtccactggactgtccgcttaacgactcggctcgtcagagggaggtaaagcgggtcaggaattgaagatctgggcgaagcgttgggcgccgggggtgtcgaagagggtttcgagcggtaccacgttgcccttggcgtcggccagcgggatgcgccagttcgggtattcgttgttagtgcccggctggttctgcgcacgcttctcccccaccgcgtcggtgatcgaggcggcgagcagcttgcacggcgaacccttcagtgcgcggtacagcgcgtcgacgatatccgcctcgtgatcctcacgatgttcggcgaagtcggcatcaagatagccctgctcgaccagcatggccagcatcgcatcctgctcggtctttgcggaggcttcgaattcctcgaccgggccggtcagcaagcccagacgctcacgaatcttgacgtgctcgtattccaggtaaccggcggtcggcggcagatcgtgcgtattcacggaggccaatgcgtacggacgccactgggagggggcgcggaacacgccgtcgcgctgctcgaaccattcaacggcgcaaccgagaataccgtggctcgacagggaatcggccacatggtccggcaccacgccgaggtcctcacctacgaccacgccgccggcacgagaggcctcgatggccagaacgcccagcatgatgtctgagtcgtagtacacgtaagcgccatccatagccgaacggttctcgggaatccaccacaggcggaacaggccaaggatgtggtcgatgcgcaccgcaccggcacgggcgaacatgccatgcaccatattgcggtaggtctcgtagccggtggcctccagattgatcgggctcagcggcggctggctccagttctggccttgctggttgaacatgtccggcggtgcgccgaccgtggctcccttggcgaagcgctcgggattccaccacacgtcagcgccggaggggtgcacgccgacggccatatcggacatgatgccgatatgcatgccggcgtccttggctgtctgctgggcggaggacagctgctcggcggcaatccattccagccagcggtagaagtccaaagtgtccgggtactgcttgcgcagattggcgatttccggggagttgcggttgaacttgcgctcccagttgctctcctcgccgttgggcgccccccacttgtcgtagcacaggcaccacgtggcatacgcctccaagtcggaaccgtagtccgccttgaattggtcgaacgcgctttggcgttcggcggtgcggccggccttgaagataatccacagggcgtgcatcttgctgcgccacatggcgtcacggtcgatgagctgggaatcaccgttcagcggttcggtatcggcatgcagcccgtcgacggcgttcttgtcgccctcgctgagcgtggcatattcgacgatcgcctcggggcggatgtacgtgaagttgatcaggcgacggcttaccggcagatacggcgacggggtgagcggggacaccggctcggcggcatgcaccggattgatgagcacgaagtcggcaccggtcttctgcttggcatccaccagcatggtcttcagatcctcgtaatcgcccacgccccaggagttggatgagcgaatcgagtacagctgggccatccagccccacagactgccgcccttcatcgggtcaagcagatcgacgcgatcaggcgcactgatcaaagtggcgtcttgcacacggtcggcgaccttgacatgcagtgtatggtaaccgatcggcagatcggcgggaatgaccacagccgcattcgaaatgaacgtgccatccaagtcgtaggcctgggatccatctccaggaccaacttcaacggtgccctgatatggctcgccattctccagcgtgatgctcgccgaaggcacgtccagaataccggtgttcaccagcacccggtcctcgctaccggcgatatgcagcacggtgggtgccaccaatcgggagtaacgctcgttcagaatgcgtcggatggcgatgagttgggcgttctcgctggaggcgtcgatgcccagcgctgccagcacctcgatcaggacgtcatcgtctatctcgtggtagtcatggctcatgcccacataactcgtgccgacaccgaccaacttggccagtcgaatcaacggacgggccagacgctcttcactctcggtaatctcactcatagccccagtctaacgccgtttgattgcgccacaccgtaagcaaaatgccgtgattccgccaaattatgtacttttagccctcacacagtgagatgtgagcgctcacaatggtggatatggggtgattgccggccaaatttgcgcggcaaaacacagcaacagtgtgcttagcggcggctttccacggcgtgccgcacttcggccgaggggtcgttggccaacttggcaagcatcgcttcggacgtattgggattcagcgccacggcacggcggaccatcgaggaaagcaccgccggtgctccctcttcggattcggtgccaagtacgcccaagaaatccaatgtctccgcatccgcagtggggtcctgcgcgccctcaagccgcatcttccagctggtgcgcttgtttttcaacgccgtatcccggacctcgggcaccgggtccttggtcaggcggccgaccagccaattcttgtcgtccccgttggcggccacggcttgacgcacggacggttcggggtcttcggagagtttgaccaatacgttcgggaacggcatggtgtcggcgaggaacacgcgatcggccaccggggtgtgcgggttgccggccacagcctccaaaagtgcggtggcgcgggagaacgccgcctgatcggcacggtcaggcaacggccgacgggcgaattcggacagttcggccgggtcgttggaatgacgcagacgctcgtatgtagcggtcagcggttcgaaatccaccggagcggcggactcggctgcggcctgcgcgccttggtcctgctgctgggcgtccgtgtcggttgcagtctcagttgcggcctcggtgggctgggtctgctggctggtggtgttctcgtcggtcatgatgcccagcttagtcatacaggcgtcacgcgagcggaaccggaatgttgaccacgtcaatcggatccggcaccaccgcggcattgaacgcttcccgcacacgctcctcgaatcgcgcgcaatcatcctgcggcaccaccgcggtcaactcgacgttcgccgcatacgattcatcctcctgactgccaccgagctgcgccagaatctgctggaatcgggccaactgcgggtattcgaggcgaacccggtatcgcttggcggtcatgatgcgggcggcgcgggcggctttcatcgccaatgatgcggcggatgagtacgcgcggaccagaccaccggagcccagcagaataccaccgaaatatctggtgacggcaaccacgcaatcggtggtgccggactgcttgagtacgtcgagaatcggcttgccggcggtaccggacggctcgccgtcatcgctcatgcgttcggatagtcgcccatccgcgcctccgcacacggcggcatacgccacgtgtcgggctttcggatgctgctcacggatcgcggccacgaacgcgagcgcctcgtcgagcgtatcgacatgggcggcgtcgccgatgaattcggactttttttcgacgagcgaatcgtgggcgggatcgtcgggcgtgttgagaatcgtctgcatgagcgtgttccggtggtcgactggctgggtgttcgactgagcgcgaggccaagcagggctatcagcgttcggagacgacgacgttatagtcctcgccggcgaagtaggcggtcaggcaggcgatcatctggcgggtgagctccttgaacgcgccgtcggtacgccagccgacgtgcggggtcaggacgatgccgggcacatggcagatggcgtcgtcggcagtcagcggctcgtggtcgaacacgtcgagtgcggcgggaacatcgcccttttgcagtcgggcaagcagcgcaccggattcgatgacttcggagcgggcggtattgatgaacagggtgccgggcttcacatgcgcaaggttctcggcggtgacgatgccgcacgtggcgttgttcagcggcagatggacggagatgacgtcgctggtttcgatgagctcgttgagatcgtcgaccggagtggcgccggagcgttcgaaatgttcgggcggcacatgcgaattccatgcggcgacctccatgccgaaggcgcgggcgatgccggacacggtggcgccgatgccgcccagtccgatgatgcccatgcgacggccggcgagttgcagtccatcgccgccggcccacgcccagttgccggccttgacgtccttatcgagttggccaacgcggcggatgagctcgaacagaagggcgaaggtgtgctcggccacggcgtgatcgccataatgttcggcgttgcagacgcggatcttcagctcgcgcgccttatcgagattgatgtagctggcgacgccggtaccgcagaacacgatgcacttgacgtgcccctgctcgctgatggcgtgcagcagatcatccgaaatgtggtagccgcccaccagcagggcgtcggcatccttcagacgctcggctatggtcgcctcgtcggacgtgaattcctcgaacatacgcacgcgggcaacgtcgtggagcgcggggaactgggccttgatgggctcgatcatcgcgtcgagcacggacggcatcacgacgaggggcagatcggtgcgttcgctctgggtttcgtagatctcggtcatacgctccaccttagaagggcggcgggagattggaacggaacgcaccggaccgcgcatcgatcggcgcagcggccgacgcatcggccgacacaccgccctcaagcacgaaaaagccggaaaccgttggaaatcagcggttccggctctgctcgcggagtcagagggattcgaaccctcgagccgtttacacgactaacaccttagcagggtgcccctatcggccactcaggcatgactccacgttacgcaataatgcgcaacagcaaattactgtaccacgtcctgcggatacggcgtgccgaacgacacattattggccgtccgcgggcgcggcatcgccggagaacgtaacgataaccgcgcaaatcaccaacaccacaccgatcacgataagcaccacgggaacatggttgaggataccgaccactgccttcttcatgaggtttacgctactcggagagccgggacagcgcgcagtggcttggaaggcgttgcggacagtgacgcaatgtggacgattccgtggaatcgcacccaccatgcgaaacagccgcacagtgcgcaaacccttggaattccggtgatattcggcattatgacaatgagcgccgcgccatgcgcgccacatagtgagcatgacctcgttcggcattcctacaatggtggtatgagcaccgcaccgagacttgaggccgccaaacgcgattggggtcacgacgagaccggatgcaccgtgctgcatatcgacatggatgccttctatgcctcattggaggtggcgcgcaaccccgggctcaaaggcaagccggtgatcatcggcaccgggccgcgcgcggtggtgtccgccgcgagctacgaagcccggagatacggcatcaattcggcgatgccggccgcgcgcgcccatcagttgtgcccgaacggcgtctttctgccggtggatatggcgtattaccgcatgatgtcgcaccgaatcatgcacgaggtgtttttgaccgtcaccgaccggttcgagcaggtttcggtggacgagggctatatggatgtgtccaccgcactgctggagtgggggcgaccgagcgcgatcggcgcgtggattcgcgctcaggtggccgagcgcttccacgtgacgtgttcagtgggtatcgcctgtaacaagctggtggccaaaatggcctcgaccaatgccaagccggacggcatgctgctgattccggcggcccgctcggctgagttcgtgcagatgatgccattgcgtggcattccgggcatcgggccgtctttggagaagcggcttaatgcttggggcgtgcattcggtggctgaattggctcagctggatgagactgcattgactcgtgccactggctccccggctgcggcacgtggattatgggcggcctcgcacgggttggattcccgcaaaattaccacggtgcgcgaggagaaatccattgggtccgaggaaaccttggccgaggatacacgcgatatgcgcgtggtgtgtgggctactgcgttcggcctgcgacgaagtagccagcacgctgcggcgcaaggggctggtggcgcgcacgctgacggtgaagttgcggttcgccgacctgagctatcagacccggtcttttacgatggagcggccgaccgatacggccggcgtgctgtacccggaatgcgtgcggcagctgaaagtcatgctggggctaccggcctcggcggagtctgccactcccctgcccaaaactattcgcttggccggtatgagcacgtcttcgctcagcgaggcggcggctacggccgtgcagccttcactggatgacatgcttgaagaggccgccaatgcccgcggccagacctcacaggcacgtttgcatgatgccgaggccgcactggacgctgtgcgccgcaaatttggcagcaaggccgcccagtttggggcgtgaacggctcaacgccacttgcgatctcattacgccgtgagacgttcgcaggcggagcggatggcctcgtcggtggcggtggcggagaaacgcaggtaggcgggagcgccgtagaattcgccggggctggggatgatgccgatcttggcgagctcggccatatcggcccagcagtcgccggacttggccttgacccatacgtacagcgcgccggagggcatttgtgccgaatagccatatgccttcagtgcgtcaaccagcgcggataggcggcgacggtaacgcccccattgctcgtgtacagcggctgtgtccttcagacctgcggccatggcggcctgcaccgggccggggataatctggccgatctgcttgcggcattcggccatttccttgactagccggtaatcgccggcaatcagagccgtacggtagccggccatgttggactgcttggacagcgagtagagcaccaggatgccagctgccgaaccttcacacacatgtggattcagggcacatggcgtggcggagagactgaatgcggtatcggaggcgggctcgttggattcggccaccggtgcggcaggcacagacgcggcagatgcagacgcggcaggcgcataggacgcggctgtattgcggcgcgccgaacgccagtccattaacgcatagcattcgtcggagagcaccacggcaccgatgcgacgggcagcagccacgatgtcggtcagccagtcagcggagatgacctcgccggagggattacacggcgagttgatccagatggccttgacgttcggaatattcacccaggaatcgacgtcggtcacatcatcgactttgaccacggtggcgccggcaagttgggtaccgatttcgtaagtcgggtaggagacagccggttggacgaccacatcgccttcgccaaggtgcagcaggctggccatcagcgccacggcctccttggaacccacggtgggtacggcggcagcgttgatggatttcagatccaccccgcgcagttcgcggaaccatgtatcgatagcggccttaaggtcggcggtgccggcggtgaccgggtatccatgggcgttgggggcgtctgcgccggcaaccagcgcctgctggacactgctcggcaccgggtccacgggtgagcctacggacaggtcgatcatgccacccggcacggttttggcggtggttttgaagccggcgatacgagaccagtcgtatggcgacgaatatgcgtggaagcccatgagaacccctttcttggacggtatgttcctaagatacgacgaaccctcggccgtgatagaccgagggttcaatccgaactatgcgctgtgtgcagcgcttatccgcaaatcagcttactggttctgcggcggcagcgcggcgacctgttccgggtctttgccgattgggccattggcggaagcgccgcccaaatcgccgacttcagcgaagaagttgatagcggcatccttgtaccaagcccactcgtccggcagatcatcctcatagaagatggcctcggtggggcacaccggttcgcatgcaccgcagtcgacgcactcgttggggttgatgtacagcgagcgggaaccctcgtagatgcagtcgacggggcactcgtccacgcaagccttgtccttgacatccacgcaaggctgagcgatcacatatggcatggaatcctccttaacagatactggtacgagggtacgcgcccgttgggacgctcctcgctctcagccgttaacggccttatcggtttcggcggacagcgtttcggtcaggtcgcccttgccgaggcgcgcatgccagtagccgtagccgaagtagatggcgacgccgaccacgagccacaccacgaaacgaatccaggtgagtacggacaggttgagcatcaaccagaagttggccacggcgatgaggatcggaatccacgggttgccgggcatcttgaaggcacgcggcaggtcggggcgcttcttgcgcataatcgggatggagatggccaccagcgtgaaggcggacagggtgccgatgttgaccatgtcggagagcacgccgatgtcgaagaaggcggccacgagcgccaccaccgcgccgacgacgatctgcagagcggccggggtgccatgcttgccggtcttggacagaccgcgcggcagcagaccatcgcggctcatggcgaagacgatacgggtcaggccgagcaacagcaccataaccacggtggccaggcccagcacgatgccgaagctgatgatcttggcggcccagtcggcgcccaccagttcgaaggcggtggccagcgaggggctgtcttgcttggcgagatcggcataggagaccatgccggtggtcaccacggccacgagcatgtacatgacgatgatgagcagcatgcccacgccgatgccgagcggcacgttcttgtgcgggttcttggtctcctcggaagcggtggccaccacgtcgaagccgatgaacgcgaagaacacgagtgccgcgcccgagaggatgccgggcacgccgtacacggatggggtcatgccggtggcgaactgccacagcggctgggtcatcaaaccagtgacggcggaggagccttccacggtggaggccggctggctcggcggaatgaacggggtgaagttggaggccttgacgtagaagaagccgacgatcaccacaaagaacacgatggcgatcttgagcacggtcatagcaccgtccacgcgggcgccgatcttggtgccgaatacgagcagcgtggtaaagaacgccacgatgataatcggggcgatatcgatatggaaggagccgaacgtcaggttggtgttggcgttccagcccatcaggcgcatgaaatcgttgaggtatacgccccaatacttggaaatcacggagccggccatcagcatctccaggatcagatcccagccgacgatccaggccatgatctcgccgaccgtggtgtaggtgaaggtgtaggcggagccggccaccggaatcatcgaagcgaattcggcgtagcacatcacggctgcgccgcacacgatgccggcgatcaggaagctgatgatcacggccgggccggcgtggaaggcggcggcctgcgcgcccaccgagaagatgccggcacccacggctacggccacgcccatgattgacagatcccaccaagtcaggttgcgcttgagcttgcggccctcttcacccgtttcggcaatggtctgttcgacggatttcgtacggaacagttgcatagtgctcttctttttctctgttgtttgcgcaccgaatgcgcacaataccgacaatcgagtatagaagagcccgtgtgtcttgtatattaataagacttagagtccgcaatatatgggattaataccccactccatcgatcaatagcgcgattacagcacaccgacgcagaccggttcgggcaccaagtccactccgaacgcgctcttgactgcctgctgaaccgcgcgcgccaaagctgcgatatcggccgcgctcgctcccccacgattggtcaaggccagcgtgtgctgcgtggatagactggccggcgcgtccgcatcgaccttatatcccttatggcagccggcatggtcgatgagccaggcagcggacgtcttggtgccgggagtgccgtcgggcagagtcgcgtcaaacctcggcgcatcttcgggcagggccgccgcttggtcggcggtcagaatcggattcataaagaacgagccgcagctgtggcgattgtagtcgggagcaggcaggccgtcatcgccaacgggaatgccggcggcctcattgagggaggccagacgctccagatcggtcaggatattggcctcgtgcttggcggtggccatgtcgggcaaggcgtagcgagtggggtcctcaagcatgcctttggcggcacgtactgcgagcacggctttgcggatgtcggcggtggccatacggtcgcccacttcgacgccgagcgctttggcgagctgtccgtaacctaccgtgccttcggccgagtgggtcagggcaaaggtgacggagagcaccacgtaacgtggcgtcgggaagaatcggtcggccggctggccgggaccggcgtacatgctggccttcagtgcggagcatcgatagccgaatcgaagatcggctggcgtgaggtcgcgcgtggttttggtgtctcgatcccagacttccaccgattcgaccgaagtggcgacttcctgcccgtaggcgccaatgttctgcaccacggaagcgccgactgtgccgggaatgccggacagtccctcgacgccctcgagcccgagctctacggtgaaggccacgaaatcatcccaattggcaccggcctcggcattgacatgcacggtgcgatcctcgccctctaccggcgcggcttcgtccggcacggtgatgaggcgtcgggcgtctcgaaccaccacgccgtcgaaaggcctatcggaaacaagcaggttggacccgccaccgatgacgaccagaggcaggcctttggaatcggcatcctccacggcttcgatgagccccacgcgcgtggtcggctcgatgaaatgggcgatgggtccgcccacgcccatggtggtgatgtctgcaaagcttgtcatggcttcctatcttagtggcgcaggtgcgatatcggggcaatcatcagctgaaacggcagaacacccgcgaggggttcgttcagacgcggggtctctgccgtttctcacgcgatgcggatactgattccgcaccctgccactcggctctggagtcaatacgcaaaaacccggccgaatgggccgggttgtgtaaagctgtgatacttgcgatcaacgagtctcgcggtgcacggtctgcttgccgcagcgcgggcagaacttcttgagctcaagacggtcgggcgtgttacgacggttcttagtcgtaatgtagttacgctccttgcactcggtgcaggccagcgtgatgcccggacggatgtcggcgctcttagccattgtcattcacctctgtgttcttaggtatagtgcgcgcccaccggttagcaggcgcgatttgtagcgaggaagaggctcgaactcttgaccttacgattatgagtcgtacgctctagccagctgagctaccccgccagagagccccgagtgagaattggactcacgacctcttccttaccaaggaagtgctctaccactgagctatcggggcgtggcggatagtggattcgaaccactgaagcacgaagcggctgatttacagtcagctccctttgaccgcttgggaaatccgccagtctgtttcccgccgcggtgtttgacctcaacaggcaacttggctatataatcacaaattttccaggtacgcaaatcagcccctacgaaaaccttgttttaccgcggaattctgcggttttatcggcgtgtctcacagcgtgttttcagggtccgcttcggccctgcaaacagccccgaccaaggctgcaccccgcacttcacccaatcatttttcttatattgtgctccagaaccttgcaatggcgcggttttcgagcggtgtcgcctgtttgcggcggcacagcgcatgctggcatgctgggtgcatggcttctgatcttgtacatcacggacaatcattcgacgaccagccgctcggattcggcacgctggccattcacctcggtaacggggtcgacgccgaaaccggcgcgatccgtcgccccatcacgctggcgaacacctacgcgctgtgccctacgacccctcggccttggcgattgacaagcatctcgaatcgctggatgtggtgcgtttcgtggagtaccccggtctggaatcgcacccgcaccacgaggtggcggtcagccagctggtccgcccggactccgggttcggcggcgtgctgtcgttcggcctcgacaccgatcatgacgggcacaaccggttcgtttccaagctcaatgtgattacgtcggccgtgtcgctcagccatgacgaatcgccgatcgtgttcctcggcgaggatgacgagcgccaatacctgtgtacccgtctgagttccaccgcggcttcttccgtctggccgtgggtctggaggatacggacgatttgattcgcgacatcgatcacgcgctggtggaggccggattcgaggtgtgagaccgcatcgcgcgcacgatttcggcctcttccgccctgctgccgccgtcagtgagtcacaagatggctcggtgacgacgatggcagggcttttacgtcggcacagggacaatacctggcggtctgccgacgatgacggcacttatcgtcggcagaccgccagtttttggaccgtcgccgacacaaaacgccgatttgccgttggtaatggtccaaaaactggcccgataacgacaccaatgcggctcagcatcggcacatcgccatttcgtggcccactgccgacgctggcctcatgccacggcactcagcgtcggtagagagacaaccattggcacagcgcgacgacaccacgaacctgcgacacggaaaaaacaacataccgtcgatctactgccgtcttgtgcaaaatgtcttaagccgctcggccagatcgccgactaagcctcttccatagggaccccaatccgttacccagtgcagatgcggtgcaacgccgaactcaactacgttgcacgcatgcacctttatgcatagcaggcatggctgggcgtttggtgggatcggttttcggctcccctctctgaggggagcccctttccgcctggcaagagaaaaccccgactgtccgcgggaacagtcggggttgttgaagttcgctaggcgactaatcagccgaggatggcgagaatgtcgcgggcgccgacgatgaggtagtcctcaccctcgtagtggacttcggtgccgccgtacttggagtacagcaccttgtcgccgaccttgacatccatcgggatgcgctcgcccttgtcgtcacgacggcccgggccaacggccaggacttcaccctgctgcggcttctccttggcgttgtccggaatatacagaccggaagcggtctgggtctgggcctcggcctgcttgacgatgatcttgtcttccaacggtgtgagcttaatcgacactgtgggtcacctcgtatctacttgtagttcgataatgccgcgccagaacgcctcaagaggctgacgatcacttgcgttgtccctttgcgctaggacacatcgtagcgcgattattagcactctgccaactcgagtgctaacgctgtgagagaaaatcggcgaatcgcaacgctcagttgccgcggcgggcaagaatggagtccaagcctgcgcccaacgaatcggtggtcgccgctggcgcttcgacgtcggcacgctcctcggattcgtggaatgcagctcgctgggcggcgtttgcagcctcgtcaccggcgtccgtagcgacgttcgtatcggcatcatcgcgctgctccgactcagtgtctacagcgtttccggcgccgacagccttgcccgcatcggcggccttggcatcgtccgcggccttgacggctcgggcctcgtcaatcaacttctccgccactgcgggttcgacaggttccgccttggacacctgacgggtcgacttgatctccaagctctccggagcgttgtcggcgttatgctctccacccaaagtgaaggaaatgagatcctgcgaggtggccatatcgaagacatccagtgcccgggcggggcgtacgctggccagttccgacgtagcatcggcagcggcatcgtcgcgctcatcacgctcgtcacgcaccgtaagcgatggttcaactcgaggggcgacggacttatccgacttagtcgacttatccgtgcgagcggaggcatcgggcgcggcggaagattcactggtttcggcagcggacttacggtcagcggattcatcgaccatagcagacggttcggcggcaggcttatcggcggcggactgtgcagtatcagacttctcagactgtttggcgtgctccgccgcggcctgatatgcggcggcggactgacgcaacgccttggccttggcctgctcaatctcggcatcacgtaatgcgcagcgaatctgccgttgttccatgacctcggtgacagcatcctcaatctgctcggcaggcgcagttacggccgcaaccggttcggccttgttcacgcgcttgctgtccttggactcggcagacggtttcttggaccagcccgtaccgctatgggtccgctcgtagcggaccaccttgcgctcccattgccgggcctggcgtgaggcattggctcccagcaccagcagcagcagcaacagcacgaacggaataagagcaagcagcgggctgaaatgcagggggaacgatacggcaaacaccaacacggttatggcaagcaggcatacggcgagaatctgccggcggcggatggccgcgcggcgcagttcccgcacatgggcgatgtgctcaggtgtcagcctcgctgacggtgttgatgctggcattgctgcccctttcgccttatacggcttgatgtctccgaatcgtctgccgttctctgcatcaacgatatgcagagaaggcgaataacgatcctgccgatgctcgtccacacgtttcatgccgttggccgtacgtacgggcagccatacaacgataataatcgccacaatcaccagcacgacgacagtgctcagtgactcataacccatagagtcaaggataggagacgtaccgacgaactggggctttccgcccgggcgtgtcggagcggaattcttccggtcgacgcttatctggaaccggcggcggcgagtctggcggcgaacccttgcctcatatcttcagccaacagcgcaaacgttacgtgatcgcgccactggccatttacatacatataccgctcgcgcagtccctcatgatgggctccgaccttacgcaccacagccaaagaacgcgcattatccggcagaatggcgatttccagccgatgcaacgcgggcccgaatgggtctccgagcgcccaatcggcaagcatagccagtgccatcggcgcgaatccgtggccggcgtaccgttgatcgacccaatagccaaccacgccggtacgcatggcaccatacgctatggcgcccaacgaaatctggccgacgatacgcatctggtattcgatggcgaagatcacgccgacgccatgctgctcgttacggcgctgccgctgcacccattgattgaatgtgatggagccgccacgcatcgggtcaccggattcccaaggtgccagccagtcgttgttgcgccagcgcacttcgttccagccgtcctcatcatccatggtcagggggcgcaggactatcggaaaaccgggatgggtgagacgtggcgggcgaatctggtggtccagcttgaacgcctctttaatcgactggaaaactgacacggcccttattgtagccatatgaaggtcttgcgccgctaccgtggccactttcgttttacggtggaaacactagactgtgcggtatgagcgaagtgggcagtggcatgaatatcggcagcgactacagcggcacagagaaaacagagaagacggataaagcgacgctgcgccaccatatactgtctcggcgcaagcgcattccagcggaagaatgcggagcggccggtgaattgctggtgcgacggttcccagcacacatgattcaggatggtcccacagtggcggcatatgtgtcgatgggttcggaaatcgaaacccggccactgttgcgatggctgctggcccatggctgccacgtgttggtgccacggttggggtctgggttggaaattggctggagtgtgctggattcattggaatccttgcgctcgatggatgcagtgggtggcgcgaacaatgccggtagctgcagctctcccagcaccgtccatcacggacccgatgagccatcctctagcaccgtccatcacagaccggacgagccaactggcgcagttctaccgcccgaagcgttggagaaggccgatctggtcatcgctccggctttggcagtggacccgcagggcaatcgtctggggcgtggtgccggctggtatgaccgggccttggctcgccgcaagcccgcatgtcccctgattgcggtgtgctggccgtgggaggtgttggacaccgatttgccggccgaaccacatgatgtgccggccgacggagtgctgacgccggagggataccggcgacttagctcatcgggccggttgagctgaccggccggccaagatgctcggcgcaagccagactgaccaaccagccacgcacactggccgatggaaccagagtggcaacagcaagctggctagtaagaccgtaacgccaatgtgtcagggcggcgactaggatatgaacggttgcatggcatggtgttgcacgccatgcgcgagaaatatgactttgttggaggaatccgttgcctacctatcattaccgttgcaagaactgcgactatgacttcaccgaacagcagtcgttcaatgacgacccgattaccgtgtgccccaagtgctcgcaggagcaggtgcacaaggtgtattccgccgtgccgattgagttcaagggtcacggattctaccgcaccgacaaatccggcaagtaaggtcggctccccgttttccctcggtaaaagatggtgtcgacggcggtatgccgcggatattggcactacgggcactgtctgttgcacgggtttgaagcgttgtggataacttggcaagctagaaccacataggtcgattcagcttgcgcttacgaaaaacttcaggtcatcatggttgcatggtgaccttttcgtttattaagccgcctgcgcgcggttcattgcggcgacggcgcatggcggatgccttgcgccgacttactgctgcgttgtgcgtgggactcgcagtgttgtttgggcttgaagccgtattggccgtggtagagaccgagccgatggtggtggccgctcgttcgattcgacggggtgacattattctggccgtcgacgttcagttggctgctatgccggtatctgcgataggcccgtcttgggcgggcaatattgaggatgtggtgggcaaggtggcgcaaatcgatatcgaagcagccgatcccatttccacgcatatggccagagatgcgcccgtaacaccgaccggcactacggtgattgaagtccgcttggccagtagcgtcgacgatgtattggccggcgatcgggtgagactggtttccgccgtcggttgcgaaggtgccgattgcacgctggccgagaatgccacggtgatgaatgtcggcaaaccggatacgactggcgcattgggagtcaacgaccgactggtgtcgttcgcaatgccaccggaggccgcggccaaggttatggagctgcaacaggccggagcgattatggccgttgtgcgctaggaagcggaatcggccttcggccgatgctgtgttttcctcagccgtagggctgcggaaaacacagagttggggcgcacagagtgcgccccaacttctactcgcgctcgttgaaaacagcccagtgtggcggcagttcgccgaggatgcgtttgtcgtcgtcggattgccgttgttggttggtctgcatgtctccgggctcgagtttgacgccgtcagcgtcaaactgctcagtgcccttcatcaccacgcgcttgtgcttgcgcggtgtgcgccgtgtagccgagtattccgccatgattattcaacctcgcggtagatctcgccgatacggctgacgatacggtcgacttccttatcggggttcacaaaggcggcgacactccagacggtcatcacattccagcccaaggaaatgagatcctgtgccgacaaacgatgacgcctgcgcgtggattgcacggacataaagttcgcgtcatcggtctgcacggccaaggcaaacggcttgtcctttaatcccaccacgagcggaatcttcacgcccttgtcgaatccataatcaacagcagcgttcagtcctcgcgcgcgcaacctgtcggcgatatcgtcgaacagcacgttgccgcctgccgcaccacgcaacggaagcaccggacggtcgtcaagctgttcggcccacgtcaacatggtcttcaggaaccgagaaccggactggtgcagtcgttcttcatccaaatcttcggaaccaaaggccgacacaatatccaagctgtggtccgccaatgccagggcatccagcaacagtccgcgaccgcctgtgctttcgagcgggccgaactgctgaagcagacgtccatgcgtggttttcgcatagcacatcgacagaatcacgtcagtggcacgacctccggccacgtcacgcaaggaaaccagccgcacatggcgcaggaatcggcccatcgccttggatttgcctgccaacgatttcaattcggcacccaagcgtgtgcggaatgcgtcggtcaacgtcacgaccacaagtcgatagctggaaggaaccacggcaaaaccggcggcacgttgtgtaatcagacgcaccacttcatcaatctccggctggctggattccaccaggccagaagacataaccggcacaccgctcgcttccacacggtggaatcgcacctcaccggcagccggctcggtggccacatcatagcgaacaggaccatatccctcggattcaaggaatgcggacaggcgcggcgcacggcgagacggggcagcatccacctcgatatgaggcaacgtgtcgatcagctgcttgacgctttcgctggttaccgtcgcgcagtgggcgatcaccaccacctgctgcacgcggccgatgatggacagcaactcgatagcgggaatgtgcgcgcacgcatcgagaatcgccacatcagccagcacacccggctcggtgagtgcggcgagcgtacccggtgcggccaccagaatcggcttggccgcggccagaatctccggatgatcacggcgaatcctgctcagcgacacactggagcgccctgccagcacggtgtgcatctggttggcttcctgagtgcgggagaacagcatgtcgcacaggcggcgcatggattcctgcgacaccatcggtccgatggagcgcacgtgctccacatcgacctgtgcgaagcggtcggatgcggtctgcagcgcggcaccatcctggttggagatgatggcggacgaacgcacaatgtcctcaaacacggtggtccaccaggccagctgcacttcgccgcgcacctgctccacgctcactcggcgagcgttgagatcggcgaccagttcgttcagtccggcagaggcgaattcctgctccagcaggcaacgctccggcaaggtgtccagtgccttgcgatcatccagcagtgctttcaggcgtgcttccaccttctcgaaatcggcggtttccagattgccaccagcgggtgtggtggaaagcacggtatccagcgcggtcatattgctgaccagcgcctcttgggtggagatgatctcgtcgagcttgctgggcagcaccggccaaccgccgtgaggcacgaactgatgccactgctccccttgcttggcgactaccttcaacgcttcgtgcaagtcctcgacctgcgcgccgacgcgcaacagatccttggcttccttgatgtggcggcggcgctcccagaatcccatcgacgtgccttcggccttgcgctggctcttcggcttggtggcctcgatcatggagctgatgtctcgctcgaaaatctccggctggaacacgtcaagcactcgtcgcagattcttcaaaaccgtaacctgacgctcccactcgcgggtggtgggaggaaccgggaatccgcaggtctgcacggtgcgtgtcacctgctcacgggtggcgggcaggaagcgacgcagcaaatcgtccacgcgctggtagtcggttactgcctgttcttcagtggtgatggacgccttgtaccatgcggtgtcttccgggccgatggtgtattcgccgagctcgccggcgcgttccatcttgccgatccatgtgtcaatatcgttggcgatgctcagggcacttgactcgtcaagtcgaacgtgggtggcagggtgcgtcgggagcacggagatacgggccagattctgaatggtctcgtatgcggacacattccacttatcgttgcccccgtgcaggtcgcccaagtagcgggtcaagcgcgagcgcacgcccacgagttcgtcggccagctggtcgaatcgctgggtggcgactccgggctggaatccgactgcggcaatcagctgcttatcaagcgcggcgttggcgtgttcatcggatacatccagtacctgcgccttcatctcattggcggaggccgtctggatgaacagacgcttctgctcggccacgccgggcacgtacagcacggaacgaccattcatcaggcagcgcgatgcgatggccacagcctgctccgcggtgcccttcgggaaggtgccgtcgaccacgatgctatggccgttggcggcaagcgacgcggcatatcgcaccgtattgtccacatcgccgacttcgtactcggcatgcgggtctacgtcgaaaggactgtattgcggaatattggcgtctttgagcgcggtgcgggcggattcgtcgccggcaagcgcgtccaacagcacattgccggtggggccgttctccagctggtcgataaactgtcggctttcgctgatcatctgcgacgaggggtccatgaagcatccgagcacaatctggcgctcgatggcgaagtcggaaatacgctccgatgcttcggacgaaatacgggcgaacatcgcggaagtttcaggagtgccactgtcatagctggcaccgtcaaacagggaatcctcatccaggaacaccccctgctcacgcaatgcattgacgaacgcggcgttcagggtcacgcgaccggtgaatcgaatggtggtcgacaagccatcatccgcgatcgtgacgctcaccgggtacaacagtaccggcagcgcgttgcccttccacgtggccacgccgaccacgagcgacaactccgccacgccggaaatcctgcgtttggcggcctggtcatccagtacgcgcccgatatggcgttcggcggccttaagcacacccgtgtcacggaacaacgaatccaaccggacatggccggaagcgaacagctgggcgatgccggagggatgggcatgggtcatctccagcttcgcggccagctgattcacatcctcgagcggcgatggcggctgcatgctgcggtattggtcacgccagcgacggatgcgattcagaccttccgtgagattctggttctgagtctggctctgggtcatctctcgactcactttccaaccgcttcgcggtattcctgatagcccttgttgtgagacagggcttcgtcaatatcggcctcgccacgggcggcgagccaagaatacatgtcatcgtacaggtacggattcatggcgaggaacgccagcaattcaggatgacgggcgacttcgaactgaacattgaaatcttgcgtggtttttgcctcgtcagaggtcaggccatcgacttcgactgccggctcctgtgctttcagctcgcccttggccacacgctcgaacaccgagccgggctcgaagactggggtgtgtacgcccgtggagtagatatcagacgcttcggagaccgactgctgagcggtttcggtttcggcagacggctgctggtctgctacgcctgctgcggtggattcttgatatgcttcggctgcggtccgctgctgatcgtccggtacgtcagctgccggctggtcggtttcagactgggcggttgccggctgagcgatctcaggctgggtgtcttcagactggacgttttcggctgacttgcttgcgccagccgctgcatcggattcaacaaccgccgccgatgccactgccggctcgcttgtgctgggagagtgcttaacgacagcatgggcgatggcatctaccgggacaataccggagattctgctgtgcttggacgcgggcgctacggtcgacgactcaggctcagtttgctgcttcggcagtaccacggagtccatggcctgctgggttttgcgttcggtctcctgctcggcatgctgggccagcgcatccgcgaacaggtcacggggtatggccggctcatcgtttttcgtcacgggctgcgtgatattcagtgagccaagttcaagttcgtcaaccttgcgtcgcacattatccgcgctgaagatggcggtcggctcgccggcccgcaaatcaagaatatcgtcgacggacatatccgccgcatccggctcctgcggtgcttcgtgaaccgcatagccaaacaaatcaggcaccttgaggtcgagcggctttgccactggatcgtcgagacgaatgaagtccgcaggcacatcaccgaactgcatgcgcatgggagacgccggcaataggaactcggtattggccggcaagcgcaacaaatcgccattttcccgcaccacatacgatccattggtcgatccaagatcgcggaccgaggccgtaccgttgctttttaccgtgaacatggcgtgccgtttggacatcgatttggtttgatcggcgacgtcaaggcgggtgttgccatcatcggcaagggggcgtaacggcttacggccgatttccacgcactcccccggcttgacgctgatccggtcgacaccgttgatcttcaccgtccactcgctcaccgtgaccgccttcctggacacactatttgaacacactacgtgccattgtgtcatcttttaccggcttttggcggattactgggcacagaattgacaactttcgctcattgccagctttgtgattccacgccggatcgcgttctccgcctcgccctcgtcaactagtctactcagtatgcggaaaccccgcagcctgaaacacaggtgcggggttcctcgaaaagctgtgattgcggcttatgccgcacaaatcacttgagctcgacggaggcaccagcctcttccagctgagccttggccttctcggcgtcttccttcttggccttctcgaggacggccttcggagcgccgtcgacaagagccttggcctcggccaggccgagggaggtgatggcgcggacagccttgatgacctggatcttcttgtcgccgacggcggagaggatgacgtcgaactcatccttctcttcctcggccggagcggcggcaccggcaacagcggcgacggcggcgaccggagcggcggcctcgacgtcgaacttctcctcgaaggccttcacgaactcggagagctcgaccagggtcatctcgccgaaggcttccagcagctcatcgttggtgtacttagccattatggcttcctttcaatcttggcggcggacgaagtggtagatccgctgcctaataaaccttattgtttaaattatcgaagcgactgattcatgccgtgagggcgtaaatcaggcagccttctcctgcttttcgcgcagggcgtcgatcgtgcgcacagccttggtaggcagggcgttgaacaggtacgcggccttggccatcgatgccttgatgtcgccggcgaattcggcaagcagctgcgggcgggacttgaggtctgccagcttcttggcgccctcggcatcgtagacagtgccgtcagcggcggcacccttgatgacaagagccttattgtccttggcgaagtcacggatgaccttcgcagcctcgatgaagtcgcccttcacgaaggtgatggcggtcgggccggagagaatctcgtcgagaccctcaatgcccgcttccttggcggcgatgcgtgccagcgtgttctttgccacggtgtaggaagtatcgcggcctagcttttcacgcagatcggaaatctgcggaacggtaagcccgcggtactcggtcaggtagacggcgtcagcgttacggaattcttccgtaagctgagcgactaccgcttccttttcgggcctcttcatggcgttccttcctaagtcggccgttgacttggagttcggaactttcggccgggcaacaaaaaagccctgcacacaggcagagcaatacaatctcgcgaagcgaccttcgccggcccttgacgggcttatatctctcaacctgcgctggcttggcgaaccaaacttcggaaatgcactcgcgcgcacttcaaccaacggtctgtggtttacagatgattagactacggatggtcagcgacattgcagaattcgggcgtgtcgcggggcgttacagcgcggcggcgtactgggctacggacgcggtgacttccttcagatagtcgagcgagcgacgccagtggccgggcacctcgatcgaatggttggcatccgggcattcgtgcacgtgcggggtgagcgcgttggcgcgggctcgatcgtagaacggatcggcggtgccggcgcagatcagcggtgccgggccggagtatcgggagctggcggcgtgcgactggccggccggttctgcgcggatgatcgcccttgcttcggccacgctcggggcctcggcttcggcgacgatatcatcgccgacagccggcaccggaatcacccgggcggatggatcgaaatcggcgtgatgcagcaccggggtcagcagcacgaacggcagaccgtagtgtgaggccacatgtgggtaggtcatcgtcgtcagcgacttgccgatcagcaacaggcgagggccggacggggtgtcggaatcacggttcggcgagcccgctgcgccatcggccagcacggtagcagaatcatcggcggcaacgccatccccggaatcaccggctttacccgcgccggactcgcgcgcggcggccacccagccgtcaatcgcctgattgaggaccggaatcaccgtggacaggtcgtcggaagcgttgcgtacgttcatgcggtcgattcgccagccggcctcgaccagagcctgggccgaccagtagagcagcgggcggtcgcagttgtagccggtgccgggcatcagcagtacgcggccgtactcctggccgggtttgacgacgttcttcttccaagaggtgatgctgacttcgacggccggtttcatcgcgcgccttccttccacgggtgtgccctgcgtgtcccctgagttgttccgaattattctggcagtcagtctactcccggacccgttcacgttaccttcacaagctataatcggccacggttctgattgggtgcgcaacacctgacgcgcgttgggcaggccgatcagggcgagtcgcaattctcgccggggccagccgcagcattatgcgcgcggtgcgcagccccgcataaacccaaggaagtagagagtagatggagaaattcttccatttgaaggaaaacggcacgaccgtctcgactgagattctggccggcctgaccacgttcttcgcgatggcctacgtcatcgtcgtcaacccgcagatcctgtcgcagacgggcatgccgtggggcggcgtgttcctggccaccatcatcgccgccatcatcggcaccctggtcatgggcctgttcgccaacgtgccgtacgcccaggccgccggcatgggcctcaacgcgttcttcacctacaccgtatgcttcggcctcggcttcacctggcagcagaccatgtgcatggtgttcctgtgcggcctgatcaacatcctcatcaccgtcaccagaatccgcaagatgatcatcctggccatccccgagcctctgcagcgcgccatcggcggcggcatcggcctgttcgtggcctatgtgggcatgctgaacgtcggactgatcaagttcacccccggcgacccgaaagccgcggccaagggaggcgccgtggcggcgaccccgggtctggccgacttcaacgacaaggtgctgtgggtcttcctgatcggcctcgtactggccattgtgttcaccgtgatgaaggttaagggcggcatgctgctggccatcgccatcaccaccgtgatcggcatcccgttcggcgttaccacctggtccaactcgcagtccatcagcgaaaccttctcccagctgccgcagaccttcggcgcgatcttctccgctgagggcttcccggcgctgttctccgacgtctccaagctgcctctggtcatcgtgaccatcttcgccttctccatgtccgatacgttcgacaccctgggcactttcatcggcaccggccgccgcaccggcatcttctccgccgaggatgagaaggctctggagaacggtcacggcttctcctccaagatggacaaggccctgttcgccgactccatcgccacctccattggcgctatctgcggcacctcgaacaccaccacctacgtcgagtcttccgccggcatcgccgcaggcggccgcaccggcctgacctccgtggttgtggcgatctgcttcgccctgtccgcgttcctggccccggtcgtctctgccgtgccgtccgccgcaaccgccggcgtgctggtgatcgtcggctgcatgatggccgcctccctgaaggaagtcaggtgggacgacatcgccgaagccatcccggcgttcttcgcagccgtgttcatggccttctcctactccatctcctacggcatcgccggcggcttcatcatgtactgcatcgtgaagacctgcaagggcaaggccaaggaggttcacccgatcatctggattgtggccgcgctgttcattctggacttcgtgtgcatggcgattctgtgacgctgattgacgacagattagcctttaaggattaatccgccgccatacggcataaaggccgggctctcacaagggcccggcctttgttgttgccacagtgatcaacgcccatgagtaccttcgatgatcatccgccattcaatcaacggctggccatgactcggacatggcgcggcacggcaagcggattttgctgttgggcataacaacagacgagagaatagatccggtcgtgagcaacaggataggtgccatgcggtgccgtgtacaaactgttgtcagttgtcaacgctttttagcgtggctccaatcatcttaatggctgttttccgccattcttgatgcatgagaatagttgtcaactgacaactgaatgtacatggcagcagcacgagtgccctattcaacatcgaaatatgtagcgcgaagaagccgaaaaaccaaaaggcttctataccgaatgaaacggtatagaagccttttggtttgcgattaagctcttctcacccgagagaagctagagaacgatcagtcctcgaatgccgaaccgttaagcgggaagcccggtgggcttcccgtaggtgaggggagcggctatgccgcgaccgatccgtgagagggctttagtcctcgaacggatcaaagtcgcgacggacgcggcgacgcgggcgctcagtacgctcttcgcggtcggcgcggtagtcgtcgtagttgtcgtcagtggcatagcgcgggttgcggtccgagccacggccacggccgccacggaaaccgccacggcggtcatcacgatcgccacggtcatcacgatcggcagaacgacggcgacgcggacgatcatcatcacgggagtcgcgagcatcacggtcatcacgatcatcgaagtcacggtcggcagaacgacggcgacgcggacgatcatcatcgcgatcatcgcgatcgaagtcacggtcatcggagcgacggcgacgcggacggtcgtcgtaatcatcctcgaagtcatcggagcgacggcgacgcggacggtcgtcacgatcgtcgaagtcacggtcatcgcgatcggagcgacggccacggccgccacggcgatcgtcacgatcaccacggccacggccgccacggcggtcatcgcgatcgccacggctcggtcgggcgttgttctcctgatcctcgaaaccagggatggccagggagatcttgccgcgatcatcgacaccctgaacgatcacctcaacggtgtcgccttccctgagcacgtcttcgacggcgtcaatacgctcgccgttggccaggttgcggatctgggagatgtgcagcaggccgtcggtgccgggggtgaggttcacgaaagcgccgaacgacgtggtcttgacgaccttgccgttgtaggtttcgccggcctcgggcacgtgcgggttggcgatggaatcgatgatggacttggccttcttagcggcctcgccaccctcggaggagatgaagacggtaccgtcatcctcgatggcgatttcagcgccggtatcttcctgaatctggttgatcatcttgcccttcgggccgatgacttcgccgatcttctcaaccgggacggaggtggtgatgatgcgcggagcgaactcgctcatctcggccgggccgtcgatgcactcgttgatgacctcgagaatcgtggcgcgggcttccttggcctgctgcaaagcggcggccaggatgtcggcggggatgccgtcgagcttggtgtcgagctgcagggcagtgatgaactcggaagtaccggccaccttgaagtccatgtcgccgaaggcatcctcggcacccaggatatcggtgagggtcttgaagatgtgctggccatcaacatcgccggacacaaggcccatggcgatgccggcaaccggagccttcagcggcacgccggcagccaaaaggctcagcgtggaggcgcagacggaacccatggaagtggaaccgttggagccgatggcctcggagacctggcggatggcgtaggggaactcttcgcggctcggcagcaccggcacgagagccttctcggcgagggcaccatggccgatttcgcggcgcttcggggagccgacgcggccggtctcaccagtggagtacggcggcatctcgtagttgtgcatgtagcgcttggactgcggaccggacagagcgtcgatctgctgctccatcttgagcatgttcagggtggtgacgcccagaatctgggtctcgccacgctggaacagggcggaaccgtgcacgcgaggcacaatgtccacctcggcggacagggtgcggatgtcgcgcaggccacggccgtcgatgcggtagtcctcggtcaggatgcggcgacgcacgatctggcgctgcagttccttgaaggcgttgcccagctccttgtccttctcggcgtcgtccatatcggtgaactcgtccgcgagcacctcgcgcacgtgctccttgatctcgtggatgcggtcctggcgcggcagcttctcggcgatggagagggcctcgtccagatccttgtgagcgatctcgtcgatgcgggcatacagctcgtcggtgtactccgggaagagctggaattccttggtctccttggcggcgatcttcttgagctcatcctgagcctcgcagatcaccttgatgaacggcttggcggcttcaagaccaccggccacgacctcctcatcgggcttggtctgaccctcgtcatagatgaggtgccaggcgttcttgccggcacccgcctcgatcatggcgatggcaacatcaccgttctcgaccacacggccggcgaccacgatctcgaacacggcgcgctcacgctcgctccaacgcgggaaggcgacccactggccgtcgatcagcgccagacgcacaccggagaccgggccttcgaacggcaggccggaaatcatggtggaggcggaagcggcgttcagggcgatgacatcgtaagcgtcatcagggttcacggcgagcacggtctcgacgacctgcacttcgttgcgcagggtgtgcgggaacagcgggcgcagcgggcggtcgatgatgcggcaggcgaggatggcctcggagctcgggcggccttcacggcggaagaacgagcccggaatcttgccggcagcgtacatcttctcttcaacatcgacggtcagcgggaagaagtcgtagttctccttcgggctggaaccggcggtggtggtggacagaatcatggaatcgtcgtcgaggtaggcggccacagcgccatcggcctgctgggcgaggcggccggtctcgaagcgcagcgtgcgcttgccaaacgatccattgtcgattacggcctcaacggccttgatttcgggaccctccatagggttcctccttctttaattttctaattattcctacatactgtgctgcggtttggcgactcgcttgaaccgcaactgtcctcttcagcggacgtcacataccttgtttcgactgaccccttggccgtcgttcctcgtgtcaaccccttcattcgggttctcttgtcggccttacctgctggcctatcctctaaccctcttgccgttgttgccgttggctggcgatatgtaaaacgcccgagcaccatcctaggtactcgggcggaagtcttcaattatcgacgcagacccagacgctcgatgagggaacggtaacggttgatgtcgacgcgcttgaggtagtcaagcaggcgacgacggtcaccgatcatcagctgcataccacgacgggagtgatggtcgtgcttgtgctccttgaggtgctcggtcaggtcggcgatacgcttggacagcagagccacctggacctcgggggaaccggtgtcaccttcgtgcgtcgcgtactcgttgataatttgggtcttctcgtcagccgtcagtgccacggcgtcctccttattgtgtcgttgcgcggtgtttcgtgcaggttcgctcgaaacgctctctatccgcgggcgaaattacgccaaatgaaaactatacggcaggggccggactggggcctcatgagccgagggtgtaagggataagttgtaaagggtaagggtttaaaggcgtaagggtgtaaggggacactcactcctgccggtacagccgcgaatacaatccgccggcctgcagcagttcgtcatgcgtaccggattcgacgatctgcccatgatccatgacatggatgcggtcgaaatcccgaatcgatgcgagtctgtgcgccacgacgatgcacgcattgtcggagtcgagcaacgccgtcatgacatgtcgctcggtatcgttgtccagagcactggtgggttcgtccataagtaggaagtccggtcttccgacgaccggatccatcatcccctcgttgatgccggcaacctcgcacgccctgacgatgtcgtcatccgtcagccacggacggtgcagcgtgatattgtcgcgcaaggtttcgttgaacaccgtggattcctgatgcacatacgccagcctgccggccttccatcggctgtccgcgtcgtaaatccggcatccgccgtcgttgatggtcaccgtgccacagacgggttcgatgagtccggcgagcagtttcagcagcgaggcaagcagcatcgtcgcgaccaacggcgggaaaccgctttgggcggcgagcgacccatggtcgaccatatagccggtgcctgcgggcacgatcaatgtcagtccctggacgacgagcgaggacagcaggctcagaccgatggcgggcatgttccggcggaggaacccggtcaggatggagacggttccgctgcgaggccgtatgggaatggttgcgcagccgtcgtttgtcggttgcggaatcagcaccgcgccagaacagtgggccgcgagttcgccgggcgtataggcatggcgcccgttcgccgggtcagcgatgcgccttgttcgataaacgggacacggtggcgacgccatgatctcatgcttgccgtccgcgcgcgggaaggccgaagtcgacgtgcgtgcggtcacgcccgagcgtggacgccttggtgaacgcctcatagtcgtcgaattcggcgagcatcatatccttgacgaggtgtttgtcgtcaaggatgatgatccggtcggccacattccaacagtattcgaggtcatgggtgacggtgagcaaagtacgctcgtcggcgcgaagctggttgacgtaatcgacgagcagcgagcgggtgatcggatcgatggcgttgcttggctcgtcgagcatgatgacatgcgggtcgaacagcatgccggcgacgatgccgacccgtttgcgcagaccggtcgagagttccgccaccttcttgtcgagatgcccctccaattcgaaggcacggacgagcggctcatcctccagccgtttcgagtcgacggtatggccgccgtccgcgattcccttgccggaccggaacagcagttgccggaagtggatgttgtcacgcacggtcatcgtgccgacgagattgccgttctcggtcatctggaacacgtcgcgcatcgacggcacccgacgcctatcgatcacgcatcgcccttcacgggggcgcaacagtccgacgatgagtctgaacagcgtggtcttgccgacgccgttgtatccgaggatcgccagcgactggccttgcggcacggtgaagtcgatgtcctccaacacggtctgtctcttcttgtagccgaaggtgacgtgttcgacggcgatgatggcatgttcgccgttgtcggtgcggtcggcgtggttgatgtggtcggcggtcatattgtctttccttgtcgtcgattcggttgtgttcgtatccgtcatgtccggatgtcacagctcgatattggtgttgataaaatatcgagagaataatctggttgaaataccgatggcgaccactaccaatacgacataaccaaccgagaacaggcacagcggcatcacgttgacgaccacaagcatatatgccaattggagcaggatcgcaatcaacaccaaaaccagttgtgccattgtcggatcgctgttccgggagacataaaccatcggcattgcgcccaaagaacagacgattgttcctaagactgatacgataagagcaccaattgcatcatctgctccagcggttatctgaaagcctgatgacaaaacacgcataaaagccagattcaaaagcacggaaatcactgtcaggataacaggaaacaggcatttacaccagcagtagctccaataggaacgaccagactgtgtatagagctcaaacagtccatctcggaaatcctgatacaggatggagaccatcaccgagcatgacgaacagatgaaaaacggtccaaacaagacagcccaagtaaatgggtctagaatgcctgcgccactgacacccatctccacgaatattgccgtgaccataaggataagaaccataccccagttcttgaatgactggaaacatgccttgcagtcacgaaacagaatcgccttcatgccacttctccttaacgataacaagtgtcaggtatgggtcggatgttttacgcaatccatacctgacccatgtaaagcaacgttcacttgcagttcccacaggatgcaagtcgggtgacgaccgttaccgaacatgccgagaaagacacgctcagaacggaaaccgcgaacgacagcgacgccggcgcgacgccatcatcgttgcgatcggtcagcatcgccatatcggccgccgacagatcctcgaaggattcaccgacaatggacttctcattgatgctcatatagtcatccttaactaattcctgcccttcaggcgaagagctgctgtaagcatgacgcgctttctcccgcttcgcaatgacttgtatgccattaggggacaaggacttttatatgaatccatgttgtgcaatgatcgttgacacacctcgacgcaaaggaaccctcatgagagctttcaatacttacggtacttggtttgacattcggagcgtcagccagcactctaagcaacagttcaacggaggaagaaatatcaacatattcactatgccctgtatggttgccattatgccatatcagaaattaggtcagtagcggtaacatgcaatagaaagaccattcttcgccgtctttttcatatctgatgaatcctccttgtccagatatcaaacgggaatatatacttagcccttttcttgctcccaaagtcacacatcgccgactcttttgtcgacatttattcacctgaacaatatcaacagcattatttgaaaatgtgacaatgacggaatattcacttttgtcagcatagcgttcaatattcgtgtaaatttcacgcaacaggttaacgattatttgattccacgagttcgacattgcgctggatacaccgcgaagagatgaatgaccgcaaaaccctttgtcatgcaaccgacggtcactttcactcaatgtagcttgaatatgttcggcaagacttacatgaaatacctcatcttgtttatggtcatcatccgatagataattcataaccgaatgcagatcttggaatatcttattgataccgttctgcaattttctccatcgcttaagctcttcttccttcgatgcatcaataccttcctgcactatgaccaacattcgtgtcaactcaccagacatggcatcatgcatcccctcagcaagctgtaagttatatcgaacaatttcagctttcttttctaactcttttttcttttcaagtccgttcctttgccgtagccaaacccctaaaagaaacacaaaccaaagcaacaccaccaaattaatggaaccatcgaacgaaccaaattcactattctcccgatatatcgcataattcagcaaagcgctaatagacaacagtaccgttgccgtcacaccattccaccaaacagcagcatagccttgaatcgcaagagataccagaacaccccatgactcatcgcattgcgataagcaaggcatcaattcattcaggaatgcgatgacgataatcccccatgttgccggtaccggatataacggcaacatactcacagcaagcatgtacacgatgcgaataaacccatcattcaaactctcaggagaatcaagaatccattcggcgatacatgcggcaagacacgtcatggccactatcgatagaacaagattttttttcgatactcccaagcatttcttgcgaaccacaagtatcgttttcattgccaatcgtctcagcatcgttcccgcctccaccaataggcaatcagttcggctctggaagtaagatggagtttgttctgagcacggtcaagataggttttcaccgtccctgccgaaacatccatcatccgggcaatctgagtgggcttatacgactgtgaatatagttccatggcatatttttcccgttccgacaatctttcgattctattcacgggaagtcgaaccagacgatgatatgcagcatctacatcctcgaatccaatagtctcccctcctactcgaacacagagagtatgaccatcgctgacgagcttgaccgctttacacagtactggaaaatcagcttttgacacaatgccttgagcaccaccctcagcagcacgtcgcgcatagcgagttaaactgaacgatgtcaccgccagcaacggcaacatcctgttacgacttctgatttcccggcacaccatgtctccgggcatgtcctccagactcatgtcaaccagcagaatgtccgcttcatttgcgggatccgtcgcatattccagagcatcggttccggtattcgccttccaagctaaccgaacattcggcagatgacgcgacaagaacgctgccaaacccatcagcacgaagtcgtcgttatcgactatcgccagtctgatttcatttgggttccccatagtgcacatgatagacgtttttcgtacggacatgcccgccccgttgtctaattgaaagtgcaacacccgttggattggagattgtccggataaccagtccgaagggatgttgcacctatgggggaaacatgttcgcacctgtcggaagaggaacgccaggtcatccggatcgagatcggcaacggcaccagcatccgcaggatcggtctgatgctcggccgcaacgcctcgacggtcggcagggagatcgaacgcgacacgtggttcccgtccaacgagaacgagtcctgacggccgtaccggccgaaacggctgaagacgggcccgtggacgggcggatgctacatcgccggccccgcgcggcgcaaggccgaccgcaggcgcgccgaaccgcgcaggcgctaccgcctgtcacgcgaacgcctgtgggcgcgggtggccgaatggctgcgtcgcggctggtcgccgctgctcatcagcggcaggctgcgcgtcctgttccccgacgactccgccatgcgcgtgtgcccggagaccgtctaccgttggatccacgccgaccgccatcgccgtgaacgctgggcgcgccgccttccacgcggccacgggaggcggcgcaggcgtggcggcaggaggacgtcgcgtttcccgattcccggacgggttcccatctccgagcgtccgccggaggccggcgaccgcagcggtttcggccatcgggaggccgacggcgtgatcggcgccggatgcaacccgcacaccgaggtcgagaggaagaccaggttcctcatggccgggatcgtgcccggcaagaccgccggggaaagcgtcggggcgcggctggcgatgttctcgccgctgccggccggcgcgcgcggcggcgtcacgcacgacaacggcaccgaattcgcccgccacacgcgcctgcgcgacgggccgggcatggacacgtgcttcgccgacccgtactccagccggcggcggggaagcaacgagaacaggaacggcatgatccgccggtatccgcccaaacgcagcgaaatccggatggacatggccggggaactgcgggagattgtcgacgaggccgacaaccgtcccatgcgcgtgccggactaccggacgcccgccgaggcattcgccgacgaactgctggaattacaggaccaacaggggtgttgcacctctaaatagacatcgggcacacggtttgcgcggtggtgagcagtgagtggtgagtattgagcaacgtacggcgactcacgtacgctcacacagtggtgagcaatccgccaaacaacaccacgagcagggcgatggtttcaatcacgaagtacagaatgaaactcgcccagcttttggtcagcacgttcagcggcgaggtcttccggataatcaccagcagaccaacaaacaccagggcatatacggcgatgccgatcgccgcacccataatgcccaggttcgcggcattcgccaggccggcctgcttgccgtagaccacgtacgtggaataccagaaattgagattgagcatgctgagtcccgcgatgaactgctcgccggccaacccgatcacaaatacaatcagccacggccaggacggcgagacgaccaccgccatcgccaatccgacgtacgcaatcaccacggccacccaaccgaccagcgcgatgccttgcggagacactccccgagcacggccacaatggagtcagtattatttaccgccaacgagcgaccgaaccagtacggcgcgatgatggcgcacagtacggcaagaataatcagcgcccaacgcaacggatgcgaacgacggcgctcgatatccgccagagacaaatcggtctcgggtatggaagcctcggggtgcttggaaacctcgacggtctctagtttgccgcccacgatttccgtcgcctcgttaggttcttgctcgttggattcctgctccatgcaccgcctcgccgattacctgctcattgccgattattgcgatgcccatcttagcgtgcgtgttgggcaagtctccgatacgatcgattactcgccctggtcctcactatgatcctcgctacgattctccttatccgaatccgtgggagcaacgtcattattgcccgcagacaagccgctgttggctaattcgtgctactgccctatatcctgattttcggtgttttcagggtatagaaaaatccccgtagagcatactatgctctgctttcgatgattatcgaggtatagaacgcgcttcggcccaacaaccatatgcccccaaaggcggcaacaattacaagttatcccgcaccatcgcgacgacatcatgattgattttgttgatgacagggtcggcaagcatctcatcaagagtcatccagcggcagtccttggcaccaacatggaactcagtggaacgccaggcgtcaggcattaccgttacgctagcgcggtatagcgtgtattcgtaataacgaacctctccatcatgctccgtggatggcttctcagaatccttcacacaaatgtgagacagagtaaagtctttagcaggaattccgaattcatcggcaaaatacgtcgtcagctgacgaacatcctcatcagtactgcttgcggttgcatgattagggaaaaagtcgcatccccaacctaaatcacgatacagaagatatcggttagcatctttcaccgcaatgatcgagcttcttcgttcggttctatccatgttgacgatatcctcatacagtgttatggcatcatacttatttctgcaagcagtaatcaaactccatactccatagaatatgaagataatgctcaatgcaaggagcaatccttgaaacatttggtcgagtccagatgtgagagcagcaggaatgtaaaacaatccttcgatgatgatgacgacccattggcaatcggcccgaaaccaatctgctctttgtgctcaaagagcttggcacgcagttcagcttcgtcgattctcaacaccatgagtactaatactactcggggtagctcacccttccggtattcccaattagatacaccaacatataaatagtggagcggatgacgggaatcgaacccgcgtaatcagtttggaagactgaggctctaccattgagctacatccgcgttaaacgtcgcttttggcgacttgagttattatacatatttcttcgggaatggcaaacgcgtgtggctgcagcaggaccagccaatctagttgatggattgtggctttgccgaggactcccctcagccgcctacggcgacagctcccttcaaagaggggcgctagaaaccgtcgaaatcacaaatggatgagctgggactcgtatggttggaggtcggcgcccatcgcattcagaatcacgaaccagcagttttcgggcagcgagtcgagcttgtcgatctggttcttgagcaggcgcacgtcgcggctggtgagcgcgctccacaggttaaccatgatggagacgttgtacagcatgtagcactcgggggcctcgggcgctattccacagaaatcgtcaccaccgcggaggcaatcgggccatcgtggctcagggaaatatggatatgcggcatcgaccccgcaccgagagtcgagcgctgcgccgaacgcgcattccgtcgctcctgcatcactgtataaggcccgttatcggaagcaggggaataagcagaggaatagcgagcgccgtcagccgaattcgcgtaatcagtttggaagactgacgccgcccccttacccagagacacatgcggcacaccacgggaatcgtccaagatctcgatttcaggccacgggaaattatcaagcgtgaacggatagggggcatcgccaagataatcgcaccaggctttgaggaacgcctccttgcccgcccatttggcggccaggtggacggcctccccgtcattcttctggcgcgcgcggtcggatgcctgccgcacctcacgcacggagaacagcgcacgcatgcgagaccccggctccgccaactgttcggcgaatgcggccacatccaccacgtcatgccccaaaccacaagtattcatgcttcctattgtgtaccgcttcgcgcgtaatctctacacctcatcagaattggggcctgatttccatttcaagggggaaaagattcactatgctggatgacctcgcacaataccgcaaacatcttgggctggctgcctagccgtccaaaaaacatccgcgccccgccccggaggtctatctccgtttcgaggggcggattttgaccgttccggaggtctacttccgtttcaaggggctggtcatcctccataccacgagtatccgcagcataacgccaacgccattccgccgtttttacgccttgtctacttgggtaacagccccttgaaacggaagtagacctccggcgaatgccaaatcagccccttgaaacgcagaaagcccactccgagggaggggctttcgtatgttctgcatatttctctcactgagtttgtgccagcgagaaagctccaggagaaactcccctcacccgcttcgcgggagctcccctcaaagaggggagccgagatccggtgcgctactggctcccctcaaccgaggggagccagaggaatcaggcctcgtagtagccgtcggcaccgaggcgggcgtccgggttgaggagcatcgccttttcgacctcgtggtggtcgtagccacggtgatcctcgcggaagcgacggttgtcgatcggctcgtagagcgcggcgcgacccatcatgccttcctcgaggtgacgctggccggcggccaggcgggcgttggcacgctcacgccaggcttccagcgcggcctcgccatcggccttggccacggccgcttcgaaggcacccggatgaaccagggccacgaagccggaaacatgtccgaagccgagcgaggtggccagaccggccttgaccgggcgaccagcggtctcgcgaccgaactcgtcctcgccaccgccgatgcgcaggggcttcctaacccagaccatgtggtcgtcgcgctggagcttcggatccacgcaatcgagcgccgcgttcgccggaatcacgccggacttgaacagctgcgtcagaccgttgacctggaagatgcaggcaccacccttggcgtggccggtaagcgtcttctgcgagatcacgaacagcgggttgccgtcggtgcggccgatggcgtgggccagcgtgttgtgcagctcggattcgttcgggtcgttggcgttggtggacgtgtcgtgcttggagaccacggcgatgtcgtcggctgagacgccgagcttagccaggtcgtgcacgagcttggagtccttgccaccgaggccggcagccagggcaccgaggcccggagccgggatcgaggtgtgggcaccatccgcgtaggagtggatgaagccgaccacggccgcgaccggcaggccgagcttttcggcgatgtcaccgcgggtcacgaggatcgtgccgccgccctgggattccaggaagccgccacggcgacgatcgttcgcgcggctgaagaagcgcgcgtcgatgcccttgccgtacatttcctccgagttggcggtggcgttcatgttgccgaagccgatcacggattccacgccgatgtcgtcgatcgcaccggtgaccacgaagtcggccttgccgagggcgatcttgtcgacgccttcttcaagggagacggccgcggtggcgcaggcggagacgggctggatcatgttgccgtaaccgccgatgtaggactgcatcacgtgagccgcgaccacgttcggcagggcttcctgcaggatgtcggtcgggatctcgtggttgaggaagcggtcgaggtacagcttgcgcatcgacatcatgccgccgaagccggtgccctgggtcgaagccaccagcgaggggtggatggactcgaggatttcggccggggtgaagccggcgcccaggtaggcgtccacagtggtgacgatgttccacagggcgatcttgtcgacgtcgccgaccatcgaggcgggaatgccccatcgggtcggatcgaagcccttcgggaactggccgccgactgtgcgggtcatggtggcgcggcgcggcacgcggatcatcgagccggcgtggcgggtcacgttccattcgccggattcctcatccggggcgatggtggtgtgagcctcgtccaacttgacgtattcggcggcgacttcgcgggtgggcacagagaaggtgacgtcgtggtcgaggaagacctcagcttcttcttcgtcagcaccgtccttgtagtcgttgcccatgccttcctcgaacgggcggatgccggagcgggccacgacctcgtcgtggtagcgctcggcgatgtcctcttcgggcacgaggttgccgtcggtgtcgtaccagccgggcttcgggctgtcggcccaagtcagcagacccatgttccacgcaagttcgagcactgcgccggcgctcaggtcgacagtgccgtccgagtggatgccgagctcggcctgggtgcgcgtacgaccggagccccacgggcccagctcaccgacggaaacgatgacgatttcgtcttccggcttggcggtgacgttggtccagtcgttgaggtcgaccgaagcctgcttggtgatgatcggggtgggcagcgccttgatttgctgcccacgcgaggagtcggacagtccagtggactgtccggcgacggagccatccgtttcctgagacgaggccgcagcagcttccttctccgcatcggccatggcctccgcgcgcaacgccttgatgtcgatgggctcggagccgaggccaccggtcaggtccacatcgagcggggccttgagggcctgctcgcgcgattcggcagtgcacaggtcgagcagcttggccgcaatctgtgcggtggagtaggtgtggatgccgtgacgctcaacgacggcgaccagcgggtcgttaccgcccatcaggccggtgccacgcacccagccgatcttcgggtgagcgaaggtgacgcggctcgaccacaccttttcagcgcgggcacggttgacgatggcgtcaaaggcgctcttgacttcgccgtaggcaccgtcgccgccgaatacgccgcggttcggggagccgggcagcaccacatggagcttgtgctgcacgttggtgtcggcaccgatgtggctgaagccggcgatggcgcgttccacgccccacagcatcagtcgggcctgcgattcgaacaggtcgccggagtcggcgagcgtgccatggaccggcggtgcggcgaacgggaagaacagggtcggctcccacgcgggcttcagaatcgtggtggtggcaccggaggtcttcttctgctcgtggcccacccagtcgaccagagcgtcgacgtcgcggtagctggagaggttggccggaaccagccacagcttggcgttgccagtggcgtgctcgcggtaggcctgcttggcccaagccttgatggacagcttgaagctatgcgaagtggccaccacggtggcgccgcctgcgagcaggccttcgaccacctgagcggcaatcgagttcgggctcacgccggtgacgatggcgatatcattcgcgtaacgggaggcgttcttgttggaagcgacctgttcgagggcctcggagccggccttctggaaggcggccttaagctcctcgctctccgactcgttggcgaaccactgggcttcggcggcgatggtcttgccaaggccgatgaagctgccgttcagggcggcggggtcgttgccgtagtaggcgcgggcgaggtcttcacgggcggaggcccaccgatcatcgaagaggatggccttgttggcgtcgaagcgcggagcgacctgcttgggccagtcggagccaagttcggcttcgaccgcggacacgacggcggcgttctcgtcctcggattcttccggagccggagcggccacgccgagctcgttcagcacgaagcgggcggtggcggcgagcacgccgttggaaccggtgaccttctcggcgaaggcgtcgagcgcggcggaatcgaccacagcgccaccagcggcaccaccggcggacggcagggccacggcaacacccttgagctgggcgacgacctcaacggccgcatcgatcagcttgtcggcttccggcttgttctgcacggcggcggtgggcagcttggccaggtcgccgccacgggagctggcaccctcgcgagtgtcgagcagcagtgcggcgagcacgctggccacccagccttcaccgagctgccatacgttggccacacggtcgcggatgtactgctgtttgacgccggcagcaccgaacagcgagcgcaggcggtcgcgcagcgcctcggagagcacggcaccgaacggcttgtagttcggggcggccttgttgacgatttgggcgagcttgtcgagcgtcgcttcagcagcaccgtccacgctggcgactcccagctcggagctgatgtccatgagcagctggttgcggcgagaagagacaccgttggtcagggtgtcggtggtgtcgttgctgccgatctggtcgaggcgcaccttggcggagtaggccatgagtacgccgatggcatcggaagccttgaagggcaggtcggcgacggcggcaccagacggtgcgccagcagcggcctgccctgattgcaggccgcgcgaggaggcggacagtccagtggactgtccggcgacagagccatccgttgtctgagcagcctcagtcacggcatttgccggagcagcacccgagccaagcttggcgacggcggaaccaccggcaggagcggtttcgaccggggccgaggccgcagcctcttccggctcgtcgtcgggaaccagcgaatcggtgtcggtcatgtagacgcggccttcatcgcggccgacgttgtagacgaccgtatcgttgccggcgaactcgggcagacgtagggtcttggtaccgaggttggccagggtcggggcgttgccgaggccgacttcgacgtattcttccacgccgaggccgccctgttcgcgctgaccgaagagcagcgcctgggtttcaatccaacgcaccggggaggcgaactgccaggagagcagttcggtcaagagcagacggccgagcttctggtcgtcggcggcgtaggaatcccacacggccgggtcgtcgagcacggccttgatgcgttcggacggcacgacttcgaggatcttggcggcgaattccttggtcatctcgaacggcgaagccacgaggttcgggatgtagcggtccaccagacggccacggtagtcgatgtaagcgggaagcagcgcgtcgagcttgtcacggaattccggcacgcccttcctgagcagcgtggagtggaacggcacatcgatgccgggcaccagcatgaacgcgggcttgcctccgaatgcggccacgcggcgggcggaatcggccttcagggccttgagtccggcgatcgtaccggcgatggcgtactgctggccggcgaggttgtagttcacgatctccaggaattcgccggacgccttggccacggattccacgtattccttgacgtgcgcgtcgtccacaccgaactggttcggacgaagggcacccatgcggtagttggagcggccctgtgcgtcacgctcgatgaggtggtgcatggtggaaccacggtggaacacgagctccagcacggtttccagcggaatcacgtcggcgaatgcggacagcgcgttgtattcgccgagcgagtggccggcgaaataggcgggccagatgtcggcgccggcttcgcgcagacgggcggtctgggcaaaagcaaccgtcgcgagcgccacctgcgtgaactgcgtcaggttgagcaggccttcggggtgacggtaggtcacgccgttggcggtgagctccttcgggttatcgcgcacgaggcccaggatcgagaagccgagcttggagcgggtaagcttgtcggcgcgctcccacacatcgcgggcggcggcggacttggcacgctcgtccagaaccatgccctgcttctggatgccctggccggggtagacgaaggcggcgcgcggtgcgcggaccagtgcggtgccgcgggagacgagctggccgtcgatacggcaggtgacttcgagggtcatgccgccgtggcgcactttgccgacgcgctcgacggagatttcgacggtgtcgtcaagctggaccatgccgtacatgttgtaggtccagccggcaatctcgtagtgggcacccttctcgtcggtcgcctgcacggcgtgctgggcggtggcggacagccacatgccgtgcacgagcggggcggccaggccggagatgcgagcgccacgagtggaggtgtggatcgggttgaagtcgccggaagtgcgggcgaaggcggtcatgtcatgtggggcgacgaccttcacgcggcgcagcagacggcgcggagtggcctgcactacttgcaggccgcgcgaggaggcggacagtccagtggactgtccggcgacggagccatccgcttccttattcaggagggcaccaccatactcgggggcgtctgccggcaaagcatcggagtagacgcggccgcggatcgcgaaacgctcggtttcgcgggcaagcggcgtgccgtcggcggcggtgtgggtcacgtggatggtgaccacgcggccggaggcggactcgaagtaatcctcggcccaagacttcagggtgatggtttcgccggtgtgcttgagcaggtcctcctcgttcacctcaagttcgatgaggtggtcgaggtggacggcgttgagcaggccttcaatcaccgggtagcccttgacgtacacggagccgagcgccgtgtagattgccggccaggcagggccgaccagcgcatcgggggcgatgcggctgggctgcagggtggtcggcagagcggcgccagtggccgcttcgtggtcgaagccgaggttggcggacagggtgtaggttgcggttgcggtaccgaacggacgctcgtcagaggtcttgccgtcaagctgcggcatctcggtgagcttgtcgccggtgatggcggtgttgccgatgcctgcggtggcggcaagcatcgcgtagacgtccggaatcaggcgttcgcggtccacgaccggcacacggccgggctcggcgccttccacgatgagcgggatgacgatatcgcgcacggcgtgcttggaggtgccgccgtccgggtcgttgtcccagtaggtgtcgaggtggatgtccagatcgtacttgccggccgcggcgtcaaacgcgcggatctcgtagtactggtcgcccagggcggtgccgtaggccgggttgtcggtgatgtggccgacccaggagatgttcggggacttgcggatgaagtcttcggcgctggtggcctcgccaagtgcggcgaaatcgtcgttctcagcggcatcggcggcctgctgttcgtcctgcacgcgcttgatggcggcggtttcgaagcggccgaggatgtcggcgatcggctcgtcgatggtggtgatgccggcaacggagatcgggccggggatggcacgcacggaatcggcggagtagcgctggtcttcggactgccagagctggtcctgaccccaccaacgcagcaggtcgttgtcgatgacgggtacgaacggcatgggcttggggtattcgcgcacgagcaccgggaaccaagccacgtcggtcgggaccaccttgagttcggcggtctgcgggtaggccagtgcgagcttttcgagcgcgggggccgggtcggcgagaatgtcgtcgtgggtcagcaggccagtggcagctgcctcttcagcagaaacgccatcagcggcgaacaacttggaggtgaattcgccggagtccgtgtcgttcacacgggcttcgatgcgctgcagcaggtgctggaagcggtcggcgtaagtcgggtcgacccacgggaaggcgagttcggcgaagcgctgcgcccactcaaggtaggtcatggaggccaggtcgccgaagtaaggcttggcggtcttgttcagggcttcgatgatttccttgcggcgggagtcgagctcttcggggtgcttcatgacgcgcacgagcagacggccgcattcggcggagtcgttctcgagctcgtaaatgtcggcgtgcaggtggctcaggccggaggacatgccaccgatggacttgccggacggcacccagtgggcggcctgcggagcgaacacgtcgtcggacttggcgtcggccggaataccgggcgtcttgacgagcagctgcttgacttcggggctggtgtgagcctccttggcggtcatcgcggcggtaccgataagcacgccgtcgaccggcatgtcgggcaggccgtaggcgtgggcccactggccggaaatgtagtcggccgcgcgttcgggggtgccgatgccgccgccggcgaccagcacgaggttgtcgcaggcgcgcacttcggcgtaggtggcggcaagcaggtcgtccagcgcttcccagctgtggtggccgccggcttcaccgccctcgacctgaaccatgatggtggtgggggacacggccttggcgatgcgcacgacctggcgaatctggtccacggtgccgggcttgaaactcacgtacggcagaccgtccgcctgcagcgactcgatcagggccacggcttcgtccagctcggggatgccggcggagacgaccacgccgtcgatcggcgcgccggaagcacgcttcttgggcacgatgcgggaggagccgaactgcaggttccacaggtaacggtccatgaacatcgcgttgaattcgaccgtgcggccttcctccagctcgtcttcgagggcggcgatgtggcggtcgaacacttcggcggtcacctggccgccgccggcgagctcggcccagtagccggcgttggccgcggcggccacgatttccggttccacggtggtgggggtcatgccgggcagcaataccggcggcttgccggtgagcttggagaactttgtgaccagcttggcgccggccggggtgttgatgacgcgcggggcgaatgccttccagttctgggtgcgctcaggctcgctttccagcgtggagagcgtggagcgctcggccagcgtggtggcttcgaccacgccgatgccggtgccttgcaccacattgccgatcagcttgccgagcgtgttgccggggccgaggtccacaatccacagcttggacgggtcggcggcgtcgaacagcgccttgacgcgggcgttccagtccacatggttgagcagcacttcctcggcaagcgcacgggtgcgcttctggtcgaagccgcaggcgccagcccaggccacggtccgctcaacagcttcggccatgagcggcgagtggaagggcagggtgacttcgaggtattcgagggtcgggttgaacacagtgccgccgtggagcttctgttcacgcagcttggcctggtgcttgtgctcgcgctcggcttcgagggcgagtgctgccaggtcttccgggtagccggaaagcacgtggtggttgtcggagttggtgacggcgatggagatcgggcctcgggcgttgttcacgcgcttgaccagagcctcaacctgttcgcgggtggcgcccttgacggagagcatcgggctggcctcgccgtacttggggttcaggcccagttcgcgcacgcggcgggttccggcggcgccgatcagggcggccacggccagaatctcgtcgagggtcttgccggcggcctcgatggagccggcggcctcgatggcgcgggccatgtgcacggcgagcacgccctgggagtggccgagcacggcaaccggcttggtggcggccacactgtagccaaggtgttcgaggtcgagcagggcgccgagctgggtcagggccacgccttccacggatgcggtggcgtcggctgcggcgccgaggcgggccgggttcggagtgaagccgaacaggtcgaccggacgaccggtggtggccagcaggtcggcggcgaccggggcgagcagtcggttggctgcggcgacgtggccacgcagggcctcgtcaaggctgggatcggtggtctggtctgccagggctaccggccacggggtggactggccggcgaaggcgagcgcatggggctcggtggccaggcgattgaggaagaaggtggtcattgctttccttacttgtgtttggttgatgtcttcagaaatcagaggggctggttgccgtggtgtttggtggtgcgcttgacgcgccgcttggtggcgagcgtggccagcgattcgacgatcacctcacgggtctgttcggggtcgatcatgccgtcgatctgcccgatttccagcgacaggttcgcgttgacggtgctggtctcgtactccttgatgtacttggcccgcagcgcatcgacgtcctgcccggaggctttggccttggccaggtcgtggcggtggatgatgttcaccgcgccggccgcgccgagcaccgcgatctgggaggagggccacgcgaagttcaggtccgcgccgatggctttggagcccatcacgatgtacgcgccgccgaacgccttgcgcaacaccacggtcaccatcggcacttgcgcgttggcgtaggcgtagatcaccttggcgccgcggcggatgatgccggcgtgttcctggtcggagccgggcttgtagccgggcacatccacgagggtgaccacgggcaggttgaacgcgtcgcacaggcgtacgaatcgggcgaccttctcggacgagtcgacgtccaggatgccggcgagcacgttcggctggttcgccacgatgccgaccggcttgccgtcgatgcaggcgaagccgacgagcgcggaggcgccgaacagttcctgcacctgcacgaattcgccgtaatcgacgatgcaacgaatcacttcgagcatgtcgtagggctgacgttcgttggcgggcacgatggtggcgagtcgcttggcggtctcgcgttcggcgcgggtgacggcgtaggcgtagaccggcggcttgctttcgctgttggacggcaggtaggcgagcacggtgcgcgcatagtcgatggcgtcggattcgtcctcgccgaggtagtgggccacgccggacacccggttatgcacttcgccgccgccaaggtcggccatggagatggtctcgccggtcgaggccttgaccacgtccggcccggtgacgaacatgttcgagttctcacgggtcatgatgatgaggtccgtcagagccgggcagtagacggcaccgccggcgcaggggccgagaatcaggctcagctggggcacgaagccgctggcctcgcaagtcttgcggaagatgcggccgtactgggtcagagcggccacgccctcctgtatgcgggcgccgccggagtccacgatggccacgatcggcactttgaggtcgatggccatgtccatcagtcggcagatcttctcgccttcggcggtgccgagggtgccgcccttgacggagaagtcctgggcgtagacggccactttgcggccgtagacctggccgaagccggtgatgacagctgcaccggcgttgccgccggcgatgttgccgccctggaagcggccgatctcctcgaacgtgccggtgtcgaagagcaggtcgaggcgttcgcgcgcggttttcttgcctttggcgtgctgcttgtcgcgggcgcgctcttcggcggcgcgggccagttcggcggccttgaccacggcggtgcgcagcggctggtgggccgagggctgggcggcgttggcggccgaggccgcagccgcggccttcacggccggcgaatccatgatgtcagtcattgccgccctccttcttggcgtcggcggccttggccttgccggcgttcacgtccagcgtgaccagcgtgtcgccggcctccacgccatcggccgggccaacgaaaatcttcttcacttcgccggcggccggcgcgtacacgtagttctccatcttcatggattcgagcaccaccagaaggtcgcccttggccacttgctggccttcggacacgttgatgcgcgtgaccacggcctgcatcggggaggcgatgacgccggatttggcaccgtcgttggccgtggcggcaccggaggccacgttgtgcaagcctgcgccgcgcaacggctgggtggggcgcttggcaccgcgggcgcgggccgagccggtgatgttctccacgatgtcgagcggcacggtgagcttgacgcggcggttgttcatctcgatgacgaacgtctccgacttggacttgtcgggcgcggccggggcagcggcacccggggcggcggccaaggaagccggctggccggaggcggcggaagccggtgtgcggttcaggtacgtgcgctccagccacttggtggacacggcgaacggatggccatgctcggcggtgaagtcgtcgttgcggaagatctccttgaacaacggaatcggcgtgggcacgccttcgatcacaagctcatcgagcacgcgacgcacacgggccacggcatcgagacggttctgggcggtgacgatgaccttgcccatcatcgaatcgaacttcggggagatggtgtcgccctgttccacaccggtatcgatgcgcacgccggggccggccggccactggatcttctccaaggtgccggagccgggggtcaggttggtggccgggtcttcgctggtgatgcgcagttcgaagctgtggccgcgcggttcgggggcacgggtgagctcgccgccggcggcgatattgagctgttcgcgcaccaggtcgaggccgctgacctcttcggagacggtgtgctccacctgcagacgcgggttgacttccaggaagtacaccttgccgttcggggtcaccatgaattcgcaggtcccgaggcccacgtagccgaccgtggtgaacaggcggcgggagtattcctcgagcgtgctgatgatttcctcgggcaggaagggcgcgggcgcctcttccacaagtttctggttgcgacgctgcaacgagcagtcacgggtggagtacacggtgaagttgccgtgcgagtcgcgcccggactgggtctcgacgtggcgtgccttgtccacgaacttctcgatgaagtattccttcagatcgccgccttgcagcgcgtcgtggttcatgtagaagcggcgcagctcctcgtcgtcatgcaccacggtgatgccgtggccgccaccgccatcagtgcgcttcatcatgatcgggtagccgtgggtgtgtgcgaagtcgagcagcgttcgcacgtcggtcaccggttcggacaggccaggcaccggcggcactttggcgcgcaaggccactcggcgggcggtgatcttgtctcccaaatccaccagcgcggtgtgatgcggacccacccagatggcaccggcgtcctcgaccttctgcgcgaagctcggcacttcggaaaggaatccatagccaggatgcacggcgtccgcaccggtcttgcgcaggatgtcgatcagcagatcctcgttgaggtacgtgtccttgtaggtgtcgccggagagcaggtatgcctcgtcggccatgtccacatagcggctattgcggtcctgttcggagtagacggccacggtggagatacccatctccttggccgtgcgcaccacgcgaagcgcaatctcgcctcggttcgcaatcagcagttttttgacagtatgagccatagtgtcaaattctgcttcttatataggggataaggcaatccacgttctcacaaaagcgttcacgcccttttgtaggcattaaacaaacgcgcacgtaggtttcagcatcgtaaccgttggcaaaaatcgccatcaagaccgatgttgcaacgtttgcagccatcagaatcgacgttacataagttgacgctactaccccattcgtcaacttacgacaaatcaaaatcgataattttgtaacttgatacgaaaccgcacgaaatcgaacacctctacgatggcaaccgtaagttcaggggaaggctcacagcaagcgggcgcaatgcggccggccaaggccgattcggcacaggtcagttcgcatcgtatccgcttgatttcgcatcatatgcagtttgcatgcggtgtggagcgtccgcaatatggacaatccgcaccgccatcatgccgcgaaacgaccgatccccttcattcatcgcataccgtccgccattcacggcgatatcacgcaaacataggggcgtacgccttcggcttcgtcatccagtccgcgttgaccggtgcaccgctcgccgccgtggctctggcctccatgggcttcgttgtcgacgacgccatcaaggccgtggtggcctctctggccaccgccggcctgtccaagctcggtcgctgacctgagctactagctagctactggccggctattacagcactcccacatcggcggtgcggaccgtatggtccgtgccgtcttgtgttctcaggatcagtgaggcgtcttcgttgaggccgatggcttcgccggtcagcgtggtgccgtccgtgaagtgcgcctcgacctgacggccgcgcgcccagcacaccgccttcatttcctcgcgcaacgactcggcctggcccttcgggtcggcgatgaacttcgccaaccgctcgcggaagccctcgacctgacgttcggccaccgcatcgcgcatctcgccgaacgacggcagcccggagacatgcagctgcagcgaggtcgattgcggcgtgggcagccggcaggcgcccaaggccaagttcaggccgacgccgaacacgatgacgacgtcgtcatcggcatcagcatcagcatcagcatcagtaccggtaccggacgacggcggaatcaccagctccgagagcagcccgcccagcttgagcccgtggcagaacacatcattcggccatttgagctcaagaaagcagtacgactggtttggcgcagcaccatactcctcgatcatgccgttcagcgcatccagcgtgaccagtccggcgatcatctgcaaccagccgttgacggattcgtcggtggcgatcgcgcgcggaatgcgcacggcataggacatcgtcgagcaacggccaggctgactgacccacttgtgaccattgcggccacggccggcggtctgccggtcggcggccaccacgaccaccgccagttcgccatcctggtggtcgggcagcgtcaacgacccgtcgccgatcatctgtgcggccagcgtgttggtcgaatcggtttcgtccacggcgaccacatgatcagcgacggctgtagttctgggtagctgcggcgttgcagctttcaatgcaatcatcatggacactacgttacctcggttgcgccgttttttacccgcgatattccacggaaatcgcaaaaaatcaaccactttcacccacatagcccgtgttaacgttcacaacttcgaaaattccgcattcgccgaacccacgcatgcacccggccgtcgtattggcttgcgaacaatggcaatgcccggcagacatcgaatatcaaccgttgacctgtgcggctaccatatactgtcatgacgtcaccagccaccgcgaagcttgccgccgtatccagccgccagtcccacccgcatcttgcgcgcgtgggcgctgccgcgcgctggacactggccgcgctggcctgcttgtggcttgcactgtgcacggcggtcggcccgctgtactgggacgaggagaacggcaccctcgcccattggaactgggccaataccgcaatattcgtcgtgtcattcctgatatatcttggaatcatcacgctgatggtgcgattcgcagcaggccagcgcatactgccgagggctatcggcgagcgcctacgccaccatcagcagaatagcgaaacatcacggaccgccgccgatcagcagaccagccaaccagccaagacccgtcgtaccgttcgcgctatcgtcacgtccaccgtcactgttctggaccgctggatcacatgcggcacgaaccggttctggaagcttatgctggtgttttttgtcggctggctctgggtgcctaccacgctgcttgccgcattcggcgctgatgttcgttcacagatccgtgaattcagctgggcctggaaccagtggaccggcctgaaacagccctatatcggcttcttctccttcgtgccgatggacatctaccccactgcgcactacatgtggccgtccgatcccacgtatctgaccgaccagcacaatgtggtactcactgtgttctatggcgcgatagtcacgtttgcgaggcatctgaccggcgcaaacgatgccggcatcgtgacgttggctgccctgcagacgctgttcgccgtgttctgctgcgctgccgccgccaatcgattcctgaaccggccttggataggaaaaacagcaacggattccgccgttcccccacaggccggaggattggctcgattcctgattctgctgttcttcatggtctgcccgctggccgtgttttccactatctccatcaccaaatcgccgctgttcgcgttctcgttcgtctggtggttcagcgtctggtatgaactcgtccagacctggcaccccgtcggcacccgcaaacatcctcaggccactgccatcgccacgcccgtccacttgccgcgccacagtttcatcgcctttatcctggccacatcggtgatgctgatttccgcgaaatatgcgtggtacatcatcgccctacaaatcgtgctggctctgatcgccgaccgcaagcgctgggcgacttacgtcgtggcgctgctcatccccaccgtactgattcacggcggcatctccttcgccatctcctctggcgcaatcatcggcggcgacccaatcgaaagccgcggcgtacagctgcaaatgatcgcccgcgtggcccagcgcaatccggacggcatttcagacgaagccaaaaagaacctcgcgcccgtcttcaatctcgatcagatggccgatgcttactcccagcaggatgccgacccggtgaaatcctccggtattcaggccaagaaggtcagctacaagtggcgcacggtgacgcccgaggatatgaccaatttcaacaaggcatggttcgaaatcgtcaaggacaatccgatcatcgcgttggatgcgctgctgtccaaatgcttcggatacttcaatgtgaacgatcagccgtacgtatcgatggattattacgtgaccagcgattacgtgcaaaaaaactccacatggatcaaggattacaaccatgactggcgtgagcacatcgccggcttcactcgcgtatggggcagcattcccgtactcggctggcccacgcacggcaatttctacgtggtgatgacattgctgatcggcgcggccgaggtgattcgtcgacgttggcccaccctcatgacccatattccgctgctactgctgatgggcgtgatgattaccgcgccggccaataatttcgagcggcacatgttgccggttgcgtttgtattcggattcgtggtgctgacgtattggcgagagtctttggctgaaaggcaacgccaatcagcgacgctacactagtgactatgtcagattttctcgaacttctcgctgccgacgttgccgattcgtccggtgcatccggtacgcccagtgcgcccgattcatccggttcgaccgcacccggcatcgccgcgaccaaccgcgtacgcaccgtgctgttcgagtgcctgttcaatcatctggccgacgaacgagtggagtccttgttcaccatcctcggcttcgagcatgacttcgattgttacgccatcgccggataccctgcccggtccgccgcacgtacggccaaggaaatcgagaaaatcgtggccgatttcggcggtgtgtgtctgaccgccaagcgcccgatcggcaacagcaccgccgtagtggcgttgattcgtccggtcggtgcggccacgccagaaatcatctgcaataccatagccccgtcgttcgccgccgatcggccaatcgccttgggcccgcagcgcaccggtgccgatggcgcgatgcgttcgattcaggccacgctctactgtcttcaggccgcgccggctctggccgccaccgtgcagccattgccgcgcccgttacgcaccgacgacgccctgcccgaacgcgcgttgatcggcgacgcggacgcccgtgacgaactggtccgcgtggtctacggaagcctgaccgcagcgggcccggacgatccgacgctgctcaccgtctccacattcttgaagttcggtggttcgctcgaaaccacggccaaggaactcaacgtacatcccaatacgattcgctaccgtttgaagcgcgccgccgaatccaccggctgggatgccaccgacccgcgcgaggcgtacgtgctgatcaccgccatcgcgctgggtcgtgtggccgaagcgtagtcgggcagaagcataaccagcagaaccgtagccggcaaaggccatagctgaccggacataaccgtccagcccgacagcctagcgggccgaatcaggctgcctgaatttcgcgtacgccatcgcgcagtaacgcggccaaggattcttgagtggctaacacttcgtccacgactccaccggcggacaggctggcgatcacgcgaccggactcgttgtccacaatcggtacaccaacggcaccgacacccaacgtcacatcctcatccgacagtgcatatccacgttcgcgagtcaagcgaatatcctcgcgcaactgttccacactgaccagcgtgttctcgttatatgccgggaacggcgctcctgcaagatagcgttcgacatcggcatcctcgaaatacgccaaggccacgcggccggccgcgccagcatgcagaggcagcacgcggcccgggcgcaggatcagcgaatcgatggcatgaccttgcgcacattccacgcataccaattcagtgccggagaccacactgaggaatgaggtcatgccggtttgcgcggtgatggcatgcatgaccgcaatcgcaggctgccattcggtacgagacgtgcgagcggcatcagccaatcgcagccagtccagtgataatgagtagttaccatccgtatccgttacggcccaccccacatcgaccagtccatccagcacgcggtatacggaggatcgcgggatatcacaggcgtcggcgatatcggccggcgacaggccattctccgccgccaatgcgtccatcacacgactcgccttgtctaaagcgcgggtcggttcacgtttgtcttccgccatcgtcgacgttccttcccctgacttatccctgactcatcatattcaactgttcaggccaagatgatcaccactgtatccaaggccttgcgacacctcacggccggcagtctgcaccaatcgcaccatgtcttgagccgatgccgttgccggttgcccatctaccagacaggccagctcaggttccaaggagcgggaaaggccactcagggcgattgccgcttgaatctctccggcgtgattgaataccggtacgctgatagtcacggagccggccatggtctggccgacgtcataggtgaagccgcattcgcgtatatgacgagcctgtcccattgctgtggcacgcatcgtggagaatgtgccgccgagctcgttggtataggcatagtgttccaacagctgctcgtagcgagccgggggaagccaggccgtcagtacatgagagggagcgctcatgctcagaggcaagctattgcccaccagctgtgcatagctttgcaatgtctcacgggtgcgtgtctcgatgcacaccgtgcgcaatcgcctccgaacgaacagaccccagatgccgaactggccgtgatgggcgcggaaggtacggcgagcgatctgctgaatgtccagtctgctttcgatttggccgccgatacgtacgcaatcgatgccaagccgatactcgccacgattgatgccccgttccacccaaccgactgcgacgagattatccagcaaacgatacgttgagcttacgggttcaccagtacgttcgcttatggtttttgcggtgcttggtcccagttccgccaatacatcaagtactgccttggatttcaccaatgcatctacgctacggtcatcacggcttggcgccaccatgcgcgtcacctcctgacctgtttgttgatacctcagacatcttaccgggtattcagcgggttgccgcccaaaacgcactgggcctcgacgggatactcctgccggggcccaagaggtttctggctttcctctttgaggggagtcgtccgcgcggcggaccagggtgaggcccaagatgctgaggcccaaggacgcgagataccccccccacgcgcgcgagtgtcccgatatgcgggaagccccggtaccttcaaggtaccggggcttcctgtacgtgtgatgcggcggcgtgctactctcccacaccctgtcgagtgcagtaccatcgccgtgccaggccttagcttccgggttcggaatgggaccgggcgtctcacctgggccatgaccgccgcaaatcttctcttgtacggtcagacgctggggtctgccggcctgtggcggcctgggaaccggataggggacgcgattgccgttgatgtttcgtcttgtggccagacaatgctcatcgtcgtctggtgtcgtttgcaggaggatgatgcggtccccgaacggatcggggaatgatagtgttgcctttcgtccgttagtaccggtcggctccacccctcgcggggcttccacgtccggcctatcgaccacgtgttctgcatggggactacagcagcccgaggctgcacggaatgcttatcttggagcaggcttcccgcttagatgctttcagcggttatcccttccgaacgtagccaaccggccgtgccactggcgtgacaaccggcataccagaggttcgtccacccaggtcctctcgtactatgggcaggcctcctcaacattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgtccgtacaccggcaccggatcactagtcccgactttcgtccctgctcggaccgtcgtcctcgcagtcaagcccgcttgtgcacttgcactcgccacccgattgccaaccgggctgagcggacctttgggcgcctccgttactctttgggaggcaaccgccccagttaaactacccgccaggcactgtccctgaacaggatcactgttcgaggttagacatccaatgcgaacagagcggtatttcaccttgcggctccgcacgatctggcgaccatgcctctcggcctcccgcctatgctacacaatccacaccgaatgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcacccgaaggctgacggatcctcttaaccttccggcaccgggcaggcgtcagtgcatatacagcggcttgcgccttcgcatgcacctgtgtttttggtaaacagtcgctaccccctggtctgtgccacccccaaaagctccccgcgcgaggcggctcaccatcgggggtctcccttaaaccgaaggaacgggagtgatttgccgagttccttgaccaggattcgctcgatcgctttggtattctctacctgaccaccagtgtcggtttggggtacgggcggcttcgagcctcacgccgaagcttttctcggcagccgggatcaccggatatcgggccacaaggcccccaccatcgcacctcgcccacacgccccgcggatttgcctacgggacgggctgcgtgcttgaccacggaaaaccacctccgcggccggctacccttctgcgtcactcctgcgctgacctactacaaggatcggtcccaacaggcccaggcatcccacccccgaaggggaagcaagcccggacccggaggttagtactccaagcctcggttctggcggctgaaagccggtacgggaatatcgacccgttcatccattcgactacgcctgtcggcctcgccttaggacccgactcacccagggacgatgaacgtggccctggaacccttggtcatccagcggacgggatcttcacccgtctttcgctactcatgtctgcattctcactcccatgaagtccacggcgcgttcacacggccgcttcgcccctcatgggacgctctcctacccagtacaaaatactgccgcgtcttcggtggtgtgcttgagccccgctacattgtcggcgcggaaccactagaccagtgagctgttacgcactctttcaaggatggctgcttctgagccaacctcctggctgtctatgcgactccacatcctttcccacttagcacacgcttcgggaccttagacgacggtctgggctgtttccctttcgacgacgaagcttatcccccgccgactcactgccgggatacacgtcaccggtattcggagtttggttgctgttggtacccgatacgggcccgcaagcatccagtagctctacccccgggacgcaatgacccgacgctgcacccaaatgcatttcggagagaaccagctatcacggaatttgattggcctttcacccctaaccccaagtcatcccccggttttcaacccaggtgggttcggtcctccacacggtcttacccgcgcttcaacctgctcagggctagatcatcccgcttcgggtccaggacacgcgactttaaacgccttttaagactcgccttcgctacgcataccccacacgggttatgctcgccacatgccactgactcgcagactcatttttcgataggcacgccgtcaccccacaaagaggctccgacggattgtaggcgcacggtttcagagactgtttcactcccctcccggggtacttttcacctttccctcacggtactcgttcgctatcggtcagacaggaatattcaggcttacccgacggtccgggcggattcgcacggggttccacgggacccgtgctacttgggagacgcgatcggcagaccatgcgcgttcaggtacggggccctcaccctctgcggcccggtattcaacccggttcccctgacacatggttttctacaactgccggccggcccgtcggagccggcacacgcgatcccgcaacaccccacacgcaacccccgacgggtatcacacgcgcaaggtttggccatcatccgctttcgctcgccactactcacggaatatcctttcctgcaggtactgagatgtttcacttccctgcgtacccccggccgaagccggtaccgacccatgacggccggtgggttcccccattcggaaatcctcggatcaaagccctgtaggcggctccccgaggcttatcgcagcctcaaacgtccttcatcggtcctgtctgccaaggcatccaccatacgcccttgcaagcaacacacaccatgaaggtgcatggccgcaagattcctctagcaaattcccagacgacaaatcatcacactaaaaatgatcacaaaacgatcgaaacgaacaatagagttcgattcgaaatcaacagcaaaacaaagattcaaaaccattgttttgctcgcgtccactatccagttctcaagccaccacgcaccgccacgccaaccagaccggcacacggccggcccgcaggcacgacgggcatcgaatcgcgccaggcaaaagcctggggtggcgatccgggagcccaaaagcgcatccgcaccacccccgcggaacatcccacgacggacgaaccgaaagcccatgatctcttccacaccagcaacccgtccacacgcgaccatcgcgcgggagggtccgcaccggacgccgaacggcatcctgtattctccgtagaaaggaggtgatccagccgcaccttccggtacggctaccttgttacgacttagtcccaatcacgagcctcaccttagacggctccatcccacaaggggttaggccaccggcttcgggtgctgcccactttcatgacttgacgggcggtgtgtacaaggcccgggaacgcattcaccgcgacgttgctgattcgcgattactagcgactccgccttcacgcagtcgagttgcagactgcgatccgaactgagaccggttttcagggatccgctccgcgtcgccgcgtcgcatcccgttgtaccggccattgtagcatgcgtgaagccctggacgtaaggggcatgatgatctgacgtcatccccaccttcctccgagttaaccccggcggtcccccgtgagttcccggcacaatccgctggcaacacggggcgagggttgcgctcgttgcgggacttaacccaacatctcacgacacgagctgacgacgaccatgcaccacctgtgaacccgccccgaagggaaaccccatctctgggatcgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttagctccgacacggaacccgtggaacgggccccacatccagcatccaccgtttacggcgtggactaccagggtatctaatcctgttcgctccccacgctttcgctcctcagcgtcagtaacggcccagagacctgccttcgccattggtgttcttcccgatatctacacattccaccgttacaccgggaattccagtctcccctaccgcactcaagcccgcccgtacccggcgcggatccaccgttaagcgatggactttcacaccggacgcgacgaaccgcctacgagccctttacgcccaataattccggataacgcttgcaccctacgtattaccgcggctgctggcacgtagttagccggtgcttattcaacgggtaaactcactcacgcttgctccccgataaaagaggtttacaacccgaaggcctccatccctcacgcggcgtcgctgcatcaggcttgcgcccattgtgcaatattccccactgctgcctcccgtaggagtctgggccgtatctcagtcccaatgtggccggtcgccctctcaggccggctacccgtcgaagccacggtgggccgttaccccgccgtcaagctgataggacgcgaccccatcccataccgcgaaagctttcccagaagaccatgcgatcaactggaacatccggcattaccacccgtttccaggagctattccggtgtatggggcaggtcggtcacgcattactcacccgttcgccactctcaccaccaagcaaagcccgatggatcccgttcgacttgcatgtgttaagcacgccgccagcgttcatcctgagccagaatcgaaccctccacaaaaaaaacttcatgaaaagcatccgaatagatgactctcaaaacaaaaattgacgagcacgtccttaaggaaggacgccctcaaaaaacctcacccctcatcaaaccctcccgggtacccgaccaccacgacaggcgatcaggcgaggaatgaactggcaatcattgactataaagaagtagtacaaacacgctcttgagttctcaaaccaccaccactcacccaactcacagctctccaggaagagaaccactcgccgagcggcagcaaggaaataacttacacgcatgtttggattcgcgcaaatcgaggcgcgcaaaagcctcaggaatcgttgcaatcacacggttccttcggcgtgtcgcaaacagcctatttgcactgttctgataccagaataatccgtctttgcattgccgatgcgtaacaaattcatgtgttcaccggcgtgttgcaagaattcgattgcgtgaccatccaggttcaccttctcgcaaccggtcatcgcatatgcaaaaagggacttccctttacgggaagtccctttcagtagctattgaagctcgctagcctcaggccagggtgttcgggtcaaccggaacgcccgggttcatcgtggaggtgatggttgccttggtcaggtaacggcccttcacggtggcgggcttcagacgcttgacttcgtcggccacagccttgaagttctcatccagagcggactcatcgaagctcatcttgccgatgaggaagctcaggttgccgttcttgtcgacacggaactcgatcttgccgcccttgatgtccttgacagccttggtgacatccatggtcacggtgccggtcttggggttcggcatcaggccacgcggaccgagcacacggcccagacggccgaccttgcccatcatgtccggagtagcaaccacggcgtcgaagtcgaggaagccgccctgaacctttgcgatcaggtcgtcatcaccgacgatgtcggcgccagcctcggtggcctcggtagctttcgggccacgggcgaacacgaggaccttggcggtcttaccagtgccgtgaggcaggttgacggtgccgcgcacgagctggtcggccttacgcgggtcgacgctcagacggaacacggcctcgacggtctggtcgaagttgtaggcaggcatgctcttgagcagagcgatggcctcgttggcggtgtagaggttgttgcgatcgacgcgctcagcggcttcgcggtacttcttggaacgctttaccatctgtccttctccttatcagtccgtaaccgtgatgcccatcgagcgagcggtaccctcgatgatcttcatgccggcctcgatatcgcgagcagacaggtcttccatcttggtctcggcgatttcgcgaacctgcgccttggtgacagagccgaccttgtgggtcagcgggttctcggtacccttctcaatgccagcagccttcttcagcagagctgcagccggcggggtcttgagaacgaaggtgaaggaacgatcttcgtaaacggtgatctcgacagggatgacctgacccatcttgtcctgcgtctgggcattgtatgccttgcagaagtccatgatgttcacgccatgcgaacccagagccgggcccagcggcggggccgggttggccttgccagcctggatctggagcttgatcagcgccgagactttcttcttgggagccatattatggttcttctttctataacgcggttcgaatggtcgccgtcctcaggttcgtctgtctgccatcatgctcggtcttgactcattatttatccgtgcatgctgtaggcaatcggcctgtggtcggtctcctcccgcaacttatattgctgtgctgtgctagcgggtcttccctccagacacaagctttcctattatgcaaatccacccggacaacacaaaagcccgaccacgatggtcgggctctgcaaagtttggggttaatctagcttctgaacctggtggaagccaagctccaccggcgtatcacggccgaaaatggacacgagcacggtgagcttctgagtggtgggttccacgtcggaaacaacggcggccatggtggcgaaaggcccatcggtgacggtgacctgatcgccaacggcgtaggagacttcgaccttgcgcttcttggcggcggcgggcttgtcgccggcggccttgagtgcctcggaagcgatcatcggagccatcatcgccacgacctccttgcgggagagcggcgccggatccttggtcgggccaacgaagccggtcacgccttcggtttcgcgaacgatacggcgggcgttctcatccggccacatacgaatcagcacgtagcctggaacacgcacgcgggtgatgaccttcttgcccttttcggtgtgcttctcgacttcttccatcggcacctcgacctggaagatctggtcttccatgccgaaggaggcgacgcgggactcgatattggtcttcacgcgcttctcgtagccggagtaggtgtgcagcacgtaccacttgccatcaagggaacgcagggacttggagaattcgtcaacggcctgctgaccggcatcggtttcctcggcctgctcggattcgttgacttcttcctcgtcctcatccagagaaacggtctcgttctgagtggaagcaacaggagcggattcagtcacggccggagcggcggactcaacatctgcattgtcgacggatgcgtcagattctgcggaaaggtcagcaaccggttcagccggggcaactgcctcatcggcagcagcttcggaagcctcgacaagaggctcctcagccggcacggcgtcgaggttctcgagattcagttcatcactcatgcgttgttattcaccttaggttgtgcggatcagccgaacacccacagcacgagcttgcccagaccgaagtccatgcccgtgacgagggccatcagcagcagcacgaagataaacacagccagagaccagaagaacagttccttggcagtaggggttacgaccttgcgaagctcgtcgatgatctgcttgataaacagaccgatacgcatgaagacattcggcttgactaccttttcgctgttgttcgtcttagccattccgtacctcgcgtcagctgcttgattattgaaaacttggcagggaaggcgggactcgaacccacaacctacggttttggagaccgttgcgctaccaattgcgccacttccctaggtgaaaatccacctcggcgtgcattccgtagagaacgcttcgccacggcgaaaccgccaaatcgttatagtaacggctccggtggattatcgcaaatcgcgtgtcgcgcgcgtggcatgtgcggggcatgtgcgtggcacgcgactcttctcagttggcccattccttgaatcgacgcatgccttcggctaggtcttcgtcggccaatgcgtaggagaaacgcaggtaaccgggagcgccgaaggcctcgccggggacggcggccacgtgggcctcatccaacagtgcggcggcaaagtcagcggacgtatcggacactgtacccttgggacccagcggcttgccaagcaaagcggtgatgtccgcaaaagcgtagaacgcgccggtcggagtcgggcagttgacgccctcgatatcgttcaaggcggtcacaatcgcacggcggcgcgcgtcaaaggccttacgcatctcatgcacctcatccagcggaccggccacagcagccaaagcagcacgctgggagatgttggccacattggaggtcatatgcccctgcagcttggtggcggccttggccacctcaagcggagcgaccatccagccgacacgccagcccggcatcgcataggtcttggccacgccgttgagcaccagcaactgcctgcggcattccggcacggcggcaccgatgtaggtggtgtgcacatcgtcatagttcaggtgctcgtagatctcgtcggagataacccaaatgtggtgctcgacggcccaacgaccgatcgcttccacggtttccggcttccagacggctccggtcgggttgttcggggagttgacgatgattgccttcgtatgctcggtacgggccgcttccagagcctcaagcgagggctcgaagttcacgtcggcaccggcgaatacttcgaccggcacaccaccggcaatcttcacagcctcggggtagctggtccagtacggagcgggaatgatgacctcatcgccatcgttgagcaagatctggaaggattcatacacggcctgcttgccgccgttggtcaccacaacctgatcggcattgacctcgtagccggaatcgcgcagcaccttagccgcaatcgcttcgcgcagctcgggcaggcccggcgtaggcgtgtacttgtaattcttcgggtcaaggcaggcatctgccgcagccttgaccacgtttgcgggggtcgggaaattcggttcacctgcgccgaagccgataacgtcaagtccggcggccttcatggccttggccttggaatcgacggcgagcgtagcgctcggtgccacagtgttgatacggtcggaaagagtctgccattgcgccatagtcatggctcccatgctaaacctacagcacgaaaaatcgccagagccgcactatggtgatgaaacctgtcgtgtgacagattccatcagtcacacgagcacgagattgtcgcgatgaatcagtgggtgggcatactgggggccgaggaaacgcttgagttgggcggtgttacgcccgagcatctgcggaatttcttcggaatcgaagccggcgaggcctcgggccaggtgttcgccgctttcggcatcgatccagaccggatcgccggcggaaaaatcgccatgcacttcgagcgcgccagtagccagcagcgaggcacgcccgccgcgaatcgcctggccggcacccgcatcgaccacaatcgcgccgcgcgggtcggcggcaaaaccaatccacagacggcgtgatgagccgcgggccttaaccggtgcgaacacggtgcccaccggatcgcccatcatcgccgggcccgcgttcgaggcgcaggtgagtaccgtggggatgcccgagacggccgccacgcgcgcggcctcgagtttggtgaccatgccgccggtgccgaccttggagccggagccggagacttggatgtcgccaagtgcatcgataacgttcggcacatattccacacggcgggagccgggctgcgagggcggtgcagtgtacagcgcgtccacgtcggtcagtagcaccaaggcttcggcccgcaccagattggctaccaaggcggagagtcgatcgttatcgccgaaacgaatctcgttcgaggccaacgaatcgttttcgttgataatcggcaccacgccgaggtcgagcagacggtccagcgtgcgttccacattgcggtactgggtggcacgaatcgtgtcttcagcggtaatcagaatctggcctacgcgaataccgaaacggccaaaagcagtctcgtagcgagccatgagcaaaccttggccgaccgctgcggtggcctgctgagtagccacgtcggccgggcgttcgtcaaagcccagcgggccgaagccggccgcaatagcaccagaggaaaccagtactacacgcccgcccatcagtcgtatttgggcaagggcggcagccagagcgtcgagcttgtccgggtcgaggtgaccgctcggctgggtcagtgagctggagccgactttcacgacaatggttccggctgcggcgaccatgcgccgcacctcggcctgactgggagtgctcatttattcctcggtttcaccatcttcgctggactcaccgtggccgaagaggctgttctcatcatggcgatcgtcgtcaacggtcgggtcggcccagtggccggccttgcgttcggccatcatcgcgtcgcgcacggcggcacgggcgtccatcatctcgtggtattgggcacgacgttcggcgttggagcggcggtgcgtgcgcgggtcctgctcttcgagacgcagatccttgcctcgggcaccgaggttggagccgtcgagcatttcagcaccggcggagatggtcggatcccaatcgaattcgaccatacgggcaccacgaccgatgcgcacttcgtcgccggggtgagcacccttgcggcgcagctcgtcctccacgcccagcttggccaagcggtcagccaggtagcccacggcctcgtcattgtcgaagttggtctgcatgacccagcgctccggcttgacgccacgcacctcgaagaacacttcgccattgccgagctcgcggcgctcgaccgtgaactcaagcgcgctgccgccctcgtcagcgcgacgcggacggcggcccttggtctccaatggcttgatgaccacgcgagcctcctcttcggcctgctcgcggttggccacttcctcacgcatctcgtgcaccagcgcagacaacgcgaagttgagctcctttagaccctcgtgtgaggcagtggagatctcaaagaccttcagcccgagtctctcgaactccggacgcacgaactcggccaattccttggcctcgggcacatcgatcttgttcaggatcacgatgcgcgggcgttcgggaatcgggatggcacccaacggcagctcgagcttgtcggcgtagagcgccaactcgttttccagcgcgtggtagtcggacatcgggtcgcggtccggttcaagcgtggcgcaatcgatcacatgggcgatgatttcggtacgttcgatgtggcgcaggaactccagtcccaggcccttgccttcggaggcgcccggaatcagtcccggcacatcggcgatggtgtatcgagagtcgccggcgataacgacgccgagattcggcaccagcgtggtgaatgggtagtcggcgatcttcggcttggcggagctcatcgccgcaatcagggacgactttccggccgaggggaaaccgaccagcgccacgtcggcgatggacttcagttccagaatcacgtcgcgctcttcaccgagttcgccgagcagggcgaagccgggggcacggcgggtcttgttggccagggcgatgttgccgaggccgccggcaccgccctgggcgacaacgcagcggtcgccctcgtggcgcaagtcggcgagctgtgcgccgggatgcttggctttgccctgttcgccgcgcgcctcaaagacgacggtgccgcagggcacgggcagaatcagatcctcgcccttggagccgtccttattatcgcccaggcccatggtgccgctgccggcgacacgatgcggcatgaaacgatagtcgagcaagctggtggcgttacggtcggccacgaacaccacggaaccgccgtcgccgccattgccgccgttcggaccggccaacggcttgtatttctcacgacggatgccggccgaaccgttgcccccatcgccgcccttgacatggacggttactcgatccacaaaatcactcatattgattaccttacaaaaaagccgcgtccttacgggcgcggcttggaaaaaacttgacgctatatcgctcaggcgatgacgtcgacaaccttgcggtcgcggcgcacaccgaacttcacggagccatcggtgagggcgaacagcgtgtgatccttgcccatgccgacgttgtggcccgggtggaagttggtgccacgctggcgaacgatgatgttgccggccacgacggcttcgccgccgaacttcttcacgccgaggtattgcgggttagaatcgcgaccgttgcgagagctggacgcacccttcttatgtgccatgattcatggtcctttctataactcaggcaatcgccgtgatcttgacgatagtcagcttctggcggtgacccttacggcgagcaacaccagtcttgttcttgtacttctggatgtcaatcttcgggcccttggcttcgtcgttcacgacctcagccttgacggacaccttggccagatcggcggcggcaagggtgaccttgtcaccatcgacaacgagggagaccgggaattccacggtatcgcccttcttggcgtcgagacggttcacgaggatgacgtcgccaacctcgaccttttcctgatggccaccggccttcacaatcgcgtacattatcgttccttttatgttttggaaagctaccttgcctaacacgcaccgagcctgcggtcagacaccgagtttcgaatctacaccaccatacggactaaatcaaatgatttttgcccgcgtgtcaagcacgacacacctgttactcttccgcttactcttccgccgtgttgttggcagcgacggcagcggcggcaatctgagccagtttggctttgacgtcagcgctggaaccagccggttcgggagcgggagcggtgccgcgaccgtgcttgttggttttgacgaacgggtcgccaccgcgaagcgcgtagggatcgtcgtagtcggccgaaacggtcggctgatcatgcaggatgaaaccacggcccttgcaggtcgggcattcctcggagaacgcctcgaccagaccctggccgatgcgcttgcgggtcatctgcaccaaaccaagcgaggtgacttcggccacctgatgcttggtgcggtcgcgtgccaggcattcgaccaagcggcgcagcaccaaatcgcggttggcgggcatgaccatgtcgacgtaatcgatcatcaccatgccaccgatatcgcgcaggcgcagctggcgggcgatctcttcggacgcctccaggttgcagcgcgtcaccgtttcctccaaggacttgcccttgccgataaagcgtccggtgttcacgtcgatggtggtcatggcttcggtgcggtcgatgacgatcgagccgccggacggcaggtaaacctgacgctccatgcccttacgcagctgggagtcgatggaccacttgtcgaacacgtccttgccttcatgctcggccgggtcccacttctccagcttgtccttcaagtcgggggccatggtgtccaggtattcctcgatgcggccgtagaccttgtcaccttccacgatgagcttgctgaagtcgtcgttgaagatgtcgcgcaccacgcggatggccacgtcgggctcgccctgcaggagcttcgggcgcttgccgtgccagaattcctcgcgcttggcgttgatgcgctcccactggcggaccagtgattcgagatccttgacgatggcgtcttcggatgcgccctcggctgcggtgcggatgatcacgcccatgtctttcggggcgatcttggagacgatgttcttcagacggctgcgttcgcgctccgaaagcttgcgactcacgccggtcatgccgccggatggcacgagcaccaggaagcggccggcgagcgtgacctgagaggtcaggcgggcacccttgtggccgatcgggtccttagtgacctgcacgagcaccgggtcgccggacttgaacgccagctcgatgcggcgcggctggccttcgagacgagcggcatcccagttgacctcgccggcgtagagcacgccgttgcgggcctggccgatatccacgaatgcggcctccatgctgggcagcacgttctgcacgcggccaagatagatgttgccgacggtctgtacttcctgaatgtcggagacgtaatgctcgaccaaaacattgtcttccaccacggaaatctgggtgtgctgttccttctcacgcaccaccatcaggcggtccacgttctcgcggcgtgcgaggaagtcctgctccatgagctggctctggcggctgcgctcacgacggttgtcacggcggcgttgcttcttggcctcgagacgagtggagccctccacatcagtgatctcgtcgatgtactgctgcttgcgggagcggcggaccagcggctgttcgctgttctgactctggtcgtcggtgccctcgccgttcttgccgccacgacggcggcggcgacggcgagtgacggtctgctcctcatcgtcctcatcgcgatcacggtcatgatcatcgcgatcgtcacgacggcgggaacgcgtatcctcggcatcgttctcggcggtatcgtgctcgccgttggcaccggtttcgccgcgtgagccgcgacggcggcgacggcgcgaacgggtgcggatggcgtcggattcttcgtcgccctcctcttcggcaatcggcgagtaggcgatatcgtccagctcgaggtcttcctcaatctgctcgacttcggcggctgcacggcgctcctgggcgttcaggcggcgggagcgacgggaacggcgagagtcggaagcgtcattggaatcgaaatcatcatggtccgcgttggcgctggcattggcgtcaccggcggcagcgttgcggccacgatcgtcacggtcgtcacggcggcggctgcgcggctgcgcgtcgtcatcatcgtggctgcgcgagcggcgggagcgacgagacggacgttcgtcggcgtcaacatcgtcatcacgagtgtcagcggtatcgtgcgcatccacagcggcgggcagtaccggttcctggaagagcagggacgtcatcggcttgccgcggcgcatggtctcgtggccagagggcagggattcgaccgcatcgaacaggcgctcatccggggtgtcctcgtgcgtatccgcaactgcacggcgagagcgggagcgaaccgggcggtcctcgtcatcatcatccatatccatagatgcacggcgagagcggcggcgaaccgggcggtcctcgtcgtaatcgttatcgtccgcaaccgaacggcgacgggaacgtggggcgtcatcgtcatcgaaatcatcgacactgacagtgcggcgcgaacgacgaggacgatcatcctcgctatacgagtcgaccactgtggaagcggcgcggcgcgtacggcgacgggttgggcgttcggcggaatccttggaatcgctggattcatcggaatcgctggaatcggccgcagtgccggcatcgggaagcgcgggggcttcgaacagcggggtgcgttcctgcacttgcagttccagagaagcgccggcagcaccggtgccgcgaaccacgcgacggccgccgcgacgacggcgaacaggttcggcgggctgggaggcggcggcaggcgcagcgttcacggctgcagccgaatcggcattggatacggttgaattatcggttccgtcgttgacgaaaccttcacggttatcagtgggcacaatgctcctcgcggcgcgctgcatcacgacgcctatttccaggcctatacgcttggctcacaccacgctctcaccgtggccgcgcgaaaacgcgccgcgtaaaggcaacttcgtctcaagtctgtcctgcgggtggcggacaccggcgcttgcgttgtctcattctcgagagccgcaaggggatcgacgccatctcacacgctgatggttatgcagaaccaccatcctttagtatgccacatattttgtgcgggcgtggcccggcgaggctgacgttctctcggctcccctccctgcggtgacagctcccctcagcgaggggagctagagaggtgtcagaccagccagtcggtaaggattgcggccatggcggtcagatcggattcgggcacctgctcgtcgtgcttgtgagccagcagcggatcgccggcaccgaggttgacggccgggataccgagctgagagaagcgtgccacgtcggtccagccgagcttggccagtgggtcgcggccagtgcgctccttaaccagtcggaccagatcctgggcgagcggggcgttcagacccgggcgcgcggaagggctttcgtccttcatttcgatgccgtagtcctcgaacacgccgccggtggccacatgctcgccattgccgagttcggcaccggcgtccgcgcccatcatcagggctttggcctcggccagcgacttgtccggggcgaagcggtagttgacgtgcacgcggcattcatccggaatgacgttcgtgcctttgccgccggagatcagagtggcgttgaggccctcgcgatagtcgagcccgtccacgttcacggtggccggctcgtaggtgttgagtcggttcagaatgtcggccgccttgtggatggcgttctcccccatccacgcgcgggcggagtgggcggccacgccgtgggtcacgacgtcgaagcgaatcgtgccgttgcagccgccctcgatgccgctgttggtgggttcgccgatgatggcgaaatcgccggtgatccaatcgggatgggcctcgacgactttgcgtaggccattcttttcggcgacgacttcctcatggtcgtagaagacgtaggtgaggtcgactttcggggtggtttccggcgtgaggccgtcgagcgtggcggcaaggtagagcatcactgcgtcggaggccttcatatcggtggcaccgcggccccacagcacgcggtcttcgggatgagcgtgggcgatttcttcgcgaatcagcgaatcgccgggctccagccactttggtgggaaattgtcgatgaccggcacagtatcgaggtgcccggccaagatcacacggctcggcttgccgaagtcggtgctggccaccactgtgtcaccgtgacgacggacggtcaggtgttcctgcccgcccaggaaggcctcagcctcgtcggtgagggggccctcgtggtcggacacggagaagttctccatgatctgggtgagcaggctgttcagctgctcggcagtggatgcggtgcggttcaattcaagcgtcatgtgaccagcgtaccgcgtgggcggcgggcccagcacacccactacatgagattttgcggccgaatacatttttatgtgccacactggggtggcgaaagggaggattatgtcaggtctaatcagcgccatgcaaggcttctgcgttatcggcatcgtgattgcggtgggatatgtcgccgcacgaatgcgaatcggcgggccgtccgctcagatggtgctcaaccgtttctccttcttcgtatcaagcccgtgcctgatgttcgcgattctctccaaggagccgatcttcgacatcttccacccctcgattatcgtggcgttcttctccgccgtgctggtgggcgtggtgttcttggtgctcaaccgcatgttcttccacctgaacgccccggacgccaccatcggcgccctgaattcgctgtaccttaattccaataacatcggcctgccaatcgccacctacattctgggcaacccggcgctggtggcaccgattctggtcatgcagcaggccatcttcacaccggtgggcctgacagtgctggacgtgaccaccaagggcaaggtctccatcaaggaaatcgccaagcagccactgcatcaaccgctgcttatcggctcgctgctgggcattgtggtctctgcgatttccgctaaaagcggctggttcccggtgccgaaattcattttcgacccaatcgacatgatcggcgattcggctgtgccgatgatcctgatggcgttcggcatgtccctgcacggcaccaagccgctgcagcagaagggcgatcgaccggccatcttcacggtcgcggtcctcaagaacatcatcatgccgatcatcgcgttcctgctcgcctacttcgtgatgggcttccgcggctccgagctgtacgcctgcgtggtgctcgccgctctgcccaccggccagaacgtgtacaactacgcggcccgctacaacgtgggcctcaccttcgcgcgcgacggcattctgatgagcaccatgaccagcccggtgtttatcgcgatcatcgcggcgctgctgagctgatctcagtcatcggcatggtaatcggcgaggttcacaccggcggccatgagaatgcccatgatctcgcgaccgcttgaagcgaatccccatgaaatcgaagatgtgtttggaaaaattaccatctgacatggaatttttcgcttacgcgaggtaaactagtagcacatcgacggttgcgggaatgccctgcggccacgattgacgccgtggcggggttgccgcggcgtcaaggcaacgagcaaggaggcttcatgctcaaaggtattccgaaaatcatcccgccggagctgctgaaagtgctgtgcgagatgggtcatggcgatcagctggtcatcgcggacggcaacttcccagccgaatcaatcggcaagaacgcaatcgtggttcgtatggacggccacggtggcggcgagatcctcaaagcgattctgacggtgttcccgcttgacacgtatgtggacaagccggcgacgctgatggaaaaagtgccgggcgatacggttgcgacgccgatctgggatgtgtacgcgggcctcatcaaggagcatgacgaacgcggtgcggatgcgattggatcgcttgagcgcttcgcgttctatgagcaggcgaagaacgcctactgtgtgattgccagcggcgagtcggcgcagtacgcgaacctaatcctgcagaagggagtcgtcttcaacgcggaataacgcaagataacgcttgacggcgctgacggcaccggaatatcagccgtcagccgcagtaccttttaccaacacataccgatacggcgagaaaagggagacctcgcagttgcggacgaatgattccgtccgcaactgcgaggtctccctttcctcgtgcttgcctcctcgtactcgtctgtttgtgtaccgcacgaaatagtttgcgctattcggcaaagcacccccctcatcagagggggcttgggtttagtcgatgttgtaagcgcgacgggcgttgttttcgaagaagtcctcgtcctcgccgaacgtgtccagcatgagttggaagtgcgtggcaaaggtcgagttgagttccacgaccggccagttggagctgtacagcaccttcttcgggccgaatgtgtcccgcacgtatttcacgatgtccgggcccaccgggttgtcgccggaaaccttgatatacgaattcggcagttcggccaacgctgcgagcgcggcgcacgattcctcatcaagcccgggcacgttgccgagatgatcgatgatgaccgtcacttcgggaacctgcgcgaacgccttggccatgtcgcccagttccgggccacggttgcacagctcgaatggcaatcccttggcggccatcgcgcgtagaccggcgatgaattcgggttcgagcgcacggccccgcggctcggaatccacatgcagcggttccctgatgccatcggcattaatcgggacacgcatccaagggcttacccgtccttgcaacatgcgcttcaagatcagaggacttgcattctcgtacagcagccggtcctcaagctcatggtcggccgcgtcaacctccacgtatacgccgccgaggaaattcacgccaaatttggcgtattccgcggcgaggtcgtcaaccgtgtaccggtgctgcagtgagggcaaccctgctagccatggcagatcctgcgcatccggatcccagatatggaagtgggaatcgattacgttgagtgtcatgtcaggcctccttcagaccgatcttggaaccccagaatgcgtaccaaaccaggaagaggaacaacggaacggtcgcccagagcatcacgttcatgccggccgcatcggtgatcgcaccgtagacgagcgggataatcgcgccgccgacgatagacatcgtgatcagactggagccggttttggccgcggcgcccttcagatgagtcagagcgagggcgaaaatcgtgccgtaggcgatggacatgaagaagtacagagcgataaacgtgatgaccgatatcttacccaatcccatggcggtgagaatcatgaggatcgtggcaccgatcatgtagaaaccgaggatcttgcctggctcgaacttggccatgaacggggtggtgacgaatcggccaatcgtgtacatcagtgtaaggacggcgaggaacgtggcggccatgccggcgctcataccctcccactgctgctgcgcgaacgtggagaacgtggagaagccgatggtctgcagaccgacgtacacgaactcggcgatgacgccgaggacgacccacggcttcttgacgagcgcgccgattgagctgtcctgagcaacgccgccggccgcttcctcctcgtcgcccgggggcgaagggagcttggcgatgacgaacacggcgatgacgattgcgagaatcacgccgatgacgatgtagaacatacgggtctggctcatgaaggcgaccttggactcctcgaagccggggtcaccgggcttggcggaggcggtgttgccgagaatcatgccaagaatcagcgggctgacgaccgagccgaccgcattgaagctctgtgcgaggttcaggcggaaggattcgcccttctcgtcgccgagcttgatgatatagggattgcagttcgcctcgagcgaggcggcgccgagcgcgataacgaacatggcgagcaggaataggccgtagctcagagacgtggtggcgggtatggtcaggaacgagccgatcacgaagaagatcaggccgcagatcataccgcccttatagccgaagcgcttggcgaccattgtcgccggaatggccattacgaagtaggcgccgaagtaggcgacctgcagcagcgaggattcggtgctgttgaggttgaggtaaacggcgaacggatcgcggatggcgctgacgaggttcatcgtcaggccccaggtgaagaacagtagcgtgaccagagcgaatgcgatgatccagctcttgcccctggtggacttcgacgtcgtcgtcggagtgttggatgccatggtttctctcctccttgagagtcacgcgccgcatggagcattcggacgcggcgcgcgattcggtgctgcattgtaaggctccccatagaggcggagccgacggttcggatgtgaccggtacgagtttaccctcccccgatcacaccccatgaaaatggcctatcaggccatatatgccccgtttcggtccatttcgtatctctcgtaggatgtgcgccggacctcgaagtcaggcgagcgcacggtcaaggtggacgtagccgccgtcgacgaacacccactggccggtggtgtggctggagcggtcggagagcaggaatgccgcttcattaccgatctcttcggtggtggtcatgcggtgctccagcgggatcttgtcggtgatcaccgacaggcgcgccttctgtgcggcctcgtcaccgaaggtcttgatccagtcggcgtacagcggggtccagcattcggagacaacgatggcgttgacacgcacccggtccttgacgagagcggcggcccattcgcgtgtgagtcccaggatcgcgcccttggcggccgcgtaggcgctagtcttgccttggccggtaagcgcggtcttcgaggagatgttcacgacggcgccatggctttccttgagatacggcacggccgcgtggaccagctcgtaatagtgagtcaggttgccgtggatcgattcctcgaattcgcgccaggtggtggtttcgagatccttgttgtcgttcttgccggcgttgttcacgatgccgtcgatatggccgtacttcttgtaggtctcctcgacgatgccggcgatcttgtcggtgtcgttcagatcaagcagatgcacgtcgtattcggtcgtgtactgctcgatatccttcttgaactcctcgagcgcgctgtccgagcggttgatcaccaccgggatcgcgccttcctgggccagttgcagcgtgatgcctttgccaatgcccttgaagccgccggtgatgatgatgactttgccttcgagatgcagatccatgggaactccttcgtccatccttattctgcgtttcatgggtgttccatgtcacgcccggccggggcttcggcaccccagccggagtggttgtgtgttgttgtgttaagttgtgttgttcagttatgaatttccagttgcggtcagccgcgatacaggtacttctcggccgtctccagcgtcatttcggtaccgttgcccggagcggtcggagcgacgtagttgccgtccttgatctcggtcgggtggacgaaatgttcatgctggttatcgacgtattcgatcatgcggccgtccatcgtgccggacacggccacgtaatcgaacatcgcgaagtggcatacggcctcgcacaggcccacgccgccggcgtgcgggcagacgggcttgttgaacttcttcgcgagcaggtattcgagcacgatctcctgcggaccggccacgcgggtggcgtcgatctgcatgatgccgaaggcgttcgcctgcagatactgcttgtacaggatgcggctctgcatctgctcgccggtggccaccttgatggggttgatggcgcgggcgatggtggcgtggccgatcacgtcgtcggggctggtcggctcctccacccaagccagatcgaagtcgtggaacttgttgatccagtcgatggcggtgggaacatcccacacctggttggcgtccacggcaagacgcacgtcggggccgatggcttcgcgggccttggccaggcgacgcagatcgtcgtcgatgttctggccgaccttgagcttgatctgcttgaatcccttgacctgcgtctcctccttggcgagcgcgaccatcttctcgtcggagtagccaagccagccgggggcggtggagtagccggggtagccgacctcgagcaggtgcttgatacgctcggccttgcccttctgcccttcccgaagaatctcaacggcttcggcgggcgtgagcgcgtcggtcatgtagcggaagtcgagcgtggagacgagttcctcgggttccatctcgcccaacagcagccacaacggcttgccggcacgcttggccttgatgtcccacagcgcggaaagcacggcgccgatggccatatgctccacgcccttctcagggccgagccagcgcaattgggaatcatgcacgaacagatcccatgcaatgcgcatgttgtcgagcagttcctcggtgttgcgcccaatcagcacctgcgacatcgattcgatggccttgcaaaccacatcgttgccgcggccgatggtgaacacgaagccgacgcccttgataccgtcatccgcgctggtggagatctccacgtatgcggaggagtagtcgggatcggggttcatcgcgtccgaaccggacagcgtctgagaggtggggaatcggaagtcatacgtcttgacttgggtgatggtactcatgtgttcgggctccttcgccttggtgaaccattgccttcagcataccccttgatttagaaatttacaaacccgattacgaaaatttttctcccagaacacgcgaagtaaggaaaactacgaaaaaatgcggcgttatgggccataatggtgaacagaggcaatggcagagaggagcggtgatggccaacgacaatcccacgcataagctcaaggtcggtgatctggcgaagatcgccggtgtctccccctcgaccgtctccaaggtgatcaacggccggcccggcatctccgacgagacgcgacgtcaggtcgaacaggtgctgcgcgagcatggttactcgcgcccgctggtgagtaccaagctctcccccaccatcgaactcgtcgtcgagtacatcgcgcacaacggcacgatggaactcatcaaatatgcctcgcactgggcgcagcaggcgggcctcgccatcacggtcacccagaccaaccatggcgatgccacggaagactgtttccgcggcatcatcgataggaatccccaaggcgtgattatgcagcagatgggcggtctgaccactcaagcgaagtctttgttgaaatcacgcagtattcccgtggtcatcatcgacccaatcgataccgtcgattcggatgtgatgagcgtgtccatcgataactggaccgcaggataccaggccggcaaacacctgctgtcgctcggccatcgacgcatcgccgtcatccgggggccggcgaacctacagaccagcatcgcgcgctatagcggattcaccgtcgctctgcaacaggccggggtggatctgccggagtcctatatcgaacagggcgactactttcccgccgaaacaagctatgaagcagcctgccggctgctggaactccccgaccgacccaccgcgattttctgctgcaacgacttgtcggcggtaagcacgtatcgcgcggcacgtgaacataagattccgttacccaaacagttgtccgtaatggggtttgacgacattttccccgctgatcagctcatgccttccctgaccagcgtgcaccagccgttcagcgaaatcgcacaacgtgccgtgcagatgatcatcgacaaccgcaatgacaatccgggcgatatgcacgtcatccttcccaccagcgtcgtcatccgggaaagtaccgtaccgcctcagtcatcagcccgataatcggccagattcaagctggccgccacccgattggacgcgaacgcgccgatggagaccagcgcatagcacagcacaagcccgccgaagaagctggccagcgtggccggttcggtcatcgaagcggcgaacagaggggccataagcagcatggaacagccgccggccacgatcaccacgatgttgagcggggtgagtacctcgatgaatcgcgcacggttcaaggtcttgacatcagtgccttccagcaccagcatgcggtattcgccggcttgatcgtagacgctgccagcctgcatcacgccggaactgaccgccgcaagcactgcggcgaatacgagggtcaggatgccgcccgtgccgatatcgcgaatgaacacggtggatggatcattggggtcgcccaccacagcggccgagccaaggaagccacagattgacgtgatgccggcgatgaacacggccaacgcaataccggacacattgcgccacgcacgcttcggattgtcgagaatcctgcgcatggcaatcatcgtggccgcatccttgggccgcttggccttggctttggcgcgagcggtgaccacccaggagcccacgaggttcaccagcgcgaagcacagcagcatgaagccgatgatcacgccgtacatcactacttcaccggcctgagccagcaccatcggattcttgaacagaagaacggcaatcaccatgatgacggcgaacaccaccacacgccagccggacggcagcgtagtcgcaacgcgtgaagtgacgccgagtggcgtgatggccacgcgccgaagcgtgaccagcgaagagatcagcgccaacacggtcacgccaacaagcgtaatgatcaaggcaatcggccccacccacagttgctcgaacgtaaacgtctgattctggaaatgcagcaacatgattagggggatcaacacgcagtaccccgcgatgccaatcagcgcccccaccaaggcctgcccagccgcatcaagcgccgtaaggcgaataacttgccccgtggtcgcgcctgccaagcgcagggatgcgagccgagcgtcacgacgggacgcagccaatcgcgcggcggaaccggcaagcgccacgaacggcacaatcagcagcaggcaggcaaagaacgccagcacgacatatgccgtggcgtattgatccaggctgtggggattggcgatacgctgcttccagatttccgctgttccgggtttgcaagcgtcgagattgattgcgcatccaatggtgtggtcggcggaggcgcgccacatgaacccatgcacgccgcccaaaacggtgagaaagatagtggtggctgcggcaaaagcaatgatggccaacaccgaagtatgacccgcactgccacgcgagccggggcgatggaacaatcgccacaatgcgaaagtgctcatcgtacgcctcccagctggccgtcctgcatggtcacggtgcgcgagcagaacgaagcgacgttggggtcgtgggtgacgacgaccacggcggaaccgttgtcccgcgcggcggccatgaggatgcccatgacctcgcggccggtggcctgatcgagggcaccggtcggttcgtcggcgaagaccacggcaggtttgacggcgagcgcacgggcgatggcgatgcgctgcatctgtccgccgctcatctcccccggccggtgcgtggcgagcgcgcgcaatcccatgcgttccagccacaggatcgccgtgtcggtggcggtgcggtagggcatgccgtcaagcatcatcggcagggcgatgttttcgaccgccggcagttcgggcagcagctggccggattggaagacgaagccgaaggcgttgcggcgcagtttggtgcgctcggcgtcgctcatgcggctcaggtcggcaccacggaagatgacggtgccggcggtcggcttaatgatgccggcgagcgcgtgcagcaaagtggatttgccggagccggacgggcccatcactgcaaccgtctcgccctcgcccagcacaaagttcacgtggttcaaggcaagcgtgtgcatggtgggcatgacgaagcccggttggatgggctgattcggttgcccagcaccgggtattcctgcggtgccttgggcggcggggtttgcgggagccggtgcgtagccggcacctgcgccggcgggaaccacaccggtgacgccgtgcccggcttgcgcgcgggccatgctggcggtgtagtccatgaccaggtcgtgggcctcgatgaccggggaccactgctgggtgtgcgatgccggctgctggaactgttggggttgctgaggctgagccgccggtcccggcgccggctgagtctgctgcaattgcgatgctgctgtattcatactcccgagcgtacggagcgaacgcccagccgaccatcgggctgcggtatgaacctttctggattaccggcccgctcctcatccgcaaggattagagatacgcagtcgacgcgacaatacatatatcagatgttcattgctcgagaagacgaggaacagtggaagaccggttcggaagctggaaccacataggccggttcggctggatatgcgaatcgcacgcacggtatgttcagggaaccagcgcgctgcgcgcctgtacatcgaacagaccaagcaaaggagcccacatggccatcgcaatcgacatcccgcacacaccaatcgtgtccgtacaaaagtcgtacaacaggagtatgactacagagaataacaagaacagtcgttttgaaatgagactcacctaagagcaacgttccagaatcgaccaagcggccgagtccaaaggcatgacttcgttgcaatgggcattatcgaatctgctcgccgccgcagatcgggacatccatgaagttcatatcattcggctcaacagtaaagcgtggaatgatttcaccgcagcattaaacgaacctatgggcctacgtctgaatgaattgttggagcgtgatcccatatggacgtgaccaacttcactgagcctcggcacctgactgcgagaggatatttctggtttcgactgcggcctgccattggccaatgattggctggtttccacacactaagtgcatacagcattgagcattcggaagctcccggttggccgaaccccattcccgtaattttgctaggcatgatgggcgtggatatcagatttcaaaccatgcacgtcgacagtcagttactccgagatgcggtatttcattctctgaacgatatgattttcggcatatccctgaatcatctagaatgtttactccgctcaatgtccacaatcaccaatgattaatggctggagaccgctatttgacgccgaccattgtctgaatcgcattcagacacaacactcctcattgcgcgcagaccagcgagttccgccgagtcggcgatgtgtctcttcggcggttgatttaggattttccgcatgcgacagctgaccacaccgctaaaaatgccattttcgcactgacttggggcggaggtcgtggcgaaacgcacgggggaacgtgtgtcatccgatatggtcatgcccgccagacattgaagcgtcctgtctatgcgcggttgatgtcccggtggcggggtcaatcgatcgacatacgaaccgggacagattcggctgtcccggttcgggatttcggcctcttttggcgaaccgggacaggcccttccatgaacacccgatatatgcaaatccaaaaccccggaattccgccattccccgacggcgaccatcgcacgatagggcgtcaggtgaatgagattctgtcccggttgtcccaaaagagacgaaatgacgaaccgggacagcagaatccgtcccggtccacacgcggttcacacggcattacccaagtaaactcatcggcaaaacattggcccagccaacaccactaccgatgtccagcacaggccagctcgtccaggcgggcggcgaagcggggccagtcggtcttcatggcggtgaggagcttgcggttgggcacgtcgtcaatcgggacccagcagatttccatgctttcgtcgtcgtttgccttgggctcgacggtgtggccgggcttttcgaaggcaaacacggtggtgtaggcccacgggccgtggtcctcgcagtaggagccgaccacctcgatgtcttcgggagtgatgttggcttcctcatagctttcgcgcagcgcgccctcgatgggcgattcgccgtccgcagtggcaccgccggggataccccacgtgccgccttcggcgctccacgcggcgcgatgttgcatgaccacgtgggtcaccttgccactcaccgggtcgcggcgagccagcaggataccggaagcaccgttggcgccccaatgcttgcggccgcaggcgcagtccacccagccatcgccgggctggtgtacgttttcgaccggcggcagaatgccagcgtgctggttgcccgatgccttgctttccggttccagttcaccacggccgacattccacaggtcggtccacgtgatgcccagttcgccggccagatgccgggccaacggcaggctgaggccgatgatgccgtgcggatcgccctcaatgctgtcgatgaacgcaccaccgaagccttccagcgtgaacgatccggcgacttccagcggctcgccagtggcaatgtaccgttcgatgtcggcatcggtgaattcgccgaaatggactttggcgtggcttgcgccgcgcacggtacgtccggtcgcgaaatcgatcaggcagtggccggtccacagttcgccggtcgcgccgctcatgcgcttcagtcgttctcgggccacggcttcgctgtgcggcttgccgtagcattcgccgtccaagaggaacatcgaatcacagccgagaatcagcgggccgactgtcgcctcggtcagtcccggctgtccggcaatagcggtggcgatgggttcggtgacggtcggcatatcgatgccggagaagtcgcgcgtggtggcgatttccgccttggaatagtcaataggcttgccggcggcggcttcacgcaggtcttcgccggcagcttcgcgttccgaatccttgatctccttggccttgagcgggtaggcgatcacgcggtcaccggtcgcggcggcggcagtatcggccacatcacgatacgcacgatgaacggcctcggccttggccacggccagaatcatcacgcgctgcttgatgctcagatcgtcgacggtgacgccttcttcacgggcggccgcttccagcgcagcaggctcatccacgtgcgagacgcgaattgtggggcagatacccgccgaatacagcacgtcacggcgaggcttggacttggaagcaagaattagcggaatggacatgacttaattccttatgctcccgctggcgggagctgtcgaacgaagtgagactgagggtggtctctgccggtatggcggaccaccctcagaccgcctgcggcggccagctcccgccagcgggagccttctcctcgacttagcgacgctcgatttcgacgccggcggtgttgatgggcaggtgaagcacacgccaatggccggaagcaagctgctccgatgcgatctggtcgatggcttcgcgggcgttgccgtaatgcagcacgagcacgcaggggccggcaccggagactgcggcggcatagcccttggagcggaagagcgcaatgagctcggtggacggcggcatcagggcaccgcgatacggctggtgcagtttgtcctgcgtggcggtgaacagtagcgcgttggactgggcctgggcggccgcaagctcgtcggcgaatgccgattcacgggttccgtcagcgcaagcgcacgtatcggtatcctgagccggggcagcggcgacgccggacttgccctgctgggcggcctgggccagcaccacgggattcatcgcagcgggcagcagacccacgcgagacacgttgtagacggcgtccttgtatggcagttccctaggcagcgcctgacgggccttctcagtggacagctcatagtcgggcacgaacacggcggcggtgatggacgggtccaccgggtagttgacggcgtggaatccgccgtgcagcggttcaccaccaggaacggcgaccgagccgacgccttccgcggtttcgaagtcccaagagacggtcaggccaccgaacacagccggggccacattgtccgggtgtccttcaatctgggcggccatatcgaagatggccggacggttgaggtcaccggtctgggcgaaggccgcggcggcggcgatgccggccacgatggcctcggcggaagagcccatgccacgagcctgagggatgttgttggtcacttccagcgtgaagccgagtcggccgaggccgaacgtggcacaggcacggcggaaggtggagaccacgagatgggtttcgtcgcgtgggagggtgtcggcgccctcgccgtggatgatcacgtgggcaatgccgtcgttcgggtcgtcgttgagcgtgaaagtgagctcgtcatagtagtcgagcgccagacccacggtatcgaagccggagccgaggttggcggacgtggcgggcacgcgcacgtgaacgctattgcagattggattcatggttgttccttaaaaaggagctccccttgtcaggggagcttgggtattcagctttcaccgttcgaccgcctcatcagagggagcttaggtttgtcagtccagcacgcgcaggatggacgggtcgccggtgacgaagtcgagcgcctgcacggccttgacggtgttgcgcagggtttcctcgtcggtcaggtgggtcacgacgcgcagctgctggatctcgccgtcgtagccggggtcggtcatggtgggcttcaagtcctggttcacaccgttgatggagacgccgttcttggcgaactcggcggcgatggcggccagcacgcccggcttgtcgtgaatcaggaagcgcacggcgaatgcagccttggaggcggtaatcggagccttcggcaaattcttgtacagcgggatggccgggccggtgcagccggcggtgatgtgacgggcttcggtcaccacgtcgcccacaacggcggaggcggtcggagcgccaccggcaccacgtccgtagaacatgaggtcgtcggcggcatcggccttgacgaacacggcgttgaaggagccgtgcacggaggccagcgggtggttctcgtcgatcagggccgggtagactcgggcggaaacgccagcctcgccgttctcgaccacggcgagcagcttgatgaccttgtgttcggcggtagctgcggcgatatcgtcggcggtgatcttggtgatgccttcaacggacacgtcgtcgatggtcacggaggtgtggaagccgagggtggccatgatggcggccttgttggcggcatcgtagccttcgatgtcgccggtcgggtcggcttcggcatagcctttggcctgggcgtccctcaggacgtcatcgaactggagacccttggtggtcatctcgtcgaggatgtagttggtggtgccgttgacgatgccgagcatgctggtcaccctgtcgccgaccagggactcgcgcaacggccgcaggaacgggatcgcgccgcccacggcggcttcgaagtagatgtcgacgcctttggcttcagcggcggcgtagatctcgggaccgtatttggccagcaacgccttgttggcggtgaccacggaggcaccggattcgatggcggccagcacgaattcacgggccgcggtggtgcctccgatgagttcgatgacgatgtccgagttggtggccacgctcatggtgtcggtggtgacaatggactggtcgatccatgggaacgcctcggtggccttcggatggcggcatgcgacgccggtgagttcgatcggacggccgatgcgagcggacagttcgtccttctgctcgacgatcagacgcgccgtctgggagccgacggtgccggcaccgagcaggccgacgcggatcggggtttcgtcgttgcgagccaattcagggtccttccaaaaagttttctatatcccaccgctattttacggattatttccgacagcagttgggagattccaattgcttcgctgctcccctcggccacctacgcctgacagctcccctctttgaggggagctggctcgcgcagcgagactgaggggagttctcattcgctgacgtcgaggttaagtaggtcgtctacggtctggcggcggagcatgacgtgcgcgccggactcgctgacagcaaccaccgccgggatcagcgcctggttgtagttgctggccatggtgcggccgtatgcgccggtaaccggcacggcgagaatgtcaccgcgcttcaaatcggcgggcaactgcacctcgtgaaccacaatgtcgccggattcgcagtgcataccgcacacgcgggcgagcatcgtttcagcggaaccagtgcgattcgccagacgcgcggtgtagtcggcaccgtagagtgccggacgaatgttgtcggacatgccgccatccacggacacgtacacgcgctcggcaatcgggttgccggcactgtctttgacatcggacaagtgcacgtgcttgatggcgcccacgcggtacagggtcacgccggcaggcgccacgatgtagcggcccggctcgaagctgatggccggcgccggcatgccgagcgcacggttggtgctgttgaccgcatccgccaagcgagtgagttccacgtcaatgtccattgaatcttcgccatcggtgtaggccacggagtagccgccgccgaggtcgatttcgggcaggatgtaggcgtcggtggcccacagggtcttacgcagcagcatcatgcgcttggccgcgtgaatgaaggcgtccgcatcgtggatgttggagccgatgtgcgagtgggctccgaccagttcgagtacgtcctggttggcaaggatgatcttgagcacggcgatggacggaccgtccgcaatggcttccatcgcggcggccagcgccttgtctgtgtcggagacttcctcgtggctcaggtcgtacgggtacttgacgtcgtagtgcagctcgcgctccgatttctcggtcttttccgcgccattttccggggaatgcgtcgcagagatacgcgcgttggtagcggcaggcgtcacgtctttgagggcgttcagcacgtcgagcacagcggcgtcggccccggcggccagcagcggcacgccgaacttctggtcctcgtgagcagtggagatgtactcgtggccgccggcgtggacaccgacggtgacgcgcagcatcacacgggcgcgtttgccgagcctgcgggcgatggcagcaacgcgctccggctcgtcgggctcgtcgataacgattttggcgaagccctgttcgatggccagcgcgatttcctcatcggacttgttgttgccgtgcagcaccagacgacgtccgggaacgccagcggcgagggcgattttcatctcgcccatcgtgcaagtgtccacaaacatgccggcctcggtgaccaatcgcacgacttctttggacaggaacgccttgccggcaaagctcacgtgcgtggtggaggtgtcgaatgcttcggcggcagcgcgcacgaagtgcctggcacgtgcgactacttcatcagtgtcgatgagatagagcggcgagccgaactcgtcaagcagcgattcggcggtacgaccatgaaattcgatggagccttcggcattcacagccgtagcggccggccaaattggagaaataggcataatcacatcttctcggggcggtgacgccgaggaggtcgaggccgttggcgatgacctgctggacggcgtcattgagcttcaggcgggcggcggcacgggccggctccgggttcttggcgatctccaaggccttgcgagcttcgtcgtcgccacgggtttccggatcggtcaggaccatcggcaccacgcgctccacgttgtaccacttgtgataggtggcggccagttcttcgaggtaacgggccaccttgtgcggctggcggtcgtcggccgcggtggcgagcacgctcgggaactgggcgagggcggcgagcacttcgccgtcggcctcggtgtcgagcagggccaagtcggcaccctcgtagctgatgccggcaacggctgcgttgcggtccacgttcttggagcgggcgtgcgcgtactgcacgtagtacaccgggttgtcgttggtgtgcgaggcgagcagggccaagtcgatgtcgaagttctggttgtaatcggagcgggccagcgagtagcgggcggcatccacgccgaccacggagaccaggtcgtcgatggtcacgacgttgccggcgcgcttggacatgcgcacgggcttgccgtccttcatcacattgaccagctggccgatgagaatctgcatgttcttgccgggctcgtcgccgaaggccgcgcacatggccatcatgcggccgatatatccgtggtggtcggcgccaagcatgtagatggccacatcggccgggttttcggcacggtgacgcttgtcccagtagtaggcgatgtcggcggcgaagtaggcgaactcaccattggacttgatgatcacacgatccttgtcgtcgccgtgcttggtggattcaaaccaagtggcgccgtccttgtcgaagatgtcgccgcgggacttgagctcttcgatggcggcgtcgaccttgccgtcggcgtacaggctgttttcatggaaccagacgtcgaagttcacgcggaagtccttcatggacttctgaatctcgtcgaacatcatcggtacagcgcgcttgcggaattcctcacgcacttcggtatcggcttcgccgagcggttcgccgtcgtcgttcaggccttgatcctggtgggccagtgcggtcaggtccacgccgtcggactcggcttcggcctgaacacgggcggcgatctcgttgatgtaggcacccttgtagccgtcgcacggggtttcggtctggtagccggcgtcgcccaagttattggcctcggcccaggcggcaaccagcgacttggcgaagcggttgatctgctcgccgtggtcgttgaagtagtattcgcgcaccaccttggcgccgttggcttcgagcacgcgggccatggcatcgccgacggcagcccaacgagtgccgccgatgtgaatcggaccggtggggttggcggagacgaactcgagattcagggtctgaccgcccagatgggcgttgcggccgtattcgttgaccttgttgagatgcttgtcggtgtcggtcacggcaccggcggcgagtacggtgtccaccacggcggcggccgaggcggagtcaagcgtgatgttgatgaagccggggcctgccacctcgaccttggcgatgccgtcggcttcagcgagcgcggcggcgaacggctcggccagatcgcgcggcttcatgccggccttcttggccagctgcatggcgatgttggaggcccagtcgccatgcgcacggtccttcgggcgcatcacggcgagcttgtcgacgggagggatcagatcgtcggtcaacgtgccggcctggccggcggcgacgaggttgtgggcaatgctggaaatcagttcacttaaggcttcaggactcattcttctaaggataccggcgatggcgacaccgtgccgcgtccggtcatcgtcggcggccataatggaacgacgcgcgaaagaggtgcatatggccgggctcaatccccaatcattggtcacgttgtggcagatcgaacagtatggttcgttctccgccacggccaaggccacgggttggtcgcagccggccatcagccagcagatcaaaaagctggaggcacagtgcggttcgactctggtgcaacgcacctcgcatggtgtggaactcaccgccaccggttcgatgctcgcccgccacggcgaggccatcgccgatcggctggagcgggcggcccgtgaggtcgaggattatcggcatcatcggtttgctcacctgcatttggtggccccaccatcaatctgctctactatcgcggcccgtaccgtggtcaagctcagtatgttcacggacatcgagctgagcctgattcagatggagccaccggaggcgatcggtctgatttcccaaggcaaggccgatgccgccgccgtgttccgctacagcagcatcccgaacttcctgcacatcggcgacgacctgaccttccattcgctgggttacgatccgatgcgactgctggtgcaccgctccagcggcatcgccaaacgattcgaggagaccggcgaacctgtgtcgctgtccgccgccaaagacgagcattggatcgccggttgccccacctgccgcgcaaatttggtgaaactggccacccgtgccggattcaagccggatatccgccactgcacggatgattactgggccacgcagaacctggtcgaggttggtatgggcgtctcgctggtgccggcgctcgatacgcatatcaacttgcagggcgatctggtggcctgtcccattgccgacgattttgcggcgcgcgaggtcggcatcgtgactcgtgccggcgaccatcgcccagcgcttggttcattgctcgaggagctcgagcgcacggcactcaaatatttgagtgccaagtagtcgcacagcgataagcaagcttgcgagcgccatcacgatttcggggagccagaccgttgagcggcccttctgcaccgggaacaatggcatgttatgagcatgaacaacattccccagtcaacgactgtgagcaacgcaaccgccggcgtctcttgctttgatgccaatcacatcgacgtgacgaccatcgaggatctggagcaggtcggttcggataaatggacccgttaccccggctgcatcggcgcattcatcgccgagatggattacggtctggcaccgtgcgtggccgaagccatcgaagaggccactgaacgtggcgcgctcggctacattcccgacccatggaagaaggaggtcgcccgctcgtgcgccgcatggcagcgccgctacggctgggaggtggatccaacgtgcatccgcccggtgccggacgtgctggaggcgttcgaagtgttcctgcgcgagatcgtgcgcgccggtaactccatcgtggtaccgactccggcctatatgccgttcctaagtgtgccgcgtctgtatggcgtggaggtccttgagattccgatgctgtgcgcgggcgccggcgagagcagcgggcgcaatgatgaatggctgttcgatttcgacgccattgagcaggcgttcgcgaacggctgccatgccttcgtgctgtgcaacccgcacaacccgatcggcaaggtattgacgcgcgaggaaatgctgcgattgtccgatctggccgccaagtacgacgtgcgtatattctccgatgagattcacgcgccgttcgtctaccaaggccacacgcatgtgccattcgcctcaatcaaccggcagacggccatgcaggctttcacctccacttcagcctcgaagtcgttcaacattcccggcaccaagtgcgcgcaggtgattctcaccaatccggatgatctggaactatggatgaggaacgcggaatggtccgagcaccagacggccaccatcggtgccatagccaccactgcggcctatgacggcggcgcggcatggttcgagggcgtgatggcatatatcgagcgcaatatcgcgctggtcaacgagcagatgcgcacgagattcgccaaggtgcgctatgtggagccgcagggcacgtatatcgcgtggctggatttctcgtcactgggcatcgatgacccggccgactatttcttcaagaaggccaacgtggcgttgacagacggccgtgaatgcggcgaggtcgggcgcggttgcgtgcgtatgaacttcgccatgccctacccgctactggaggaatgcttcgaccgcatggccgccgcgctcgaggcggacgggctgttgtagaacaaaatcgcggctcccctcaaagaggggagccgaggaacggccgaattagtcgaagtcggcgccgagggcttcgagtttgcctcggaagtcggcgtagcctcggtcgatcaggctgatgccgtgcacgtccgaggggccggacgcggccaaggccgcgatcagatggctgaacccaccacgcaggtccggcacgtcgatgtcgcgtccggtcagcggggtcggtccgaagatcacggcggaatgcttgtagttgcgctgccggaaacggcacggcagcgagcccaggcactcgcggtacaactggatggtggcacccatctcgaccagcggcttggtaaagccaaagcggttctcatacacggtctcgtgcacaatcgacaggccattggcttgcgtcagggccaccacgagcggctgctgccagtcggtcatgaagccagggtgcacgtcggtctcgatagccacgggcttcaagtcgccgcccggatgccagaagcggatgcccttgtccgtcacctcgaacttgccgcccaccttgcggaacacgttcaggaacgtgatcatctccggctgggtcgctcccttgacgaagatgtcgccgtgcgtggcaagcgcggcggacgcccaggacgcggcctcgatacggtcggtcagcgacgtgtgcgtgtagccttgcagctccttgacgccttcaatgcggaaggtgcggtccacgtccacggaaataatcgcgcccatcttctgcagcacgcataccaaatccatgatctccggctcggtggccgcgcccgacagttcggtcttgccctcggccagcacggccgccagcagcgtctgctcggtggcgcccaccgacgggtagggcaggtggatcttcgcgccgtgcaggccgttgggcgcggtgatgtggatgccgtccttgtgctccttgtccaccgtggcgcccagcttgcgcagcgtctccaaatggaagtcgatcgggcgcccgccgatcgcgcagccgccgagtgcggggatgaacgcctcgcccagacggtgcaccagcgggccggagaacaggatcgggatgcgcgaggagccagacagcgtgtccacgtcagccacatcggccagctgaacatgagaggcatcgatagtcacaatgcccttttcgccgtccacatccacgtccacgccatgcaggcgcagcaaatcggacaccacatgcacgtcacggatctccggcacgttcttcagcaccgacttgcccggcgccagcaacgcggcgaccatcgccttgctcacgaagttcttcgcgccgcgcaccttaatcgtgccagccagcggcttgccgccttcaacatgcagcacgtcatccgggttctcagccacgccactctcctcaatcaatcaatcaagattcaaaaatgctaccgtccagtttgccataagccatgtgccgactccgtgaaatgccgcagccgaactttgatcaccgtgcacaacggattccacaccccgtcgaatcaaaccaataacgtgatcttcctcacatttgccgccacggcgttctccatacttctacgctacgattcagggcaatggcatcagacgccatggccacaagcaaaggagcatttatgaccacagtcgccgtcatcggctgcacgcacgccggcacgttcgccaccacttcgattctcgccgagcatcccgattggaccgtccatgttttcgagcgcaacggtacgctgtccttcctctcctgcggcatcgccctgtgggtgggcgaccacgtgtccgacccgaagaaaatgttctactcctcccctgccgctctggccgaagccggcgcgaccatgcacatgcgcaccgacgtgacgtccgtggacctcgacgccagaaccctcacctaccgcgcgctggacgaggccggagaccccgccgagcagaccctcgctttcgacaaactggtcgtgaccaccggatcgcgcccggtcatcccgccaatccccggcatcgacagcccgcatgtgctgctgtgcaagaactgggatcacgccatcgccatcaaggagaaggcgaaaaccgccaagtccgcggtggtgatcggttcgggctatatcggcgcggaaatcgccgagcagttcagcgtcaccggcgtcaagaccacgctggtcgacggccttgatcgtccgctggccaataatttcgataagaccatcaccgatcaggtggcggccgcgttcgaggagcacggcgtcacgctcgcgctcggccagaaggtggtcgcgttccgcgacaatgacgacgacaccgtcaccgtggtcaccgaaaagggcgagtacacggccgagatggcgattctggccgtcggcttcctgccgaacaccgacctgctcaagggcaaggtggacatgctgccgaacggcgcgatcgtggtcgacgactacatgcaggcgtccgtgccgggcgtgtacgccgccggcgactccgccaccgtgttctacaaccccaccggccagcacgattacattccgctggccaccaacgcggtgcgccagggcctgctggtgggccgcaacatcgagacgccgaccgtgaagtacatgggcacgcaggccacgtccgccgtgcagctgtacgatctctcgctcgccgcctccggcctgacctgcgccggtgccgaacgccgcgggctcacggtccgcgagacctcgctcaccgaggattatcgcccggacttcatgctcatcaccaccccagtcacgtcgattctgacctgggacccggaaacccgcaaggtcaagggcggccagttctgttccaaagccgatatctccggcgcggcaaatgtgatttccatggcgattcaggccggcttcaccatcgaccagctcgccaacgtggacttcctgttccagccgaacttcgacaagcccgtctattacgtgggtgccgtggccatgaaggcggcggccaagtaagacggccgtactcaccgcaaaaagaaaccccggcgtgatgggcgccggggagagaaaggagagaagaaagaggttaagttatgcagcttgttcggccgtgattacatataacagcaacagttttaatgcaacgtgggcactggctgggaatcgtctgggaatcacggcccgtacaggctgtttcttgtttctggagccgatctaccggctggctttgatcttgtgggccagttcggcgtcccacatcgcaccggttgcggacatcaccgaatccgcgccggcgtttctgtatgcctgatagtcggccggcgaaaccacgccgcccacgccattgatcttgaaatcaagaccgagcttctcgcggatcgcggccagacgggcgaccatgtcgagtccggcgccgcgaatcgcgttgccgcatacgcctgaacggtcacggcctgcaccgggcagtgcctgattgccattggcatcgaccagtttggcggaaatcgtattgatggtgctgaaaccctgcacagtgccgtggcccacggtggaacgcaccataagctccagagcgtcgtcgctggggatgtaggcgagcttgaccatcagcggaatgtcgccaatctcctgcttcacggcctcagtgatgcggcctacgagcagcggattgtggcatagcaagcggttgtggccctcgttggggcagctggtgttcatcaccatgagcttggcaccggtttctttgaccaggcgggcggtagtggcatggtcggcgatgtattcctcctcgctcatgccctccacacgcgagccctggaagctcgggaccagcacttgaccgggaccggcggcctcgatggcggcgcgcatgtccggctgccaggcatccgggctttgcgagggcacgccgaagctattggagatggagatcggagtctcgtaattggtgtcggcgagcacgccctcgtccagttcggcgctgcccggtgttagtgaaccgtccgccgacttggggtgtacggcgagcacattcgggaacgggttgcagccccaggcgcgcgaacgcacggttttgtaggtcgccagatcgaagcccatgcggaaggcggccgtggtgaaacggctgttgagcagcgggcctgcgggaatgccgaaaggcaggttgaccggctggcccagaaaagtggccaaggcaccctcgctggtggttccggcggcatctgcaccgttgccatccttcagcgcctcggcaaacgcgccgaacggcccttgctcatagttgtcttcgtagctgcggctgacatcgtaaaacggctcaaaatcactcatgcttcaacgataagccacgccccggcccacaacgcacgatgggccagtcgcccacggctacacgatgccgcgatcggccaacggccctgggcctgcaattatagactcgcctttcggcgaggctcaatgctggcctcgctgctgtcgcagctcggcacagggcctgccgaaagcccactgggctttcagcaggccgatcgcggctaaataatgccgcgatcggccaacggccctgtccaatcatcgtccggctcgcgggcggactcgattttttcttcgggccagtgcttggcgggaatggtcttgggcttgaaggggaacttttcggcgcgcatcttttcgtaggcggcgatgtcgtcctcgtgctgcagtgtcagatcgatgtcgtcgtagccgttcatcagacgccaacgcacgtaatcgttcacctcgaacggcagggtcacatcgccgcaggtgacggtgcgagtctccaacgagacagtcatctcgcgaccaggctcttcctccagcagcttccacaggagctcgacggactcctgcggcataatcgcggccagcacgccgtttttggcggtgttgccgtagaagatgtcggcgaagctcggcgcgatgaccacgcggaaaccgtaatcgtgcagcgcccacacggcgtgctcgcgggaggagccgatgccgaattcggggccggcgaccagaatctggcccttaccggcgtattccggcttgttgagcacgaagttcgggtctcggcgccatgcgtagaacagggcgtcatcgaagccggacttggtcacgcgcttcaagaacacagcgggaatgatctggtcggtatcgacgttggagcggcgcagcggcacgcccacgccggtcagtgtggtgagtttttccataacaattttcctttcggggatctctcccccagtcagtcttcgactgacagcccctcgtcagaggaggctcatgtgtattgactcagagatcggcgggggacgagattgtgccgcggatggcggtggcggcggctacggacggcgacgccaaatgcgtgcgcgagcccttgccctggcggccctcgaagttacgattcgaagtggaaatcgagcgctcgttcggtaccagcttgtcggggttcatgcccaggcacatcgagcagccggcattacgccattcggcaccaaagtcctcgaacaccttatcgaggccttccttctccgcctgcagacgcacacgggaggaggccggcaccacgagcacgcggtgaatgttctcggccttgtggtggcccttcatgatcgcggcggcctggcgcaaatcgtcgatacgaccgttggtgcacgaaccaatgaacacggtgtccacggcgatgtccttgatcggcatgcccggcttcaaacccatgtatgtaatcgcacgttcggcggcggcgcgcttggtggcgtcggcgatcttgtccggctccggcacggaggcggtgatcggcagaccttggccggggttggtgccccatgtcacgtacggtcccagcgtggaggcgtcgatgtccaccaccttgtcgaatacggcatcgtcatcggtcttcagcgtcttccagtacgccacggcctgatcccacagttcgccttccggcgcgtgcggacggcccttcaggtactcgaacgtggtctcgtccggcgcgatcatgccggcgcgcgcgccggcttcgatggacatgttgcacacggtcatgcgctcgtccatggtgaggttgcgaatcgcctcgccacggtattcgatcacgtatccctggccgccgccggtgccgatcttggcgatgatcgccagaatgatgtccttggcggtcgcgtccgcgggcagcttgccctcgacgttgatggccatggtcttgaacggcttcagggacagcgtctgcgtggccatcacgtgctcgacttcggaagtgccgatgccgaacgccagcgcaccgaacgcgccgtgcgtcgacgtatgcgaatcaccgcacacgatggtcatgcccggctgagtcaggcccagaatcggggcgaacgcgtggacgatgccctgatcggcgtcgcccagcgggtgcaggcgcacgccgaactccttgcagttcttctccaaagtcgtcaactgcagtgcgcttgtcttgtccgggttcggccggtcgatatcaacggtcggcgtgttgtgatcctcggtggcgatgagctggtccacgtgacgcggcttgcggccggccaagcgcaggccctcaaacgcctgcggactggtgacctcatgcatgagcatcagatcgatgtacagcaaatcaggagctccgtcgctgcccttgcgcaccagatgatcggcccagaccttctcggccagtgtcgttcccatagtgattcctccaaaaaatatcgcgcgaggcattgtgttcgcgccttgttcgtggtattagcctatgtgcttgcgatgggcccagccatgagcatgccggatattgagatacggtcaaatgacggcctcaatatggctcggatacgactcgaacatgacctaggcatgactcggttccgctccagacaggtctcttcggcatccacgaacgccctttcaacttcatgaccaccctgtgagacacttccctaatttgccatttcactatgtgagatggcataatcgcccttattatgactgattcccaagaagaaccattgaacaacagcttgaccgagtccgagccggttgaagacaccaccaccaaggacgatggggaaatccattccggcgttggcgtccttgataaaaccgtaaagattcttgacgcactggagtccggtccgtccacgctgggacagcttgtggccgccaccggtctcgcccgaccgaccgcacatcgtttggctattgcactggaacgccaccgtttcgtactgcgcgaccagcatggccgattcgtactcggctcccgtttcgccgaacttgccgccgcagcaggcgaggatcgtctgctgaccgccgccggccctatcctgcagacactgctcgatcgcactggcgagtctgcgcagatttaccgccgccaaggcgatcagcgcgtgtgcatcgccgctgtggaacgcgcctccggcctgcgtgattccattcccgtgggtgccatgctgtcgatggaagccggttccgccgcccagattcttctggcttgggaggattccgaccgtctgcaccagggattgcgccacgccaagttcaccgccaccaagctggccgccgtacgcaagcgcggctggtccgagtccgtgaacgagcgcgaagagggcgtgtgctcgatttccgccccgatccgcaacgcctccggccaggtcatcgccgccatctcgatttctggcccgaccggccgcatgggcgccgcccccggacgccgctatgcgccgctggtgatggccgccggcaagtacctcaccgaggcactggtcaaagccgttcgctgaaacataccagtcaatccaaccgatagcccaaccggcagaaatcccgcgtcacaacgaaagagacgcgggatttctgccactaatcgtccaacacagcggaaggccaccgaaacctcgaatacttcgcgccgctttccgcctctatcaggaacagttacctgaataaaccgggttacctgaataaaccggacagttgactccatagcgacggcttgcgcagcaaatcatcgccctcgccctcgccaggcgcggtctggttcaccgcataggtataggcgcgtttggaactgggcttgcccaccagttcgccaaactccagcaattgcgtacgcggctcgtaagggtgacggatatcaaattcgatcaatcgcgtggcgcgtttggccggagccggtccgtacgtattgaatccgcaggttggcgtagcgataagcaacagaccctcatgttcgccgacgaaaccgttgcgatgatcatgaccagctacgacgccgaaatacccctcgcgcagcaattcgaattcgcctgacgtatcagggcaggatatgccttctcccaaatatccgccgggctgggtttgcaattcgtccagcacgtagtaggtatcggcgtgcgaacgatagccctgcatggcaaacgccgcgttggccgccaccggcttcagcacgttgtaatactcgggcatcggcatgtgctggaacaccattgatttcgcaccgatacggtcgggcacggcgttcaggaaggcgagcgctgcgggcgatggtgcgccgaagccgccgccatgcacgtaatcgccggagtcaagaatgaccagacccagcacattgcgcgtatggtcaacgtccataaccggcagcgcgaaggtgcctggttcaccggaaccagtggcaccagacagtgtctgcacagcgccacccgctccacaggtgtatgcaatctggttcggcaaggtctcacttggcggattgacacaaccggggaactcgcgatagataccgtccagttccgcattgcttagcccgcattggaaatcatggttgccgtacgtcacggcccacggaatgccgcgcgccgccaacggctcagtgaactggccaatggccttgcgcaccagcgctcgggtatggttcagcgcggattcggcaataggttcatcacaccagcgacgtttacggaatgaatcggcgaacgccggatcgtagccggcgatctggttgccggagaaaatcaccagatcaggccgtgcggcatcaaggctggcctcaatcagggcgatggtgtctttggagactttcggcccatcctgaatgtcggcaatctgcagcacgcggaacttgccggaatagtggaattgcagtcgtccgagacgcgcagagatagagaccgggcggccgtcttcggcatcggccggcttgatacggggtttcgacgacatcccctctggcgtacgctgtgtttccgtcatgccctccactgtacacacaaacgaaaaggcccgccggagcgagccttttctacaagttcaactactggagcagaatctctgcacaacatcatcgttgtaacggtaagtctttccaatgcccgtccaacgtaacagtcctcgtgaccatacactatttgtgggctctgctctgttcagttgtccttgtacctcataatctattcatcactcccgtttctcgcaacctgcagagagtcgttgtgcgttttttatcacaactgttcaatcgcactttctgactatcggaaaacgagctgaactgttcacatcgaacccgtctgatgttcggtttcgttcgtttcaccgccgctcacggcgtgtcgcgagcacgctagcacacacaaaaccaaccaacaccgaactaacatgaacacccgttgaattctggcgcgttcagtcgttttccggccacgccagagcttacgatataggctatggcacagatatttgacgcaccctcgaaggcaattctgcgcagccaaatcgcagagcatattgccgaaaacgacaacaacgaccgccgcgtcgatcaggaaggcgaggcaccgctgcccaaggaccgtttcttcgaccgcgagctcagctggctcaagttcaaccagcgcgtgctcgaatgtgcggagaacgaagacatgcccctgctcgagcgcgccaacttcgccgcgatcttcgcctcgaaccttgacgagttcttcatggtccgcgtcgccggtctgaagcgccgtatcgactcgggcatcgccgtgccgtctgccgccggcctgagcccgcgtcagcagctgcgcgcgatcagcgagaccgcacaccgtctgcaagacgagcacgcacattacgcgatcgacaccattctgccggaattggagaaggagcgcatcgtcctgctgacgtgggacaagctcacctcctccgagcaggagcgcctctcgcgctactaccgccagcaggtgttcccggtcctgacgccgctcgccgtggatccggcccacccgttcccctacatctccggcggctccatcaacctggccgtcatcgtggagaacccggcctccggcaagtcgcacttcgcccgtgtcaagatcccgggcaacctgccgcgcctggtgccggtggacgacatgaccgacgaggagtccaaggacgagcgttacggcttcatcgccatggaaaagctcatcgccgcgcatctggaatccctgttcccgggcatgatcatcaaggaggcccgctccttccgcgtgactcgtaacgaggacatcgacgtggaagaggatgacgccgagaacctgctcaacgccatggagaaggagctgctgcgccgccgcttcggaccgccgatccgtctggagatcacggacaccactagcccgttcctctcccagctgctcgccgaccagctcggcgtgagccaagacgaggtataccgtctgcccagcccgctggacctgaccgtgctctttgagctcggcagcgtggaccgcccggacctgaagaaccgtccgttcgtgccgaccacgaaccgtcagatcgccgaggtcgagtcctcccgcgcacaggatattttcgccgccatccgcgagcgcgacatcctgctgcatcacccctatgactccttctccacttccgtgcaggccttccttgcgcaggccgccgcggacccgaaggtgctggccatcaagcagaccctgtaccgcaccagctccaactcgccgatcatcgacgccctgatcgacgccgctcatgccggcaagcaggtgctggctttggtggaaatcaaggctcgtttcgacgaggacgccaacatcgcgtgggcccgcaagctcgaacgcgccggcgtgcacgtggtgtacggcatcgtgggcttgaagacccactgcaagctcatcgaagtcgtgcgtcaggaagcggacggtctacgccgctactgccacgtaggcaccggtaactacaacccgaagaccgcgcgactgtacaccgatctgggtctgctgacctgcgacccggtggtcggccaggatctgactcgtctgttcaaccagctctccggttacgcgccgaagtccagcttccaccgtttgctggtggcccctcgcaccgtgcgcaccggtctaatccagcgcatccgccgcgaggaggacgccgcccgcgccggcaaggaggcctggatcaagatcaaggtcaactccatcgtggacgagaagaccatcgacgccctgtaccgtgcctctcaggccggcgtgaagatcgacatcgtggagcgcggcatctgcgctctgaagcccggcgttcccggtctgtccgagaacatccgcgtccgttcgattctcggtcgcttcctggagcactcccgtatctacgccttctgcaatgcggacggcccgcagatcggcgagggtccggcttccggcccggaggtctacatcggttcggctgacctcatgcaccgcaaccttgaccgccgtgtggaggctctggtgcgtgtcaccgccccggagcagattgacgggctcatcaagtacgtggacctgcagatggccgactccaccatgagctggcacatgcagcccgacggcacatatgtgctgcacaccaaggacgacgagggccgcccgctggtcgatagtcaggaatacctgattcgcaagcaccagcgccgccccaattcgcacaactgatttcactcgatgctccctgtcaacgcaagctgactgagggtggttacgatgcccggctcctctttcgagaggatgccgggcatcgtcgttccatgcgcaaaactacgtagcagcggtccaacgtgacctacaatacaagagatgggtacgaacagtatgagacgaatcgtggaagccgccggcggtattctgtaccggtggaaggatgatgccgagccgacgcaggcatcatctccatcagtgaaatccaatattgccaccgatggcaccatcatcgcgaacaccacggattctgacggcgagaccacggcagcacccggcgcatcggacgcggctcccgccccggacccggcacaggccgacagcccagccacggcggacaacgtactcaaccgcatcgaactgtgcgtcgtgcatcgcccgaaatacgacgactggagctggccgaaaggcaaggtcgatccaaacgaatcacaccggcatgccgccgtgcgcgagatcggcgaggaatcgggcctgtccgtggagcttggcccttatctgggtgacatcgagtacccgctgtccgaagagggcatcaaacagcgccataccaaggatcggtcggcggacaccaagcacatccagttctggatggccacgccaatcagcgccatcgacaatctgcggcgcacccatgcgttcggcccggtgcatcgggcggacatcggcgaaatcgacgaagtcctgtggttgacgccggctaaggcccgcaagaaactcagccattccaccgataaggacatccttgcgctattcgttgaccgggtgcaggagggcgcgcttgacgccgtgccggtgattatcgtgcgccacggcaaggcagaagcgcgcaagctgtggaagggctcggacgagaaccgtccgatcacgccgcgcggcgcggctgcggcatacgcgctgaaccgcgagctggcgtgtttcaatccgacccgactggccacgtcgccttgggtgcgctgccaggagacattggagatgttcgcgtggcagaccggacgagacatggttcatctcgacccgctcaccgaagatgcatacgccgctgcgccggacaccgcatgggagtgtctactcagcgaaatcgagttcgcacttgagcgccgtcagcctacagcgatatgcatgcaccggccagtgattgggggtatgttcgaacacctgcgcagcatgtgcgttgcgccgtctctgagcaaacgcctgattgccaagacaccgtttatgccgaccggcacggcggtggcgctgttcgtcactccgacgcctcatggtcccaaaatcatcgatattcagaaggttcaaccgcttgtctactagacccgcatttcctgattcatccaactcctcggccgctgccgccgcggctcatgccgcgcacaatggtgccgccggcagtctgggcccaggcttcggctcgctgcgtgcggccggagcggcattcggacctgctcgcatgggttcttcacgcccctcgcgcccggctcagctcgacccggctgtggccgatggattggcaggtggcatggacccgcaggcgttgagcgagatgagccatctgtccgctgccgcattgctggatcgtgtgcgccatagcgaggacccggcggttgttgagcgggtgctcacgttggtggagacggtcggtgtggatgaaatcgccgaactgtggagcgatgctgagccggattcgctgcctggtgtgctgtggcgactgtatatgctgcgtacgtggatgcgatcgaatcgcgactcaatcgcgcatctgtggcgcttgggcgagccggtggccactaccgcctccgccatcgccggcgtggatcaggctcccagtgaagatgacatcgtgcgattggccgattcgattctctccggtgcttttgtgggcgattttgccgtggcgcttgaacgtgcggcggcgtttaccgatgtggtggcgttgggcttgcgcatggaggcgcggcgcatggtgacccgggccgaggccaacggcgccttctcctcggatgccgatgaaaaggcggtgcgcaccaaagccgcccgccttatgcacaccgccggcagcctcatggccaccgccaaggatttccagcacggcgccaacctctggcgtcgcggacggttggagtaaatcctgctccgggctccctctgatgagagagctgtcacgggcgatgcccgtgactgagggagagactcaccaaccgcaccccaacaatcagctaccggccaacaccaccccttccccggcgcggcgatacccatcgcaagctatacttggtatccgcgtcggaccgtgcttaagccccgggctccattttttgccgccgcgagcggcccttgcgccgacaggcgctttcgcggttcggcgcttctcttcttttagctggcattcctgcacagcacaactaagcagcccatcagcgagagactggggcgtgtgtccatgaccgccgatcgcaggaacgaacaggcccgtccgctatggaccgcatcttgcggttcaggcggacgggccttatgggaggattgggagcgggagatcagttcttggccgccggcgtctcctcgttgatggcctcgacggcctccacggtctgcgcctcatcgtcgacgatctcgccggaagcgagcttggcttcgagctcgtcaacgatctgcgcgtgcatcttctcgtcgatcttgaccttgaaccagaacacgacgaggctgaggatgatgagaacaagcgggatgtagaaggcgaaggtcttgaacgtggtgatgttggacgcggtcatgtcggctgccgtggcatgaccggtcatgccagccgcgagggcaacggcaccgaccacaccgttggacatcgcgccgccgatcttgtcgagcatgggacgcaccgacagggtgaccgcctcgttgcgcttgccgttcttcagctggccgtactcgatggagtcggtcagcgacaggatcgcggtcatctggatgaactgcgcaggcacatagaagaagatcagggcgacgatgacgaccggcaggttgctggagaacagggcgagcatcgtgtagccgatgatcatggagaccatgccgccggcgaacaggtagcgacggggaatccagcggttgagaatcgggtacagcggcgccatgatgaatccggcgatcagcgggatgataccggtgacggagaaggcggccggctcgtcaagcacgaacacgaagaggtagtacatcacaccggtcgtgatgacgtttgcgatggcgtacagcaggtaggacagggcgacccacagcagctggtcgttctggaacagggccttgaacgcctcgaacgggttgccgttcttctgggccttggcgcgcagcgcgttggtgctttccttggtgccgaaggcgacggcccaggcggtgatcaggccgaggagcgcgacgatgaagccgaaggaggtccatccggcctggccctggcccttggcgccggtgaacgtccaggtgaagtagctgacgatcgggatgacgatgacggtgatgccgttgtagccgatggagccggtgaaggtgccgagggcggtgtaggtggaacgttcgtgggagtcggaggacaacgccgggatcatgccccagtaggagatgtcacgcagggagtagaacacgtcaagcacgatgaacgtgatgacgaacagcacgatgaacagcgtggtgttcacgttgaccagtccgaacataccagagaagatgagcatgatcagcacggaggagaccagaccgccgatgaactgccacgggcggaaacggccccacttggtggtggtgttgtccacgaggttgcccagcaacggatcgatgaagatctcggcgatgcggataacaacgatcaggccggtgatgacggcgatcatctgggcggcgagagccttgctgtagctgacgaacaggcagctggtgacgtacgtgacgaagtacgtgctcattgcgttgtagaaggcggcctgccccaagttgccgcatgcgtaggcgatgcgctggccgagcccgcccttcttgcggacgtcgccgaccgcggtattttcgttgctcattagtctcctccttaagaatccagagcatggaactatctctattagataatcacttgccgacaggtgacacaccgccggctccgacctcaaggcccgaaccaacatgggcatgggcctggacatgaccgccgatcgcaggaacgaacaggcccgtccgctatggaccgcatcttgcggttcaggcggacgggccttatgggagggatgggagcgggagatcagttcttgactgtctgcgtctcatcgccgacggctgcggcggcttcggcggcctccacgggctgcgcctcatcgtcgacgatctcgccggaagcgagcttggcttcgagctcgtcaacgatctgcgcgtgcatcttctcggtgatcttgaccttggagacgaacaccaccaggctgagcacgatcaggatgagcggggcatagaacgcgcagatcttgaagacgtggatattcgtcggggtcatatcggcggcggttgcgtcacccgtcatgccggccgcaagggcgatgaagccgacaatgccgttcgacagagcgccaccgatcttatcgagcatcgggcggatggaaagcgtaacggcctcgttgcgcttgccgttcttcagctggccgtactcgatggagtcggtcagggagaggatgaccgtcatcatgatgagcgtgccgggaacgtagaagagcaccagcgcgatgaagaccaggacgatgttgctggagaacagggcgagcatcacataagccacgatcatggagaccatgccgccgatgtacaggtagcggcgcggaatgtacctgttcagaatcgggtacagcggggacatgaccaggcccgcgatcatggcgatgacaccggtcgcggagaaagcggcctgattgtcaaggacgaacttgaacaggaagagaagcacaccggtggtggtcacgttcgcgatggcgtacagcaggtaggacagggcgacccacagcagctggtcgttctggaacacggccttgaacgcctgcaacggaccaccgttgtcttcggcgttggcgcgaagggcgctttggttttccctggtgccgaaggcgacggtccaggcggtcatgatgccgagcaccgcgacgatgatgccgaaagcggtccaacccgactggtgctcggcgttctcgccggtgaacacccagctgaagtaggtgacgaccggaatcacgaggatggtgatggcgttgccgccgatggagccggtgaaggagccgagggcagtgtaggtggaacgctcgtgggagtcggaggacaacgccgggatcatgccccagtaggagatgtcacgcagggagtagaacacgtcaagcacgatgaacgtgatgacgaacacgacgatgaacaatgtggagttaacgttcaccaggccaaacatgccgctgaaaaccacggcaagcagcacggaggagaccagtccgccgaagaactgccacgggcggaaacggccccacttggtgttggtgttgtccaccaggttgcccagcagcggatcgacgaagatctcggcgatgcggatgatcaccacgaggctggtgatgacgccgatcagcttggccgcaagcgccttgtcaacgcccgagaacaggcagctggtgacgtacacgatgaagtacgtgctcatcgcgttgtagaaggcggcctgaccgaggttgccgaacgcgtaggcgatgcgctggcctaacccgcccttcctgcggacgtcaccgtccgcgacattttcgttgctcattaatcttctccttaagaacccagagcatggaatcactcattgattttgtaaagtaagcatacaagttttatcacgggggtgcggatgtttttttggacggtcaggcggccagtccaagacttctgcggtattgcacggggctcatccagtccagtgacttcttgatcctggtttcattgtagtgggtcaggtaggcggccaggcgttcgcggaactcctcgtagcccacgcccctccagtcccgcccgtagaataactcgttcttgagcctgccgaagaacccctcggcggccgcgttgtccgggctgcatcccttggcgctcatcgaccggatcagcccgtgctcctcgcagatgcggatccattcgtcccaccggtagtggcagccgcggtcggaatggatgattggatgttccccgtccctgagcgtggcgaccgcgtcaaggagcatccggttcgccatgtcggcgttcggggagcgcgacaaggtccaggagaccaccatcccgtcgaagcagtcgaccaccggggaaagccagcacttgtacccgtccatggtgaactgggtgacgtccgtgacccacagcatgttcggcgcgtcggcgtggaagtcccgctccacgaggttcgccggggcctcgccgatctcgccggcgtaggagctccaccgcttcggccgcttcaggtacacgggccgcatggccccctcgcgcatgatccgcctgacgaccttctccgagacgacgatcgggtcggactcgtcaaggcgcagcatgcggtggatggtccggtatccccatgcgcgcccaccctgctcgaacaggccggcgacgcgggcccgcagcacggcgtacctgtcgcccgcggcgatcgcgccgcgctcgtaatagtaggtgctgcgtttcagccccacggccttcagacaggccgccaggccgaattcacccctgatcgcgtcgacgacccgcgtcctctccctgttcgtcagcatggacgggtcgaggcgcgggtcgtcggcttttaaaacatcgatcgtctcccgcatcaccgcgttctccagccgcaggacctccacctgccggcgcagctcctccacgtcatcgccggccgcgggcatcggttcggccggcatcggcgcgtttctcctgtccatcagtcccagtatcccctcgctccggtagcggcgcatccactggtacacgctcgtcggcgtgcaacccgcgtcgcgcgccacgcgggcgaggggctcgccctcgagcgcgcgtctggccgcattcgtcttgcattccagcgtatacgaacgcctgcacgcgcccgtgtaacgcgggtcctcgcgaacccatttcaccagcgcgccctcggacgggtaaccaagctcggcaatgaccttcctgatggtcatgccctccgtgaaatacaggtcaacggccctgcgccgatcctccatcgaaaacatgcggactccaatccggacgcccaagcgtccaactttccgtccgcatcccccaccgaaagtaaaaaacattagtaaacggagataaacagcgtgtcgcaaggatgggataacatgagctgaaccgagacattgcatggacgcggcgcagcgtcgacggcaagcagtgccaatgatttggaagcggtaaacgtgatttgcgttttatataaacactgtttatccttttcggtaaaggaggccccggcctcttccataatatcattcacaacgaggtaatgacagaaagcaggagaacatgacagacgtcacacatgtcgatcgcgcatcgcaggcttggctgaccgacccgacggtgttcgaggtgaaccggactccggcccattccagccacaagtggtacgcccgtgacccccagagcggacaatggtccgatctcaagcagagccttgacggcgagtggcgggtcgaagtcgttcaggccgccgacatcaacctcgaagaggaacccgcgacggccgagtcgttcgacgactcctcgttcgagcgtatccaggttccgggccacctgcagacggccggtctgatgaaccacaagtacgtgaacgtccagtatccgtgggacggccacgagaacccgttggaaccgaacatcccggaaaacaatcacgtcgcgctctaccgcaggaagttcaccgtctccgcccccgtggcaaacgccaagcaggccggcggatcggtgtcgatcgtgttccacggcatggccacggcgatctacgtgtgggtcaacggcgcgttcgtcggctatggcgaggatggcttcacgcccaacgagttcgacatcaccgggctgctgcacgatggggagaacgtcgtggccgtcgcctgctacgaatactccagcgcctcctggcttgaggatcaggacttctggcgcctgcacggcctgttccgctccgtcgaactcgccgcccgcccgcacgtgcacatcgagaacacgcagatcgaagccgattgggatcccgaggccggcaccgcctccctcgatgccgcgctgaccgtgctcaacgcgaccgacgcggccacggtccgcgcgaccctgaaggacgccgacggcaacacggtgtggcagacgacgggcgacgcggaggcgcagaccgcgctctccagcggaccgctgcagggcatcgaaccatggagcgccgaaagcccgacgctgtacgagcttgacgtcgacgtcatcgaccaggcgggcgacgtcatcgaatgcacgtcccagaaggtcggtttccgccgcttccgcatcgaggacggcatcctgaccatcaacggcaagcgcatcgtgttcaagggcgccgaccgccacgagttcgacgccgaacgcggccgcgccatcaccgagcaggacatgatcgatgacgtggtcttctgcaagcgccacaacatcaactccatccgaacctcgcactacccgaaccaggaacgctggtacgaactgtgcgacgagtacggcatctacctgatcgacgagaccaacctcgaagcccacggcagctggtccctgcccggagacgtcctcaccgaggacaccatcgtgccgggcagcaagcgcgaatgggaaggcgcctgcgtcgaccgcgtcaacagcatgatgcgtcgtgactacaaccacccgagcgtgctgatctggtcgctgggcaacgaatcctacgtgggcgacgtgttccgcgccatgtacaagcacgtgcacgacatcgacccgaaccgtccggtgcattacgagggcgtgacccacaaccgtgactacgatgacgtcaccgacatcgagacccgcatgtactcgcatgccgacgaaatcgagaagtacctgaaggacgacccgaagaagccgtacctctcctgcgaatacatgcacgccatgggcaactccgtgggcaacatggacgaatacacggcgctcgaacgctacccgaagtatcagggcggcttcatctgggacttcatcgaccaggccatctacgccacccagcccgacggcaccaggagcctgcgctacggcggagacttcggcgaccgtccgtccgactacgagttctccggcgacggcctgctgttcgccgaccgcaagccttcccccaaggcccaggaagtcaagcagctgtactcgaacgtccacatcgacgtgacgaaggattcggtgtccgtcaagaacgacaacctgttcaccgccaccggcgactacgtgttcgtcctgagcgttctcgccgacggcaagccggtctggcagtccacccggcgtttcgacgtgcccgccggtgagacccgcacgttcgatgtcgcatggccggtggcggcgtaccgcgccgacgcccgcgaactggtgctgcaggtttcgcagcgtctcgccaaggcgaccgattgggccgagagcggctacgagctcgccttcggacaggcggtggtgcccgcggacgccaccgcgacgcccgacacgaagccggccgatgggaccatcaccgtgggccgttggaacgccggcgtgcgaggcgccggacgcgaggtcctgctgtcgcgcacccagggcggcatggtctcctacaccttcgccggcaacgagttcgtgctgcgccgtcccgcaatcaccaccttccgtccgctgaccgacaacgatcgcggcgctggtcatggcttcgagcgcgtccagtggctgggcgccggccgctacgcccgctgcgtggacaacgtgctcgagcagatcgacgacagcacgctcaagggcacgtacacgtatgagctcgccaccgcgcagcgcaccaaggtgaccgtctcctacacggcccacaccgatggccgcgtgaacctgcacgtcgaataccccggagagcagggcgacctgcccaccatcccggcgttcggcatcgaatggacgctgcctgtgcagtacacgaacctgaggttcttcggcaccggcccggaggagacgtacctggaccgcaaacacgccaagctcggcgtgtggaacaccaacgccttcgccgatcatgcgccgtacctcatgccgcaggagacgggcaaccatgaggatgtgcgttgggccgagattaccgacgatcacggccacggcatgcgcgtcagccgcgccgatggcgccgcgccgttcgcggtaagcctgttgccgtactccagcttcatgcttgaggaggcccagcaccaggacgagctgccgaagccgaagcacatgttcctgcgcgtccttgccgcacagatgggcgtcggcggcgatgattcctggatgtcgccggtgcacccccagtaccatatcccggcggacaagccgatcagcctcgacgtcgatctcgagctgatctgatcagaattgatccgatagtccaccgcgcaaacgatgtggcccccacctcctcacaggaggtgggggccacatcgtttgcgcggtcctcgtcagtccagcggatgcgccgcggggacgaagccgtcttggacggccaccttggtcagctcatccgtgccgatatggttttggatgatctacctgcggacaagccccttgaacggctcgtcgggagacagtcggacctgcgtcgcgtcggtgccatcgacgatcagggtgatcgtcgcgggcttcgtgcagcgcagcgtgtattcgatggcgtcgtccgtccaggaggcgtccaccgaaaggcctcccctggcgcgcaggccatggaagctgccttcatgccaatcctcgggcaacgcgggcaggatgcgcaccatgccgtcatgactctggacgagcatctccgccagagccgcggggaagcccagattgccgtcgatctggaatgggggatgcgcgcacatgccgctggcatacacgccgccgccaagcagatcggtttcggcgtcggcttcgaccgggcggaggaacatgccgatgatgcgttcggcgtgctcagcgtcccgcagacgcgcccacatgatcatgcgccacacgatgctccagccggaaccgtcgtcgccacgcacttcgagggacttcctggcggcctcctccagacgcggggtgttcgcggtgatgcctgcgcccggatgcagttcgtacaggtgggacaggtgacggtgatgcggatccgcctcgacgagttcatcgttccattcgagaatcctgccatcggatcccacgcggacagccgccagcttcgcgcgggtggattccgcctcccgcaccaaggccttgtcgccgtcatccaggtcgggcatggtttgcgccgcgtggatcagatcatcgagcagattgcgcacgatggccgtggtgttttcgctggtgtgggcgacggcgatcgtttcgccgtccacgacgaagtagttttccggcgatgtcgccggagccggggccagaccgtgttccgtatccgacagaaaatccatgcagaatcgcgcgctgtcccgcatgatcggccagatggaagccagatacgactcatcctggttgaacaggtactcatcgaacaggttccggcacatccacgcctggccgaacggccagaacgcccacgtcggctctccgttcgccggcagcgccctgcgccagatatcgacattgtggaagaccgcggaaccaccgcatccgaggatggcgccggccgcatcatgccccggttccagcagctccctgttcatggcgacgagcggttcgatgagctccttgagggcgcatgggccggtcatccaatagttcatctcgatgttgatgttcgtcgtgtaggcgctataccagttcgggaagtccttatggttccagattccctgcagattcgacggctgggtatgcggcctggacgaggagatcagcaggtatcggccgaaatcgaacatcgcctcggagagcgtctccagacggtgcggcgtatcctccttggagcgcaggatctcggcgaacggcacctcctcatcgtcgtcatgggccgggccgagacgcacgccgacccggtcgaagaaccggcggtagtcggcgacgtgacggtcaagcatcgcccgcgaatcggacggccatgcggcgatggtctcgcccagccgatcggcgagcaccgtcatgtcccgctccggctgttcggcgcttcccttgaacccgctcaggctgcggaaccgaagcgacaagccggtgacgcccgagcactgcagaacatcatcgatcaccgtgatctcgccgcccgtgacggtgagggagaaggcgccggcatacgccatcccgatgccgtcccgttcgtcctcccatggattatcggtgacatgggccaatgatccgacattgagtccgggcatctgccccatgacgacgagggtggcctggcgcgcatcggaatcagaccccgacgatatccgggtctgcttgagaaaagtgccggtgacgctcacgctcgcatcgaccggcgcgctcgacgacatctcatacaccagcagatcatcgggagcgctgcaccatgcgtcgacatggacgtcggcggcgcccagccggaacgattcgccggcgagggccctggcgaggtccaggctgcgcttcacatgcttccgttcgccggcctccgacgagtaccggatgcaagccgtgccgaacggctcgtatatctgctcgtccttctcccgctgcgtggcgtcctggatgatccgcgtggccgacacgtaatcgccgcgagacgacgcctgacgggctttggccacgatttcgggcgtcaacggcgaggtctccgcatgcggatagcccgaccagagggtgtcgtcgttgaggtacagcacatccgcgtccggttcggagcacaggaccgcccccatgcgaccgttgccgaacgggattccttcctcccaatgcgaagaaatcccatcgaaagtgagtttcatggtgttaccgcctttatattcctatacgccctcagatgcgcacggcagccgcgcggctgatcatcggcgcaagcctcgaaccgtccacgtgaagggtgaccgaggacacctcgacatcgtcgaagcggagtatcctccggtaacccaccgtgccggcctggccgagcacgcgctcggtgccgtcaggcagcgcacccgtgacgcgcagatgctcgatgcgctgaccgtgctctatggcctcctcgatcacgatggcgttgatcgtcgtgggctgcgggagggtgagcgtgatggcgggggccgcatcgtcggcatccgggcgccagaacgtgtcccgattcccgtcgacgagatgcgccgcggcggcggatgcgctgctggtcctggcttcgcagcggaccgaggccagcgcttcacggaactcgctgacgcggcggcccaatcccttgagcgactgcacatccggttcggcgagcagaccttccggcgagggaggaatgttgagcagcaacgatgaattgccgcctaccgcggaaagccagaggtcgaacagctgatcggcgctcatgaccttgtcgtcctcggactggtggtagaaccacccggggcggatggaggtgtcgacctcggccgggtaccagcagacgttgtccccgtatccggcgaccgcctcacggctgccgaggtcgtcgtcctgggagctgaccgtggtggcgaaggatgcgtcatcctcctgctgcgacttctccatggtcagttccgccgaacgcaggcggcggggcacgacgctccattcgttgtcgcgcacatgcccggcttcgttcccggcccagcgcacgtcggggccgcacacggaaatcaccgcatcgggctggagcgaacggatgacgttgtagtaacgatcccagtcgtagtactgggtcttgccgttcttgccctcgccattggcgccatcaagccagacggagaagatcggcccgtactgggtgagcagctcggtcagctggccgacgtagaagtcgtcgtacgccttgcccttgccgtaggattcctcggtgcggtcccacggggacaggtacacgccgaacttcagtccgtgacgcctggcggactcgctgacctcacgaacgaggtcgcccttgccttcacgccacggcgacgaggcgacggtgtgccgcgtcaatcgggacggccacaggcagaatccgtcgtggtgcttgcacgtcaggatgacgccggccatcccgccggccaccagcgcgtccatccactggtccacgtccacgttccgcgggttgaacagtgccggatcctcatgcccaagaccccactccctgtccgtcatggtgttcatgccgaagtgcaggaaggcgtacatctccatgcgctgccaggcaagctggcgcgacgatgggcgcacattcgcgagatagttcaggttgatgcccgcatctgcaggattgttcattatattgctcctattcggttattagcgaatgacgccttttctgatgatgatgttcgcatactgcgattgttcgccggtggcgacgatgcaataggacctgccggcctcctcgtagaaggcgaaccgttccagcatcccgatgcccgcttgcttgccgggctcgtgcctgtcgatgacctgacggtaccggtcccatatcggggtgtccacggtgtctccgggaaccttgtccatcagcagcaccgggtgttccgtgtattggtccagcggtatcagctgcagcaccgcgtcgagcagcggctcgatgggctggccgtcatacctgatcacgtgggatcggacgcccaccgattcggcgggaaagtgggcgtccgcaaggactatggcatcgccgtggcccatctcgctgagtatcttcagcagatcgggctgtatgatcggcggtattcccttcagcatcgttcctccctgtccgtcttcgggactattcgaccgtcacttgtccaggatggcgcggatggtgcgatactgctcgtcggtcagctgcacggcgggctcgtggacggacgtgtcgatgggtagtcccttggccttgaccgcgcccttgatggcgctgatgaacaggtcggcggtgtcgtacaggcgcatcaggtaggagacgcgctcggccgcttcgacgaccgcggcgtggtcgccggcctcccatgcgcggtgcagtttgacgaacgtctcgggttccacgttggtcagaccactcagcacgccgttgccgccgctgatccggttgacgatgtagtattcgtcgaatccggacagcacgctgaacgacgggttcaccttgcggacggccgcgatgaccttcctggtgtgactgatggtgtcgacggtgtctttgatgccgacgatgttcgggttctcgccggcgagttcggccaccagctcgggcgtgaggtcgttgcccgttcgggccgggaagttgtacaggatgacgggcagggtcgtcgccttggccaccgccgagaagtaccgtttcgcgcaatccggggacgggccgaaatagtacggggacacggcgagcagcgcgtcgactccggccgcttcgctttccgccgccaacgccttcacgttgtccaggttggtgtctcccacgccgacgagcaccttcatgcgtccggcgaccttcgagacggcgaagcgagccgcttccgccttcgtcttgacgtcgatggcgtagaattcgccgatgctgccgaacagcagcacgccgtcgacgcctgcgtcgacgaggtggtcgaggtgcttgccccagttgtcgtaatctatggttccgtccgcgttcatgatggtgatggaggggcagaacacgccttcgaacatggcgttgctggtcatgatattttcctttcgacgatatggtggtcgttgcgcttgcggcggcgaagaaatccgcgggccgagcggtgttgaagcgatgaatcgaaaacaggggatccggacgcgcgaacgcgaaccgatgatcccctgtgcggcatctcctagccgagtgcccgatcgaggtggacgtatccgccgtcggggaagacccattgtccggtggtgtgcgacgacctgtcggacagcaggaacgccacggtgtcggcgatctccgacgtctcggtcatgcggtggccgagcgggatcttgctggtgatcttctcaagctgcgcgcgctgcgcctgctcgtcgccgaacgtcttgatccactgtgcgtacagcggtgtccaggcctcggccacgacgacggcgttgacccggacctcgtccggggcgagggcggcggcccattcgcgggtcagtcccagaatcgcgcccttcgcggcggcgtaggcgctggtcttgccctgaccggtcaatgcggtcttggaaccgatattgaccaccgagcccttgctggccttgagcgccggcacgcactgatggaccagctcgtagtagtgggtcaggttgccgtgaatcgactcctcgaactgacgccacgatgtggtctcgagcgcgagattgtcgttccttccggcgttgttgaccacgccatcgatatggccgtgcttctccatgaccgacttgacgatgggggcgatgtcgtcggtgttgttcaggtcgatcagatacgtgtcatacgagtcggtgattcgttcaatgtcctgtcggaattcgtcgccggcaccgtcatcacggttcagcaccacaggaatggcgccctcctcggccaagcgcagcgttatgcccttgccgatgcctttgaagcctccggtgacaatgatcaccttgtctttaagatgcaggtccatctcaggtcctcccgaccggtcagtccttgtgcaggtacttcatgcattcgtcgatcttcatctccgtgccgttgcccggagtgagcggagcgacgtatcgtccgttcttgatgacggtcggatgcacgaagtattcatgctggttgtccacgtattcgacgacgcggtcctccatctcgccggagacggacacatagtcgaacatcgcgagctggctgacggcttcgcacaggccgacgccgcccgcgtgagggcagaccttgacgccgaacttcttggcgagcaggtattcgaggacgatctcctggggaccggcgactcgggtggcgtcgatctgcatgaccttgaagctgccggcctgcaggtactgcttgtacatgactcggttctgcatctgttcgccggtggccaccggaatggggtcgatggccttctgaatcgcggcatggccgagcacatcgtccgggcaggtgggctcttcgacccatgcgaggtcgtagtccttgaatttgccaatccattcgatggcctgcggcacgtcccagacctggttggcgtcgacggcgatggcgatgtccgggccgaccgcttcacgggcgagcttcagcctgcgcaggtcgtcctcgaggttctggccgaccttgagcttgatctgcttgaagcccatgacctcggtctcctgcttggccaggcggaccatcttctcgtcggaatagccaagccatccggcggcggtcgaatatcccggataaccgacttccttgaggtgggcgatacgctccgccttgccttcctgggcggcgcgcaggatatcgatggcctcctgcgcagtgagggcgtcggtcaggtaacggaagtcaagcgtcgcgacgagctcttcaggctccatctcggaaaggagcagccagagcggcttgccggcgcgcttggccttgaggtcccacagggccgaaagcacggcgccgatggccatgtgctcgacgcccttctcagggccgagccagcgcagctgcgaatcgcgcacgaacagatcccatgcgagacgcatgttgtcgagcagttcctcgacgttacgaccgataagggtctcggacatggagtcgatggcccggacgacgacatcgttgccacgaccgatggtgaagacgaatccattgccggaatcaccggcatcggtggagacgacgacgtaggcggaggagtaatccggatcggggttcatggcatcggagcccgagaacgtggccgatgtcgggaaccggaaatcatacgtggtgactttggtgataacgctcacagtgcgcttccttccttggaatattcatatcgtttgaaatagatgacagacaatcaggttgccatcaggtatcgccaagcggaatcagtttattaatactgaaagacaacggggaatgaatctggcgacgtcgaatccgtcgtccttgcctcatcgtttcttctccaacggctcaatcacccgcacgtccatgcccggcattttgccccacgaatacacggccaccatggtgaagaagatcggcaccgccggcccgaacgccatcatcagaccgggccacgtgtagtaggaccacaccgtggcgaggaaaagagccagcacaatgaagctgcacaacgggcgtgcgaccaccatgaccagcgacgtgcgcaccgtccatagcagattctcattgaaattgatgtgcacggaccagctgaggaacacgaacaggccgtacagcacgttgagcaccaacagcacgccggatacggcggtccccacatagcccaggtcgttgttctgcacgaaccagtattcccagatgagcagcagccagatgatcgtctgcggccaccccagctgattcgccgcgccgatctcctccagccatgcctgatggaacgtcgtccatgtacgtttgatggtccaggagcgatcttcgacgtcgagcagccactggcggaacaccgaatacgacgcggccacggagggaaacagcccgcccaagacaaagccaagcagcgtgtgcagcacgaaggcgacattcaccacagccaccatcatgatgatccggcagatgaactcataccccacagccagacgcttcataatgcccctacctccttcatgcgggaagccgcatggatcgctacaaaacaattggcggcatccactctcatggagccgccaatggcatacacgtcacgggcgggtttcgttgtgtgtcgtgcaacgaaaccccgacgatcagcccttcacggcaccgatcatcacgcccttgttgaaatacttctgcaggaacggatacaacaccagcaacggcaacgtcgacacgatgatcacgccgtacttgatctggttcgcgaaatcacgctgctgcaccacgtccatgccacccgaactctgaccggtgatgttcgtctggttcgacaacaggatggaacgcaacacgttctgcaacggcagcttgtccgcgtcgcggatgtacaccaagccagtgaagaagtcgttccaatgacccacgaagtaatacaacgtcatcaccgccaggatcgcggagctcaacggcagcacgatccgcaggaaatacccgaaataccccaggccgtcgatctgcgcggcgtcatgcaggctctccgggatcgagctctcgaagaacgaacgcgccacgatcaggttccacacgctcaccgcgcccggaaggatgaacacccacaccgagttcagcagacccagctgcttgtacagcaggaagctcgggatcatgccgcccgagaagaacatcgtgaacgtcatcaggaacaggatcacgcggcgcggcttgaactcgcggcgagacaacgcgaacgccgccgggatcgtgaccagcatgttcagggccgtgcccgccaccgaatagaagatggtgttgcggtagccgacccagatcctcgaatcggtgaacaccttggcgtaaccgccgaagttcatcttcgcgggcaacaggaacaccttgccctggctgaccatcgtctggtccgagaccgaggcgatcacgatgaaccagatcggatagacgatcgccaccacgaccaacgcgatcaacagccagatcacgatgtcgacgacccagtcggacacgctcctcctctgcctcagcttcgggttgaacgggatgtcgtccgaccccgcgccgcggaccggcgccggattgatggatgtgcttgtcataatggaccctcccgcccgctagaagatgctggtgtccgacgccctcttcgaaatgaagttggcgagcaccaggaagaagaagttgaccacggtgttgaacaggcctatggccgtcgtgtagctgaactggttgcccagaatacccatgcggtacgtgtacgtcgcgatgacctccgacacggacaggttcatcgggttctgcatcaacagcaccttctcgaagcccacgttgagcacggaacccatgttcatgatcagcatgatgcccaccgtcggcatgatcgccgggatgtcgacgtagcggatgagctgcagacgaccggccccgtcgatcttcgcggcctcgtacagggacaggtccaccgaactcaacgccgccagatagatgatgcagttccaacccatgtgctgccacacctcgctgatccagtagatcggcgtgaacagccccggctcgcccaacaggtcggtgcccgggaacaggcgcccgatcatgcccgtgctcggcgacaggaagatgttgatcatcgacacgatcacgaccgtcgagatgaagtgcggcatgtacgtcaccgtctgcacgaaccccttgatcttcgacgacgagatctggttgatcagcaacgccagcacgatcggggcgatgaaccccatgaccagcgtccacaggctgatccgcaacgtgttgaccatgatgttcacgaacatgcccgaccggaagaactgctcgaaataccgcagccccgcgaacctgccgcccatcagaccctcgaccggatcgaaatcatagaacgcgagacgaagaccgtacatcggcacgtacgcgaacagaccgacgaacaccaacgccggcaacgtcatcagccacaacgcgccgtaccgacggaaatgacgccccaaccgcaccggcaacggcgcggaacgagccgccaacgcgttatccaccacttcaccctgcttcaccacagacataaaaatccttcccacgtccgccccgcccgccacgcgaacgcgcgacggacgggacgacccgctcatgcaacggcggaaccgctacatcacttcttcgtgtagatgtcgtaccacttctgccagatcttcacgttctcctgcagaccaaggctgtcgagctgcttgcaatacgcatcccactcctcgtcaataccacccttggacatccaagtagcagtcttctgcatggcgacgttggaaatctggttgtagttgctggccaacgtggtgttgtcgtccgcgtccgggttcacgtagtccggaatgtagtccttgacgggatcgaagttgctgcgctgcttctcatacaccttgctcgcctggtacagggcgtcgctaccggcatcgcccttgatggtgacctcgtcgggaatccagccggcggggtaggacaggctcggggaggtgttcttcttgcgcatctcgataagcttgtcgttgtccacggtgtattcgtgctcaccggtcttggtcacggtcttgccgaaggagccgtagaactgctgcacggagtacttctcggagtacatcaggttgagcagcttcaacgtggcgtccttgttggcggcgcgcgcggagacggcggggccggcggcgtcgaattcgctcgaggagccgtcccacacggtctggtccggcgagacgcccggggcggacggcaccgggatggtgatgtactggtccttcagatcgccgaaggtatcggagatggagctgctgaacaccacgccggtcttcgcggtcttgccgtcgctggtttggtccgcattgtaggcgtcatcgtccttggtggcccagtcggcggggatcaggccctcggagatgagcttgtggtagtacttgatgacctgcttgtattcgtcggaggtcatgaagctcttgaccacgccgttcttggcgtagaagccgtatgtggacacgcccttgttgaagccggtcgggatgccggtggagttgagcagcagcatcgggctgtgccaggtgtagtacaacgggtcgagcttcttgatgttcatcgggatctcgtcggcctggccgttgccgttcggatcctgggtcttgaacgccttgagcacgttctccagctcgtcccacgtggtcggcacctgcagacccagcttgtcaagccaggccttgttgatcatcatgagctggccagtgccggcattgttcttgccgtgggcattggggagcgtgtacaggtggcccttggaatcggtattgagcttctgcgcgtccggcttctccttgaagaacgccttgacgttcggcagcttgtcgagatcctggttcagatcctcgaacaggttggagaactgctccgcgtacacgaagctgaaggcatggaggctgatgtccggaatgtcgccggcgctcagcgtggtattgcgctgattcgcgaaatctccgttatcgacttcctgccattcgatcttgcagtcgcagtcggcctcgaggtccttggcccactgcatgttggcgatcttgtcctgattgggttccttcgcaaccaggacgctcacgatcggcttgccgtcggcggtcgtggtcggcttcttgtcgccgccgcatgcggccagcgaacccagcaaggcaacggcgcacacagcagagcccaccctcatcgcggttcttctcatcattctccctttctgcagaatgaaaacactataagcgtccatcacaactgtgagacgaacatacagtaatatatgcctcttcgcagcattttgtcaacatgcctaacaatatgtggcaccacgacgggcgaccggggaagcgcgcgacggccgaatgaacaaaggggtttcgttgtgtgtcgtgcaacgaaacccccgacgatcagcccttcacggcaccgatcatcacgcccttgttgaaatacttctgcaggaacggatacaacaccagcaacggcaacgtcgacacgatgatcacgccgtacttgatctggttcgcgaaatcacgctgctgcaccacgtccatgccacccgaactctgaccggtgatgttcgtctggttcgacaacaggatggaacgcaacacgttctgcaacggcagcttgtccgcgtcgcggatgtacaccaagccagtgaagaagtcgttccaatgacccacgaagtaatacaacgtcatcaccgccaggatcgcggagctcaacggcagcacgatccgcaggaaatacccgaaataccccaggccgtcgatctgcgcggcgtcatgcaggctctccgggatcgagctctcgaagaacgaacgcgccacgatcaggttccacacgctcaccgcgcccggaaggatgaacacccacaccgagttcagcagacccagctgcttgtacagcaggaagctcgggatcatgccgcccgagaagaacatcgtgaacgtcatcaggaacaggatcacgcggcgcggcttgaactcgcggcgagacaacgcgaacgccgccgggatcgtgaccagcatgttcagggccgtgcccgccaccgaatagaagatggtgttgcggtagccgacccagatcctcgaatcggtgaacaccttggcgtaaccgccgaagttcatcttcgcgggcaacaggaacaccttgccctggctgaccatcgtctggtccgagaccgaggcgatcacgatgaaccagatcggatagacgatcgccaccacgaccaacgcgatcaacagccagatcacgatgtcgacgacccagtcggacacgctcctcctctgcctcagcttcgggttgaacgggatgtcgtccgaccccgcgccgcggaccggcgccggattgatggatgtgcttgtcataatggaccctcccgcccgctagaagatgctggtgtccgacgccctcttcgaaatgaagttggcgagcaccaggaagaagaagttgaccacggtgttgaacaggcctatggccgtcgtgtagctgaactggttgcccagaatacccatgcggtacgtgtacgtcgcgatgacctccgacacggacaggttcatcgggttctgcatcaacagcaccttctcgaagcccacgttgagcacggaacccatgttcatgatcagcatgatgcccaccgtcggcatgatcgccgggatgtcgacgtagcggatgagctgcagacgaccggccccgtcgatcttcgcggcctcgtacagggacaggtccaccgaactcaacgccgccagatagatgatgcagttccaacccatgtgctgccacacctcgctgatccagtagatcggcgtgaacagccccggctcgcccaacaggtcggtgcccgggaacaggcgcccgatcatgcccgtgctcggcgacaggaagatgttgatcatcgacacgatcacgaccgtcgagatgaagtgcggcatgtacgtcaccgtctgcacgaaccccttgatcttcgacgacgagatctggttgatcagcaacgccagcacgatcggggcgatgaaccccatgaccagcgtccacaggctgatccgcaacgtgttgaccatgatgttcacgaacatgcccgaccggaagaactgctcgaaataccgcagccccgcgaacctgccgcccatcagaccctcgaccggatcgaaatcatagaacgcgagacgaagaccgtacatcggcacgtacgcgaacagaccgacgaacaccaacgccggcaacgtcatcagccacaacgcgccgtaccgacggaaatgacgccccaaccgcaccggcaacggcgcggaacgagccgccaacgcgttatccaccacttcaccctgcttcaccacagacataaaaatccttcccacgtccgccccgcccgccacgcgaacgcgcgacggacgggacgacccgctcatgcaacggcggaaccgctacatcacttcttcgtgtagatgtcgtaccacttctgccagatcttcacgttctcctgcagaccaaggctgtcgagctgcttgcaatacgcatcccactcctcgtcaataccacccttggacatccaagtagcagtcttctgcataacaacattggaaatctgtgcattgttattggtcagtgtattactgtccgtcggatcggggttcacgtagtccggaatgtagtccttgacgggatcgaagtggctgcgctgctcctcgtacggcttgttcgcctcaagcaggttgtcgccgtcgacatcacccttgatggtgacgccatcgggaatccagccggagaaacgatcggccaagcccgggaagaggttgtcgcccatcgccttggtgtacttgtcttcgtccacggtgtagtggcggttgccgtcatcggtgaccaggttgccgaaggagccgaggaactgctgcacggagtacttctcggagtagagcaggttggccagcttcagcgcggcgtccttgttcgcggcgtgggaggacagggagaacctatcggcttcgaactcggcggaagagccgtcccacacggtcttgtccggggagacgcccggggcggacggcaccgggatggggatgtactgatccttgagtgttccgaagctcgcatcctgggaccatccgaacgacacgccggtcttcgcggtcttgccgtcgctgagctggtcggtatcgcacgcatcgaacgtcttggtggcccagtcggcggggatcaggccctcggagatgagcttgtggtagtacttgatgacctgcttgtattcgtcggaggtcaggaagctcttgaccacgccgttcttggcgtagaagccggtcggggacgcgcccttgttgaagccggtgacgatgccggtggagttgagcagcagcatcgggctgtagtaggtgaagtagctgtcgagcttcctgatgttcatcgggatctcgtcggcctggccgttgccgttcgggtcctcggtcttgaacgccttgagcacgttctccagctcgtcccacgtggtcggcacctgcagacccagcttgtcaagccaggtcttgttgatgaacatgtgctggcccgtgccggagtaggacttgcctcgggacgaaggcagggcgtacatgtggccttcgggatcggtggtgagtttctgcgcgtccggcttctccttgaagaactgcttgacgttcggcatcttgtcgagatccttgctcagatcttcgaacaggcccgggaactgcgcggcgttggcggggaagaacgcatggaggctgacgtccgcaatcttgcccgcggccagggtggcgttcttctgctgggcccaggcgtcctcgctgacctcctgccactcgatcttgcagtcgcagtcggcctcgaggtccttggcccactgcatgttggcaatcttgtccgtggccggcctcttcacgaccagaacgctcacgatcggcttgccgtcggcggtcgtggtcggctccttgctgccgccgcatgcagccagcgaacccagcaaggcgacggcgcacgtgatggcgcccgccttcagtgcggttcttcttctcattgtctctcctttgaaattatgatcctggatgcgcccgccacgtctgcgaggtggacgcacctaggataagtctcgggagatattttgtcaacgtccttaacatatatgaaatatcggcaccgtttcgctatgcctcagcaccctccctcaccagacagcggaaaaccgccgattccgtcgacgttcagctggccgttgagccagtcgagcgagatacgggtgtacataatgttattattatcaccttcatacagcaggccatagccgccgccggccttgtggctcaatgcggcgatcaccgaatacgccatcggccctgtcgtgaaccgtcggccggcactccaggtcttgccgtcatcgatcgagacgcgcaccagaccatcgatcctgtccgaaggcgacgaggaggaatacagcagaaccttggcctgcgccgacccctcgggggcatcggggaacgcacgggcaatctgcgcgttgttctcgggatcgggcagctgcgtttcacggatcaccggaccatacgtggcgccaccgtcccgggagatggcgacatagcggcaaccgtttccatcggaggaacgcgagttcagcatcacacggccatcggaaagttccacgactttgttctcgtccatgtgatcgccgacgggggtgcctgcatgccaggttgcaccgtgatcgtcggagaagaccgataccgcacggtagcggccgtcgagctccttgatggtgtactgctggatcaggcgccccgcatgctcgccatacgtgagctggatgccggcaccggaagaagcgaaccgtgaaatccatgattcgctgttcgtgatgtcggcggtgatgatgcgcggctcgctccacgtcacgccattgtcgatggaactggtgacggcggcttgaagcacctcacgcgcagagggatcgacgcccgcctgggaggttccgaaaccggcgtcataggatttgacgaagaacaggaacacctctcccgtctgccggtccaccacataggacggatcggaatacccgtatttgtcgacgccatcatgcccggcggccacaacatgctgcggctcgaatgaccggccgccgtctttggagatacgctgcacgatcgaattggcttgcggggcatcctggcagttatggggccgcgcgtcgaacgccgcgaggatccagccgttgggcgcctcggcaagggccggaatccggtagcaggccacaccgtaatcgcctggggccgccagactcatcgctccgtcatggttcgcgccgcacacagtattgttcgtattcatcatcccgttctccgtcatattcgctcactcctgttcatcaccttgatgccgcccggcgtccacgggcaatctccgttcacggccaaacggcaccccggcgcattccgcaacattgcggtgtgccatcccgcggacctacatgggttgggggaaggagaaggtccgcgggatggcacgtcatcatcactcggtggacacatcgacctgttccaccgtgcgcgcaagctcgaaaccgcatgcacgcaacacgtccgcaatggctttcacattgtcgccatgcaacgccaacaccggttcgggcatctggttggtgtcgaacacgcccagcaacgccatcgcggtcttgaacgcgcccacgccggaaccgaatccctggacgccggacggcgccaggacgattcgcatcaatgcggcgagtttgttctgctccttgcgcaccgaatcccaatcaccgttccggtaggcgttccacatcgcaacatagccatatggatccacattggccaagcctggcacgctgccgtccgcgccggccatgtacgcgccatcgacgacgacttcctgaccggtcagcaacgtcagcggatgaccgttctcctcgttgtccccaatcaggaaacggaacgccacatcatcgttcgacgagtccttcaccccggccagcacgccatcacgccccaagcggatcagcagatcattgggcagcttggtatgcacgcatacggggatatcgtatgcgaacagcggcaattcaggcaccgcggcgtgaatcagacggaaatgcctctcgatctccgccacgccgcccaatgcgtagaacggcgccgtggccacgatggcggcggctcccatctcacgagccgcgcgagcatgctcgatcacacgattggtctccgtgtcgatgcaccccgccagcaccggcactcggccgccggcaatctcaatggccgcggccagtatctcacgacgtcgctcatccgtggagaacacgacttcgcttgaggatccgagaacgaaaagtccattgaccccggccgcaatcatacggtcgatcgaacgccggtaactctccacatcgagacgatgatccgcggtcaatggagtgacgaccgggggaatgaccccacgaaactgattcatagtgtgaatctccttgttgtatttgtgtctgtctggtacgcgagacaacaccgcatccgctccgcatgagcgaaccgcacccggtcgttgatccgaattcctccagttcagcaattcgggtgcggctcacatctcggagtcgcaagcactgcctcgcaacagatctgcgctcacgacaccatcacttcgtgtaggtgtcgtaccacttctgccagatcttcacgttctcctgcagaccaaggctgtcgagctgcttgcagtacgcatcccactccccgtcaataccacccttggacatccaagtggcagtcttctgcataacaacgttgagaatctgggtattattgctactcagcttgttattgtcttcggggctggggttcacatagtccggaatgtagtccttgacgggatcgaagtggctgcgctgctcatcatatgctttattcacctcaagcaaatcatcagcattggtatcgcccttaatggagacttcgtcgggaatccaacccgtaaaccgatcagacagaccagggaagaggttgtctttcatcagctgactggtcttctctgcatccacggtgtattgatgattgccgttatcagtaaccagctgtccaaacgagccaaggaactgctgcacggagtacttctcggagtagagcaggttggccagcttcagcgcagcgtccttgttcgcaacatgcgatgagatggaaagtttgttgccgtcaaattcgctggacgagccatcccacacggtctggtccggggagacgcccggggcggacggcaccggcatagcgatgtattgatccttgagcgttccgaaactcgcgtccagcgaccacccgaacgacacgccggtcttcgcggtcttgccatcactggtctgatccgaatcatacgcgtcgagagccttggtggcccagtcggcggggatcaggccctcggagatgagcttgtggtagtacttgatgacctgcttgtattcgtcggaggtcaggaagcttttgaccacgccgttatccgcataatagccggtaaccgtcggccccttgttgaaaccagtgacgatgccggtggagttgagcagcaacatcgggctataccaagagaagtagctgtcgagcttcttgatgttcatcgggatctcgtcggcctggccgttgccgttcgggtcctgggtcttgaacgccttgagcacgttctccagctcgtcccacgtggtcggcacctgcagacccagcttgtcgagccaggccttgttgatcagcatattctgaccagatccggaataggacttgcctcgggacgaaggcagggcatatatgtgaccgtcaggatcggtgataagcttcttggcatccggcttctgtttaaagaaggccttgacgttcggcagcttgtcaagatccttgctcaggtcctcgaacatgcttggatattgagcagcatcaggcactccaaaggcgtggaggcttacatccgcaagcttacctgcggccagggtggcgttcttctgctgggcccaggcgtcctcgctgacctcctgccactcgatcttgcagtcgcagtcggcctccaagtccttggcccactgcatgttggcgattttatccgtactgggtctcttgactattaagacacttacaatcggcttgccatcagcggtcgtggtcggctccttgtcgccgccgcacgcagacagcgaacccagcaaggccacggcacacgcaacggcacccgccttcagcacggtttgttttctcatcgtctctcctttgacatgatgatatttgagcgcgcccgccgcatctgcgggacggacgcactcatgataggcacgggagatggagttcgtcaacattcttaacatatatgtgagtcgcgccacacatagtcattcccgccaccatgtaatccactaaacagaacgcagcacgtcaaaacccgctcccgcggcttcgggaacatggactgcttcagcaccgtgatctacctgacccgcggcagacccggcatccgctccgcatgagcgagccgcacccgatcgttgatccgaattcctccagttcagcaattcgggtgcggctcacatcttggagtcgcaagcactgccttgcaacaagcttgcgctcacggcaccgtcacttcgtgtaggtgtcgtaccacttctgccagatcttggtgctctcctgcagaccaatgctgtcgagctgcttgcagtaggcatcccattcttcgtcaatgccacccttggacatccaagtagcagttttctgcatagtggtattgaaaatctcggcattattagtgttcagcttcgtcgcatcggaaggatccatattatccatattgacgtagtcgggaatatagtccttgacgggatcgaagtggctgcgctgctcctcgtacaccttgttcacttcaatcaattcatcggcgtgagtatcgcccttgatagtagcttcatcaggaatccagcccaccaacaattccgacaggccaggatactggttgtcaccggtcaactggctcagcttgtcattatccacagtgtactcatgctcaccagtcttggttattgccttgccgaaggagccgaggaactgctgcacggagtacttctcggagtacagcaggttggccagcttcagcgcggcgtccttgttcgcggcgtgggaggaaatcgacagtcctgcaggggacaactcactggaggaaccatcccacacggtctggtccggggagacgcccggggcggacggcaccggcatagcgatgtactggtccttgagcttgccgaaattgtcggatggagaccaaccgaacaccacgccggtcttcgcagtcttgccgtcactgatctgatccgcgttgtaggcgtcatcgtccttggtggcccactcggcgggaatcaggccctcggagatgagcttgtggtagtacttgataacctccttgtattcatcggaggtcaggaagctcttgaccacgccgttcttggcgtagaagccgtattcagacacacccttgttgaagccggtgacgatgccggtggagttgagcagcagcatcgggctgtaccacgtgaaatagctgccttcgagtttcttaatgttcatcgggatctcgtccgcttggccgttgccgttcggatcctgggtcttgaacgccttgagcacgttctccagctcgtcccacgtggtcggcacctgcagacccagcttgtcaagccaggccttgttgatcagcatatgctgacctgtgccggagtaggccttgcctcgaccatcggctatcgcataaatccgccctttggagtcagtggacatcttcttggcatccggcttctgcttaaagaaggccttgacgttcggcagcttgtcaagatccttgctcagatcctcgaacataccgggatactggtaagcctcaacagcaccgtatccattcaggttcacatccgcgatatctccagaggccaaggtggcgttcttctgctgggcccaagcttctcgagtcacttcctgccactcgatcttgcaatcgcagtcggcctccaagtccttggcccactgcatgttggccatcttttcctgattggcgttcttcttgaccagaaccgtcacaatcggcttgccgtcagccgtcgtggtcgacttcttgctgcccccacacgcagacagcgaccccagcaaggccacggcgcacgcaacggcacccgccttcaccatagtttgccttctcatcgtctctcctttgacatgatgatatttgagcgcatccgccgcatctgcgggacggacgcattcatgataggcacgggagatggagttcgtcaacattcttaacatatatgtgagtcgcgccacacatagtcattcccgccaccatgtaatccactaaacagaacgcagcatgtcaaaacccgctcccgcagcttcgggaacatggactgctccagcaccatgatctacctgacccgcggcagacccggcctcaacaccgcatccgctccgcatgagcgagccgcacccgatcgttgatccgaattcctccagttcaacgactcgggtgcggctcacatcttggagtcgcaagcactgccttgcaacaagcttgcgctcacgaaaccgtcactttacgcaaaggtcgtaccacttctgccaaatcttgatgttatcctgaaggccaaggctgtcgagctgcttgcaatacgcatcccactcctcgtcaataccacccttggacatccaagtggcagtcttctgcatgacggtattgaaaatctcagcattgcttgtattcaactttgccgcatcagccgaatccatattgacgtagtcgggaatatagtccttgacgggatcgaagttgctgcgctgctcctcgtacaccttgttcacttcaatcagctcatcggcgtgactatcgcctttgatggtgacttcatcaggaatccagcccaccagcaattccgataggccaggatactggttatcaccggtcaattggctcaacttgtcgttatccacggtgtactcgtgctcaccggtcttggtcaaggtctgcccaaacgaaccgaggaactgctgcacggagtacttctcggagtagagcaggttggccagcttcagcgcagcgtccttgttcgcggcatgcgcggaaatcgacagtccggcaacagacagctcactggaggagccgtcccacacggtctggtccggcgagacgcccggggcagacggcaccggcatggcgatgtactggtccttgagcttgccgaaattgtcggatggagaccaaccgaacaccacgccggtcttcgcggtctgaccatcactaatttggtccgcgttgtaggcgtcatcgtccttggtggcccagtcggcggggatcaggccctcggagatgagcttgtggtagtacttgatgacctgcttgtattcgtcggaggtcatgaagctcttgaccacgccgttcttggcgtagaagccggtttcggacgccgcgctcatattaaatccggtcgaaataccggtggagttgagcagcagcatcgggctataccaggtgtagtagctgctttcgagcttcttaatgttcatcgggatctcgtcggcctggccgttgccgttcgggtcctgggtcttgaacgccttgagcacgttctccagctcgtcccacgtggtcggcacctgcagacccagcttgtcgagccaggccttgttgatcagcatgtgctggcccgtgccggaataggacttgccgcgccctgtagctatcgaataaatctttcccttggtatcagcagagaatttttcagcttccggcttctgcttaaagaatgccttgacgtttggcagcttgtcaagatccttgctcagatcctcgagcataccgggatattggtaagcatcaacggcaccgtatccattcaggttcacgtccgcgatatctccagaggccaaggtggcgttcttctgctgcccccaagcttctcgagtcacttcctgccactcgatcttgcaatcgcagtcggcctccaggtccttggcccactgcatatcagccatcttttcctgattggcgttcttcttgaccagaaccgtcacaatcggcttgccgtcagccgtcgtggtcggcttcttgctgcccccacacgcagacagcgaccccaacaaggccacggcacacacaacggcacccgccttcaccatagtttgtcttctcatcgtctctcctttgacatgatgatatttgagagcatccgccgcatctgcgggacggacgcactcatgataggcacgggagatggagttcgtcaacattcttaacatatatgtgagtcgcgccacacatcgccgctcccgccaccacgtaacctgttaaatggaacgcagcacgtccgccgcgcgccataccacacgttggatgcggaacagcggggcgatatccttggctgcatcgtcaagcttgccctgcgtggcgccgggcaaggactcggccacggtgaaacggttcgcgacggacccgcggcagacccggcctcaacatcgcatccgctccgcatgagcgagccgcacccgatcgttgatccgaattcctccagttcaacaattcgggtgcggctcacatcgcggagtcgcaagcactgccttgcaacaggtctgcgctcacgacaccgtcacttcgtgtaggtgtcgtaccacttctgccagatcttgatgttatcctgaaggccaatgctgtcgagctgcttgcagtaggcatcccattcctcgtcgatgccgcccttggacatccaagcagcagtcttctgcataacggtgttgttaatctccgcattgcttgtactcaacttcgcggaatcggaaggatccatattatccatattgacgtagtcgggaatatagtccttgacgggatcgaagtggctgcgctgctcctcgtacaccttgttcacctcaatcagttcatcggcgtgggtatcacccttaatgatgacttcattgggaatccaacccaccagcaattccgacaaaccagggtaaagattatccttagtcagcttgtctaacttggcgctgtccacagtatacttatgctcaccggtcttagtcaaagtctgaccaaacgatccgaggaactgctgcacggagtacttctcggagtagagcaggttggccagcttcagcgcagcgtccttgttcgcggcatgcgcggaaatggtcagcccagcaggagccaattcgctagaggaaccatcccacacggtctcatccggggaaacgcccggagcagaaggtgccggcatagcgatgtactggtccttgagcttgccgaaattgtcagtcggagaccaaccgaacaccacgccggtcttcgcgatctggccgtcactaatctggttcgcgttgtaggcgtcatcgtccttggtggcccagtccgctggaatcagcccctcggagatgagcttgtggtagtacttgacgacctccttgtattcgtcggaggtcaggaagctcttgaccacgccgttcttgacataataaccagaagtggatacgcctttattgaagccggtcgggatgccggtggaattgagcagcagcatcgggctataccaggagaaaccgcttccgagcttctgtatgttcatcgggatctcgtcggcctgtccgttgccgttcgggtcctgggtcttgaacgccataagcacgttctccagctcgtcccacgtggtcggcacctgcagacccagcttgtcgagccaggccttgttgatcagcatgtgctggcccgtaccggaataagattttccgcgcgcagtggctattgcatagactctacccttggaatcagtcgagaatttcttagcttccggcttctccttaaagaatgccttgatatttggcaacttgtcgagactcttgcctagatcctcaaacattcccgaatactgataggcgtcaagggaattaaatccgttaaggttcacgtccgcgatatccccagaggccaaggtggcgttcttctgctgtgaccaagcttctcgagtcacttcctgccactcgatcttgcaatcgcagtcggcctccaagtccttggcccactgcatattggcgatcttgtcctgattggcgttcttcttgaccagaaccgtcacaatcggcttgccgtcagccgtcgtggtcgacttcttattgccacacgcagacagcgaacccagcaaggccacggcgcataccgcagcacccaccttcatcgcgacattcctcattgtctctcctttgagtcgatgatgacttcggttgcatccatcacacctatgagatggacgcaaccatgataggtacgggagccagcactgtcaacagccttaacatatttgcatcaggcccgctcgcaccgccgctcccgtcaccacgcaaccggctaaatggaacgcagcacgtccgccgcgcgccataccacgtgttggatgcgggccagttccgactgccgactgacctcatgccagagcctcgaatactgttcggtccagcattccagttcatcggccagcttcgccgcatcgattccggcctcatcctgccgcaccacgccatgcgcggccaacaacgccaacccgacacggttcagcagacgctgaccgtcgatggccaacgaccagaccgcagcggaggagggatcaccggccacgcggagcagctgggtgatatccttggctgcatcgtcaagcttgccgttcaattcccggcccgcgagaatggagtcacgcaacgtccgcagcatcgaaacgcgagcatccgccaaccttgcctgaccggactgcggcaaatcattccgatacgcttccagacagcccatgacccgcacgatctccgtattgcatccgccacggccgtcgtccagttccagataggtgacgagatcgctccacgagaatccgcctttggcagaagcgcccctgagcgcaccgaccacgctaccagtatggtcgccgtattcgatggtggatatgcgcgacagcatatcgacttcgctgagctcggcatccggattccaggattgctgcgcaccgaagatcatgcccggaaccgacatgcggggatcgttgacgtgtccgaaatcccccaatcagtgaccagcatccccgaaacatcatgggcgcggccatggcgcgccatcctggtgatgttattccacgcatcgtcgatccgcggaatcagcgcattccagcaccacaccgccgggcacaccatctgcgtcgcgccggcatcggcgagagctgccgttgtgccatcatccacgttgggctcatactgccaattcagccaggtgatgttcttgggaagcgtatcgatgatctcagggtgctcgagcgcgacatcggcccacaccatgacatcatgcccacgatcatcaacatggcggcacagtcgctcgacgaaatcggcatacatcgcgccaacgccacgtttcgccgattcctgcttcgacctccccttgccgagatcaaacgtctcatcggcgcagatattgaacttccgcgaacggaacaacggcatcagctcatcgatcaatgatgtcgaaaactcataggaccgctcatcggtgatgttgagcgtatggtgcgtcattcgctcgatcaggctgaaaggacgatccgcgtcctccggaaactctcccagatcacgtagttgccgcgtccgcagcgcggtgtaatgatgtccgaacgtcgacacggagggcacgagctctatgccacgcgccgcgcaataggaatcaagctcgagaatgtcggacgaagtcaacggatcggcgccacgccacacttcgctaagaccattgaactggaacgtatgctcgatgtacaactggaattggttgtacttgtagaagcacaggcgatccacccacgatttcagccaagccatagagggcacacggccacgagtcacgtccagatagtaaccgcgggtcgagaacgccggccgatccctgatgaccatgcacggtatcgtcaaaccaatctggcgaataatctgacgcaatgtctgcacgccatcgcgaacgccttcgaaccccgaaccagtgatcacaacgccgtccggcgagacctcaagcacgtacgaccagtcatcgagcgaaggactggtccgcaaagtcacctcccgctgaacctctccggaggccacctgccagcggcctccgcacacgcgcttaatgtcgtcgacaagctgacgcgcaaacacggcctccgcatcatccgcacctcgttgctccacaaccgttcccgacaacggcaacgagcatgttcccaccagcggctcgacattcgtcggctccggtatgacatgccattccaatgttggttcctgcaccatagcagccacatatcctttcgacctctgcatcgagatagagccttctggccctcaggacatgatagccgtcaacggggtcaacggacacggttgcggtcagtcccggaaagcggcctcggccccaccggcatccgccgtcgcggcggcgcatacatccacaatgtcatcgaccatctgccgcaaggtcggggcggtgatggtcgcgggcaaggatggatcaggctcgtggatgaacgcggtaagcccaccggcggcacgcaccggagcgatatcgttcgtccagtagtcgccgatactcatcatgctcaactcgcccgtccgtcggcgaaccgccgacagcctttcgatcaccttcggccatccgcctggcttggcggcaccggcgatgatgccatcgaatccttcgagcacgcccagacggtccaacgtctcacgcagcccgatcatcggcgagttcgtgaccagcacgcgccggcaacccagctcacccaaccgctccaagagggattccaatccctcgggcgggcgcacgtcgaacgtgccttcggccaacatccgacgcgaacgcatatacgcatcctgcgactgctcgacggtcagacgccctgccgcatgagcctgcacgacgtcataggcatccgaatacttcggcatatccgccggacatgccagaaaccgctccagctcatcgttcaacgtggccgcatcatcacgatcaagatgcgcgcacaccgcctcggcgtaggccttgaccggaccatcgccgaggcataccgtgccgtcgaaatcgaaagccaccgcgaatgccgaatcaccgttcacagctctaccatccaatcctgcatcgcaccattcgccggaatacagcggtcactgttcccaatccgaatcgaacgtcggcttgagcgtgctcagcgaagacttgacgtcacccgcaccggaaagcacgctctccaaggacttctgcacatcgtcgctggcctgttgcatgccgggcgtcaacggaatggtgaacaggttcttggtggcatcagccaagatgggcgcaatggcactgcccgagttggcatacttggcatcggcgatcgcggacttacgaacaggaatgtaaccggtaccgatcgcccactcaatctggctgtccttggacgtcaggaacttctcatacagataggccgccgtgcgctgctcggggctggccgaggagaacatgtagatatcggtgccctgctgcatcgtgtgcttcgccggatacggcaccacaccatattcaaacttgccctcggcgcccttcttaacgaaggattcaccggcgttggacccaacatacatggcgaccttctggttggagaacggaccggacatgtacttgtcggtgccggcgatgcggaagtagccatccttgacgcctttgtcgtagtagtcgaaggccttggcggacttctcgccggtcacatcgaggcccttgccgaacgtcaccccctcgttcttcatataggtgatgtagtagttcgacagcgagtcgaagcccgcgccgggaatgcccttcgcgctctcgattttcttggaggtttcggcgagctcgtcatacgtggtgggcaccttgagtcccagctcgtcgagcatggtcttgttgtaccacagcacctcagtggacttgttgaacggcatgccatacgtcttgccgtcgatcttcacgccatcgcgcaggccgggcagcacatcgtcccagttgtcgaatgcaagattgccgtccttggatgcgatgtaggggtcaaggttgacgacctgaccatcggagatcgcgtcgaccagccagctcgggtacgcctgggtgatggtcggcaaatccttcgggctctgcatcgtggcggtgagcttctgctgcaggtcactgtagctggactggttctgcaaagtcaccttgatgttcgggttctgtttcatgaacgtatcggtcaggctctgcagggtcttctcctggttgcctgtcatgccgtgccagaacgtgatctcaacgtttcctttgatgtcggagacgatcttgtcggattgtccaccatcgctcgccgcgctggtcgagccgcatccagataaggctagcacgccagccatcaatgcggtcagcaccgctttcgcacgcatattaccgtgtagtgtcatgattccattccttttctgattccattggtttccgtttgcttgtttcttttcctgttttccgtggaacaattccccggaaaagtctcggcaatgacgcaaccggcaacacgccggttcacggctcacagctcacagctcaacagtcaaccccggttcgggcaagatcatcgctccataatcgttgcgataccgttcgggatgctcgccatgcaccgggaacagcagacggggacgcaccgcatcgatgatctcgaacgccttctccaccgtggcgtgtccggagcacgaaatcgtgacggcttcgacatcctgatcggcgaatccttggaagaacggcttatacgcggggtcgtattctccgagaggcgcggcacccgtgtgcacatacaatccgttgcgtcgaagatcgtgcagatgtgcggctctcgcacgatcgtcgagctgccacagatacgcatcctgatcggacagcagttcatcgaacggaatctccagcgtcgagtcgagcgacgaataatcacgatcatcattcagacggtagtaatgcacggggtcaccggtcacggaagtgtagacgaaagccgcgtacgcactgagcacgacggtgcgcggactggacacgatgatgtgctggattcgttcgatgttcgtcagatagtagttgaacgtgatctgacgatgcggattgtcccgaacgagcgcctcgatgcgatcgcacacctgctgctcggtggtctccgggcggtcgacgggatcacccggcttgcggaaggagatcgacgtgccttccatgatgagcgcatcggcacccgcgttcgcttggaggaacgcacgggtgtcatgctcaagaaatccgtggaaacgaatgtcgcccgtgtacgcgatgaccgcgtcaggcgtgacgacgcgcagaccggacgcaccgtaggcatcgtggtctacgggcatgaccgtgaccgagatggaaccgacacgcacgacgccgttgggctccacgccggtaatcggccgagtatggccgcaatccttgcgatacggcgggaaatcgaaatcgtcgttcacgttcatggcttcgagcaccctcttggtgttctgcgaagcgtagacggggatggcggaatcgatatagttgagcatcttggaatggtcgagatgcgcatgcgagacgaagaccgcactgtgcgcatacgggtccgcagaccagtggtgaccgggcacgtctatcgtgcggtcgaatatcgccggcagatacggtacgtagccttgcgagatgagatcggcgagatctcggggctgcttgggagcggcagggttatattcgcaaccgcagtcgaacacgatgcggctatcgccataggacacctcgatgagattgcctccgatcgtgcggatgccccggtagaacgtgatgcgcgttttgtcgcgcagatcgttatcccttgatgccattgctggacactccttcgatgatttgcttatggaagatgaagtacagcaccaatatcggcacaatcgtggccgtgctggccgccatctgaagttgtaccgccgtgccggtctcagtagcgaacgcgctcagaccgttgctgatcagacgcatatccgtgctgttggtgacgagaatcggccagaggaacgaattccagccgccgatgaacagcagcaacgccatggtgaacaaagcgggcctgctcatcggaatcatcactttccagatgaattcgagatcaccgcacccgtcgaccttcgccgcgttgtaatatgccgccggtatggacgacaggtactgctgcaaatagaagatgtagaacacgcttgccaaggagggcaagatcaacgcccaatacgtatccagcaaacccagctggttgatcgtgcgatagttggtgaacacaacgacctcatacggaaccatgagcaacgccatcatgcccatcatcaacgccttcttgaaacggaaacgcaacctcaccaaggcgaaggccgcaagtacggtggtgatgatcgtgcccaacgtcgacaacccggacaccagtaccgtgttgaggaaataacgggggaacggcgcctgcctcatggcttcgacgaaattgtgccactgcgggacgtgaggcactatcgtcggcgggatgctcgtgacctcctgataggtcatcaggctgctggacagcatgtacaggaacgggaagagcgtaagcgccgccatgacgatgacgaacacgtagaccagacccttaccgagaaacctcacttcgccagcctcctcaatacgatgccttggatgatggtgaaagccagaatcaccaggaacagcaccaccgccgcggccatgccctgcccatacttgttgtccacgtagaacttgttgaacacgtagaacaccgccgtcgtggcgctatcgccgataccggccttcccgttgaacaaggcgtacacctccgtatacaccttgaaggaattgatgaaatccacgatggacaggaacgtcagaatcggcaccatctgcggcaacgtgatccggcggaacttctcccaggccgtggcgccgaacatgtcggccaccttgtaatattccttgtctatgccgcgcaggcccgacaacagaatgatgatgttgaacgccagggacgaccatatgccgaagatgatgagcgtgggcatattgaacttcggatcgttgagaaaatcatagggtccaaggccgcacagacccaacacgtaattgacaagaccgtaatcgccgttgaacagataccggaacaccatgccgatggcgatcaccgaggtcagataggggatgaagaacaggatttcgaagaccctgcctccgcgaagctttccattgatggccacggccaccgccatcgacagcaccagcccgaccgacaccacgacgaatgcgaacagcgccgtattggcgatggccttgcggaattcgggatccgcgaacacgaaaacaaaattacgcattcccacaaaccgttgacgggtcaacgtcccgccctgcagcgacatgatgaagatacgcaccaggggaagcagattgaacacggtgatcagcgccaaggccgggaacagcaacagccacgcatggggctgccgctcggcggaatatcgacctgagcgatgagatttccctcccccgccctcattcagggcagtcaccgcaatcgacttctcgcgcctctcttccatatcagtacaccctcgttccatcctcggagaacagatatatatcgtcatacccgatggcgaacgcgacccgttgcccttggcggattcccgtgcgtgcatcgaccacgctgcgcgcatgttgcccgccggcgtcaaaatgcaggacggcataacggccgatcatttccaaagactcgatttcggcctcaaacgccggcttgaatccatcggcatgccctttcacgggctccgtcaggaaatattcaggacgaatgccgaccttgtagcgctcctccgtcagcattccgcccgcggcgtcggcgcggaaccgggaaccatcaagatccgcgagcgcgatgtcgaaggcctttccccgcagcatgccgtcagaacggtcgaatctcatgtcgaagatattgatgatcggacttcccatgaactgcgccacaaacaggttggccgggtcgagatagagtttttgcggattgtcgtactgctgcaccacaccctcgttcatcagcacgatgcgatcggaaatcgacagcgcctcctcctgatcgtgagtgacgaagatcgtggtgatgcccgtccccttgaccagacggcgaatctcctcgcgaatatgcaaccgtagacgcgcatccaaattgctcaacggctcgtctagcagcagcacccggggagtctgcacgagtgcacgagcgatggccacacgctgctgctgcccgcccgacaacgcggaaggtttcttgtccgccagattctcgatgttcgtcatgtccatgaacttgtgggcgatcttcgccgcctcttccctgctgcggcgatgttctcccacacgcagcggaaacatgacgttctccaataccgtcatatgcgggtagagggcataattctggaagaccatcccgatgttgcgattcttgggatgcagtccgacgacggattggccgtcgatggcgatatcgccggaagtgggatccagaagacccgcgatgatgttcagcgtagtgcttttgccgcagccgctgggaccaagcaggcagaccagttctccgtcttgaatatcaaggctgatatccttcagggcctcatatccgttctcatacaccttcctgagattcttgattgagattcccatatccacccactcccatatttcggcgtttcggcggcgatcagcaccagcatgacacgaggagatacagcggggggagaaattcatcaggactatacgcgcacaagtcagagaattcatcttgttcacatggagttcagacagacccggacaccagccctccactgacgtcgcggcatccaccggactgatacaatgcccgtatcgtcgcagcgacgcattgcgtcaggatggagaggtgcatggtgagaacatacgagaacgcgcaggagctcaaaaaggagatcggcgcggcgtttcgaaaatacattgcggagttcgacgacattccggaagccctgaaagacaagcgcaccgacgaggtcgagaggaccccggcggaaaacctcgcctatcaagtcggttggaccaccctgctgctgcagtgggaggatcgcgagcggaagggccttccggtgcgaacgccgtcggacgagttcaagtggaaccagctcggaaagctgtaccagtggttcaccgacacctacgcccacctttcgctgcgggagctgaagggcatgttgaccgacaacgtcgacgccatatacgccatgatcgatgcgatgagcgaggatgagctgttcaagccgcatatgaggcaatgggccgacgacgccaccaaaacggcggtatgggaagtgtacaggttcattcatgtgaacaccgtcgccccgttcggatcgttcaggacgaaaatccgcaagtggaagcggatggccctataggttcggcgcgccccgcaaccggcgcggcctacaaccgtcgcggcccgcaaccggcgcgtttcctcggactccccttcacgccatcagtcgccccggttcgtcaggccgggaatcatgggctaggctgggagtcatggaacttcacgttttgaatcatccgctggtcgagcacaagctcaccgtgctgcgcgacaagaacaccccctcctccattttccgcgagctcgtctccgagcttgtgatgcttgaagcctacgaggccacgcgcaacctgtccgtggtcgccgcgccgatcgagacgccggtcgccccgatgaccggcaagaaactggccgaaccccgtccgatcatcgtgccggtgctgcgcgcgggcctcggcatgctcgacggcatgacccgcctcatgcccaccgccgaagtcggcttccttggcatgaagcgcgacgaggagcatcccacccagcaggtgacgtatgcgaaccgtttgcccgaggatctgtccggccgccagtgcttcctgatcgatccgatgctcgccaccggcggcacgctggtcgccgccacgcactatctggccgaacgcggcgccaaggacgtgaccgcgatcaacatcatcgcggcgcctgaaggcatcaagtacgtcgaggagcacatcgacccgtccatcgaattcaaggtcgtggtgtgcgcggtggacgagaagctcaacgacaagtgctacatcgtgccgggtctgggcgatgccggcgatcgtctctacggcgtcatcgactgacacatgaacatcgacatcgtctgcgtcggccggatcaaggaacggtatctgaccgacgccatcgccgaatattccaagcggctctcgcgctactgcaagctcaacatcatcgaggtggcggatgagaagacgcccgaacacgcctctgaaggcgttggccgacagatcaaggccaaagaaggcgaacgcatcgccaagcatctgaaggacggggcgtttgttattgcccttgccatcaacggcaagcagctgtccagtgaagaattggccgccaaaatcaacgaccttggattgcgtggtaccagccatattcagctggtcatcggcggttcaatcggccttgacgacgcgattctgcgtcgtgctgattttctgctgagcttctcgaagatgacgttcccgcatcagctcatgcgcgtgattctgttggagcagatctatcgcgcgtacaaaatcaacgcccacgagccgtatcacaagtgaaacaccatgcctcatggggcgggaaatccctcatggggcggtaattgccccatggggccgtaaaaccctcatggggcggtataccaaaatggcttaattccgcggtttcacatattcttcaaaccgccccatgggcaagttaccgcccgatgagcctgtaaccgccccatgggcacatcaataacgccctcaacctcacactgcgtcggggccgaatgcttcgaagatgtggcggtcgaagtagggggcgcactgggcgagttcatcgctgctgcgcacggtccatgaaaccggcatcgcacccatcgaacgagcgagcttgacttgcggtgaagcgccaccggtccagtcataagccacgaaatcaggacgagacagccagtcgaacgccagtaagccggcgacccattcagccgcaccattcttgctcagcttcgccggccagctcagctgaccacggcacacctcagggtgatgctccttgtaccaattcaccgcgcccgggtggaaggattcgatcacgtacgggccgtcatacgcctcaagcaaggcgtggcccttttccatgagctcttcgctacgctcatcccaagccttgttgttgctgaacttgtatttcacgatcagcggagcctggccggccaccacgtccagcacatcggagaacagcggcacatgctggtagtaccccatcagctcatgcgcgtgatcctgttggagcagatctatcgcgcatacaagatcaacgctggcgagccgtatcacaagtaacagcgcgcgccccaatcatgcggggcatggcaaacggcccgcctcctcgaaaacctccggggcggcgggccgtcgtcattgtcgcggcatagggaccgcgaccacatcacttctgggacagcgagttattgtaatcgtccagatccgtctgcaacgccttgacctgatcgctcaaagccttcttgggatcggtgccttcgaagatctgttcgacggccttctccacgcccttgcgggcctgcggcatcacacctgcggagcatccctgggtggcgggagtgagcttggtgttctgcaactgcttgaccgccacatcgaactgcgggtactgctgacgccactgggcgtccgccggctcctcaagcgccttcttcgaggtcgggaagtaaccggtgccggtgtgccattcggcctgacgcttcgggtcggaaaggaacttgacgaactgccaagccgcctgctgctcctcgtcggagtgctttacgttggaaatccacagggagccgccgccgacgatcgggccggagttgttcttcttgatcttcgggtagttccccacaccgacttcgaagcccttctgcttggcggcgtccatcacaccggccagatcggcggtggattcgatggtgatgccgatgttgccggtttcaaaggcgttgatggccgccgtggtatcggaaccggtgttgccggagacgccggagtcgaccatatccttccaccacttcatgaacgtgactgcggcgtcgttgtcgaagtcgaacttcgacacgcgatccttgccacggccgttgtcgggaccgcagtactgctcgccactggcggcgatctcctgctccaggtaccagccgtagacggcggcgttgaagccgtactgtgcgggtccgccattcttctcagaaagcttctcggcggcggccttcacttcatccagcgtttccggtgccttgttcgggtcgagcccggccttctcgaacaacgtcttgttgtagtacagcaccggcatggaggtgttgaacggcatcgaatacagcttgccgttcacggtgtagtacccggccacgttcggctgcagatcggaggtgtcgtacttgtctttatcgatgaaattctgcatcggcgtgacggtgccggaatccatcatgaagcgcgaaccgatgtcgtagatctgcatcagcgtcggcgtggactgcgactgcacggccgacttgtatttggtgatcgcttcatcatacttgccttggtacaagcctttgacggtgatcttgcccttgttctgcgcgttgaactcattgatcatcttgtccagcacctgaccgttcgtgccggacatggagtgccagaagttcacggtcacggaaccgtcggactctttgggcgtagggacgttggcgttcgaagcggtatccgatccgcatgccgccaaggaaaccatggaacccaccgccgcgatgatggcgatggcacgggtggcaatcttgttcattcttattcgttctcctcataagccgcccgcatgccggatacgacacggccgacggacggtgattggtgacagtcggccagcgagcgccggccgagggatggtgattgacgtcgacattcagctcggccaatggtcggcgacgtcaatggttggttgttgtcggtattgagttatgaatcacagatcatttggtcgaaccagcagtcagaccgcgcacgatctgacgctgtccgaacacgatgatgaacagcgtggggatgacggccagaacggcgccggccatcaccagtcccgggttgaaggcatcgggcgactgcagctgcgtgatgccgatctggatggtctgcatctgcggtgtctccgtgaccagcaagggccagaagaaggcgttccagtgagtcaggaaggtgtagatggccagcgaggcgatggccgggcggcttagcggaagcactacggaccatagcaggcgcaggttcgaggcaccgtcgatgcgcgcggcttccaccagctccatcgggaactggcgcatgaacgaatgcatcatgaacacgccgaatccactggcgaggaatggaagcaccagtgcgaggaaggtgttgcgcagcccgagcgaagagatggtcagatagttcgggatgatcacggattcacccggaatcatcatcgtggacaggaacagcacgaaccacacgcgacggcccttgactttgaggatcaccagcgcatacgccaccaaagtggaggtgagcacctgcgccacggtgatcaccagcgtggcccccagcgagttgacgtattggcgcataagcggaatgatctgcgccgcggtggcgagattattccaggtgatgccatgcaccggccagacggcgggcggataactggcgatgtcctcctgcttcatcagcgaaccggcgaacgagtagtacaccgggaagaccacgaggaaggcaagaaacagcagcaccagcacgccgaagatcttcgaggcgatgtatttggcgcgggaaaggctcagcgagccggtcgcgccgcgcgacacggtaccggagggaacggaagcggtcattggttatccacctgctttccaacagtgaggaactggatcagggtgatgacggcgaccaccacgatcagcaccaacgcctcggccgaagcgtagccgaaattggagctgttgttggcgaaaccgtgcatgtagatgtcgtataccagcgtggtggtggaggcgttcggaccacccttggtgagcacatgaatctggccgaagctttccaacgactggatggtgtcggtgatgatcaggaagaacaactgcggcatgatcagcggaatcatgatcgaggtctgcaggcgtagaccggaagcaccgtccagacgagccgcttcgacgatctcctccggaaccgaacccaggccggcaagcagcaccagcacgttgtagccgatgttcatccacaccgtggtcatggcgatggccggcatcgcgaatttcgggtcggtgagccaacccaccggctgcatgccgattttctgcagcgcggcgttgaacaggccagtggccggattgaagaaggcggagaagatgatggacgcggccgacaccgagtaggcgaacggcagcgcgaaaatcgtgcggaacacacgattgacggtggattccttgttcagcatcaacgcaatgaccagcgacagcagaatcgtgggaatcaccgtgtatacggcgaacatcaacgtattgagcatgattttgccgaattcgggatcgctgaacacgcgctggaaattgcgcagtcccacgaacttgctctgtcggccgagaatgtcggtgcccgacatggacagcacgaacgtgcgaatcagcggatacaccatgaatacgaggaacacgatggccgcgggcgcaagatacagcgacgacgtcacgtcgcgcagggtgaatcgcgccttggcacgggaacctgcgccatatgacggcggggattggctaggtttttggatgtgtgcgactgcctgagacatgcaaaggccccttccggtcgaagaccgtttatgcatttttcctatggacggttacctcgttcagtggtaccccagcagtcgacgcccctggatcgatatcactgagaattcaatatggcttcatcgccattacgtctgatattcgcctcgttcaccgccccgtcatggcatgccaataaacaggccgcccaccacgacaaatgtggtgggcggcctgtcgggaaccagtaaagcggtttaccgttcgtcgggcacgaacgcctcgaagatatgacggtcgaagtaagcgtcgcattgggcgagttcgtcacggctgcgcacggtccacgacacggcggtcgcgcccatcgcgcgcgcgagcctgacctgcggcgacgagccgccgacccagtcgtaggccacgaaatcggggcgggacatccagtcgaacacgagcaggccggcggcccattcggccacaccgtcctccttgatggtggcgggccagctcaactgcccgcgattcacctcgggatggttgaccttgtaccattccacggcacgggggttgaacgattcgatcacgtacgggccttcgtactgggcgagcagcgcggcacccttgtccatcagttcgtcgcagcgtccgtcccaatgggcgttgtcgtcgaacttgtattccacgatcagcggaacgcggccattcaccaccgcaagcacgtcggagaacagcggcacatgctggtagtagccgtccggcgcggcggacggcgtggtgaccagcggcggcacctcctcggcgccgggcaatggttcggcgacggcatcgccgggccgggccgtggggaacaacgggatgcgcgtcagttcgccgtaggtgaggtcttcgatgcggcgcggatcgccggccacgcgtttcaggtcggggtcatgcacgacgaccacctggccgtcgagcgtcagctgcagatcgagttctatgccatacccggcctcgcaggcggcggcgaaggaggccagcgaattctcgggggcgatcgggccggcttcgttggcggaaccgtagccggctttctcggccatgcggcgggcgagcgccacatagtcgccggattcggcggcgtaccgatgggtcaggccggaaccggcgtcgtgcagaccacggtgggcgtaccacgcatcgggaaccgaaggcacgaagttgcggcgcttgtcgttgaacgagcgcggcgcaagcgcccaggccgcggtgcccgcggcaacggtgccgccgatgatcacatttctgaacagtttcgatgaagacatacgttcctcccgtgtcggaccaatcatccacgctcagcctaccgcggtccgtcacctcggcacgcaaggtcccgccggctgacggcacgtttttgcgcggcccggcggcccgcgctcacaaggcttcggccagccatgccggcgtgtgcggcgaggccggatccaggatgcgatcgtcatgcgcgccgcgcagcggcgtccaactgaagtcggccagcagatcggcgggcggacaggcgatggggtcgggccgtaggcgaagcagccacgcacagtagccgatgatctgctccgggcggacgccgcgcgcccgcagggcgcccatgtcgagcgaccgctctcgtttggcgaggcggcgtccggccgcattgtcgatcagcggcagatgcgcgtatacggggcgcgcggcgcaacggcttgcgggccgaccggcggcgcacgggtcgatgccgccatgttccggttcaaagccgccctccagcaggcacctgcgaatccgcatctgcaatgcggtggagcgcagcaggtcacgcccgcgcacgatgtcgtccacgcccatgtcgagatcatcgaccaccacggccaactggtatccgaacaacccatcggcccggcgaatcacgcaatcgcccacttcccgggccaggtcgtatcgacgcggcccgtagacgccatcggtgaaggcgacggccgcctcaggcatggcgatgcggatggagtgacggtcgccgcgcgtcaggcgggcgcgcacctgctcgggatgctcgcgcaacaggcggcggcatgtgcccggatacaccgtgaaaccgtctccctcgttgggcgccgacgccgcgcggatatccgcgcgcgaacagaagcagggatacagcacgccttgcgagcgcaggcgttccagcgcatactcgtatcgttcggtgcgctgggactggaacatcggctcaccatcccagtcaagcccgagccaatgcaggtcgtccatcatgagccggtcggcgccggcgaccacgcggggcccgtccacgtcttcgatgcgcatcatcatgcgttcgccacgggaacgggccgagagccatgcacccaacatggcgtacacgttgccgatatgcatgcgccccgacggcgtgggggcgaatcgtccggtcaccggtcttcctgaatcccgtccacgctcacggactggtcgtcgccggacggatcgtcgccgcccgaacgtgcggagagctccagatgctcgccgccggtctgatcgacgagcacggtgtcgccgtcgtggaccttgccggccagcagcatgcgggccagctggtcgcccacttcggtctgcaccagcctgcgcagcggacgggcgccgtacgccggatcatacccggtgttcgacagccattcgcgggccgccgcggtgacgtccagcgtgatacgccggtcggtcaggcgctgagccaccccggccacctgaatgtccacgatgccgccgagctcatcgcgggtcagcgggtggaacatgacgatgtcgtccagacggttcaggaactccggcttgaagttcatgtggacggcgtccatcacggccttcttcttggcgtcggcgtccatgtcgtcgttcacgaggaactgcgagccgagattggaggtcatgatcagaatcgtgttcttgaagtccacggtcctgccttggccatcggtcaggcggccgtcgtcgagcacctgcagcagcacgtcgaagatctccggattggccttctcgacctcgtcgaacaacaccacggagtacgggcggcggcgcacggcttcggtcagctgaccgccctgctcgtaacccacgtagcccggcgcggcgccgatcaggcgggagaccgaggctttctccatgtattcggacatgtcgatgcggaccatggccttctcgtcgtcgaacaggaagtcggcgagcgccttggccagttcggtcttgcccacgccggtggggccgaggaacaggaacgagccggtcggacggttcgggtcggagatgccggcgcgcgaacggcgcaccgcgtcggatacggcggcgatggcttccttctgtccgatcacacgcttgccgaggtaatcctccatgtggagcagcttctcgttttcgccctgcatcaggcgtccgacggggatgccggtccagtcggagacgatgccggccaccgaatcggcgtccacacggtccgggaccatcggttcggcgcccggctgcccggcgccggagtcttgggattcggcgtcggcgttctccgctgcggcaagctccttttggatggatgggatctcgccgtagaggatcttcgaggcttccgcgaggttgccttcacgggtgtacttatccgcctgcacgcgcaggtcatcgagcttggcacgcaggtcgccgaccttgttgtgcccggcctgttccgcatcccaacgcgccttgagtccgctgagcctctcgcgggtgtccgcgagttcggcctgcagcttgcccagacgctccttggacgcggggtcctcggccttcctgagctgcatctcctccatttcgagacgggtcaccctgcgttgcagttcgtcgatctcctcgggcgaggagtcgagttccatgcgcaggtgggcggcggcctcgtcgaccaggtcgatggccttgtccggcagttgacggcctgagatgtaccggttcgagagggtcgcggcggcgaccagcgcatcgtcgccgatcgtcaccttgtggtgcgcctcgtaacgctgtttgaggccacgcaggatggcgatggtgtcctccacgctcggctcgcccacgaacacctgctggaaacggcgttccaatgccggatccttctcgatgttctcgcggtattcgtccagcgtggtcgcgccgatcaggcgcagttcgccgcgggccagcatgggcttcagcatattgccggcgtccatcgagccttcggccgcgccggcgccgacgatggtgtggatctcgtcgatgaaggtgatgatctggccgtccgcgttcttgatctcgttcaggacgctcttcaggcgctcttcgaattcgccgcggtacttcgagccggccaccatggagcccaggtcgagggagatgagcttcttgccttgcagcgtggtgggcacgtcgcccgccacgatgcgctgggccaggccttcgacgacggcggttttgcccacgcccggctcgccgatcagcaccgggttgttcttggtgcggcgactcaggatctgaatcacgcggcggatttcctggtcacggccgatgaccgggtccagcttgccttccttggcggcggccgtcaggtcggtggagtacttctccagggccttgtacgagccttccgcgtccgggctggtgactttcgcgccgccgcgcacaccgggcacggccttgcgcagggaggcggcggtgacgccgttcttctccaggatttcggccgactggttcggcttgctggccgcgatgccgatgagcagatgttcggtggagacgtattcgtcgcccatctgctgcatttccttttcggcctgggcgatggcggcggtcagctgacggctggcctgcggctgtgatgtgctggaaccggatgcgcttggcagggcgaccaaggcgttgcgcaccgccgcgccgatggcctgcgggtctccgcccgcggcttcgatcagcgaacgcaccacgccgttctcctggcgcagcagcgcgtccatgacgtgcagggtttcgacctgcgcgtttcccgcggcggacgcactctggatggcgtcgccgacggcctcctgggccatggtggtgaacttctgttccatatcgtattcctccatatcatgcggtccgcgcagtgcggctcgcaggcttcgaaagtcctgcgagcgttgcggcagaccgcaacttgtcgttgtctgatatggtcaaccgacctggaacccattctattcccaaaacttgagtgcatgtgactcaagttttcatgttccgcaatattccacccatctcttccacaagatcagacgaatctttgccacattgcccagtgaagaatccatagaagcattcctgcggcaaagcggaatactgctggttatcttatgaacctggaataaagttgccagtcagttatactacctgtctggatttgttgaaaccgaggaaaaggatggagatgaattgattgctattgtgaagccgtaagaacagattcggaatccgtagaggagatattaagatgtgcatcaggaaagcaacagtagatgatttatcaagaatcgctgaaatatatgtatttaataatagggtaaatttcttccctatattcaaagatgaaagcttctcttttggagagttacaagttgtttcattggtagataattacttcaagaaagatgaaatcatcaataacatatatgtatctgatgatggattgataaagggttttgttcagatggacggaacagaaatctgtaaattatatgtagatacgtcttttcaaagcgagggaatcggcaatgaactgatcgaatttgcgattaaagaactccatgcgaataatctatgggcattagagaagaatgttagagcaatttctttctaccacaagcatggttttcatttgacaggtcagaaaaagtttgaagaagacaccaccgaatatcttgttaggctagaaaggtgatactgataaggcccgaaatcctcaccatgactgacactgtggagtatgatcagttgaaaaccggcaagcgcaacgaggcagtcatcctctccgtcaggcccatgcttgacaaaatcgcgggcgttccacgcccacaagccgcaccccgatcaccggtccgggaaacccggattcgattaatcgcgggtgcggcttcttcgtacacgtaaaatcacgcgcggcaacggcgtgaatcggacggtacgcccacatgatgcaggtgccaaactcacgcacgcaccacaacgttgcgcagatcgccgatgccttcgacgtggacgatggcctcgtcgccgggatcaagatgaccggaggcgttcggcgtgccggtcatgatcacatcgccgggcagcagcgtggagaacgacgagatcgcggcaatttgttcggggataccgtgaatcaggttcgcggtggtgccggacgccatcggcacatcctcgccgttcagcgtgaaggaaatcttggcgtccttccagtcgaggtcgtcgcgcatcacgatccacgggccgagcgggcaggaggtgtcgaagcccttggcgcgcgtccacgtggggtcgatgccctgcagatcgcgcaacgtcacgtcgttcacgcaggtgaagccgagcacgtaatccatcgcgttctcgacggtcacgttcttggcgatgcgtcccatcaccacggccacttccggctcgaagttcatgtccttggagcaggcggggtacacgatcggatcgtcggggccgattaccgaggtggacggcttggtgaagatcaccatgtcttccggcgcgtgggcgatttcggaatggccggcctcgtgcatgaactgggcgtgcgcctcatagttcttggctaggccgtagaccttggaggggatgaccggggagagcaggcggatgccgtcgccgtcgaccgggtaacgagtgccggtgggcttgacctggtcgccggccagcgggtggccgtccagttcgatgaggtagtccttgccgtccgtttcgtccttctgcacgaaggcgtagcgcggcgaatcattcaaagaaaaacgtgcgagtctcatggtgccaagcctactccttggcggcggcccgcacgcccgtgcggcgaacggtcatttggtgagcagcggggcgacctgctcctcgtaggcggtcagggcggtgtcgatcacctggtgcatgtcgtagtacttgtacgtgccgagccgcccgccgaacacggtcttcggctcggccgcggccttggcctcgtaccgcgcgtacagggccttgtccgcatcggtgttgatcggataatacggctcgtcgccacgacgcgcgaaacggctgtactcctcccacaccaccgtcttgtccggattctgccggtcccggcgctccggattgaagttcttgaactcgatagcacgagtgtacggcacgtccgcgtcggagaagttcatcaccgggcaaccgaaatggtcgccctcatcgtaacggacctccttgaagtccaccgtgcgccacttcaggtcgccaagctcgtaaccgaagtaacggtcgaccggacccgtgtacaccaccggcacgcccgcggcccgcagggccttcttgttgtacggctgggattcgtcgaagaagtccacgcccagcgaaaccgtgatgcgcggatcgtcgatcatgcgttccatccacttggtgtagccgtccgcgggcagaccctcccacgtgtccttgaaatagcggttgtcgtagttgaagcgcaccggcagacgcttgacgatcgacgcgggcagctcggcaggatcggtctgccactgcttgcccgtgtagttcttgatgaacgcctcgtacagggggcggccgatgagctggatgcccttgtcgttgaggttctgcggatcggtgccggccagctcgcccgcctgctcggcgataagcttctgcgcctcggccggcgtgtaacgcgcgtggaagaactggttgatggtgcccaggttgatcggcagcggatagacctcgccgtcatgcgtggcatacacgcgatgcacgtagtcggtgaacgaggtgaaacgattcacgtaatcccacacacgcttgttggacgtgtggaacaggtgcgccccgtacttatggatctccgcgccggtctcctcatccatatacgagtaggcgttgccgccgatgtggtcgcgcacgtcgatgatatgcacacgggcacccgcatgctccaccgcctgctgcgccaccgtcagaccaaacaacccagcacccacaacaaccaaatcaggatacttcacggaatcagtacgcgcgtctgccatgcctcgcgttcctttcaatacgaaacttctaaatacgatgttcggattaccaccatactatcgccacggccatgacggtactcgccggagccgccgacgtgcggcggccacggcgctcaccgcgcatccagctccgcgaaggatgagtcggagacggcggtgtagtatttcgccccatgcggctcatcgtcggtttcaagccgcgtgacgccgagccgccgcagcgcttcgccgtcacgggcggtcgccgaggtgacgagcgtgggccgggcgccttcggcatgcagccgcatccaccgttcgaagatcgagccgcccggaccgcaggcgccacggttgagcgggttgccgttctcatcgacttcgatgacgacggcggcgtcattgcctccggctgcgggcttgtcccgatactcctgcgccatctcggcgaaggcgcggccgattggtttgatgttgccgtgttcgtcgaagaggccgagagcgtgctcgaagggcgggaaatcactcatgcgcgagtccacgtcatgcgagcaccaccatgtgacgccccacagattcgggcattgcgccgccttggcgatggtgtcgcggcaaaattccggggtctgctcggcttcgagcacgttctgcggggcgccgacctcctgcagccatacgggcctgtcggggttccgggcgaaggctcgggagagctcggccaagtagagcgcatgcgcggtgcattccccgctcattgcgccatagccttgcgcggtgccgttgaacacccacgagtggatcgtggtcatgtcgcccaggttcgcggcctgcaccggcgtgaacggatgatggtcgagataccatacgccgtcgttttcgctgtgcaacgccacgtgcttcctgcggtcgacgacggccagcagatcggccagccaggcgtcgatgcgccgggacgaggtcgccattttggcgggatgcggacggtcggagaactgattgagttcgttgcccagggtgagcccccggaacgccggctcctgggccagctccccgtacagttcggcgacgagcgttttctccgccttgactgcatcggcatcctcgaacatgttgccgcgatgccaggtaaccagccatgacggcaggaagtcgaagctggacagatgcccttggaacacgtccacataggcgtccatcccctgctcgccggcgatgtgcaccatgcggcgtacatcggcgatggccttgcggttgatccatgtgcggttgggttgcaggtagggccacaccgggaagacgcgcacatggtccatgcccaggttcctgatgcggcgcatgtcttccttgacgctcggccagtcggggtcgagccagaagtggaaccagccgtgggatggggtgtagttgacgccgaatctcatgcgcatcatcctttcatcctttgatgccaccggactccacgcccttgaagaagtagcgttggaagaccaggaagaagatcacgatcggcacgagcgcgatgatcgtgcccgcggcgatcaggcgcggatcggagacgaactgattcttgagccggttcagccccacggtcagcgtgtacaccttgtcatcggacaggatgatcaacggccacaggaagtcgttccatgcgccgacgaaggcgaagatcgtcacgacggtcatcgtccccttgacttggggaacgcagatgttccagaatcgttgccacacgttggcgccatccaccttggcggattcctcgagctcgttggggatgccggcgaaggcgttcatcatgagcagcacgttcatcgcgccgcacaggccgggcagcgccgcgccgatcagcgtgttctgcagacccatgttcttgacgatgatgaactgggagatcagcagggtttcgccggggatcaacatggcgctgaagatcagcagcacgaccagacgtttgcctttgaaggccaggcgcgagagcgcgtaaccggcgcaggtggatcccacgacgttgccgcatacggcgatggcggccacgatcagcgagttcttgaaatagctcaggacgggaatgcggttgaacgcctcgacgaagttgctccacgtcggatcccggggaaacacgtagggcgggacggcgtagatgtcgtcgcccttgcctttgaaggccagggtgagctgccagaacaacgggccgatcagcacgaggaagaacagggtcagcagcgcatactgcgcgactttgttcgatgtcttacgcatccttgctcatcttcctttcgatgaggaactcgatggcgatcaggctgccgacgatcaggaagatcagcatgctgaccgctccggcatagccgtatttggcgttgagtccggtgccgtagttcttgaccagcatggtcatcgtgacgtcttggccgcccacgccgccggttccgccggtaagcacgtatatttcgttgaacacgcggaaggccgcggcgctggacaacagcatgatgagcaccatggtggagcgcactcccggtacggtgacgtgcaggaagcggcggaccacgccggcgccgtcgatctcggcggcttcatagagaccggggtcgatgttggccagcgccgccaggtagatgatcatgtaatagcccaagccggtccagatggtgatcatcatcgcgctgaacagcaatagccagcgatcggtgaggaacgggatatagtccttgattgcgttgacggacttcagcgcggcattgaccactcccttcggggccaggatattggtccacaccaacccgacgatgaccgtggaaacgaccacgggcaggtagaaggaggcccggaagaacgagaggatcttggaattgcccgagaccagggaggccaggatcagcggcaggatgaccatgaagggcaccacgcagaccacgtagagcgacgagttgagcaggccggtgtgtacggccggatcggccagcatcttgcggtattgctccagtccgacgaacgtgccggggcgggcgaaggtggcgtcggtgaacgacaggcgtaccgtgttgatgaacggcgcgatgacgaacaccagggccacggcgagcgcgggcagcacgaacagccatgcggcgaagcccgtgccttcgtggatgcggtgctcctcatccacgacgtccacgccggcatggcggcgagaaccgccgcgcgcggcggctttggaggagctgccgcgcgcggaggtcgtggatccggttggggtggattcactcatgagttcaagtcctcattggcgatcttgacgaccttgtcgagggcttcctgggcggactgcttgccctggatggcaagggcgatctgctcgcgcaggctgttcttcgcgttctcggagaacggggccggggaggcgaaccagtcatcgtcgagcacggccttggaggcaagtttgacggcctgatcctgcatggagtcgccggtcggggagaatgccgggtcttcgacggctcccttggcggacgggaaggtgtgcgaggacttgcagaacttggtctggttctccttgttcgtcacgaattcggcgaacttcagggcctcttccttgttcttggcgttcttggagacgacgagggtctccatggcgacgttcatcttgccgccttcgccgagcagacgctcggtgatgccgaggttcttgtagagttccttggcgttctcctcgaagtcggagaccgagtaggccgaacccgccagcgaggcgaccgacccctgcttgaaggcgtcgccttcgccggtccacaggttgttgagcgcatcggcggacagggacttctcgttgtacatgtcgatgtaatgctggaccagctcaacgcccttggcgtcgttgaaggtgaatgcggtctggtcttcgttcatgagcttggcgccgtactggccgagcgattcgatcgtcggggtggaagccaccatcgtggtgccggcgcagttcttgccgagcgtggaggctgcggcgaagaactcgtccatgttctgcggcaaggcgtcgatgccgcactgggtcaggaccttcttgttgtagtactgcacaccggagttgaggtaccacgggaaggcgtaggcgcctttctcgatgttctcgcctttgaaggtcacggcatcccatgacgacttggtgaactgtttggcggcgtcgggcgcctccgtgctcaggttcatcagcacccccgctttggcgaggctgtaggcgccattggggctcatgtccacgatgtcgggcagggtgccggctgcggcgtcggcgttgatcttgtcggtgtatccgtcggcgggctgatcgatccacttgatcttgacgtccgggttctccttctcgaacgcggcgataaggtcgttgaaatacggcgtgtaggtatcgttcttcaggttccaggtctggaaggagacttctttcttaccgtccgccgttgtccctccgcccgacgagccgcaggcggagacgcttaccagcgctgctacggcgcaggtgatgccgagaattttcttagtgacgtgcatgggttcttcctttccttgatgagactcgtccgatgcgccgagcttcattgatcggggcgtttggccggtgccccacggcttggcatccaccagctgttgttcgtcgttgaaccggtgggtaactaaaccgctttagtatcatcttacaccacaccgcccaagcatcgaaacatcctgcggaaacagcggaaaatcccggacgcgccacccctcttcggcgtgtcgccctcccccacccaagaagcatccctcattggcgcggcatcggtgccgggacaacaaaaaaactccttccttgcacaaggaaggagccaatggggaaacggctatctgcgtctcaacatggcgaaactgttggactcgacgatgaacgccttgcgatcgttcttggccatgacatcaaggacgacacccgtcacgaacagcagcagcccggcgatgacaagcatgaccgctccgatcagcgtggggaatcgggccaccatgccggtgttccagaagtccaccgtcaccgtgccgcacagcacgacgccaatgatgccgaggacgcagccgatgccgccgaagaatgggagcggcttgtattcgcggatcatgcggaaaatggtgcccatcaccttgataccgtcgcccacagtatcgagcttgctgaccgacccctcggggcgatcccgatactgaatcggcatctcataaaggcggaggttgttgttcaacgagtggatggtcatctcggtttcgacctcgaagccgcgcgacaacacaggataggtcttgacgaaggtgaacgagaaagcccggtaaccggtcataatgtcggtgacattggcgtggaacaagccgttgatggaaccgcgaaccagacggttgccgaagttgtggaagggcctcttgttctcctggaagtacgtggagctcagtcggtcgccgatcaccatgtcgtagccttcgaggactttgtccaccatggccggcgcggcgtcggcgggatacgtatcatcaccgtcggccatgacatacacgtcagcatcgatgtcttcgaacatggcgcgaatcacgttgcccttgccctggcgcggctccttgcggacaatcgcgccttcgcccgccgctatctcggcggtgcggtcggtggagttgttgtcgtatacgtacacgtcggcatcgggcagcgccgctttgaagtcgcgcaccaccttgccgatggtgacttcctcgttatagcaaggaagaagcaccgcaacggaaacgttcgaattctcaagcatacgtcttactatagcttctgtgctgccgattttggattttgcatgagtctgtcacattcctgctccctgtgcagaatgaaacgtggaagatgaagagttgtgcggacacgtgcgaatacaatcattagagggatgtgatacaagcgaatgaaaaaacgtgtagtcggttatgacatcattaagtgtattgcaatgttttttgtggtaatgcttcactactcgttttacacgaaattctattcagacggactcgccggaacggcaatcaccgtattatgcgtagtgtgtgtgccactgttctttgccgtgaacggcgcactgcttcttccccgagatatgaatacggtgaagcattatcggaaaacattgaacatcatcattgtggttacgatatggaaattgcttgccgcaacattcttcacccttgttgacggatcacacccggtgacattaaagaatctcgccatcttcttacttggcggaggatttggagattatccgactggatatttctggtttatgaacgctctgattgcagtttatttggtcttacccgtaatgaagatggcctttgatgcagaacagaagatcgcattccatgcactattagcggttttggctgctttcacagtgggtaaggattccctgaagctagtcctacagatggcaggaaccacaacaaatcatgattttgcttcgattgtaaatccccttggagaattctacatcttcggctcgtatggatacgttttactgtatgtcttagtcggaggtgtgattggaagatatctgaagcaaacacgggaagagagtaccgatggcaatgctctgcattttctatccagaatctccccaggaaaagcatgcgtcggtattgcaatctgttacacgctaacactgttaatccaacgatatcaacatgccacacatggcactaatttaaccgtggacaatgggtactggttgttaccaacattcattgcaacggtactgatcttactgacgttaggccaagcggacattcaaggcactggggccaagttcttccaaatcgtcggcatgaacacattcggcgtatacatgcttcatctagcgggactcgtattattgagccgtttgcagtcgttatcgtggttcgaattcatgggaaccatgaactcaattgcagtgactctgctaaatacattattgtgcgcatgtgtatttgctgcatgccttgcaacgtccgcactactccggaatattccatatatcggacggttgtttactttgtgaacaagcatgtatagcccctatggagaaaagaaagcgacaatgaatcagctgaaagcattaaagagaatcgagccacggatcttagttccactgactcttggcataatgttcgccctaggggatgaatcttccaaccccaaaggctacatcatgcagggcagagaatcattgattgtaaaaatagtggtcttctgcgtcttgttctgtgcattgttccgaaccatggacattcttattcacagaatatacgccgcaaaagataggtcgtgtgagagacattgttcagggttcttcgagtatggctacgccataaaaccatggctgaaaaatgcggcaataatcgctacatgttggctgccatatgaattttggctgtttcctggtgtatattggtcggacacttcgaaacaacttcttattcattacggggcagaacgattcactgaccaccaccccttcaccttaacatacatcgttggctggttcgctgatttcggccaacaagtttttcacaatccaatttatggattatatttattgattgccatacagcttattgccgcaccattagttttctcttggatgcttctgtatacaaggaagatgggcattccgcaatggttatgccacgtggaattggcattcttcgcattgttcccattcttcccggtgatgttctcttcactagcaaaagacactatttccgtactgtttttcatccccttctgcatactgttcattgatggtattcgcaccaagggcacgtctctggtgaggccgggaactatcatcgcactgacattatgcggtttgttgacttgtctgacaaagaaggcaggcatgtatgtgataatcccatcaatgctgctgatgtttctgattgcaggagtatcaaagaaagcaaagaccattgcattcgccattggaaccgcgattgctgttgtcatgataatcatcattcctaaaaccgtcatgccgacactcggcatcgccccgggaggtaagcaggaaaccataccgtttgctattcagcaggttgcacacgatgttaagtataataataaggacatcacaccccaagaaagaaaactaatttctgattttttaaccatcgattacaagagtattcccactgcatacgatccgcagattgctgatccaataaagggaaccagtctaaggaatcccgaactcttcaatgatttcattaagttgtggcttaagaagactgcggaacatccaattggtcatcttgaagcatggatggggctggtacatggttggttcagcttctccaacaatgatggttcgccaaacgatatggtggtttgcactgaatccgcatggtattacgaacctattctgaaatatgttccgcaatggccactgaaggcgaacagaagcgataccgcacgttccgtgtacaacatggaacagagtctgcctatattaaatgccctgttctcccgtgcgttatgggcatctattctgccatgcttcatgctgtacctagccttacggcgcggtaaaggcaaatggagccgtgtggcttcaatgcttccagtagatatgtcattcgcctacctactgttggtgcccacgtccggcatgggcggggagccaacacgatatgtgctacagctaatctgtatcgcgccattattccttgcatttatgagcacgacgaccaagtctgacacaatcaggtaatcaacaataagaggtgggactgcaatcccacctcttattgtcattgttcaggctcgccttgttccagcagggacaatgaaatacagaggaacaatgggagcgtgtatacaagcggaagcacgtaacggacagcctctccataggcagatgtaggtcccgcaaccagtgtgagcagggtaaccatgatcggcatgttgagaatgagcatacgccaccagcttctacttctcactgagacaaatataaggaagaatggcagaatggacgcccataacgatttctggaacagaacacctgctattggcaacgttagcagcgtctgttcgtaaaattttccaaaagcctgtccgcctttagtggagtccggccatgacatgaactggttcactcccggatgatgatgagaagagcccgataataccaccatgctattctgcttcgctccgtcttctgaggcaacggcaaacgaaaaccaagatgcagaaaggccagcccagccagcggccatatccgtaggatgcgtcaataactggcgcaaccagagtttcccgagtttgtgaacgtcttccggaggaatacgttgtcctttgatggggtcagatacataccagcaatatgccccgcgcaaacgttcagtatcttgttgatatatttcctgaatttcatcaagctctttattactaagggaactcggatgattgcgcacgacattcgctacttgctgcatgggaacagcaagcatttcactattttccccaggttcaatatgaagaaccgggaaaatgaatgttggagcgattaaacctacagtaagatatggaataagcgcgatggccaccactcccgctttcataagccatgtcttcacgatgaatgccagcagcagaagactgagcatgataacatacatgccagtttttttgacggcagaagcaaacactatatcaacaatcaacaatacgtcaaataagggtgatgcgaggacattacctcttgtcatccatatctcgcagaacatgattgagaagaagacgaaaagaggtgttgcaatagtatcttttgctaaactcattgcaagacaaggaagaaatgggaataacgcaaaaaaagcgattacgataaatcgtatcttccaaggaaccttgaatcgtgtaagatagcatgtcattgaagcaagagaaagcgcagaaactgctgcttgcaaaatcactaatatatataatccatatacagcattatccaatagggatttacctaggacggcaaagaaccccaagaggtaagtaagcgcgaatggatggtgatcagtaattggtgtgttcggatcaaaaaactggacaagctgccatgaagtatcaagccaataggttccagggaaaaatatgatagcataaggaatccaacatatactgattattccccatgagactatgacagactttagcgaccagtcgagtttaagatgcttgcaaaagtcaaatggcgtatcgaggttacagggatgtctctttattttctttaccagttttatggcactatgaaatatgatgacgaatagtgccgcaaagaagatgacatccgcataaaggatgatgttccttatctccagcgttcctccatggactccaacaaaggaacacactccgaacaatacgcctagaagaatcggcacaaggtaggcgactcgtttcgacgttcttactgctcgaccttttaagcctttgttcacagtgataaccttctcaccagcgtcaacgcctaccgcggattacacgcgcaacggctttcaatacgtcgcgacgtctggaaccaataggcatcaatggatcaacaaacttacgaatcggattatcttcaccaactgcacgctcatgcttcggcaagaaaacttcttctggaatctgtggctcgtttgccagcaccacgcgcttgatcagacgttcgtagaacggtgtttcgcgggcatagcgccagtagatcgaagagtaatcgcaatccggatccacccaaggtttctgataaccggcgtaatggataatctgcggattgctgcgcgattttacgtaggcgtcataaacatcattgggtgcctgcgtaaacaggttgccaacgcgcccaccacaatcgtgcaccacattccactcccacggaaggtatagcactttgccctcgcaatatgcgttcaacacatcctgatcattgtagatgtaatttgggttcgatgcgtaagtgagccattgctcgatagagtaacgattacgcatacccttcgtgttgaggaccagcactccagcttggaagtaatcgtatggattcttcatcttcagcacatccttcgcatatgacatacgcttgccgtgcttcacgtttaggttgccaaggaagtcgatgtcgcggacagcccctaacaggttgtcctgaagatcgatgtcatacagcttcgcaatatcaccaacgataatgatgtcggaatcgagatagagcaccttgtcgtaattcggcaggagttgctgaatgaggaaacggtagtacgtttcgatactgatatgcgcattgtttgtggacaaatcgtagccagacagctcacgtttcacattcaggaaccgcagactcatgttcggaaactgctcgaagaagcgccacatacgctcttgcttgtcccctgcgatatcctgctgcaacactacaacatcatagaaatatgacggatcagcattcttcatagccgaataaaccgtagtggtgagctgtggaacataattatcatccgcggcgaacacgactggaacgatcggcttgtcgaacacatcaagcggcttcagctcttcagcgggttctggattggtgaagtgtacgcactgcagttctttgaaccgccagttggaatcgacgcgcttgtggtgtagcaggtagatgttcagcagacgctcggaaagatgcccgggcgtgcgcagggcttccctgctgtagtggctgtagtcggtgttcctgtcgaattcctcaaggattgggaacatccaggagcaatagtcgaagaagatttccctcttcatgatgaacatgttgcagaagcaggctttgttgccctcgaagaaggccttcgcatcctccttgtaatcggggtacatgctgcacaggatctgatagcaacgcttcagatcatcatcgtaaagcaagggagcagcctcccacaatgcacgcggagtcccatgcttgtcaatgatttcctcaagattgccgaagggtgtggtgataacatcgtactgcttgaccactttggcgatgttggcatcgttgagaccatattttcgtgcggctttcgcatcgatatagtcatccatgatttcgccatacggattctcctcatgcggggtttcggagaaatcgaagtacctgcggtaatggcagaaaccgtagtaatcggcgttgatgttcttccatgcccagtattgcgtagtgagttcgcaatagcgtggattgcgttcggaaatgttttctccgtcatcatcatggaacgcccaagggaaacggtagctgccctcgcgcaggcctacctgtacaggctgcatgatgacgctatcgaaggtgtcgacgttcttatgcgtggtgacgaagagacgaatgcgttgctcgttgtacttctggaacgtttccgtattgcaggtcttttcagtgagctcagacatatgatgggtggcgacctgtttcatttcatggaatcggatagaatcttcggatatctgatcggcgggaacggtgatggcattggccattgcgagccagttcggtaaagtattgtccggggcaatcaattgatctgcggaaagcagagcgtaggctttatcacgtacgaagcggtaaatctctcgaccggtgattgccgggccgaagacctcctgcatggattccaacgcttcggctttctcatcttcggggatacgaacagcccagtcgttcgcgagaatttcggtggctttacgctggaatccctgtgcacatgaacgcaacatgtcggaatgctgtgcgtcggcgaactcgtatgacgcatcgaaatccgccttgaaatgttcacagtactttgcgtatttctttgcgctgatggtgttggttccgctgatgcctcgtccgtagtaatacacgtatccgcggcagtgtttgcaggaatggtaggtcttcgcgaaggcggaaacgacaaaacattcatagccgtcctgggaacgtccgagcctgtccttggtcatcgcggcaaatgcttgcttgaggatggaagtcttgtagaggcgctgggttacgcgccaatccactttgtaacctcgggactcatcgaagatatcgcgaacgatatcctctcccgatgaatctggtatctcggtattgttgaatgcttcaaatgcttcctgttcggattgcagaaggtcattggcaccgattaccgtcagaccataatgaagaatatctacggggtgctgagacaattcctgcacgagctgttcgcacatgtcaggtttcagtgcatcatcaccgtcaaggaagaacgtgtattctccggtagcggcctctgctccggccatgcgagtgcgatgagtgcccatgttaggattgttggcaatcacgcgaatgcggggatcctgcgtggcggcagcctctgcgatctgggccacgtcgtcggtactcgcgtcattgactacaattgcctcgatgtcggagaacgtctgattccgtacggaatcaaggcattcctgcaagtacgaacctacgttgtaggcaggaatgacaattgaaatcttaggcattgattcttccttcagggagcattgatttgcaatattgatgctagatgacctttacatatttaatcgtcataagaaatgagatgcattcgcatggcacggtcattcaacaaggcataatctctcgtattagctttatctctgacagcgaaaagcaaagaattatcgtcattagtataagcaatcatatccgttcgcttatcatcttctaagttctcagtacggaaagaacctacaagacgaaattcgccgttattaaacaaagcgaggggcatatccatgtgtaaaatatgatgacccttctgaactttgaggttcttctgacctgaatcataggggattccgccacgtttaatatcgttcattgcaattgcgatgtagccgtcatcgtcattgtattcgtattcaatgtcgaatttgaaagtatcagaacaattagcaacagttggtgaaaccggaatgaatcggaatgtggggacacggtcgttgagtccttctggatgttcattctttttcggacgactgtgcttttggtcacttctgatgttttcgagagtgtattgatcagcaactgagtctttatctcctgaagcaatgatattgccatctttgattaagatagctttattgcaataacgtttcactgcgtccatggaatgcgtgaccaaaataacagtttttgtcggatccctcttgattttagtgaagaaatcatcgcatttgcgctggaacgcctcatcgccgacggcgagcacttcgtcgagtaccagaatgtcaccttgtgccttaatggctacggagaaagcgagacggacctgcatgccggaagaatagttcttgagcttctgatccatgaaatcctcaagctcggcgaattccacgatgtcatcgtacatggcatcgatttccgtgcgggtgaagccgagcaacgcgccattcagatacacattttcacggccggtcagctcagggttgaatcccacgccaagttcaatgaacgggaccagcttgcccttgacggtgacggacccctgctccggagtgtaaatctgagaaataatcttcaacagtgtggactttccggatccgttacgcccaacaatgccgaaaaagtcgccctgctgcacctcgaaattgatatcgcgcagcacatgttgctcggtatagcctttgatgcccttcgtccaattcagaaacgccatcttcaggccggtcgcctgctcggtgggtaaacggaacatcttggccacatggtcgaccttgagcaccacaggacgttcgtccacggttttctcctgcgtcttctcagccattgcaacttcagccataatcagagcacctccgcgaacttggagctgtacttgcggaacacatgaatacctaggcacaaaataaaaacagacaacgcatatggcagcaggcacagcagcctgttatcgaccatggtccacactgttggcacgtattccggggaaagcagattgtgacgaatatccatgattatctgtgtggaaggattcagcatgagcaatttaccagcccatgcgaactccggattattggccaccatcgaaatcgggtaaattataggcgtggcgtagaacatggcttgcagcacgacctcccatatatgcgccacatcacggaagtacacgaacagcgaggcgagcagcaatgccacgcccaatcctaagcaatacagctgaatgatgttgaacggcacgagcaacacgcgccaggtgtagtgcgcatgggcgaagaagccgaacaggagcaccacgcataggttgatgcccaacgaaatcatagaacccatcgtggtggacgccacgatgatgtaattcgggaagtgtactttgcgtagcagatcaccacgtccaacgatggattgcatgcccatgctggttgattcggagaagaagctccacaaacaggtaccgcatagcaatgaaatcgggaaggttggggtgccatccgagaacttcaggaacttcacgaacaccacatacatcacggcgaacaacatcaacggcttcagcacggaccataccatgcccaggaatgatccctgatagcgcagctggaagtcggtcttcaccagttccttgaaaaccaccatcgcgtagtggtacctcttcttgaggctctcaaaaaaatctttcacgaacattccatcctactagtgcgaagcgtttggacgcaaaatcatgtggcagtgcggttgatgcgctctccttcgacagtactctcatatattctagtgaggaaaggacgtttgtcttagtaaggcggaatatctcacatggttctcacagcggaacagcaccattcgaacatccgaatcttcgtgtcggcacataagcaggccacgtttcccaagggggagagcattcttccgatgcaggtaggcgccgctcacgccacgacccgtttcccgaacaccttgcatgacgatgaaggcgagaacatctctgccgaaaatccgcggtattgcgagctgaccgcgcaatactgggcttggaagaacgaagatgccgattattacggtttctgccactatcgtagatatttcgatttcacggataccccacataaggaaaacgattacggcgaaatcattgactcatatattgatagtcgcacgattgccgaatatggcatcaacgacaaggcgatcgcacatgcagtggacggatgggacatcatcaccacaccattgaacgatgttcgtcgtatcggcggattttcaaaccttaaacagcattgggacgccgacgagcatctgcggctgaatgacttacgccatatgtacgacattctgtgcgagcggcatcccgattacaagatggatgccgatgccgtactcaacggccgcaccgcagcattctgcaatatgttcatcatgaggaaagaaatcttcttcgaatacaacgagtggctattcccattgcttgacgaattcgcaatgaccaccgacttcagcaagatggacatgcagaccacgcgcaccgtcggccatctctccgaacggcttttgaacatctttatcgcacacaagcagcgcaccggcgcagactggaaaatcaaacgactgcaatgcgtgcattttctgcatccagagccgaacgcgatactggaaccggtagggcaggagcgtggacgtgtggtgccggtggtgttcgccgcggacaacaattacgtcccgatgctcaccaccaccatctattcaatgctgaagaacgcttccacgaatcgtatgtatgacgtgatcgtactagaacgaaacataaccgacgagaacaagcgctacatgcggcagttctttgcaaggttctcgaatgccctgattcgtttcttcgacgtgaaccgctatctcgccggattcaatctcactaccagcaatgcgcacatcagcattgaaacatattatcgtttcatcattcaagaagcgttgccattctactcgaagctgctgtatctggactgtgacctggtggtcaatggcgatatcaccgaactattcgataccgaactcggaagcaacgctatcgctgcagtaccagatattgatttcattggaaatctcaacatgaagaacggtgagcgtgctgaatacgttcataaacagttgcacatgcgtgacgcatatggctacttccaagccggtgtattggtaatgaatctcgaccgcatgcgcaagattcacacagtgcacgaatggctagaaatcgcttccagaccgggatacatatacaatgatcaagacattcttaacgtagagtgtgaaggtcttgtcacatatttggattattcgtggaacgtgatgcacaattgtgcaggccgcattgctggagtgttcgatttcgcacctgcctccatgtacaaggcgtatatgcaatcacgtaatacgccaaaaattgtgcactacgcgggctttgataaaccatgggaaaatccatggtgcgatttcgcaccgctgtactggagctatgcgtgtgaaacgccattcgcggcacaaatggttgccgcaatgagcggcgtggaacgccccgccccaccagaacaccacgaacgcgcaattgccgaagacagccctatgcgcaagtatgtggatgtgctggctccggtcggctccaaacaacgagaactgctgaaagtgatagcgcgcaaggcgcagggcaaacggtgagacaggcagacaagtcaccggttgttgacgggggcttcgtgtcctcgtcaacaaccgaccatggtttcacagggaagaattagtccctgcgaaacagatcgcgggtgtagaccttgtcgctcacgcccagcaaatcgtcattccaacggttggctacgatggcagacgagcgggtcttgaaatcagcgagatcatgggtaacctcactgccatggaaattggattcgcgcaatgtgggctcatagatgagtacggggatgccgttcgctttgaactgcttcataacgtcttggatggcggactgacggaaattatcggaaccggacttcatggtcaatcggtagataccgatgatagggttctgaacattcctgacaagttccatcacctcagaggctacgaattccttgcgggtacgatttgcgtctacaatggcctcaatgaggttctgcggaacctgactgtaattggctaacagctgtttggtgtccttcggtaggcaatatccgccatagccgaagctggggttattatagccgtcaccgatgcggggatcgaagcaaacaccctcgatgattgcacgcgtgttgagtccacggctttccgcataagtatccagttcattgaaatacgccacacgtaacgctagatatgtgttggcaaatagtttgatggcctcagcctcggtgacgcccaccaccaatgtgggaattccggtgctgccatcatgattaacgcgagacatctcagcgggatcagcaccttcaacgagcagggacgcgaatcgacgtgccgcttcgacagactcagtatcattctgcggggtgccgacgacgatgcggcttggatgcagattgtcgtacaacgcgtgtccttcacgtaaaaattcgggggaaaagagaatacgatcatcctgaaggttcttacgtaactgttgcgtatatccaaccggtatggtggatttgatgataatccaagcattcggcgcatatcgtctgaccgatgtaatcgccgcttcgacactggacgtatcgaagtaatttttcttttcgtcatagtttgtcggcgtggcgatcaccgcgaaatcagcatctctatatgcctcctgcggatctagcgtggcatgaaagtcaagtattctttcgccaagagtgcttttttccaagaaatcagtaattacagaatcgacaataggacttttcccattgtttaactgctcgactttctcgggaatgatgtcgagtgcatgaacttcattgtgctgagcgagcagcaaagcgacagacaatccaacgtagccagtccctgcaaccgcaatcttcatagtgccagcctttccttacgcaatcctaagatattgtagacgcaggtcactgcaacgaatcaacgtagccagcatcttccaaatcgcacatgccgacgttcatcctgtacgggcgaaccggtaaccaatgcacatttcttgatgggtcttgcagaacgacgagcgaatacggctaaggagcatcccgaaaacgtaattatcgcgtcattcatgaaaatcaaaacacgtcagcttccaaggacagaagaggcacgaaaagctcgcacggacgcaagatggcgtccgcacccggacccgaaccccgcagcagttggcatgcgacggtatgctggaatggtgaacagcatggcgtgcggcggcgtattcgagccgcgtaatattctggtgactggcggatgcggcttcattggcgcgaacttcgtgcgatacgtggcgcggaaccatccgcacgtgcacatcaccgtgctcgacaagctgacgtacgccggcaatccggagaacatcgccggcctgccgccgtcgcaggtcgatcttgtcgtcggagacatctgcgacgtcgcgctgttggagcgtatcgtgcccggtcatgacgccatcgtccacttcgccgcggaatcgcacaacgacaactccatcgccaatccggaaccgttcatccgcacgaacgtggaaggcacgatgcggctgttggaggccgcccggaaacacgacgtgcgcttccaccacatcagcaccgacgaggtatacggcgatctggcgttggatgatccggcgcgtttcacggaagacacgccgtaccacccttcaagcccgtacagtgcctcgaaggcgtcgtccgaccatctggtgcgcgcatgggtgcgtacatacggcctgcgcgccaccatctccaactgctccaacaactacggcccataccagcatgtggagaagttcatcccacggcagatcacctccatcatggagggcgcgcggccgaaactgtacggcaccggcgagaacgtgcgcgactggatacatactgaagaccactcccgcgcggtgtgggcgatcctcacccgcgggcgcatcggcgaaacgtatctgatcggagctgatggcgagatgagcaacatcgccgtgctgcgcatgatcctgcggctgatgggccagccggaggatgcgttcgactgggtgcgggacaggcccgggcacgacaggcgatacgcgatcgacgcatccaaactgcgcgccgaactgggctggtcgccgatgcacaccgacttcgccggcggactgcgcaacgtcatcgattggtatgcggaacaccgcgactggtgggcgccggccaaggaggccaccgaggcccgctaccgcgcgcaagggcagtgaaacgacggctgctacaggcggcccttccgcggcagagcgacgttgcgcagcagacgctgcacaggcttaagcaccacggtatcggcaatcaccgcaaatagcagcgccaccaacagcgtggcggcgaacatcagcacgctgatgcccgcgtacgaccatccatccgtgggcgcgggaatccgcgggccgatcagcaccttggacaggggcgaatgcaccagatagatcgtgtaggagtaccccgccagccaggtgatcgccctgcgcagccgcgcagacgccggatgcacgtcgtaccggaagaacaggaacaccgcggccaccaccaccgcgaaggaaaccgtgagcgtgcggcccacctggatctgctggccggcgaacaggtacggcgtggcgacggtccaggccagggcgaacggcgccaacgcgtacaaaccgcgccgcgcccgcgtggacggcggatagtattccagcacgaaaccgagcagatagtagaccagcagtccccgccaggggaacgactgcaggaacgtcaacgggtatccggcaagattgcagatctgctcggcggcggccacggcggcggccagaccgatcagcagccaggcacccgatcggcctatcgtacgcatcatcgcggccaggaacggcgtcgccagcacaaacccggcaagcatgaatacgaaccaatagacggaatcgtcatacccggagaacaaatcgaacaacgttccagacacagcgccgccaaccgaacgatgatcaatcaccaggtaggcgacgaatcccatgccgcccgcatacagcagatacggcacaatcagcgagacgaaccgtttgtagtagtagcgcacgtacggcgcgaggctaccgggatcggcttggccggcaccgccgcctgtccgggcatcagagccagaacccggcaggttgcccaacgagcgggtgctccccagccggccggcgtcgcacgtcaggttgaaccggccggacaccatgatgaacagcggattgcagaccatgaacaacgcgaacagcacggatcgcaccgtttccgcgccgccggtgagagccatcttgacgggcatgtagttgttgatcacgtggacgccgatgaccaggcacatcgccaccacgcgcaacagatcgtagttcacgtcgcgcggccggccggcggcaccgacagcaccggttgtaccggtcgtaccggcggcgtcggaaacggaatcgggcatggtcatcacatggatcccgccaaggacttcagatcgaccgggcagctgatctggctcttcagattgtccaaggtgtccaggccggccgcgggatcggaggacgcgcccttatgcgcgtcgttcttgccgccgttcgcaccatcggcgccgttcgcaccattggcgccgttcgtatccgccgagcactcatcagtcaccttgccgttggagcccgtctcgatgccatccgcattcaccaccggcgtggttaccgcgttcagtggatgtgtggcatcgctgctgacccgaacggtataagcaatcgtcaattcttttccgggctcgatccactgctggttgaacataatgtactgacggtcatacaggctcgcggtgttggtatcccatgaatctatatcagcctgcacagcggtgatttcgccaccgtacggggcggtaagcaccacgcggtacaacatgccgccgagcactggattctccgagccgccattaacgaaatcaggcaacgattcggccttagccttagtcagcgtgttcttcatggtgaaggtgaccgtgtattcgtcaccgagctgatcttccgtaaactgacccagctgcgtgttacgcacggctgtcgtgatgcgcttatccagcacgccagaatacagggcgttctggctggccgagacgtcaccgcaagtctttgtgaccgtggtggaggtcttcagataccaatcctgcttgccttgctgcagctccgaaagatagatgccggtttcaggcacctgactgtcagcagacagctcaccactggccttatcgtcgataagtccggtggcaatcagcgcctcctgctcatccggatcagccatccatagcttgaaatgaccgctagcgctggtatctctgattgccttcaacagcggggatgcggtagaggcattcgcgttgccaagcacgtggttcatgatcgcctgcgccgcttcggaaacgaagttgttctgctgctcgaagtccgggtaatccgtgtacaggtctgaagcgaagaacggcaccgtggtggtgccatccagcactcggccgtccgaaagcttgaccttgcctgtggctcccagcaatgcctggaggaatacgggatcgaatgacaatacacccgctacgttctcgtcttcgtggcctttctgatacagccacatgtatttgttcatctgtgccacacgctggaattcggggtcgatggtcgtggtggccgggtactggtcaaaagtgtcgccaaatacctggcgctccttcagcaccgtagcatccatcggcttctcaggaatgtcccaaccagaagtggtggcgaaatcaccgatggtaatcgtgcccttatctgccgtgattgcggcgatggtgcccaccatgccgcccgccgaacgcagctcggccgggttctgcaccatcaccaaatacgtgcgcttgccgtcctcgccaagcagttgcggtagcaagttaatgaggccatcgtattcgctgagcatcgaatccacggtcttgagcgcagccttttcggattcgagcacggtggccaccttggcgacgctcggagtcggcaccttgttgagcttggtgagctgctgcgagatatccttatgcgcctgcttgacgatattcggcatatccatcagggcgctgacgtccaccgagccattcttcagggagaagccctgcaatcgtttggacaggttcagcagatcagtgaacggaccgttgaccagcgtatccacggaagccagcatttcgcgggcagcggtgatgtcgctgccaaatcgcgaatggtcgcggaagaagtcccactgcgggccgttcagctcctcgttgagatcattggtggcattgaccaactcttgggagatgtccgacagactcttatcgctgccgcagccaagtgccgaattggccagaccttcggcggatgtcagcacacgctgtgcatccgtggccattctcgagacggatgccgcgtagagcgtgcccacacaggtgacgctggccagcaacgtcagcagcagtacaaccaccactcgcgcccatatcggtgtacggctgaccagcgaacggccgttgccacccacgtgctggggagtcttcaggtttacgggacccgtctgctgatttgcagcgctattcgtagatgcggagcgattggatttcccgttaccggcatggcggcttctcctacgccccacagccttatggctcgaatgccctgaagtgaatcgcatacttatcctacccgaaaatctgctcggctcatactcttatccaacggcgcaaggccacgcttccggatgccggactccgggcgaatccggaatcgcagacatgccggagcacacgtgacgccacgcatatctcatgccagtgtaccgatgccaccgaaatagaccgagggtttatcccataccgagtgcaaatcccctcatgaccaccacatcgctgtcagaatgttctcagacttcattgaggggtataacagtattgcgcaagaaaacggtcactaaacgcaacaatagttaaagccgtattgatctgttcggcttaggagaacgggagaggtaattacatgttcgtcctcagcaacgcctggcgggccctgacacattctaaaggacgtacggccctgaccgcgttcatcaccttggcggtcaccttcggcacagtcgccggactggccatcattcaagaagataccaacgcacacaccaccgcgtacgatcagcagaaggccacgttggccattcgcccgactgcggctacgtggaagaaggtctccgctaccgatcagtcctccaccaggcattacatgacgtggtccacctacaacgagtacgccgcgctcatccagtcggccgtcagctcgctgaacttcacgttcaccgagaccgcgccggcgcgcgtgaacggcgacctgaaggccctcgacggcggttcgctgggcacggccggagacgatgcgaccggcggacggctcatctggcgggcgttctggaccaaggacgccgccacggccagcgacctcggcgcctacgccatcgtggacggcaagaacctgacctacgacacccagtcctccaacccggacgccaccagcgcactggtgtcgaaggcgttcgcctccgccaacggcctgaaggtgggcgacacgttcaaggtggcgaccgcctcggatccctcgaccacggccgaactcaaggtgcgcggcatctaccggtacacgtccggatccaccgtcgacaatccggtgacggccgcccgcaaccgcgagaacgcgatcttcaccgcctatccggccttctccaaggccggactcgacccgcaaagcgtcgaccagaacacccccggctggaaagtgcccgacctggacgtgacgtttgacgtcaacagccccgccacataccgggccttggtcgccaacctcaagaaggccaagctgcccgccaagggttacgccgtgtcctccccctcgctggaggcctacaccgcctcgctgaagccgttggacaagctggcctcgcgggcgaagacctatacggccatactggccggcgtgggcgtcgtgcttctgctcgtcatcgtgctgtcaggcgtgtgggcgcccaagcgtgacgacgagatcggcatggcactggtgtccggcgtcactcgcgggcgtttgggatggcagttcatgctggaagtgttcatcgtcaccctgcccttctacgtaattggcctggtcggaggcgcgttcgccgccaagccgatcggacctgctctggcatccggccatgccatcccggtgacatcggacctgatttggaccatggtctggtatggactgggttcaatcctgatcctggcgattcttgccgccctgcgccttgcgttcttcagcgcgaacaagctgttcgccgccgatggcgactggggcaccgtgagcgagactgagacgatcgaaacggccgaaaccactggcgctgctgagaccgatgaagctgctgaggccaccgctcatgatgctggcgaggccaataagacgaccaccacaaccgacgatgcggaggcacaggcatgagcgacaagaacaacgatcaggaactcgagaagaccactgacgcaacggctgacgaagcgacttctgagactgagacgaacgacgccattgaatccgttccagctgactccgtgcagttcagcgtgaccttcgatgacgttgatgacgaaggcactgttgacgatggtatttacagcgcactggcatctgccgaaaccggagcaaccgacgagaccagcgaggccgaagcagacgccatcgcttcggccaacgcatccgccgaagtgaccgagcgcaatgccgcccgcgtcaacgaaacactccgactggccaaaaccgatcacaaagacgcattggccgagcatgcggagcctcagggcaaagcgaccgatcccaccatgacgctggcctcgcgtatcgatcgcgtgttggtgggcggcggttccgacgacattctgctcaagacctacccgacctttgccctgaacaaggtgacggtcgccggccccaagggcaaggtcaacatcctcgatgacgcgaatttctcctgctattccgggcacgcatacgcgctgctgatcagcgacgaccccgattcgggcatcaccgccgacgccaagcgtcgcgcgctgatgggcgtgatgagcggtttgaccacgccggcgtctggcacggtgatgaacaagagcgccaacattgttgagctcgagcccgtggaactacgcggccaccgtctgggcatcgtaccgcagctgcacgccgtgcaaccgaatctcgacgccgaacaaaacgtgcggtacgccatgaatgcgtccaaccgcaacttcctgaagcccaagccggtgatcgcccgcgaactgctggccaaggtcggcttctccgaggccaccagcggcgtggccgtcggcacgttgcctttggtgcagcagcgtttggtggccatcgcccgtgcaatcagcaccgaggccgaagtgctaatcctcgacgagccgacacgagggctgaacgcggatgacgaggtgaccgtgttcgccgcgctggccaagctggcgcacaccggtgacccgaagcattgcgttatcgtgctcactgcgtcacgcgagatcgccgaagcagccgacacactcttcaagatctgatgttcagaccatagaacccctgtgattcgtattgccgaatcacaggggtttttcaatgccacggctcattgccgcgctaatctgaggataaatctgaccgtacgaggcgaaacctgataatcatgaccggatatattcccacactggagcagatcgacgaattgcaccgcaaaatcgcgccgtccaaggcggcgtacgagctggtgcacacgcattgcgtgattgtggcgaccatcggctgccagatcgtgcgccggcagaacgcgctgttcacgcgccgctgcacattaccgaaggacgcggaggtaccgcccaccgcaggcgtcaccggcggtcatgtgccgccgcgtctgctcgatgagcatttggtactcatcggcggactgctgcatgacatcggcacctaccgcgtgttcaagcatgacggctctgacggcgaaccgctcaaattcagcaagaaacgctacattctgcacggtcttaagggctacgagtatctgctcgacgagggcgtggacgagtccatcgcccagttctgccgcaaccataccggcgtgggacttacgcgcgaggatgtggtgtgccaggagctgccgttgccaccagccgactatgtgccgatgaatctcgagcaggaagtggtgatgtacgccgacaagttccatagcaagtcagtgccgccgaagttcctgcaggtcgaggcgtatacggcccgagccgagcgatttggcggagagaacaaacagcgatggctggatctggtggccaagtatggcatgccggatattccggcgttggcggagaagtatgggatgcggatgatttgaggctcaaggccctcgtcagagacggcttatgaagctatttcagatggaacggagacggtaggtgccgttgcggttggaggcgatgatcatctggtcgttctccagcacgttccagccttcctgctcatagccggaagaggagaccaccacaccggcggagtcgccgttgtcgtcgcgcagctcacggtagcgcatcacacggtagtcggcggcctgcgcgccacggccatactcgtcgtagatttccacgatgcgcgggctggtcttctcacgaccggcggcgcacagggcgatgagctggtcctcggactgaatcatgcagttgtagctggacttcgggtaggcttggcgcagttcgcgcacggcctgggccacggcctcgtcgagcgggaagccgaaaccgatgtattccagaatcactgcgaagaagatagcggagtcggaacggccgccggtggagaggaacacactgtggttcaccgggtatgaacggttggtgacgatgttgcggccattggcgtccgagatatcgccgttgtggatgaagctcaggccgttcgcatagaacgggtgctggttctccatgatgagcggcagattggaacttgccaagcgcaggtgccagatggcaccgcgagacggttcgtcggccagcgcctcaaacgtgctgtcatgacgggccgcgatggtcgacttgtagatgcgcgtaccggtttccggggtgggcgcgccgccgtcgcgcacatgcggcgcttcggcgggatcggaaagctgggctacaccccagccatcattgtggatttcagacagttcgcggaaatcgccgacattgtcccgacccaacaccgcgttgaggctcaggttgaagcctgccgtcgcgtatcccagtaatctgcacatggtatttcaacttaccgaaaccgtgtggcgacgtgcggcgactgttataggcattctttatagagcgcatcagcgccgctgcaaactggtatgttatcgcttctgtttggcggagcgctgaggcttggcggcgggtttgccgttcttggccttgcccttatcgccctgctcagcgaccgcagcggcggcagcggtctcagcgatcttccgctcctcggccgatacggcggcatcgagctcctgtaccaatcgcccgagcccggacgtggtgtccatcgggtcggggacggcggccgggtcggccactgcccgagtcggcgtgggcgtcgggatggtcttggccgtatcggtgcgcttcagacgcggtgggcggcgggtggagacgaacagcggctgcacctcgaccagcgggttgtaaggtgccagaccgaaccacttaaccggcgagccggccatgcggcggattgcgtacttggcttgcaacgacagggcaccgcgtgcggaaaccttggattccggcatcagggccttgtgaatcagcacgtaacggatggtgccgatgtccggatcggcgtcgaccttggggtaaatcgacttctgcttaggcagttcgccggttttggacaggtcgtgcatgatttggtggatgtacgccgggatggactgcgaaaccttgaatcccaaacggaagcgcacgcggtagatgtagttcgtgccgaagttctccaccgagtattcacgggtgaacggctcgtcggtggtttccacgctgactgcccaccaagcacgggcacgcttggggtggtcggcgaagatggagaagaagatgtccgtgtcgagtcgcttggtttccgagtcggaggtcaggtacacgatgttgtccgcaaaatacgggatgcggaaatcactgtgcagcttgtcgagcgcgggtaggaagtcgttgggccgcatgtgacggcgttgcgcacgttcgagcttggtgccctcattccacgtgtacatgacgaacagaatcgcggcggtcagcaacatggtgaaccaaccaccatgcaggaatttggccatagacgcgatgaagaacatagcctgaatcgccaagaacagcacggtgaacacgatggcaccgacccgcttgccggaatgccagatgtgcacgccgagcagcacggtggtggtaatcatcgtaatggtcagcgccaggccgtacgcggcggagatatgctcggaatccttgaagatggcgagcacggcgagcgtggccacgcacaacacgccgttgaccaccggaatgtacagctggccgcgcgtacgggccgggtaacgcacctgcagatggggcatccagttgaggcgggtggcctcggaaaccatggtgaacgcgcccgtgatcagggcctgggaggcgatcacgccggccgtgacggacaggatcacggccaggtaccgcacgttcggggtcatcatctggaagaacgggttgagcgacttcatcgcggtgtattgctggttatcgctattggccagcatccacgcgccttggccgaagtagttgagcaccagcgcaaccttgatgaatggccaggtgaagtagatgttgccgcgccccacgtggcccatgtcggagtacagcgcctcggcaccggtggtcgagaggaacacagtgcccataagggcgatgccggcagcattgtccgggctgaacaggaatttgatgccgtacaccgggttcagggccgcgaacacagaccagtcgttagagagattcgtgacgcccacgatggcgaggaagctgaaccagaccagcaccatcgagccgaatactttgccgatgcgttcggtgccgcgcgactgcacggagaagagaatcacgatgatcacgacggtaatcatcagggtcaggcttgggttttcgtcgaacaacccttccaatggcggcagggtctgcaagccttcgactgcggaactgatggaaaccgccggagtaagtaccgaatccgcgaggaatgccgcgccgccgagcatggcgggaatcgcgagccatgcgccgtacttgcgaatcaacgagtacagtgcgaagatgccgccttcgccattgttgtcgatgcgcatggcgatgagcacatatttgacggtagtgattagtgtaatcgaccagaagaccagtgacagcatgccgagcacggcctctcggtttacgctgccaagccctccctgaccggcaaggaaggtctgcgcggtgtagaggggcgaggtgccgatgtcgccgtacaccacgccgagcgccacaatcgccatgccccaggtaaccttgtctggactggattgcaagcgggcccaccatcggccgaggccgcctttcgaccatgcgctggcgattttctcggcttccttggtttcggcttccctctgcttggcgagtgccgcgcgctcctccttggtgagagtgcggcgggacaccttgggagcgttggtaaaggtgtcggccctcagcagtgcttcttcttcctgtcgggccttggctttggcggcgccagcctgggctttctgggcctttgaggcttcttgggcgcgtgcggtcctttggttcgactcagccatacgttcagtcctccattgaggtggagatcatcccctcgcttatgtcaggtacatcatggtagacctcgttcacaattctgacaaattttacaagtcaacacatcgtctctacacgctccgcgacggccgcacacccggccctcacagtccgtatacggcgcgggcggtatcgcgggtgccgcgcgccacatccgcgatggacaggtcgagcgtatcggccatggcccgcaaggtgtaggggatcatgtacggcgcgttggtgcgcccgcggtagggcatgggcgtcaggtacggcgcgtcggtttcgaccatcgcatggtccagacccacgattcgcagcgattcgcggatgccgtcgttgcccttgtagctcacggtgccggagaagctcagataccagccatgttcgcgcgcgatctcggccatctcacggtcgccggaatacgagtggaatacggtgcgttcgggcgcgccgtcggccagcagggtttcgatgacctcgcgatgggagtcacggtcgtgaatctgcatgggcaggcccagttccttggccagggcgatgtgcgcccggaaagcctcgcgctgcagttccttggcaccttcgccggtgcggaagaggtccatgccggtctcgccgatagccaccacttgctcggggtatgtggtggcgaggcgatgtacttcggcgagcgcgtcctcgaaagacgtgtcatggtaaggcttgtatttgaggggcagaccatccggccccggcacaccgcgatgcccgtggagcacggactcattggggtgtattgcgagcgccgcgtgcacgttacctggatgatcgagggccatctggacggcggtcatcaggtgcggcagctcgcaaccgcagtcgatgatacccccaatgccgacagattgcgcctgcgccagcaattggtcgacgtcgtacaccgggacttcgggctgccccttctcctgcgcctcatggctcatagcgcgcgcgaaagggattacggaggccacgtgagtgtggttgtcgatggtctgggcgtcgtccggcaatgcttcaggtgccggggcccagctacggtcgcgatggtggtgcttgctcatggtttctcagtgtaagctgtttctcagtgtaggctaccgtcagcaggcgaacacggcgagcgcaaaaagcacgatggtgatgatgggattggtgatgagactgagcgcctgacgcgtggtgccgtgggtcatgctttctgttggagtgatgttgaggatgccgccgcagtcatcgtcttttcgcgattgcggcggcaatgtcatctacacactcgccgtaagcgatgtgcgcggtgatagatgctcgcggaagaacgccatcattgcgtcattgagttctccgctgccggaatcccacgtcatcaagggatagtcatgaggaatacgcttgccgttgacagaccgcagatcatgcagttcatgatcgcagttcatcgagcgcagtagcatcgttgcgtacagcgcatcgttttccagaaaatcatcggtactggtggaaagccataccggcggatatgcgattgctcgcatcaacgattcagtacgctcatatggtgttccctccaatcgtgatatcaatgttcggaacgctggccgcagcttctcgaacagctcgccggaatccgggtagaacgcatcgaacagatggtcatacaccagcatgccggaggtgaaaccgactgattggaaccgcacatgattactatcaatccccagaagagaggacagctcctcattggtctcacacgccaacaggaacgttcccagcaatgcgccggcagaatcgctgaccaggaacagttgctcagccgacagctgccacccatcaccattgcttactagccatcgcaaggccgtcgacacatcagtcaacatatcgaggaaatcgcccccgggtgccaacgtatagttggagcacaccacggcaaatcctcggctggcaagctgagcggcatacgcattctgaatttccttgaatgaatagaagaacgcgccaccgtgaatgttgaaaataaccggaatatcaccgtcgccgcgcaagtatgcgtccttcggcaggaaaatatccaacttatgagcacgcccgccatcggtcatatagtcgatatccggaaatttcatcacggtatcaggcaacgcactgcggaagtccagtcggcgtacgtcactgaacgcgtagcttgcccgatgctgccgcacataatcgataaagactcgatactcatcatcatcatcgggtatgtctgcggtatcgggaagatcctcgtcaaggtaagtccatgttcgggccaaccgttcctgtagcggcgtcaaaacacaagttccattcgtagcgtaaatatcattcaacgtgaaaggaattccgttgacagagaacgtcattgcatcgtcgtcttgataacgcatcattccccacctcacttcagctcagccttcatatcctcaagctccacaccgttggtttccggcaggaacttgacgacaaagaagaagcccagcaatgccatcagcgtgtagaagccgtacgtccatccaagaccgataccatcacgcataggaggataaatcgtagtgataaggaagttgaacatccagttcgcggcagtcgccacggcctcccccttggcacggatacgattcgggaaaatttcgctgatgatgacccagacggtgacgttcgtagtggcacagcaaaccaggaagaacgcgtaggtgcatacgatggaaatccacgtccacgtaatcgacaggctcagagtaccgtcagcactcaactgtccttggccgaagccaatggccgtgatgcccaggaataccgtcatcagcaaagttccgtatttcataagattacggcgaccgactcgatcgataagcaccatacctaccaccgtggcaacggcggcgagcgtcgcacgtacaacagcgatggtcagcgacgcctgctcgctgaagcccagcatgttccaaaggctggaatcgtacagcatgatgatattctgcccattggcctgagccagcagaacgaagatgatggaaatccagaccacgcccttgagaccgaacgtcttaccgcgcagttccctgaaggaaaccttcttctcgttctcctcgctctggaacgacttctggattttggcgatggtcacatcggcattgttgtcaccgatgacgtcaatcagaatggtcttggcctttgcaatctcgcccttcataaccagataacgaggagtctctggcaaagcgaagcataggaagaacatgataacgccaggcagggctgttgtcactagcatccaacgccatgcgtctatccccatccagaatggcatttcagcgccaccggatgccacgacatagatatcgttgacgaccagcgatgcgatgatgcccaatgcgatggccatctgctggaagctggtgaagaagccacgtcttgctgctggagaaatctccgaaatgtaagcggggccgattgccgaggtgaatccgacaccaaggcctccgacgatacggaagatgataaatatggtgaaattcgtcgtcagacctgtcaccaaagaagctgccacaaacaatatggcggcaagttccagtacacgaattcgtcccatacgatcggcgaccacaccggcgaaccatgcgccgaacacacatcccagcaatgcgctggagaccgagaatccgctcatggtactgctgagtgcaaaaccggaatccggactggcgattgcggtcacggcgccgttgatgaccgacgtatcgtatccgaacaggaagccacccacggctccgatcgtacagacggcaattaacttgcctttaagcttgccatcgatttgagactgagtctgttggctcatgatattctcctttgcccgatgatggacctcgtcgcccaccagtaagcccctatcgtattgagcgagcatttgccggtcattggcaacagggctatgggcgtgatacaaatgaatgattttgtgaccgatggttcaaggcgtcgttgtcgtactcggaggaagcctgataacaataaaagcggaggcgaactgacgcagtgcagtcgcccataccgcttaatcacaccaacggagatgcctatgagttttgcaagcataatccatcagcatacggtgatatccgtggacatcggcggcaccaaaatcgccgctggtctcatgtgcgtagacctcgacgaacaaggaagaccgcgggacatgccagcgttgattcgacggtacgtcataccgacgaaagcacgtctcggcggcacctccgtattgcaacgcgtcgttcaagccattcgccagtgtctggacgatggtgagattcctttcccactattggggatcggtgtagcgagcgcaggagtcattgacggcaacggttcggtggtatcagccacttcgttgattcccggttgggccggtattcaactgcaagccgaattatcggcaacgttcaacgtgcctgccatcgtcatcggagatgttcaggcacacgcccttggtgaagcgcactggggatgcggacgacaataccaatcactactggtcgccgccatcggcaccggtatcggaggcgcgataatcatcgacgggaaactggtacgcggcgtccacggagcctgtggccatatcggccatctgccgcatcccgacgccattggtatatcctgctcatgtggatgtgagggccatgtggagtcaatcgcctcaggtaccggcattgccgataattatcgacgtgctctgcaacagaacggacacaatactctccccaccgacatcaatggacgcgctatcgccgaactggccagtcaaggtagtacggaagccgtaaccagtatcactctggccggcacgagtctcggcgatgttcttggcggactaatcaatgcccttgatcccgatgccgtgatcctttccggctccgtagtccattctggagagctatggatgaaatctgtgaaacaaggcatccaaagacagaccttgggcattctttcccgaacaccggttttgacaggaacactcggcggcagagcccctctcatcggagcaacatcagctctgtgcgccgacctcagatcaaataaggagcagaaatatgaatactaacgatacttattcgaaacgtcttattgattcgctccacggcacactgatagtcagctgtcaagcatatcccggcgagccaatgcggcatcccgaaaccatggcccaagtcgctcaatcagtagtaatcggcggcgctgccgccattcgatgccaaggtcttgccgatatcagcgccatcaaaggccaagtaaaagttccagtcatcggcatatggaaggaaggcgataacggcgtatacatcacgccaacgttacgccacgccagagcctgcattatggcgggagccgacattgtggcactcgatgctacagatcggcctcggccagacggtctaactctgcagcagaccgcgcggcaactcaaaagcgagggcgcaatactgatggccgactgcggctgcatcgaagactccgatgcagccgtggatgcaggattcgacatcatctccaccacgctggctggatacaccgattcccgcgccaaaacagaaggaccggattacgagctcctcgctcaaatgctggagcggcacccccacgtaccggtgatatgcgagggtaggatacatactccgtccgatgcggccaaagccatagaaatgggtgcctgggcagccgtagtcggtaccgccatcacccaccccatgacgataacgtcatggttcgccgatgcagtaaggtcctgatggcgcacaaaccaacagcgacctaggtaggaggcgatatgcagtacgttaagggcaccaatcaggaactattgaccacatcaccgcagttccctgccctggtcatcgcacatcagggattcgacaaagccaggttgcattggcatgaaggcttcgaggtggtatacgtccgacgctgtcgggccacagtgatgaaaggcacccaacgttcgatgcatcatgccggtgatgtagtactgattcctccacgctgcctgcatagcatcgaacttattcaggatcttcggcaaccatcagctgtaccgcaggcgctttccgtaacgatctcgcccacggagttgctaccgtcatatccgtatattacccaaatccaacaacagctggattacgactacattggcgaaaaagatcatcaacaattgctgaaatgctgcgaacaaatgtttgcggcactgatcagtggcaagcagacacggttccttgaagcgaattcctggttctacaccatgcttaccaatgtttttgactacgccaaaccattggctgcagcgaaccaagaagacaccgaggatgaaaccatactccaggatggacgagtcattagacgaatacgccactacgtgcaacgtcattatcgcgagcccctatccaccgcacaggtgtcgcagaaattcggatattcacgagagcatttttcaaggatattcagcaaatattctggagtgacatttaaagactacgtaacgcgtgtacgtctgctggcggcctgcgatttgctcaccaacacggatatgccaatcaatcaaatcgtccgggaatccggattccccagttctcaaaccatgcgaggatcgtttgaccgcgaattcgcatgcacgcccagcgaatatcgctctcgttcgatggaagaataatcgagaatcatctccattcttacgaagcgcgatatggacgatactgcagtaggagtccaatatgtcgcagtccctcaaaaacgaacaaatccggtagtgtctgagaatcttggcattactacaaccatggcacgaagttactaatcctcgctcactcccgtcgagaggatgcttttcaacgattccgacgtctgtatcttcagcgggcgcttcccggactgaacgacgagacccgcatccagtatctcccccacgtatgttctcgcactttgcttggatagtccgatttggcgggcggcgtcgtccagcgacatggactcgatcgaatcgaacatctcctcctggattacgccgtatagtatcgaggccgctttcgcagacagaccgtgcttctgcctaagccgttcgcaaatcgtctcgcccttgtcaagctggtcaaccatgatttcgagctcgccaatcagctcgtcctgggcttcacggatgaacccgaggagggtgttcacgaaaagcgtgagctccccgcagttcagcttagcctccgcttccacgaacgccttgtagtaggcgtttttgttctccgcaatggtgcgcgacaaagacagtaccgtaggcatggtcagatcatgattcaggtaaagggccaggagataccgccctgtcctgccgttgccgtcgtagaacgggtgaatgtactcgaataggaaatgcgacatgatagccgcctgcaggcgaggaatctcgtcggaggttgcgagatgaatcatatccgcgagaagtgcgctgatattgccttcgccactgacgccgttatgaattgcaagaccgtgcggccacttcagctccatcgcttattctggtagaacttcgcggaatcatatacacctatcacatcactgatagttttcaataaagcagcattagccgcaccgcctccacacaacggcgagtccccgtcctctgctcctcgagccagtcgcgatgccacatgcgcaacgcctctcgactgggataacccaactcgcggatcacatccgcaacgcagcactcgtaccgcacatacaactcaaccgcacaccgacgctgctccttgctgtacttcgccatggccgccccctcgaatcacagtccaagaaaacggcaccacccccaaatgataagtattgcttgtcatggaacgcctccccagattgcgttctacactggccaacttccacttggccaacctctgcctggccaagccatacgggccaagccttcgagcgattacatgccgccaatctcgtccgtctgaacttgccgtttcttgccacgagcgcaacattcccgggaaagtagcgcaaccggcaagcgagatggccgccatcctgccgccttttctgcctcatcaacccattttctacctcattttgataaaatatgatgcagaaaagttcgtatgatgcagaaaatgaggcggtatgagatcattcgactacatcgaatcaggtaagacgttgctcaccccgcacaccacgagtttgcttgccgcgattcacgaggcaaaagggcgccaaagcatacagacaacgatcagaccggatatattggagacgctggttgccgtcgcgcgcatccaaagcacagatgcctcaaaccgcatcgaaggtatttctaccagcgatagcaggctcaacgatctcgtctcggagaaagtcacaccgcgcaatcgcaatgaagaagagattgccggctaccgtgacgtgctatcggctattcacgaaagccacgactatattccggttaccccgaacgtcattcttcaactgcaccgcgacctcttccggcacacaccactgacctttgcggggcatttcaaggacagtgacaacgtcatcatcgaacgagatgcacacgggaccagcaccgtgcgattcgccccaccgtccgcacttgtcacaccggaactgatcgaacgcgcgtgttccgcctacacgcaagcaatccgagatggacataccgatccattgcttgccgtcgccatgttcattctcgatttcacctgcatacatccgttcaatgacggcaacggccgcatgagtcggctactcacgctcctgatgttgtaccgcaatggctatatggtcggcaaatacatcagtatcgaacaccttatcgagcaaagtaaaagcacttattatgaggcgctggccgcaagcacccaaggatgggacgacaacgccaatgattatgcgccattcacgaactacctgcttggcatcatactgtccgcgtgcaaggaattcgacgaacgcatcaatctcacggcaggcggcagagcgcagggagcaccgcgagtagtcaccaagggaacgcggattgaagcactgcttgatcgatccctagttccactctccaaggccgatattctcgctcgcatgcccgataccagcaccaccaccattgagcgcacgctgaaatcactgttggactccggtacgatcatcaaaatcggtgccggtcgcagcacccgctatatgaaacgccgctaaacgcatccttgtgcgcaacatctcgtcactcttccggcgccccgctggccacgcgaatcatcgcgtactgcgactcgtagaggcggtagtacgcgcccttggcggcgagcagctgcgcgtgcgagccgtgctcgacgatctggccgtgatcgatgtagaagatctcatccgcgttctcgatcgtcgacaggcggtgcgcgatgatgaagctcgtgcgccccttgagcagatgctgcaggccggcctgcagcgcctcctcggtgcgcgtgtcgatgttgctcgtcgcctcgtccaggatcaggatacgcgggtcggcgagcagcacgcgcgcgaaggcgatgagctggcgctggccggccgacagggtcgatccgcgctcctccaccaccgtgtcgtacccgtcgggcagttccatgatgaactcgtgcgcgtgcacggccttcgccgccgcctcgatttcctcgtcggtggcgtcgagcttgccgtagcggatgttctcgcgcacgttgccggagaagatgaaggtgtcctgcagcatcacgcccatctgccggcgcagcgatgcgagcgtcacgtcgcgcacgtcgtggccgtcgatcgtcaccgagccctcggacacgtcgtagaagcgcgacagcaggttgatgatcgtcgtcttgccggcgcccgtcgggccgaccagcgcgatcgtgcgccccggttcgacgtggaagtccacgaggttgaggatgttgcggctgtccttctcgtagcggaacaccacgtcgttgaagtcgacgcgcccgcggatctgcggcaggtccgccgcgtcgggcttgttgcggatctccggtgtgacgtcgagcgtctcgaagatgcgctcgaggtacgccgagcaggtgatgagctggttgtagaagttgccgatgttgatcaccggattccagaagttgttcgcgtagccgacgaacgcgatgagcacgccggtggtcacgttcacacccccgaagcccatcacgccgacgaagtagatgaacgagatggtcatcacggagatggtctgcacgcccggccacatgaggaactggatgtgcacggcgtgcatccacgcggaacgcacctcgccctgctgctcctggaaggtcctgaactgggcctgctcctgcgcgaaggtctgcgtggtcttcacgccggcgatcgactcgtggatgtaggcgttcaggttgctctgcttgttggagagcttctggaaggcgcgccgctggaagatctgcagcacgcgcacccagatgatgagcaccgggaacaggatcaggctccacagggccagctgccagtcgatcacgaacatcacgatcagcgtgatcacgaaggtgaacacgtcggagatcacgttgatcagaccggagctcagcgtgtccgaaagcgtgttcacatagttgaccacgcggatcaggatcttgccgtgcgggcgcgaatcgaagtagctgaagggcagcgtctggatatgcgtgaagatatcgcggcgcatgtccttgagcatgagctggccgacgcgcgtgatcgccaccgtgcggtagcgcagcccgaactcgtacagcacgattagcgcggcgaggatcacagcgaggatgccgagcttgccgaggtccttgttcgggatcgcctcgtcgatcatgatcttggtcaggtacggcacggcgacgacgatgcagctcatcgagatgacgacgacgagaatgcgcgccacctgtgccatatacggtttgagatatttgccgacgcgagcgatgtcgtggaggttgatggactcctccagctcctcatcctcgcggaatgtattgcgttgtgccataagtcctcttctaaaacccctgtgcagcgccggactggagtccgagctgcttgtggtagatgtcccagtagcggccgtgtgcggccacgagttcggcgtgggtgccgcgttcgacgatacgtccgtgctcgagcaccagaatcaggtcggcatccttgaccgacgagatgcggtgggcgatggtgacgatggtcttgccgccgtccatctccttgaggtgcttctggatctccgcctcggtctccatatcgacggccgaggtcgtatcgtccataatcaggatcgacggatcgtccgcgagcgcgcgggccagcgacaggcgctgcttctgcccgccggacaggcccacgccgcgttcgcccacgacggtgtcataaccctgcggcatcgacctgatgaaattgtccgcgccggcgatctgggccattttccggatatatcggtcgtcgctatcatcgctggcaccaaagccgatgttgccgccgatggtgtcggagaacaggaaggtatcctgtgccacgatgcacacctgcgagcgcaaggtggccagcggccagtcgcgtgcgtcgatgccgtcgatgagcacatggcccacggtcgggtcgtagaagcgggagatgaggctgacgagcgtggacttgcccgcgccggtttcgccgaggatgccgagcttggagccggcgggcacggtgaagccgaggtccttgaggatcggggtctccgggtcgtccgggaaggcgaagctgacgtggtcgaagcggatgtcgcctttgatgtgcagcgggcaggacttgcgttcggcggactgctgggcaccggatgttccggaagccccgggcgctccggtagccccggtagcctcatcatcgtgcttgacttgctcgacgatcgtgaccgcctgcttgacggcttcgaccgcgtcgggcttctccacgatgcgcggctgttcgttgagcagcttgcggatcttgatgcagctggcgttgaatcgctgccagtcgttgatgagccagccggactggcgcaccgggccgtcgatcatccacaggaaggagttgaaactcaccagattgccaagggtcatgtagcccttgatgaccagaaagccgccgaggccgagcgtgatgagctgcagcgagaagccaaggccgtccagccagggcatgtacctgcgcgagttgtaggccagggccatgttgcgctgcatgtagtcgtcgttgtgctcgtcgaacttttcggtctcgtacggttcgcgcacgaatgccttgaccacacggttgccctcgatgttctcttcgaccatggagttgagggaggccagcgagttgcggatagcgaagaacagcgggtgggcgtgcgtggacaggccgcgcgtgagcacaaaaatgaacggcgtgacgcaggccaggacgagcgcgagtcgccagtcgatggcgaacatcacacacagggcgcccacgaacatgaccacgcagtcggcgatctgatagctcacccaactcaggcagtggcggatcgcgtcagtgtcggaggtcaggcggctcatgatgtcgccggtgcgtgtgtggttgaagtacgtgaagtcgagctcgtgcagcttctcgtattcatcggagacgaggcggtagaccgagttctggccgaaacgctccatccacatctggtagccgtatcgcgcgcccacgcggatgatggtcatgaggatcatcagtccacacagacgtggcagttcgtcggcatgtccgccgacgatgacgcggtccacgatgataccggacagaatcggaatggtcagggccatcgtgttattggcgatgaacagtagaagcgcgcctaccacgcggggcaggtctggtttgcagtatggcagcacccatttgaggttgcttgcactggtattgattcccggatcgacgtacatgtgaggggatcaccgtttcttggggattgtttgcttatggtatggtgcggcatgctcctgcgccgcacgcggcaatcgctgccgccacgattcacgatcagccgtgcttcgcactgcgcctgtcattggccgcacgaccggagctctccttcatcggtcgaagcacgttcgactttcgcaaacgcgtactagtctagacggcctgcgtccaatcgcaacagcccacaactctgcgtgttccccgccttagcaacgcggcacggcccaattcgcgacgcattccccggaatgtgtcgcgcgaaacgttgcgcatgcggcaatgcacgctcgagacctgttgcataccagtcgaccaaattatagaatcataattaagtaaattacgattctataatttgcgcgtgtgcaccaggcagacagcaaagcaaggagacaagggccatgttcgtcgggcgagataaggagctttcggcactggaacgccgctggagctcacagcagttcgagtgcgtcgtggcctacggccgtcgccgcgtgggcaagaccacactcatcaaccgcttcctcgaagatcgccccacgattttcttttcggcaatcgaatccagcgcttccaagaatctcgaatcgttaagccgcagcattgctctgtatgaaaagggctcagaggcgttcgagacagcgcccgtataccgcagctttgaatccgcactggaagcggtgttcgcgctggccgcaaagcaacgcatcgccttcgtcatcgacgagtacccatatctggctaaagcagaccggaccatcaattcggtcctgcagcatgccatcgaccgccataaggatgacagtcagctcatgatggtgttatgcggctcttccatgtcgttcatggagcgccaggtgcttgggtatgagagccccctgtacggcagacgcaccgctcaaatcaaagtggagccattcggctacgccgatgtccgcaagttcttgccaagatacagcaacgaggacgccgccattgcttacggacttaccgacggtatcccgcagtatcttcggcaactggacgacggcatcagcatccgagacaacatccgttggaacatcctcgacccaagctgctatctgtttgaggagccagacaacttgctgaagcaggagctgcgcagtccggccgagtacaacgccgtaatccaggccattgcctccggggcatctcggtcgaacaccatcgccaccgcatgccatatggaatcgtcctcatgcgccacctatttgcgcaatctcatcgatctgggaatcgttcgcaaggagacacctttcggcgaggacgctcctcgcaagacgatctaccgtatcgagaactcgttcttccgattctggtaccgatatgtgccgaacaacatgtccctcattcaatccggtcatgccgatctcgccgccgaccgtgttatgcgcactatctccgactttatggggcaggtgttcgaagacatctgtgttcagtggatatggtcccataacggtaccgaggcattgcctttcctcatgcttgatgccggacgttggtggggcgccaatccgaccacccgcagtcaggaggaaattgacatcgtggcttcaggagaaaaaccgaaaactctcctattctgcgaatgcaaatggcgcagcgtgccatccggtctgcagcagttggaagtgctgcgcaatcgcgccagactgctgcaccccgaaaccagccattacatgctgttctccaaatcaggcttcgacgagcatgtcgccgcccgcgcggcgcaagacggtacagtgacgcttgtcgattttgcggatatggattagtcggttcactccattgcggacggtaagggtgaagtaacaggctgggtcaatggaccgaaccgctagaccgggcaacaggcccaatccgcgacacattcccgggaaagtggtgcgcgttacatcacgctcaaacaacccagcatatatatgggcaggtattcggttcggccaacagtctccacgttgccatcatggaacacgtaggcatgggcaaaccgataattgtcggtatccagtaggttgttcatggcccgatgccgcgtatagtccttgcccgatttgatttcaaccagtgaaatatcatccagaccttgctgcactacaaaatcaacttcaccaatacggttctggttgaagtaatgcagttccaatccctgtgcaaacagttcctgagccgctgcattctcgaaaatcgacccgtaattcatactggatcggtgattcacaatctctaagtccacactgcgcatcaaacgggaggtcagcaaaccgacatcgttcatgtacagtttaaacgtgttctcgtcggcatgctccgtcagcgggtattcagggtcctgcacgcgcgaagtaggcaaggcaatacctgcgttcgccaaccaatcgaacgccgtctgcatatgagcgaacctgatattcttgcccaacttggagaacttgaatcgtttgttttccgcattgagctgacttggaatcgcctcgtaaatgctcttgatatggcgacgttccaccaaatcggagacatatttggtgatgtcgtattcataggtatcgaatatggcctgctgagtattgcgggctttgacaatatcggcaaaatccacgaatgactgcactgcgtcgggcatgccaccaatcagcagatacttgtaccacaggtcggtgagccgttcatgtagataatcgggaacctcccgtcgatccacataacattcacgcagcgtatcgagagcggactgaggcagccggcatgcagcgcagaactcatagaaattgagcggatacatacgcatcgtctgcaggaatcccaccgggatcgagcgcacattgaacacatcaatgcccagcagggagccagaaacgatgacatccaatcctttggtgccagacaggaatttggtccacgtgagcatgtcctcacacgcttgtatctcgtcaagaaacagcagagtcttgcccggcgtaatttccgtgccggaaagtaccgataaccgcagtatcaggtcttcggtgtccttggccttgcttaccgtttcgaccgcctgaggcatttcgatgaaattcaccttagccacatgctcataatggtctgcaccgaactgctcaatcagcgtggtcttgcccacctgccgggcacccgtgaccagcaagccctgcttggttttacggttcttccaattcagcaactggtcatatgcatggcgcttgagcatattcccctcctcttttgtagagaatgactgaaaacacgcaggtcatcacacaatcacatactgatatcatcttagcattcacgtttttacatatgcaaaacgcactttgagtcacaaaaaacacaagaatagtgaatggttcattcacgttttacgtattgtgcgacggaatcggcatctcccgcaacacgtgagatatgcaaaagtgccgcatgctgaatggtgatcagcgtacggcactgcgcgaaacgcgtgaaatccgcagaacgcacgaaactcacgaaacagataaaacgtacaaaacgcaagcaaggcgaagacaacgaacagacagagacagacagcctacaggtcagaacgtcagcgaacgcacgtaggaaccaacttgcgggcggacgggaaccagcgagccgtcaggattgtagtcaagcggcgcgaataccacttcgcgatgacagccatcgcctccagcccagcgaccggccggattgtaggcgaaccggtgatacgcgataatccattcgtcggtgccgggaatattcacgatgttatggtgaccggtggcatacagcttgcgcgccgggtcttgttcgatcagcacgcgcggttcgctccagggcccatgcagcgattcggccatcgcgtacttgacgcagtattccggctctcgggcgtcgttctccgaccagctggcgtagtagatgccgttgcgcttgtgaatccagatggcttcacggaaatcgcccggcacccagctgaaagcgcgcgattcgtcgaacgacagacagtcctcattgagcggcgcggcccaagctatgccgttgccccacaggaagtaccgggtgccatcatcctccacgtatacgccggggtcaatggtgtggcaatcgaacgtaccttcgcgcacgattggttcgggctcaggcacgaacggcccgcacggggattcgcccacagcggcgccgatctgggaaccggccacgaagtagaacacgtatttgccgtccgcgcgctgtaccacggaaggcgcccaagcaccatccgagccatcccaccacggcgcatcgcgcaagtcgagcgccggatatcgctcccatgtggccaagtcgtcggacacatacacactgaacgcggtggtgtcccaattatccacaccgtcatcggtgcagtacaggaaatatcggccatcgaaaatggcaagattcgggtcggcgcaatacctgcgcagcggattagtggtcagtaccgcgttattcacgcgatgaggaaggccgtcacgaggcacggctctcggttttggcgatgtttgtagcacagtgccaacagtacccatgggaaattcttatctggtgaagaacatggctccccacacgccgcggaaggagatgatatgagcgtagtggggagccggaattaataccgtgatcagccagccgactagtcgatcagccgatcagcccttgaccgaaccggcgacgaggccggagacgatccacttctggcagaagatgaagaacacgaacacgggcagcagggcgagcacggtgatggtcatgaagctcggccaatcggtcgagaactggcccaccgcgttgtacacctgcagcacgattgtgcgcagttccgagctggagaggaacacattcgcgttcatgaagtcgttccacgtgcccatcgtctggaacacgaccacggtcgtcaggatcgggcggatcagcggcatcacaatcgaccagaagatgcgcagcgggccggcgccgtcgatgcgtgccgcctcgatcagttcgaacggcaggctgcgcatgtacccgacgatcaggaagtagcagaacaccgctccgcccaggtagataatcaccagtccggccaaggtgttgaccaggtgcgcgttcgcctccatgcggtacagggggatcagcgtcgtctgcgccggcacgacgaacgcgaccatcaggatcgcgccgaccgcggcggtgaacgtggacttgcgcaggatcatgccgtatgcggccagggcgccgacgagcacctggatcacgaccgcgaagaacgtgacgatcaacgtgttcagcagggagcggaacaccgggaccgtctcgaacgcgttgatgtagttcttgatcgtccattccttcggcaggccgagcgggttggcggacatgtccggaatcgtcttgaacgtgttgatcaggatgtaccacagtggaaccgcgcataccagcgcgatcaggatcatcaccacgctggtgaccgccgaaccgatcctcttgcgcgtcgtgaagttcatgcccttcggcgcggccgtgacggaagaagccttgttgcccatgatttactcgaacctcctcgagatcaggttggaaatgcccatctgaaggaacaccacgacgcccgtggcgatgaagaacaggaccgccagcgcggaaccgatgccgtactgcgactggccgatgccctgctggatgatcgactgcgtgaccgtgtacgtcgaatagcccgggccgcccttggtcatcgtgaacggcaggtcgtacaccttcaggccgcccgacatgagcaggaacgtcgaggtcacgatgcccggcatcagctgcggcagggtgatatgcgcgaactgctgccacttgttcgcaccgtccacggtcgcctgctcgtacaggtccgcggggatcgcctgcaggaacgccaagtaaagggtcgcatgccagccgatctgcgcccagatcgcgatgaagatcacgcagaacttcgccagagagttgttcgacagccacggcaccggtcccaaaccgaacgccgcgagcacgctgttgaccacgccggtcttcatcggggagaagatgtacttccacaccatgcccatgatggccagcgacggcaccgagaagaagaagaacacagagcgcacaaaatcacggccgacgaacttgcggttgaggatgaccgccagcggaatggcgatcacggtcaccccgaccatcaccacgatcgcgtacaggatcgtgaagcccaggccctgcagggtggacggatccgtaaacaccttcttgtaattgtccagaccgaccccgttcatgtccatgctgtaaccgttgaagtcggtgaacgagaagtacgcggtctgtgccaacggcaccaggaacagaaccacgaacaccgccaggatcggcagcaggagccagaacgacgtcacgtcctcatgcaggccacgcgcacgacgacgccgacgatacaggtcttcgtccaacggcggcaggttgccgaccgccgagccttgcattgttgcgctcatatgccatcctcctttgacattggcttatgaccgaaatccgattgcgggcatgcgaagggcgaccagccgcagccgacaggccgccccattaccatgcgcacggttcatgacgaaccggagattgtagttatctatgtgtgattatgtgcgatccgttgcgggtcactgcgcggccgcgaccttggcgtcgatgttcttggcatactggtcgggcgtgatctgcccctgcaccagctgctggttctgcgccttgagttcgctcttgagaatgtccggcttcgaatagaagttggtgtgcaggtagtacttgccggtcttgatgtcctgatcgtagaccttctggtactgcgtcatcaccgtagcgtcgaacccgtcgacagtgacagcgtcgccggcgtcgttatgcttctgcagcgcccacttgcttgacaggaaggtgaggaacttctcggcggccttgagcttgtctccgtcgagcttcgcgtagatcgcccacgccggggaggcggagccctgcgcgtactgcgtgtagtcgtcgccgagcttgggcatcggggcgaagtcccagttcatgccggcctgttcgaaggtggcaaagtcccacgcgccgtcgacgatcatcgcgacctgtccgttggtgaactgcgtcttcatgtcgtcgccgctgatgccgaccgtgtcacgggtcacgccaccctcatcgtacaggcggatgtattccttgacggcctcgagctcgtcggtgcccggcgtctggttgtcctgcgtggacagcgtggtcgggtcgacgcccttcttctcgaggatggatccctggaaggcgtcgatgaagcggctcggctcgtcggcgttcggctcgaggaacggctcgatgccggcgttcttgagcttcttgcacagcttgaggaagtcatcccagttcgccggcggctcgtcgtagccgacctgcttgagcagatccttattgtaggcgatgccggagacccacgaggtgatcgacatgccgtaggtcttgccgtcgcggcctacgaagtccttgttggcctgggagatgttcttcatgaacgactcgtcggtcaggtccttggcgtagccgttgtcgatgaggtcgtcgcgattctcggaggtgatgatgaacacgtccggggcctggttgccgacgaggcgggtctgcagcgtggagatgtactcgctggtcggcggcgcgtagctgaagtcgatcttgatgtccgggttttccttctcgaactcgtcgatgtacggcttggacgtctgctcgttgtcccagctcaggtagctgagccggatcttgccggcgtcggcgtccgagccgcaggcggccagcgggaccagcatcgctcccgcgcaggccagagcgagcattcgtttgccccagatcttcattgacattgcaactctcctttgtgttggtggcatacgccatgttgtatgccgaaagaaaccacattgtcttccgtgcaagagcccggttttaaaccgatttaatcttgtagttgtatttatagcactccgctcaaacggcgtcaactcgttacaaaaccttttaaacacaagggctgtggaacgcgcggaatcgcaccggacaacgaaaaataattaaacaaaaaacgccgcgagttgtcccaccgatcggcgatccaccgcgaacagccaccggacgaccggtcagcgcgtgcggttggacgactcgcgcaccagcacctcataacccaccgtgacatgcttgggcatggccggcgcgccgtaacgcccctcctcgatgcgctcgcacaggatgtcgacggcctcgcgggcaagcttgtcgatgtccaccgcgatcgtgctcagcgtcggcgcgctgtacgatccctcgcgcacgccgtcgaagccgatcaccgccacgtcgtccggcacgccgatgccatgctcgcgcaacgcgcgcaacgtgccgaaagcgatcgcgtcggtcatgcagaacagcccgtcgaacgggaagtccccctcctcgatgcgccgcgaaaccgcgcggtacgcgtcgtcggtgtcccagtcgaacagctggatcgtgtcggccttggtcagcgtgcgctcatgccgctcgaacgcgcgatggcagccgatcagacgtcggtcgcccacgtgcatcgaccggcgcgcctggtcggccggcatgaagtccgtaccgaccagcccgacgcgctcgcaccctatctcgaacaggtgcgtcaccgcggcctcggcgccgttctcgcacggtgtgaacaccgagtcgaacggcccttggtacgactggtcatcgagcagcaccaccggcttgcccctgcttagctcaatgatctcggcgtcgctcaggccgcccgcgctcaggatcacgccgtcgcagaacttgttggcgaccttctcgaggatgcttttctcatggccgaccttgccggtcgagatctgctgcgccacggcctggatgccgcggtcgaacgccgcattcgacacgccggcgagcagctgcgcgtagaacggccggtcaagctggaaaacggcggcctcgatcacgccggttcgccccgaacgcaggctcttggcagtgatgttgaccgaatagttcatccgattggccacgtcgatgatgtgccgtgccgtttcttgtttaattctgggatcgccgcgcagggcgaacgacacggacgcaggagagacacccgccgccttcgcgacatcacgcatcgtcaccgccatggcgtcctccttaggtatttatgggcttttcggcatctcaccgagcagctgccgacaccttcaatcatccatttgacgaagacaacctcgacgtacataatggccaccaggaattaaatcggtttaacgctgaaggggcaacgtcaccacacacggggaccgccgctcccgacggcgcgacgccgaaccaccccaacgcgagtccgccgcacgccggccacaacgccgagaccggccgcaggccgcatcatcgtcatcgcaaaggagtacgcatcatgaccgacaccatggcacacacccaacccgcatcacccgcatcacccgcatcgcctgcaccgaccatcaccgcaccgggcggccgcttcgtcttcggcggcgactggaaccccgagcagtgggacgaatccacctgggcggacgacatcgccaaactcgaacgcgccggcatcaacgaggccaccatcaacgtgttctcctgggcgctgatccagccggacgagagccgctacgacttcgccatgctcgaccgcatcgtcgacctgctggtcgcgcacgacttcggcttcgtcctggccacgtccaccggcgcgctacccgcatggatcgcgcaacgctaccccgacgccacgcgcaccgactacgaaggccgtcgccaccgcttcggcgtgcggcacaacgcctgcccgaattcgccgaacttcctgcgcctggccggcgcgctggccggcaagctcgccgaacgctacggcgccaacgaccatctgatcgcctggcacatctccaacgagctcggcggccgctgctactgcgacaactgcgccgccgccttccgcgtctggctcgaacgcaagtacggttcgatcgaggcgttgaaccgcgcgtggaacgcgaacttctggagccatacctacgccgatttcgcccagatcctaccgccgaacgcgatcagcgacggactggacggcgagcgcgccactctgtccgcctgcagcatcgactacaagcggttccagtccgactcgctgctgggcacctacgtcaccgagcgcgacgcgatccgcgcgttcgacgcgatgcatccgatcaccacgaacctcatggacacctacgagggtgccgattatttccgttgggggcgcgagatggacgtgatcagctgggacgattatccgttcccgcacaccacgccttccgacaatgcgttcaagcacgatctgatgcgcggcgtgggcgacggcaggccgttcatgctcatggagtcgacgccgaaccagacgaactggcaggagtgcaacgtactgcgcgcgcccgggcggatgcgtgcggaaagctatcaggcggtcgcgcatggcgcggataccgtgcagtatttccagctcaagcagtcgcgcggcgggttcgagaagtaccatggcgcggtgatctcgcacggcgggcgcgaggacgagcgcgtgtacggcgaggtgcgtgcgctcggcggcgagctggcggcgcacggcgcgcggttcgtgggcggtctgaccgaggcgccggtcgcgctgatgttcgactgggattcgtattggtcgaccgagaacatttcgttgctgccgaagggcttcgactatccggatcaggtgcggcgctggtatgcgccgttccaccaccgcaacatcgcggtggatgtggtgccggaagacattgacgccgggcggctggcgggctatcgcgtgctggtcgcgccggcgctcatgatggccaagccgggcgttcgtgagctggtcgaggggttcgtgcgcgccggcggcacgttcctggcgacggtgatggcaggcatgcacgacgagcatgacaacgtgatcctcggcggatacccgggcgcgttccgtgaggtgtgcggaatgcgcatggaggagatggacatgatcccggacggccgcgacgtgcgtgtcgtgttcggttcgggcgagggcgaggacgcggacacggacgggtcccgggtctcgctggttgccgggctgatcaagctcgacggcggggcgcgccctctggcggcctacgccggcgacgtgttctaccggggtacgccggcggtgacggtgaacgatttcggcgcgggcacggcgtatttcgccggtgcggtgctggacgaggccggcatggacgccgtggtcggcgacgtggtgcgccgggccggcgttaccggcatcgtctcgccggagccggtggaggtggttacgcggcggtacccgtcacgcggggagtcgttgacgttcgtgatcaaccatgcggatacggccacggcgtggcaggatacgccgttcgccggatgcgagtcggtgcttgacggcacggtactgggcagggatctggtgctggagccgtacggcgtgacggtggtgcgcaccgcggcatgacggattcggccgcaggccggttgcggaccatatcccaagtcagcaaccggccgaaccatatctcgcggctgcagtcatccttcatcatcagtattcggtagcggccctaaatcagctccgccatccggctcataatcactcgccaaccacgggcggaagtagctcccgactatccacagtgggacattggtcagccaatcctgctccttgtaattccgcatcgacgtacggtaaccgcaaatcccgtatttgtcgcacagccacttcaagctacgcttatgacgctcggtaccagctttggcctccagcggaatgattgcgccattacctgcaaagacaaaatcaacttctcccgtactgttcgcattcgaccagtacatcggtgtgatgccggcggccactaattgctggcaaacatactgttccgttaacgcaccacggaattcggtcagcccgccatcaccaaggaccacgcttgcgggagtcagatccagggccgctgccagcagcccaacatcatggagatacagtttgaacgcggaatcatcacggtatgacggcaatggtgccacaggtttttcgacgcgatacacccgcaatgcaagaccagaatcgacaatctgctgaatcgcggattcatattgcgccgcccgagcgccacgagcgatgtggccaaaaataaatttatgattctcacgcgccagatgggacggaatcgaagaaaacaccaaacgcattttctcactatccacaccggttctggggtgtttggaaaagtccatgtcgtaattggataacaattctttctgcacggcacgcgcatgctgatagccatcttctacaaatgtctcaacgacttcgggcatgccgccaacaaaacagtactgacgaacccttcgctctaaacgttccgcaaatcccccaagtgtctcaatacgctggttccggatgcgttcggctatcactccatcaccgaccgcttccaagaactccacaaacgtcatcggatacatatcgatggaggtgacactgccaaccgggaatgacaggtcttcgtgctgagccatgcccagataggagcccgctacagcgacatggagatccggcatttcctcatggagcgctttcaacagagtcagtaaatcagggatttcctgtatctcgtcgatgcacagcagcgtcttgccgggccgaacgcgaaccccattaaacgcctccatggaatcaagcaacatgtgcaccgaatccacacctgtcaacgcagcctttgcaccgccatcgaacaagttgacataagaaaatgactcgaacttgtcccgacccagcaccttaagcacatgagtcttgcctacctgtctcgcgccgcacagcactatcggcttgtgctccgtcgcttcagcccatgccgacaacctggtatatatatctcgcctgaactccgccatgccgccctccctatcgcatgggaccatacatcacaaatcactgtcctatcgctccatcataccgcaatacacacttttcctagggttgcaattcgcgtattctacattttttctagggttgcgattgtccaaaattacatttttcctagggttaataatgcagaatactgcacttttcccagggttagtaccctgaccttccctaatcacacggtgttgtaaaggcgtcgcggtattggccgggggtgagtccggtgcggcgcttgaagacgagcataatagaatatctcaagcatcgatgaatacgaggagatgatcacaatggctgattccatcggaacagtcaacaaccaatcttcaacacagcccaacggtcacaattcacatagcaacaccaccgagtcgctatggcgcggcacggattatggcaaatggttcgtagcggattcatgcacgtcgctgtcatcaagtatccaaggtttcgcaatgccactcatcgcgcagaccgtcacgggctcaccggcacaggcgacgctgctggattcaatcatgaccatgatatcgtcggtattgcggctgccaggtggcgtggtacaagataagtacgaccgcaaaaaacttatgattgcgttcggcctgattggtttcgcactgttcggcatatgcacggccctaggatgggcgggattactcatatacccggtgctgatggtacttgcgatatgcctcggcatacgctcaggcctcctaggaaccacgagcaacacgatgctacgaggcatcgttcccgatcaattgctgcccaaggcgtcaagcctcaatgatggccgcgatgccgccctcgaactcgccggcgcaccagtaggtggcgtattgatcggcggcggtctatggctgccattcgcagtcagcgcgctgctgaatctattggaaaccgctgcggcgatgcggatcacaaaatactggcatcgtggcgggcggaccaatacggagggccgcgcccttgccgacgatgaggccgatgagaatggcgatgcggccaacatcactcaggccgctgacgagcaggcaacgaccacgatatcatccgcgtcacagtattggcgtgagatgttttccggattccgctggcttcttagcgagcgattcgaacgtcgcctgattttgtcgagcgcgctggcgttcgcgtgcttcaactcgttcctgctgattacggtgctctcgatcggctccgacccatcacatgtggtgtcagccagtttcatgaacgtttctgtgtctgtgggcgtcatcgttggctcgctcatctcttccgtgctggttcagcatgtgcgcggcggcatagtcgccgtatcgttctacgtgctgatgagcatcggcgcgctcggcgcagcgctggctccgtggattcttgcgcgcatggcgtttctggcaatttcgctgctggccctaccggccggcaatgcggtaatcaacggattccaatcattgctcatcaacaaggagcatatgggccgcgtattcgccggcatgggcatgattgagacgattgctgccccggtgatcacatttctgtccggcatcgccatgcaacactggggttactcagtcacgtccgtggctttgggcttgtgcatcgtggcggccgcgatccctgccgtgacaatgagggaactggtcacactgcctaagccggatggctgggaggaccatatccgcaaatccgggctcaccaagttctgacaacaagtaagggcgactatctcccggatttgtgacgctcggcaaccgtcagcgtcacaaatccgggaagaggaaggtggatacggtttcagccgcgcgggcagcaaggtggacaaatcgttgccggggtggaatcgcggcaagtatgcaaaagcctcccgttcgcgcgcgacgcataagcgcgcaaacgggaggcttcccaaccgcagcatcatatgcagaaataaggagagtaaggcatatgctgccgcggtcacaccccgccgggaacctgccgcaggccgcgtccggcatcgaaagccctgcagtcgatgcgtgcggccggccgttcccggcgcggtggccatgtcagtcagacatcagtcagatgtcaatagacatccgatcagacgtcatcacttctgccagccgatgtcctgcggcaggttgccggcgaagccggacgggccgtagttggccaggcccttcttcgcaccgaggtacgaagccgggttggagaccgggatggtgccgtacagcttgagggcttccttctcggcggcgttgacggccttggtctgctcgtcgtagtcggagaggccaccggccaccttgacgagcttgtcgatcttttcgttgcccacgtaggtgaagttggacggaccgtcggaggtgtacagctgcggggcggacaccacgaaggtcatggcgctcggagcctgccaagccatcggcagcacctggtagttgccggaagacacggtgtcggagaacttggactcggccacgttcacgaccttgaccttgatgccggccttcttcatcatcgcctggtaggcgttggcgagggcctgctgggtggcgtcgtcaccgaagaaggtgaaggagatctcaagggtcttgccgcccttggcgtagtagccgtccttacccatcttgtagccgtcggcctcaagggtcttcttggcgttgtccacgttgtacttggcctcggcgggcaggttgttctcgtaacccttctggaacggcagcagcagctcggagcccggctgctcggccttccagttcaggccttggaactgcacgttgttgtaggtgttcacgtcgaaggcctgggtgatggccttgcgcacctgcaggtcgtcgagcggcttggacttgccgttgtactggagcacgcgggtcttggtgctgtagccgatgcgcagctgggcgtccttgacggagcggatggccttgatgtcgtccttggtggaggcgctcacggcgtcgatttcaccgttctggaaggcgttgagggaggcggtgtcggccatctgcttgtagacgatcttgtccagcttcggcttgttgccccaccacttctcgttcggcacgaaggtgacctgggagtcggagaaggagtcgaccttgtacggaccggcggcccactcgttgtgcgggttcttcacccagccctgggtgaaggtcttcgggtcggcggccttcgggttcaccagagtgccgaagacttcctgccacgggtagtacggggtcttgtaggtcaccttgacctgcttcgggctgtcgccctgctcaacgctggcgatacggtcgaagccgtcggtgctcggcgggttgtagtccgggttggagccgttgttggcttcccacgtagccttgaaggcggtccagtcgatgtcggagccgtcgttccacttggccttcgggttgatgtcgtactgcacgaccatcgggtccttgctcacgagcttcatgtcggtcaggaagtccgggttcaccttaatcggggagccattgacctggtcggtcatgagcaggctgggctggtaccagctccacagctcggacatgtagccggtgttgccgtcggaagacaggtagttccagttcgggccgacttcggtgatggacagggtcagcgtgccgccgtccttgacgttgtcacggctctggtggttgtcgtaacgctcggtgaccttcggcatgggcaggtcgccggcgtacgacgaatcgatgccggccggcggttcggtggcgctcgaggcgttgctggaaccgttgccattgcccgcgccgcagccggcaagcagcatggcaagcgccgcagtggccgcggcgagcgcggtcagcttacgtgtcttgttcattgttatttcctcctctatatggttccgaccgtcatgcgaaatggcatgcaacctgatggccgctcggtcgggaagtgtcatacggccgcagcgccgggcgttcgccgcggcagcgggcctgttgttcggcgctcagcttgggcatgagcgggcagcggcccatgaacgggcagccttcgaacgtctcggtggggctgggcacctcgccctgcagcacgatgcgctggcgggtgcgttccgccttcgggtccggcaccggcacggcgctgatgagcgcctgggtgtacgggtgcaacgggtgctcgaacacgtcttcggtgtcgccggattccacgatgcggcccaggtacatcaccgccacgcggctggagatatggcgcaccaccgacaggttatgggccacgaacaggtaggccacgcccagcttgttctgcaggtcctcaagcaggttgatcacgccggcctggatggacacgtccagtgcggagaccggctcgtcgagcagcacgagcttcgggttgaccgacagcgcacgcgcgatggcgatgcgctggcgctgaccgccggagaactgcgtggggaagcggtccacctggtcggggttcagctccaccagacgcatgagttcaccgatgcgttcgcggatctgctctttggagtagtgctggaccttcatcggctcagccaggatgtcgtagatcggcaggcgcgggtcgagcgaactcatcgggtcctggaagacatactgcacggccgaacgcagctcgcggcgcttctcgcgcggaatcttgtgttcgagcttggtgccgaacatctcgatctcgccgtcctgcggctgcttgaactccatgatctccatgagcgtggtggacttgcccgagccggactcgcccacgagcgccacggtctcgccttcgcgcacgtccaacgtcacgtcgtccacggccttgacctcgccgatcttgcgacgcaggaagccgccagcggtcagcgggaaggtcttgcgcatgtgcttgacgtcgagcaccatcttgcgttcgtcgcgcgggatgccggcgaacttcgacttggcggcctcggccaccgtgtacacgtcgtggaaggtcaggcccttgtccacgatctcctgggtgcggtggcaggccacgaactggcccgggcggccgggcaccggctccatggccggctcggtggtgtggcatatgtcggtggccagcgggcagcgcggcgcgaacgggcagcccttgggcatgttgaccaggttcatcggggagcccggaatcggcaccagacggctgttgcgttcgcggtcggaacgcggcacggcacccagcaggcccatggtgtacggcatggccgggtggtcgaagatggagtcgacgtccgccttctcgaccgggcggccggcgtacatgacgacgatgtcgtcggccacgccggcgatcacgcccagatcgtgggtgatgaagatgacggccgcgccggtttcacgctgggccttgcgcagcacttcgagcacctgggcctggatcgtcacgtccagtgcggtggtcggttcgtcggcgatgatcacgtccgggtcgttggcaatggccatggcgatcatcacgcgctggcgcatgccgccggagaactcgtgcgggaaggacttcaggcggtcctccgggtccgggatgccgaccaggttcatgagctcgatggagcggtcgtgaatctgctgttcggtcatcttcggattgtgggtgaccagcgcttccttgatctggtcgccgatggagaacaccggggtcagagcggagagcgggtcctggaagaccatggcgatgcccttgccacgaatctcgctcatctcaagatcggacttgctgagcaattcctcgccgtggtaggtgatggagcccttgacgctggcgttcttgtccagcaggcccatgatggccatggaggtcacggacttgccggagccggactcgcccacgatgccgagggtcttgccggggtacaggtcgaagttcatgccgcgcaccgcgcgcacggtgccggcttcggaagcgaagctgacggtgaggtcgcgtactgaaatcaccggttcggatgccatgccttgcgctcctgtggtgtcggggttggtgttggttgttacgttgcttgcgttgcgttcgtcgctcatgatgcccgtctcccctctcactcggccttgccgccggagcgggagtacgggtcaatggcgtcgcgcaggccgtcgccgatcagctgcacggagaaggtcaggacgatcagcaccacggacgggaagaccagcacccacggcgaggtctgcaccacggactggccggcgttgagcagcgtaccgagcgaggtgtcgggcgccttgatgcccaggcccaggaagctcagcgaggtctcgctgttgaccgcgccgatcacgccgagcacggtgttgatgaccagcaccgaacccaggttcggcaccaggtggcgcacgatgatggtgaaggacggcacgcccatgaacttcgccgcgcggatgtattcgcggtcgcgcaggctcagggtcagcgtgcgcagcgtacgcgcatagccaacccagccgaacgcggtcaggccgatggccagccacagccagtcgctgccgccggccgccatgccgacgatcagggcgatgagcaggaaggacggcacgacgagcagcatatccagcagccacatgccgaccttctcgaaccagccttcgaagaacgccacggccgtgcccaccagggcggcgatgatcgtggtgccgatggagctgaagataccgatggtcagcgagcggccgaggccacggataatcatcgcgtacatatccgagccaccgaccgtggtgcccagccagtgctgggcggacggcggcgaggcgagggcggcgaaatcgggctcgtcgtagctccactgggagaatttcgagccgaaaatcgccaagagaatcagcaggatcagcaccaccagacccaccacggccgaggggcggcgcatgaagcggcgcacgtacagctgcatgcggccggtgcggtggaagtcgtcgttgctggaagcctcctgggcgttcttggcgtcggcggactgcggttcgctgccctgcggatcggtgagttccatatcctgggcgacggcgtcggagaccatgttctcgttgtcgttcatcatgtttgatcgtcctttgcgcggggctcagctcagtcggatgcgcgggtcaagccaggcggagaagatatccgccagcagcgcgccggtcagcgtgcacacgccaccgaacgcggccacggccacggcaccgttgatgtcgttgttggcgatggtctgggtgaagtacatgcccaagccgttgatagcgaacacgttttcggtgatcaccgcgccggtgaacacaccggcgatggagaaggccacgtccacggcggtcggaatcagcgaggtgcgcagcgcgtggcggcggatggccgcgttgagcgtcaggcccttggcgcgggcggtgcgcacgtagtcggcgttcatggtgtcgagcaggtacgtgcgctgggtgaggtggtagcccaccatgcccggaatcgtcatcacgatggtgggcaggatcaggtgctgcagatagtcaaacacccagagcaccgggttggaaccttggtaggagtgcaggccggtcacgaagaacacgcggttgcccacgatattgttgaagttgatggccagcagcaccaccatcaggcccataacggcggccggaaccaccaggaagaacgttgcggtggtgttgagcacgcggtcctgccacttgtactggcggatggccgtgtacacgccgatgctcacgccgaagaggatggagagcacggtggcgagcgtcaccagctgcagcgaagcggagatacgggaggcgatggccggcgccaccggcgactggtccgggctcaggccccagttccactgggtgaggatgcccttgagccagcggaagtaacggatgacgaccggcgtctggtcgttgatgttggccagatcgagcgaccggttgatcgacgcgatcggcggatgcggattgcgcgacatgtagttcgaacgcggatccatgaatgcgctggccaggaaatacgtcatcgatactgccacgaacagcatgatcacgtagttcacaatgcgtttgatgatgtacttgaacacccaatcacctcccagataactggaaaagtgatacccccccccgctcaaatacccaaatcaagttcattatatggaatctgggtattgacttctttgacctttttctgtaatggaaatcgttaagaaaccttactggatattgggcaaacgctggataagcatccgtttgttaattttgtatttcccgagcttttgctggacatgctttatacttccgtgtcagtagtccgccgactcggatggtgacagtccccgccgccggcagcagaatatccatcagcatcatcagcatcagacaggggcatcatgacgacagacgccagcgcacgggccatcaaacccgaacttctgcgtacgtacaccgaagacttcaacaaggaccgcgccaacctgatcgcggcggacgcggcggtttcggccggcgtgctcaaggcggccaccgactatcgcggcgtacgtgcgctgccgcgcgacttctccatcgaactcaagcagggttcgatcaccaatcaggagcgttccggccgttgctggatgttcgcctccctgaacacgctgcgttacgaactcatgcatcgctggaatcttgaggatttcgagttctccgagacctacctgttcttctgggacgcgatggagaagtcgaacacttatctggagaacgtgctgcgcacgctcgacgaggcgaccgattcgcgtctgttcgaagccatcaactggggcccgtccgacgacggcggctggtggcaaatgttcgccgccctggtgaacaagtacggcctggtgcccaagagcgcctacccggagtccgagaactcccgtaattccgatgatttcaagcagtacctcaactccaagctgcgcgagttcgcagccgagctgcgccgccgttcggttgcgggcgctggcgaggacgagctgcgcacgctgaaggacgagtacatgggcaccgtgtaccgcatctgcgccgtgtcgcttggcgagccgccggagaagttcgacttcttcgcgcgcaccaaggatgatgatgaggataagaagggcgaggcctgcaagtgcaaggccgaggccgacgcagacggcaaggccgaatcctgcaagtgcggcgactcctgcaaatgcgagggcaaatccgacgccaaggcctgcaagtccgacaagccgaaaaccggcaaggacgagcgcccgcagattcgcgagatcggcatcaccccgcttgagttctacaagaagtacgtgccggtggacgtcaacgatttcgtgacgctggccaacgccccgctcaagaaccgcccgttcaaccagcgctaccgcatccgcttcagcgcgaacgtggccgaggctggcgatatggaattcgtcaacgtgccgctggacgtgttcaagaaggccgcgcttgaccagctcaccgccggccacccgatctggctcgcctgcgactgcacgcagttcgcgctgcgcaaggacggtttcttcgaccagtccgtggtgcgcgtcgaccagctgttcggcaccgaattcaccggcgacaaggcccacggcctcgaatacggcgacagcccaagcaaccacgcgatgaccttcaccggcgtgaacctcggcgaggacggcaagccgaaccgctggaaggtggagaacagctggggcaaggacgccggcaaggacggctactacgtcatgtccgacgcctggttcgaccgttacgtcaccgagctcatcatccgcaaggaatacctcgacgacgccacccgcgccctgctcgccgccgaaccggtcgagctcgacccctggcagcccctcacccgccgctgccgctgacattccgctggcgggagcatatattgaatgccccttctctctgttcagagagaaggggcattacgttatgcgagtacgtccggccgcacctattcgagactatcgcggctgagctgagcaaaagtgccgtcatcatcggccaattgccggtaggttccggcctcgctaattgttccgaactagttatccacagagttatccacatctcccgcaagctagagccacataccccggttttcatagcgagcacgtgaccgctgcgctacggtggcgtcatgaacgacatattgcccactccaccgcccggcgtattcgacgacgaaccgtccggctggacccggccccacacaccgcgcaccatcaatcctgagctacgttcatcaccacgtatggtgagttccgcgccaactgtgattacaggccctgtgtcgccagcaatgagcgaaaccctcacccaacgtaagcgggaaatgcttaaacgatgcacggacgccgcgctacagctcaggcaaccggtgctcttcggcatgaccacatcgctgatactgcaatccgtgccgcttcccaaggattgcgatatcgaccccgccgagctccataccgtctccgactcacaccgcacacgaatacgtgccatcgtgccgccaacgacaccacacatctggaagccgctgagcgatgcacacaatgtgcgtatcaacaaacatgtgtacgcactggatctgatacacacttgggcacaactcgccactcatatatcgctcgaatcgctggtcatacttggcgacgcaatccttacggcaatcgcccgcaagccgggtctggcgaacggccgcactgctgacggcatttatcaggacttcgtgcggcaagtcaccgaactcccgaaattcaacgcaaaatccaagtgcatgatcgctcttgcattcattacgccccgcgtggactctccaatggaatcaaagacccgcatcgcgacgacgaaatacgggcttccgccagccgtgacaaattacacggtgcccggcgcgacattcagcaacggtgcgccgataacgctcgatctcgcttggcccgaatttcgcgtcgccatcgaatatgacggcgatcatcatcgcaccgacaaaaaccagtggcggcgagacaacgacaagcgcgaactgttgcgacatcatcattggatcatcatcatcgccactgccgcgaacatggccgatgagccatcccaagccgaactcgcctaccgggtcgggcggcagttggcattgcgaggtgccgtattcgatttcactttgacggcaacgccactcgatgagctcgcccggcggaggcgacgaagaatataacgtttatcgcgaaagtcgtacagtatccatgttgcgccgacgctgcgcgactcggtgtccgtgtccgatgtcccggtagcgatgtcaatcgatttatgtgtggaccgggccagatttcgctgtcccggttctccatttcgcccctttttgagcaaccaagacaaaatttcattcacctatcaccccaccgtgcaatattcgccatcgtacatcggtggaattccggggttttgggattacggataatgggcgtttacaaggggggctgccccggttcccaaaaagaagccgaaatcacgaaccgggacagcgaaatctgtcccggtaatcgcgtcaatcggttgccgtcatcaccggaacatcaactgcgcatagatcgaacgcttcaatgctcaacaggcatgcgaccataccgcgatagcgatattccgacggaagtatgggactcaccacgcgaccaatattatttactgagctttggtgcctcgtgctggatgtggcggatcacggcatcggggaaaccggcgtggatgtagtcggacagcatccgcaatagcctctcgtcaaaggtgtgccgctcatcactgctggcatcgaccaggatgaaatcccatgagtattcggtgtcaccgtcgttgatgatgagcccgcggccagtgatttttgcggccagcaacgcggcgatctgcatggagccccgcttgataagggctgattccgcttgggtcagattgcccgaaaatgtgacggtatacaccattagttcaccccttctttgttattttttagaacagcaatgcctcattgtaaacagaaaacactctgttataatccctttttcaatatgcgaccctggcattcccagcattaaaaaagaaacccggcggagggggccgccgggcgagagagagaagagagaagaagggttcagttatggggttcgaagaacctcgccaccggtatgaacttcactccgttgacatcttctatgtaaccgccccatgcttggcgaattgatgtgcttgtctgggaaaagtcttggcggagtgtgacgaatttgtgacgcccgccgacaaccggcctcgctttgtcggggcttggccgcacatacggcaacggaccacctcgcaacacttcatgtgcgaggtggcccgtcagctacgagctagcaatgccgaatcattcggcggcgagcttggccttctcggcggccagacgctcggcttcggcggcacggcgagcagccaacgcttcatcgaagcgagccagctcctcttccacggcctcggtcggaatcttggcgaagatcggcgcgggcttaggcaccacggcgccgacctcgattgcctcgctcttccacgggtgcacgttcacaccgagctcgtaatcgccggtgataatcggatacgtgaagccgggcttgtcgagatcctcgacttccttgagctcaggcagcggcgagaaggtgccggtgccgccgagcgcctcccacaccttctgtgcggagtgcggcaggaacggcgcgagcaggtggttcgcgtcagacacggcctgagcggccacgtgcagcacggtgccgagacgagcctggtcgtccttaatcttccacggttcggtggcggagatgtacttgttgatgtcgcccaccacgcgcatcgcctcggacagggcgtgcttctggtggtgggtttcgatggaggagccgaccacgtcgaacgcggcggaagcctcttccagaaggccacggtcttcgttggtcatcgaatcctcgtccagcggcggaatctcgccgaagttcttgttgatgaggttggccacgcggttcaccaggttgccccacgaggaggcgagctcctcgttgttgtggcgcacgaactcggcccacgtgaagtcggaatccgaggattcggggccagccacggaaatgtagtagcgcacggcgtccacggggtagcgggcgaggatgtccttgacgtagatcacgatgccgcgggaggaactgaacttcttgccttccatggtcatgaactcgctggccaccacctgctcaggcaggttgagcggacccatcgggccggtttcgccgcccttggagcccttgccgttgtacgccagcatttcggacggccagatctgggagtggaaggtgatgttgtcctttcccatgaagtagtaggccgggcacttcgggtcgttccaccattcgcgccacttctccgggtcgccctggcggcgggcccattcgatggaggccgacaggtagccgatcacggcgtcgaaccacacgtacagcttcttgttcgggttgtcgatccaacccttcaccggcaccgggataccccagtcgatgtcgcgggtgatggcgcgcggcttgacttccttgaacaggccgagcgagaagttgatgacgttggtgcgccagcccttgcgggtttccagccacgccttgttggcttcggcgagcgccggcaggtcgaggaagtagtgctcggtctgttcgaaacgtggggtctcgccgttgatcttggagacggggttgatgagctcgtccgggtcgagctcgttgccgcaggcgtcgcactggtcgccacgcgcaccttcggcgtggcaaatcgggcattcgccttcgatgtagcggtcgggcagggtacggccggtggacgggctaatcgccacctgctggctgcccttgtagatgtagccgttctccaggcactgcttgaacatctcctgcaccacgtgctcgtggttaccggtggtggtgcgggtgaacaggtcgtagctcaagccgaggtcgcacaggtccttggcgatcacgcggttgtaacggttggccagttcctgggcagtgagaccttccttctccgcctcgacgagaatcggggtgccgtgctcatcggtgccggacaccatgagcacatcattgcccttcatgcgctcgtagcgcgcgtagacgtcggagggcacaccaaatcctgcaacgtgaccgatatgacgggggccgtttgcatacggccaagcaacattcaccaaaacatgactcataaggcttgattatccggcgcggcggggacacgcccggatagctgccgcgccgccatcctcatcccactcacctatccgcccgcaacttccccacatacttatccgtacacctcttgcgcgcttatccacatacgcattcgcacacgtatccgtacgtacatccgtacacacgtccacgcacatccgcacacacttccgcctgtcgatatccaccgagttatccacatcattcgcgcacctagtgaagttatgcacttatccaccgttttcgcttatccggtggcgcgcaagccgtacttctgcatattgttcggtcatggatatcacagcaggtccgatgacggacatcacaacagtcgcctcgccggcaaccgcgcagcccgcggtgccgccgatactgtttaccaaggatctgccgggaccgctcagccttaaccgtctggccgccttcggcgcgttacgtaagctcgacgattccgccggctactggatcgagcattcgggcacactgtatggtcgcgcaaaaatcgtcgcggaggtcgccccgtttggcactgtggtgtgttcgatgaccgccgcttgggtatggctgggaggccccgactttccaagcaccatagacgtgatctccacatcgcacttccgctcggcatccgtcagccgccgcatccgcgtattcaaaagattgacgttgccggagcaaatcatcaagctcggcgggctgcctgtcaccacgccagcccgtacggcttgcgacctggtgatgagtcctgaagacatccccgatccttccaccgtcaacgcgctggtgtgccaactgatgtccgcgtaccagtttcggccaaacgactgtctgcaaatcgtcaaggagcatcggcatcacaagtatgccggacgcgcacgcatgttttttgaatcggtgcagaaggagattgacgaaccggctttggagcaatgcgcatgacgaggggattcatcgccaaaggacatcgcggaggccgccatgccgctcaccgtttacggcatttgcggcaggcgcaacggttgcctcgccacgcggcggcggcacactcatccgaatccgcatcgcgcgcaatctcggatatgaccgcgccgcctgaaccacccatcagacttacgcccgcggtggcatgttcgcccgatacggatgttgccgtgctctggcacatcgcatatcacgtgcccgaactgcgtaaatggctggttgccaatcccaaagccgacgcgcctttgctggaattggtctcgcagcgtggtgggcctggggtccggcaggcgttggaaatattgttcgagtcgatggaagcgtaacggggagataatcgccggctgctgcgctatcccttgattttcagcacagccgcatacacctgcttgcgattggccaacgatccgtcagccaatggatgctcctgcaccacttgcgcgatggcgtccttgatacgcaggccgtcctccaaagcacggtcgatggccagcacggccatgtcctccacgctcagcgtgctgggcgcggccgcttcggcctcctcgttggacgcgccgccgatgaccagcaccatctcgccacggggcggatcatcaatcacactttggcgaatctcgccaatcgggccgcgacgaatctgctcataatccttggtgagttcgcggcacagggccatcgggcgattcgggccgaacgcgtccagcagatcgtccatcgaatcggcaatgcgatgaggcgtctcgtagaacacgatggtgcggcgttcgggcaacagcgtgcgcagatactgcacgcgctcggaatgctttcgcggtaggaagccttcgtagcagaagcggtcggtgggcaggccggagagggcgagcgcgtcgagcacagcggaggggccgggcgcgcaggtgacgggcagaccgcgttcgatggcacggcgcacgatggccaagccggggtcgttgatggtgggcatgccggcatcggacacgacgagcacggtggcgccggtttcgacctggtcgagcaggccgtcggccttgtcgcgctcgttgtggtcgtgataggcgatgacgcgaccgttcacatagacgccgaggcgacgggcgagatcgtagaggcggcgcgtgtcttcggcggccacgatatcggcccgctccaagagggccaccagacgggcggaggcgtcgccaacgttgccgatcggggttgcggcgagcaccacggtgccggcggggatggtcacggccgattcgcgggattgggtggcggcggattcgccggcatgaacttcatcattgcgttcaggcacttgcgtcacgctaccgtcagcatcatactgctcattcaactcatctgcgcttgtcatactcccagtattgcccataccacagagcaatccacgacaatccatggcggaatcgaggcattctccctttgcaggggctgatttcacatgttccggaagtctacttccgtttcaaggggctcctcatccggtgaagcaccagtacaaacggctttgacgcaacgctattccgccattttggcggcgtatctacttgaccatcagcccctcgaaacgcaagtagacctccggcaaaccccaaatcaggggttataggccaaaatgtgtgtccgttttggcttgtgttcctttgtggcggtgggcgttcctcctgttcgagttgtatgggcggggaactcgaggtcggccagaatgtgtgtccggaatggccggtcaggccttgcggcacaacggttgagtgactttcgagttggcgtggcagattgggtggatgaacacaccttgttgcgccgtgtgcggcgagccgatgaagcggaacggaaggacgagctcgggacggatcaggtggcggtgccggaacgccggctgtgggagctcacgcacccagtcgcgcgacaacagcgcccgtgatctgcggtgcggtctggattggctgttctcgaagcagtcgcaggccgagcaccggctgccggcacgcacgctgcgccgcaggtgcgagctcatgtggggcctgtggccgcccgtgccgctggtggacgaggtgcatcatgtggtgcatgtggacggcatccacctgcaccgcgacgcggtggtcctgatcgcggtggccggcgggcacgtgatcggctggcacgtcgccaaaagcgagaaagcggcggcatggcagtgcctgatggcgcgcatcgcgccaccggacgtgctcgtgtgcgacggcgggggcggcgtcctcaaggccgcgaaggccatgtggccggatacgaggatccagcggtgcctgttccacgtgcaggccaacatcctcgagctgaccggcaggcggccccgtctggaggcgggcggacggctgcgccgggtggccctgtccctgccccgcgtcggggacgcgggcggcgcggccgaatggctggtctcctacaaccagtgggagcaggacttccattcgttcctcgacgagaagagcgaatacgccgacggcggcgtgaacgacatgcaccaaaggctcgtcaaggcacggcgcatgatccgcagacgcatccgcgagggccacctgttcacgttcctcgacgaggggctcgcgtccgtcggcccggtgccgtccaccaacaacctcgtcgaatcatggaacgcgcgcctgcgcgacatgctgcgccgccaccgtggactgcggctggtcagacggctgaaggcgatctgctggtggtgccaccagcacacggcgcatcccgagaccgacgcgtggctcgcggccaacgcgatgaccgacgaacgactcgagcgcctctaccggcaggcatgggagagaagcccgcaaggccagtacgagacgttcggcatccccgcaagatacggcaccggcatcgactggaacgagttccacacacgggtcgaatggcagtcgaacgactagaccaccagacacacattttggcctataaccccaaatcagcccctcgaaacgcgagatggcacaataccaacgaagacaaatgaaaagaccctctgcggtggaatgaatgcagagggtctagtggagctgacggtagtcgaaaccgcgacctcttcgatgcgaacgaagcgctctaccaactgagctacagccccttggatgttactttgctccgcaaagcaactcgcaacaatatagtacggagtgcggtcaaacgcaatttgacgccgaagtgtcgcgcacatgtcggcacggtaacgtttcggtgcgggcgcccggcccgagcgccgacgcgccgcacgcactacgatggtggcatgactggcccgacacaacgaccgcacgaccgaccgccgcacgaccgaccgcacgtgcggctgaccgaccgtctgccgcacatcgccgcgttccccgatgcgctgggcaccggcctgctgctgcacaccgacgccccgctggcggacgggcttcacgaccggcttggcgcgttcgtcgacacgtatgagcggacgctgtcccgattcagggacgattcgaccgtgagccggatgcgcacggccacgcgcggcggcgtcttcgactttcccgactgggcatcgggcctgttcgacctgtacgacgccctgtactcgggcaccgacggggccatcgacccatgcgtgggcgaggatctgatccgactcggctacgacgccgtctattcgttcaccgtcgagcccgacgcccgcggcgggcgtctgggcgccatccacggccggcccacctggggcggcgacgtggagcgacatggcaccacactggtcacccggcgtcccgtcgcactggatttcggcgcgtgcggcaaaggatatctgctggacctgcttgcggggatgctgcgcgccgactggaggcgaacgcgccagtcggcgcacgatgaccgccaatacgtcatcgacgccggcggcgacatgctcatacgcacggtcgagccgatcaccatcgcccttgaggacccgtccgaccccgccaacgccgtgggattggccgaactcaaccggggcgcgttctgcgcgagcgcccccagccgacgccattggcccgacgccgccggccaccagctccaccatctgctcaacgccatcgacggtctgccggttgacgatgtagccgccacatgggtggccgtcatgccgcacgcagcatctttgagcaccgcactggccgacggactcgccactgctctgttcactacctcggccgcccagttacgcgctcacttcgatttcgaatgcgccatcctcaacgccaatcgtgccgccgcacaatcccccaattttccgggcggctttttcacgcattaatgtacgaaatcatcagtatcacatccagtggagcattccctcgggcggaccgatgggttgctcccttcagtcagctacgctgacagctcccctcggagaggggagccgagtatagctaatccgctaatccgctaacgcaggaaacaatccgtcagtcagcgagtgcgaactggctgttgtacaggtcggcgtagaagccgcccgcagccagcagctcgtcatgggtgccgcgttcgatcacatcgccgtgggtcatgacgaggatcatgtcggcgtcacggatcgtggagaggcgatgggcgatcacgaacgacgtgcgccccacggtcagcgcgtccatggccttctggatcagctcttcagtacgggtatcgaccgaggaggtggcctcgtcgagaatcagaatcggcgcgtcctgcaccatcgcgcgggcgatggtcagcagctgcttctggccctgggagagcgacgacttgtcatcgagcacggtgtcgtagccgtccggcagcgaacggatgaagtggtcaagacccacggccttgcacgcatcctcgatctgcttgtcggtcacgccgggcttggagtaggcgatgttctcgcgcacggttccgcggaacacccacgtatcctgcagcaccatggagaactggtcgtgcacattccagcgcggcacggacttggtgtccacgccgtcgatcgcaatcgagccgccggagatctcatagaagcgcatgagcaggttgaccatggtggtcttgccggcgccggtcgggccgacgatggcgaccttctgcccggccttgacggaggcggagaagtcgtggatgatcggcttgcccggctcgtagccgaactgcacgtggctgaattccacgtcgcccttcacgtcgcgcccgcccgcatggtccgtgccgagtagggcctgcttgccggattcgtcctccatctccggctcctcaaggaagccgaacacgcgctcggcggccgccgcgcaacgctgcaggttctggaaggcttgggcgaactgcgccaacggctgggtgaacaggcggatgtacatcatgaacgccacgatcacgccgaactcgatctggccgttgagtgcgagcgccgcgcccaccacgcacaccaccacgtagccgaagttgcccacgaagttcatgagcggcatcatcaggccggagaggaactgtgacttccaacccgactcgtagaggtccgcgttgtaccgttcgaagcggcggatggaatccgcctcgccgttgtacgccttgacgatgaggtgaccggcgtacatctcctcgacgtggccgttgacgtcgcccagagccgtctgctgccgggcgaagtacttctgggaggccttcatgatggccatcatgatgatcaggccgatgaggctggcaccgatggcgcacagggtcatgatcacgttgttgtagaacatcatcaccagcgcgcccacgaacaacgtcgccgaggtgatcagcgagccgagcgactggcccagcgtctggccgatggcgtccacatcgttggtgatgcgggacagcacgtcgccgtagctgaccttgtcgaagtatttgagcggcaaccggttgatcttgaccgagatcgattcgcgcagccgctgggcggtgcgctgggtgacgttggccatcatccagctctgcacatagccgagcacggcatatcccgcgtacagggccaccagcgtccaggcgatgtggcccaccgcgccgaaatcgaccgagcgcatcaccggcctgccgttgacgatggcgggcaggcctttgacgatctcgttggtcatgtccttgagcttgtccgggccgacgatctggcagacggtgccgatcgcgcccaggatgagtgcgacgatgatgacgggaagatagttgcggcagtagttcacgagtttgcccatgactttgccgaaatcatggggcttttcgacggcgcgcctgccgcccattggtcctcttggcatggtgttcagtccttttcgttgtgccttgcccctccggtgaggggatgtccgcgtgggggggatgccttacgccgtaagctccgactggctgagctgggattcggcgatctggcggtatacgtcgcagtgttcgagcagttcccggtgcgtgccctggcccacgaccttgccgtcgtcgagcacgacgatgcggtcggcgttcatgatggtgccgatgcgctgggccacgatgagtttgatggagtccttggcttcgcgggcgagcgcgtcgcgcacctcgcggtcggtcttgaagtcgagcgcggagaacgagtcgtcgaagatcaggatctccggatgccggtacaccgcgcgtgcgatggacagtcgctgcttctggccgccggacacgttcgagccgccctgtgcgatcgcggcggcgtatccgccgtccatgcgcgccacgaattcgctggcctgcgccacgtcggcggcggccttgacgcgctccatccgctcggccggcaggccggcgtcctgcgcggccttgtccgcggcgagcagtgcggtctcgtgcttgcggccggaggcggtggagctgtccgtcatctcgacctccgccgggtcgcccggctgatcgccatagctcacgttggaggccacggtgcccttgaacagcacggactgctgcggcacgtagccgatcttgtcgcgcagggtcttcaggtcgtagtcgcgcacgtccacgccgtcgaccagcacctggccttcgctgacgtcatagaagcgcggcacgaggttgatcagcgacgatttgccggagccggtggagccgatgaacgccacggtctggccttgcgtggcggtgaagctgatgccttcgagcatcgcttcgcgcgagtccgggtaggtgaagccgacgttgcggaattccacggtgccgcgctggccggtcttggccacgtcggcggcggtcttggtgccgttgccgacgatcggctcggtgtcgagcacttccatgatgcgctgcgccgaaacgtcggcgcgcggccagagcacgaacaccatgctcatgagcaggaagctcatgatgacctgcacggagtagttggagaacacgaccatgttggagaacacggtgagcttgtccttgagcccggcggcgtcgatcaggtaggcgccgatccagtagacggcgagcatcagaccattcaggacggtgttcatcagcggcatcatgaacgccatgacgcggttggtgaacagctgggtttcggtgaggtccttgttggccttggtgaacttggactcctggtagtcctcggcattgtaggcgcgcaccacgcgcaggccggtgaggttttcgcgggccacgaggttgatgttgtcggtcagggcctgcatcgccttgaacttcggcatgaccatggccatcatgacggtgatggacaccagcaggaccgccacggcgatgccggtggcgagcgtccattcgaagccttcgccggcgatcttgcatacggcccatacggccatgatcggcgacttgacgatgagctgcagacccatggtgatgaacatctgcacctgcgtgatgtcgttggtggagcgggtgatgaggctggccgtggagaacttgctcatctcggccggtccgaaggattcgaccttgcggaattcgagcgagcgcagacgctgggtgaacgaggcggccacgcgcgcggctatgtagccggtgatgacggcgcacgccacggagccgagcgagatgagcagcatcttgccgcccgcgatccagatgtccttcatgtcgctgcccggcgtctcgaccaaggtggtgatgtctgacatgtagtcgggcagtttcaggtcgaagtagacctgcccgacgatggtcagcagggcgacgagcatctgaccgatctccgctttggagaggtatttcatgatgcggaacattgatttccccttgtattggtgtggttggcgtgaatgtggtgtggtgttcggttggttggattagtggtgttgatcggtttccgttgtctgaatagtttccacggtttggttacttacactgtgagatattacgcatgactctgggcattcgctgtgagcccccgggattacgctctgcgctcaaccgagggggcaaacgaggccgcccgcgcccggcgcggggcagacggagcccctaccgttcgtcgctccgcgcccgtccgtccggcatatgctcggccacgcgccggtcccgctcggcgaacgcctcgctcacctgctccgcggtcggcctcggctggcccggatggcagatcgacatgtatgtggtgaattccgagagcagttcgacgaacgcgcgcgtgcgccgctcccccatctgcgagaagatccagcagatcgccgaacgcatctcatccatcatccggcgggactgctcgcggccggaatcggtaaggttcacgcggatgatgcggcgatcctcggggtcgatgtcgcgcgtgacccagcctttcttctccaacgccgacaacaccgtggagatgcggccggaactggtctggagcgcggcggccagctgcgatggcgactgggttcccttgatggacagctcccggagcacgaactgctcgccgtgggccccgcgggtgaattccctctgcatcttcgaacggttgccgcatacgctggcatacagttcgctgaccgcctcctgttcgaatcccatacgggcaccatccgtttccgttcattgtgcggcgcagcgccgcggacgcccccagaatagctcacaccgtaaacaattcaacaccgcaagccaattatcggcgccgcagggcggggcggcgcggggcggtccgccggcacccgccggcacccgtcaccgtccgcggctcagcgcggccttgagatcacggctgcggtaatgctcgcgcagtacggagaacccgccgaacccgatcagccacaccagaccggcgatggccgaactgcgggtgtcgtccgccaggaacagcgtcaggtaaatgaacacgaagaacacgatcgccaccgtgttgagcaccttccacgcgggcatgacgaacccgtccgcgatgaaatcggcggaacggcggtacctgcgatgcgccagcagcgtcaggatgtagatgaacaggaacaccgcggaactggcggacgagaacagcacgaacgcccccgagatgccggggatggcgttgacgatcggcgacagcagtatcagcgccgcggacaccaggatggcgcgggccggcaccttgcggtcggacaccttgccgagcttgttcagcatcgggttcggcgacacctcggacagctggtacaggtggcggccggcggaatacaacagcgaattgagcgacgaggacgcggcggtgatcaccacgaagaacaccagggcggacgcccagttcaacccggcatactggaacaccatgatgaacggggaggcgaaggagccgtcctcgttcggcttgaacgaggtccacggcacgatgcacatgatggccacgagcgcgcccacgtagaagatgagcacgcgcacgatgatctcgttgacggctttgggcagcacctcacgaggattcttggtctcggagacggtgacgcccacgaactcgagcagctcataggcgaagaacaccatctggaagctcatgaggaaggccatccagccgttcggggcgaacgagaagccggcgaacaggttgtcgagtccggcgtggcccgccgggctcacatgatccacgccatgaatccgcgcggccgggtaatggtagccgatcacgatcatgaccacggcggtgacgatcatcgcgccgatcagcgtgatcttgatcatcgagaaccagaattccacttcgccgaacaccttgacggcgatcaggttgacggacaccagcgacaccaggaaacacagctcgatcagccatttccaatgggtcaggtcgatgccgaacgtgtcgaagaaggtgatgaagtacgtggagacggccgtgatctcggtcatgcccagcagcacgagcgcggcccaatacgtccagccggcgaaatgcccccatccgttgcccaggtagcgggtgatgaaattgatgaaggtgtgctggctggggtcgcggtacatcatctcgccgatggcgcgcatcaggaagaacatgatgacgccgaccaggatatacacgaagacgatcgaggggccggtcagcgccagcgacttgccggaccccaggaacaatccggtgccgatggtgccgccgatggcgatgaactgcacgtggcggttgttcaggccgcgctccatctcgttggtccggtccaggctttcgacagacttgagtttgcccgtagcctgctgtgcaccaccattcacattcgtatcggccatactgatttcatttctcttctccgccgcccgattgttacgcaccggacgcgatactcgttcaaaacaagttcagactgtatcaccgaaatatgtcacgaaaacgctcagctcaagaatacatgcgatgatgctgtaagtattccgccaaaaaagttcaattcaccaacaccaaattgaacttccgtctctattccacggacttgagcgagctgaccgggtctacacgatcgagcactgggttggtgaacagctgcaccagcagcgcgaacgccagcgtcgccaccacggcaatcgcatagctgtaccagtgcacttccacttcgaaatacagcgacggcatattcaacgcagcagtcagtaatccgcctatccacctgccaagcggcagaccaaccaccacacccataccggtcaatatcatcatctcgcggttcacgtagttgtgcacctcgcggtcatagaagcccagcaccttcagtgtggccatctcgcggatgcgttcggacacgttcgtattggccaacgtaaacagcaccaccagcgccagaccgccggcgagccccacaatcagcgccaccacggcacccatcagatcgaacttaaacgtggcggccagatgcgcacagctcacggccttgagcaccgacgattcctcgcccaaccgatccgcatattcggcctgttcggtctcggaacctttcagcttgacgagcatcgcgttccacgtcaaggtcgaggcagtgccatcccccgaagccgaagacgtcacaccgtcggccgcaaacttctggtcgtacagtcgctcactgatgtacacatcagagccaacaagattgcgcgtcacggccgcgacctgcaccttggcccggctgctgccgccattgcccagcgtgacggtgtcgccggcatgaatattcagcgagttggcggcggactgcgacacaatcacgccactatcgtccaacgctacagtgccaccacccgctttgccgaaaatattgggcagtccgaaccattcatcatcgccggcttgctccaacgtgaccatatcgttcaagatattcagcgaatcgttgggcacggtcatcagctgcacggtttcgcttttctgcgccgcattgctcatttcgccgctatccacgcgcagattcagcgtttcggtggcctggccatcttctgccacctgcttgcgcatcgcggcggcgttatcgtcattggccaccaccatcaagtcatactggtagatctgctcatattgcttgacgccaatcgtgtcgacggtgtcgttaatcgcaaatccgcagataatcaacgctgtgcaaccggccacgccgcccacggtcataatcaagcgcgacttgaatcggaagatattgcgcgcagtgactttgccgaggaagttcagccggctccataccgggcgaattcgctccaacaatatgcgagcgcccgtcttcggcgccttcggccgcatcagcgcggcgggcgtgtgccgcatctcctcgcggcagacgagcgcggtgaccactcccacaccgaccacgaacagcacgatgccggccgagccgtacagccagtcgtattcaagtcgcacaccgggcaatatatacagtccctcaatcaccaccagcaggaatgccgggatgccgaggaatccgaccagcagaccgatgccgccgccgagcaggcaggcgagcaacgcgaacagcagataccggctggacacggcgagtccgccatagccgaggccaaggtaggtgccgatgagtccgcgatcttcctcgaccatgcgggtcatggtggtcaggctcatgagcacggcgaccagcaggaacacaatcgggaatgcgcggccgatggattcgatggaactgacgtctgatttgagcgagctgaatccgtcgatcgaggcgcgcgtctgcacataccaacgtgcgttggccacatcgtcgatgcgccgttgctgcttggcgaattcgctttccgcttcgcttcgcttcgcatcgagtgcagactgcgcatcatccagtttcgccttgccgtccgcgagctgttgttcgccttctttcagctgccgctcgccttcttcgagctgctgcttgccgctggccagttgggcggcctgcgcttcaagttgcgccgactgggtttcgagggttgcggcattcgcttcgagttccgcggatttggtattgagctgtgcctctcctgcagccacttcctgttccttggcggtcagttgcgcgttctgctggtccaaggtggattgtgcgggggcaatggtttcgtttaatgtgcgctgcaaatcggctttctgctgggccagactgtctcgctgcgtttgcagttccgtttgcttggcggccagctgttgccgcagctcactgattgacggcacttcaggcagggtaatgccaaggcgcgcgagcagttgcttgatggcctgccatgtgggtgagttgaagtcgatattcgggtcaagttgcgccagtagattgtcggcctgttgaatcatggacagcatctgatcaatttgcgccacgccttggtcgatttgggtaatgccctgttcgattttcgtgcgattggcggtcagttccgtttgcgccgcatcgagctgtttgcgagccgaggtgagctgcgttttgcctgattcgagctgggtgcgcgcttcggctatctgctggcgaccttgcgcgatctgttgacgggccgatgcaatctgcgcacgtccatcggcgagctgccgttcgccatcggtaatggttgtcctgttgttctccaattcggtacggctatcttgcaatgtcgtttcgttggcttccagctcggcccagttgtcgtcgatctgcttctgggcttcgtccagctgctcgttggcctcgtctttggcatcgtccagtctgcgctgcgcgctggagacgatctgttgacgacgggctttctggcgtgtggcctgtatctgatgctcgatacggtcggccacggttttgacggcttcatcgtaggcatcggaaaacgtgtcaaaatcggacgcaccagtgacggcaaccgatatcgcagtgtatatattgccggtcacgccgtcgctgggtgcaaagaacgtatagtcctcggatgaggtggaccggaaggaggtcatgcccgaatagccgtctggattgttgaggtcgcgcgggtcgagcacgacgccggtgatggtgagtttcgtggggaactgcggggattgctcggcgtcggcgtccgtattggcgtcgtcagtctccgtggccgctgccgatatgacggatgaagaggtgtcttgtggcgtcacagtaatggtgccgccaatcttgagtccgctatcgttcaggaattgctgcgtaaccgccacttcgccggccttgttcggcagtttgccctgccgtatgtacggctgatcaagcccttcggtaccgatttcctgcatggtcacggttttcttggtgccgtccaccaacgtggtcaccgtctgagaacgttcgggctgcacggtttgcacaccgtcgattcggcgcagtgccgctgcatcatcaccggtcaggccgtatgtggatagcacctgcaggtcatgcagtccctgctgatcgtaaaaacgaccggccgccagaaaagcatcgcggcatccggcgtagatgccggtcagcacggccacgccaagcagcgtaatgacggcgatcgagacgaacctcttccagctgcgcagccagcaacgcaacgtatctttggcaaataccgcagaaacgcccgctcctcgaccgccgctatcgtcgaggttccgccgtttcacagaatgtttcacaggttgttccacgaatcgcctcgcttgtttcacggggcgtttcacagagtgtcttgcagtgagcatcgccaatcacctaccattcgatatcggcgatgggctgcggcgttgcgttgacctcctcgctggtcaccttgccggagcggaagcgaatcactttatgagccatcggtgcaagcgcggaattatgcgtgatgatcatcacggtcatgccttgcgtttggcaaatatcctgcagcagctgcagtacttccttaccggtctcgtaatcgagcgcaccggtcggctcgtcacacaacagcagcttcggctttttggcaatcgcgcgggcgatggatacacgctgttgttcgccgccggacagttgcgccgggaagttccccatgcgctcccccaacccgaccttgcacaaggtttccaccgggtcgaaatggtcgggacaaatctgtgaggcaagctccacgttttccagcgcggtaaggttcggcacaagattgtagaactggaaaacgaagccgatgtcgttgcgccgataggtcaccaaatcgcgcttgcgcaatccggtgatatcgcgatcgcccacaataacacggccggaagtcgcggtatccatgccgcccagaatgttcaacgccgtggtcttgcctgcgcccgactggccgaggatgacgcttagctcaccttgatcggcggtgaaactcgcctcgtcgagcgctcgaatcacactgctgccggaggggtattccttgaccacatgatcgaattcgatatacgccatcacgcacctccgacagttcccaccacggcgcgtcacatcggcgaagccgtctgcgttcccttgttcccttccagtaaaacaacaccatgacggttgcgcaaccagcatacggatcgtgagtcgccggtctcgcccagtggcggtgggcgttgccatcacgccatacggcgttttacaatggcgggcatcgtgcatggcggggtcgccatccatgccgatagtcagaggaacctggggaagggcatcatgagcaccaacgatacgtccgaacagccgcgcgaaaccgacgatgtgccggtgccggccacgctgcgcaagtcactgaagaaccgtcatatccagctgattgcactgggcggcgccatcggaaccggcctgttctatggttccagcgaagccatcgcgctggccggcccctcgattctgctcgcctacttggtcggcggcttcgcaatcttcatgatcgtgcgcgcgctgagcgaaatgtccgttgaggatccggaggcgggcgcgttcagctactacgccactcgctactggtccaagcgcgccggcttcatctccggttggaactactggttcaattacatcctcgtctcgatggtggagctgtcagtggtgggttcgtttgtgaactactggttcccggcgattccgacatgggtgtcggcggccgtgttcttggtgattatctgcgccgccaacctgctgggcgtctccaagttcggcgagttcgagttctggttcgccattatcaagattgtggccgtgatcgccatgattatcggcggcctggccgtcatcatcttcgctctgcccaccacatccggtatcaaagcgagctttgccaactggttcaccttggaagggggcttcttcccgaacggtctcatggagcagactaaggacggcacctggaccggtctgttgatggcgcttgtcgtggtgatgttcagcttcggcggcaccgagctcatcggcatcactgccggcgaaaccgaggaccctcgtcgtacgattccccgcgccaccaatgacattatctggcgaattctcgtgttctacattggcgcgctcggcgtaatcatggccgtaataccgtggaacaccatcggcggagacgatgctcccagcccgttcgtgcaaatcttcgattccgtgggcatccacgcggccgccggcatcctcaacttcgtgtgcctgaccgccgtgatgagcgtctacaactccggcctgtacgccaactcccgcatgctgtattcgctggccaagcaaggcaatgcgcccgcgtatctgggcaagctcaacgctaagggcgtgccggtggccggcgtgctgacgtccgccgtgatcaccgccatcgccgtggtcgtggtgttcgtgtggcccgagttcgcgttcaactatctgatgtcgattgccaccatcgccggcatcatcaactggacgatgatcatgttcaccgagatgaagttccgtaaggtggtcgccgcgggcggcgctcccgaggattccgagctggccggcaagtccggcaaggaagcgctcgacgcgattcacttcaagctgccgttcgctaaggtgaccccgtgggtggtgttggcgttcttggcactggtggtggtgctcatgtgcttctccgccagctaccgtgtcgccgtcatcgccggcgtgatttggctcgccattctctttgcggcctaccagctcactcaggcgaagaagtagagtctcatctgcgaatagctctcagaatacgccgcttgacatttgcatctatggtctcatttgggtcaaattcctctaggtaacgcgggataccgcccagtgtcgcgtaggccggctccttatcctcgttgactgtccgctagctgcttagcgttgcatactatcgggagaatccacaggattggcgagatatggcttgaagacgcgctcggtgacggggatatggagcatcagcatggtgccgtaaccaaggatcaccagcaggaacagtccaccgggcatgtagaaccagctggccaccagcagcgccacgaacacggcatccacgatgaccagagccacggtcatcgcgatgtgggagatgccgaagatgaaggcgttcttcaaggtgccggccgcggtgttctcgaagcgtgcctgaagcgcgaacacccattcgaagccgataagccagaggatggtcagcgcgaatttgatgatgagcagcggcgtgatctgcaggacgatccatgaccagaccactgcaatcagcaccaccaagaacggcagccacagcagcgtggctttgatgaagttggttttgaatgacttgaagtagttggcggttacgcctttgccctcgccctcgatggagcggcggcaagcatcatggccggcagtcagggccgcaccgatggtgatgagcggaatcgaagtgaccagcatcagaatgttgatccatacgccgtcaacaagattgctccacgcgcgcatgaatttcgagtccggtgccagccagttcatcaactactccttgtgctgctcttggctccccgccagattgtcgggctcaacccttgaccgcgccgccttcggccctgcaattacggactcgcctacgacgaggctcatcattagcttcgccgctgtcgcggctcagcctggagcctgctggaagcccactgggcttccagccatgggctgacgacgcgagtcgtcagcccttgacggctcccgccatgacaccagagactatatacttctggcataccaagtagaagacgatgatggggatgatggccagcaccaggcaggccatcatggcgcccatatccacggaaccgtagccgcccttgaggtattgcacggcgaccgagatggtcttgtacttgccgaggtcgagcgtcaggtacggcagcaggtaatcgttccagatccacatggcttcgaggatggccaccgagacgatcgacggcttcatgattggcaccacgatctggaagaagatgcgcggcactgacgcgccgtcgatcatggcggactcctcaagctcctgcgggatgcccttgatcacgccggtgaagatgaacacggccagaccggccccgaaaccgaggtacacgatgcacaggccccacggggtattgagcttcagcatgtcggcgatcttggagagggtgaacatcaccatctggaacggcacgatcatgttgaacaggaacagggtgtagagcagcttcgcggcccagttgttcacgcgcacgatccaccatgcgcacatcgaggtgcacaccagaatcagcaccaccgagccgacggtgataagcagcgtccagccgaaggaggcgaagaactgcgtggtctcgatgccacgcacatagttctcaagtcctacaaacgccttgccggtcggcagggagaaggcgttcttggagatgtacgccttctgcttgaaggagttgatcagcaccaggacgatcgggaaaacccagaacagggagacgacggcaaacagcacggtccataatgcgccatgcttcacaggcttgttctcgttcatcaggctgccacctccttgctcgtggtgagcttgttctgaatcagggcgatgaccgcaaccaggatgaagaacagcacggccttcgcctggccgacgccttcccagcccatacggccgtagaaggtgcgggtgatgttcagcgccagaccttcagacatgttgctcggcgcaccgttggtcaatgcgaggttctggtcgtagagcttgaaaccgttggtcacggtcaggaaggagcacacggtgatggacggcatcatcagcgggatgatgatgcggaacatggtctgccgtccgttggcgccgtccacggccgcggcctccagcacgtcggtgggcagggcctgcaggccggcgatgtagatgatcatcatgtagccgatctgctgccagcacaccaggatgaccaaaccccagaacccgtaggacgccttataggtcagggcgcggccccagtgggccagtacgccgttcaggagcagcagccagatgtagcccaggatgatgccgccgataaggttcggcatgaaaaataccgagcggaacagcgtggatcccttgatcgccttggtcagcatgtaggcgatggcgaaggcgatcacgttgatcacgatggtggtcacgatggtgaacgcggtggagaagccgagcgcgtgcaggaattccttgtccttcagcgctttgccgtagttcttaagccccacccattcaccgtcggtaacggtggtgaattcgcagaagcttaagtagatgcccatgatgaagggcaccaggaacccgatgatgaatgcggcgaatgtggggagcgcgaacagcgcccaccatctgcgtatcgccttgccagccatgctgatcatgacttttcctcctccttgagtccgctgcgttgcgacactgcatcgtgcgccggctgcggagttcaactcaatgcgagcctgccgatcgagaaccgcatgcacggcctgttctcgttcaagcctatattcatagtaaacgtcgaatcattatatgtccaacgttgtcattttcagcgtttcaagctcgagcatactccagctccagcaatcttctttcaactaagataacggctatataaagccaatctgacgccgtcatagacactgtgcaaacgtttgtaatacaatcgttgtcatcgccgcaaatcaatcaatcagcatgtacactggagtcagttgcgcatgtgtattgcgattttccattcaacgcaagggggctgcaatggctacgagcattcaggatgtcgcccgcgaggccggcgtctccatctccaccgtctcacgttccttcaccagaccggatctggtgtcggccaagacccgcgagcgcgtgctcgccatcgccgacaaactcaatttctcactctcccgctcggctgcggccctgaaatccggccgcgccctgcgcatcgcagtactgatgagcggccatatccgcctgtggttcaccgcctcggtcatcgaggggctcaacgaggtgctgcacacgcagggctacgatatttcggtattccagatttccagcatcgaggagcgcaaggaattcttcgagatgttgccggtacgccgtaacgccgatgccgtgattgtggcgtctttcgatatcgacaacaacgaaatcgcgcaactggcttcggtcggcgtgccgatcgtcggcatcaattcagtcgagcccgaagcccgcggctttaccgccgccgtcaatatcgacgacgtgcagggctccacgctggccgcccgccatcttatcaatctcggacatcgccgcatcacctatatcagcaccaatcgcgaggtgtcgctgagcttctccgtgcaaagccgattcgactcatccaccgcctgctgccgcagggaaggcatcgagccgcaggtcatcgtctgcaaggtcgatgacgatggacgttatgaaatcagcgacgtggtcgaccaactcatgagccaagacgagatgcccaccgccatcgcatgccaggaggatggcatcgctttgccgcttatgttccagctggagcgcaatggattctccgtgcccggcgacgtctcgctggtcggctacgacgatagtttctacaccggcgatatcggcctgaccaccatccgccaggatccggcggagatggcccgcgtggcagcccgcatgacgctcgacctcattgacgagaagccgattgagcaaccctatatcgtgttcccggcccagctgaaggtccgctcctccacctcccgcgttaagtaggctcacacaacaaagcccaccatagaaaaagcgttaggcaaccgcacaataacgctcaatcgcacattgtgggaaatggcgaaaaatcgccaatccatggacccacagtgtgcgattggccgggtgtgtgcctcacactttttctgcggcggccgattttgtgcaagactcagcaatacaaagcggcgcccctggagaaggaaaggcaggggcgccgcggattgttacttatcggctatgggactctatgagactcagtgcgaggcctcgtattcggaagcccaaccgtccacgaaggcagtcttgacggcatcccacttgccggtgccctgcgcgtactcgagcagcgcctggccgaccttgttcttccattcctcggacggcatcatggtgaagttccaagaaacctgggtcttgccggactcctggtcttccacggcggcctcggtcagcgggttgtcgcttttgacgtcatcgaaggtcttgaacggggcggtgaagcccatgtcctgagagagggccttcttgccggtatccgaggtgatcacccacttgaggaagtcctcggtggccttcttgtcggcgtcggaggccttgtcattgatacaccagtagttctcggaaccggtggtcagaccctgcttctcctcgcccttgacgccgatgtagatcggcatcatgcctacctgatcgtcggtcatgccggccttctgcaggtcggtccaggcccaggtgccgttctggtagaaggcggcctcgccgagcgcgaactcggagttcgcatcatctccggtcttggcgctcagctgggtgggttcggtggtggagtcggtgatgtacaggtcgaagatcttcttgtagttcggcaggtaggtgcccttgatcttggccggctgctcggtgacgttgtcgtccttgaactcgtagtaaagcggcagattggccagatgggtcttgaagcgccagtcggagctggagtcgaagccggcggaggtgaacgcgcccttgatgccgagctcgtccttgcgggcctgcatgtcgtcggccacggccttcagggtgtcgaagttgtcgatttcgtccatagacgtggccttggcgccatccagcgcgaagtacttgttgaggatgtccttgttgtagatcaggccgtaggtttccatcacatacggcacgccgaccaccttgtcgccatccttcagggccacatcctggttggcaagctccttgtacacatccgtattggacatatcggcggtgtacttcttccagttctggtagccgaccgggccgttgacctggaacaaggtcggggcgtcggttttggcgatttcggacttcagggtctgctcgtaggtaccggaggccgcggtctgcaccttgacctcaacgcccttttccttggtgtattccttggccagagcagtccactgatcagccgcttccggcttgaagttcaggtagtagaccttgcccctggcgtcatcgccggaggtcgagcttccgcaggccgccaaagtgccgagggacatcgcagcgacagccgccatcgcgactgctgacttgactgtacgattcatcatcgaacctttctctttcatcgtcgatcccggccatccccggtcgggacaggtacgctagcacgcacctttacgactatcgacatgcactattatgcaacggtttgcttctttttgcaaacgatagcaatagcggcgcgtcatgaatcatcattttcaggccattgtcaacagatatcctattacttcagcctttttgcctcattatcacaatgcaagcgttcgcaatcatgagagcgctaacatatcttttatggcgatcgattgccacttatacccatcaaaaacaacacgccgacgctatcgtttgcaaatcatttatcgacataccgcaattcccaccacaaacaataaaggcccgcccgcagtagcgggcaggccagcgtaatcacagcgcaaccggggctaggcgttccaccgttcgatgacgttatctcccttatagacgctgagcaccgagtagtgcgccgtatccaaacgcagcaaccgcgcgaaatgcgggtccacgcccagccattgcgaggtgaggatgcgcaggatgtgcgcatgagccaccaacagcacattatggccgtctttcagaagcggcgtaatctcatcgatggcgctcttggcgcgtgccgctgcttcttccagcgtctcgccaggcccggcatgaaccggcacctgctcgcccgaaggcaaggtctcgacccaatcgccctccagcgtgggcgtcagcgagcgcggcccgtcacgccacacatcccattcaaaaccgctggcctcactcacctgctggcgcgtacgcccctcggctcggccgtaatcccattcagcgatgccgtccaacacaccatggtccgcaaaaccagccaattcagcggtttggcacgcccgcttcagcggactggaaaacacacagccctggctgaatccttcggggaaagcttcgcgcaggcgccttccggcatccgctgcctgctgctcgccgaccgcggtcaacgggatgttcgtgcgcccggtatgctgcccggattcgctccacacggtctggccgtggcgcagcaacaccaaaaatccgttgccgccacgagagttctcgacggcaacggtgccgttcacgttctgttcgctcatgcctccactctagtctgcgctcgttcatgactccaccattaacgcccatcttttgcgctgagatgattgatatgctactagactgagagtcatgagcgacgaaacgaacaccgacttcccctccagcgccgaccgcgcggtcgacagcctgcaccgcatcgacgagaaggtcaataagctgcgcgaggaccgactcaacgaccctgattctctgggcgacaagctcatcaagtcggcagccccagcgctggcaggcttggttgccggcaaagtattccagatgatatgggacaagggcacgagcaaacgcaatctgcgcaagggactggcggcagacgcgccgcaaggtctggcaatgagtctggcattcgccgccatttcggccgcactcggcgcagtggtttcgcagctgtcggatcggggctccaaggcgttcgtcgaccaccgccatcgcaagcccagccgctaatcccccggttggatgatggtttctgttggttgactgatggctcatcgctggaatttcgtcaaggaaccatcagccaatcgacaggaaccatcagtccagcacagttccgccacacaatatcggcatttcactgtgaggtaattcaccgtggcgtccggcgtctgccgtgcgacaataaagccatggttaccaacgcaacaatcgaggctcttctgggccgccgctccatccgtaagttcaaggacgaggccatcgacgacgatacccgcgccacgctcgaaaccgtcgcccagcatgccgcgtccagccagttccttaacgactggtccgccatccgcatcaccgatccggccatcaaagccaagctcgccgaattcggccatcagccgtatattgccactgcgccgctgctgtacgtgttcgtcatcgacgagcaccgcaacgcgcgcatcgccgaacgcaagggcatcgatcccgcttccgacgaattccatctcaagtacagttatcgctttacccaagctcagaacgacgcagtgctggccctgcacgccatggagaccgccgcctattcgctgggactgggctgcgtgattctcggctctctactcaacaacatccccggccttatcgacgtgctgaatctgccggaatacacgtatccggtgctgggtctggccatcggcaagcctgatcagaacccgaccgtcaagccgcgtatgccgcgcacgatgcagttcttcgagaacacctacccggctgacgccgatggagtactcgaccagctgcccgccttcgacgaagaagttcaccggtactacgatctgcgccaagccgaccgtccggtggacgccttcagcgatcaggtcgtcacaatcagtcggcaggatgtcagccatcagacgctgctcgacaaggccgccgctcagggcttccgtctggattagtgagaccaggaccaacgagataggctcgggatgggctcgtcactgagtcgtctcagtctcagcactgcgacgactcagtcccaacacctcaacatttcatcaccggataccggcaaaattgcacaaccattccgccggtgtcgcactatcaatgagcgtccacatatcagtcccattatgcggataatcaagggtcagctttgcaagaaaacccgccaaaccagcagtatccgcaccagtggtgggaatagactgcatgtggccgcaatgactacgaaccggaaaagagggactggatgcggacagtttggcaagtctttctgcgcgattgcagacgtatcttacgcaatcccgttgccgttgtggtgacgctcggcgtagcaatactgccctcgctgtacgcatggttcaatattcttgccaactgggatccctattcagccaccggcaatctgcaagtggccgtagccaatgaagaccaaggcaccaccaacgatctggtcggccatctcgatgcgggccggcaggtcgtcaagaaactcaagcagaacgacgaactcggctggcgcttcgtagacaatgaggagcaggccgtacacggcgtggagaccggcgaatactatgcagccatcgtgctgcccaaggatttcagtgccatcttggtcgaatcggtgaccggaacctccaaacagccgaaaatcaagtattacgtcaatgagaagaagaacgcgatcgcgccgaaaatcaccgacaccggtgccaccaccatcgatgagcagatcaactccgccttcgtcaccacggtagccaccaccgttgcctcggccgtttccgaagcgggagacgatctcgaccaagtcaccggcaaagtccagcacgatacgatcgatgatctcaatacggtgatgtccacgctgaacaccgttcaggattcactcaccgacttacaggacacgctggcccagtcagacacgattctcgccgacgccaaacagaccaccgcctcactcaagcagaccgtcgcggccgcgcagaaggcctcccgccagtccggcacactgttggcggaaacacaggccgggtcacaagccttctccaccacactggtcggcgcgctcgacaccagctcagcgcaactctccggactggccgttcacgtcaacaacgccgccggcagcatcaccggctccttcaacagcgcgcagaactccgtcgacaccatcaccaacacactttcggctccactgaacgccacccaaacgtcaatcagcgatctgaaaaacgcgctgaccaaagccggcatcggcaaagacaccaccgacccggccggccagaacatctggaaacaaatcgatgcgctcgactcattgatcagcaaacagcagacacagctcaacaccttccataccgacaccacacagttcatcaactccggcaaagacgccaccacgaatctttccggagccatgaccaacaccaccaccggcggcatcgcggcgctgaataccgcgcgcggctcgctgaccggcaccgtgatgccatcgctcacctcatcattgaacagtttcgccgccctgaacggcacgctggatggcacgttgacttcgttgtccggcaccttggatcaggccgacgggctgttcgaccagcttgtcgataccctgaaccaaacgaaaaccaccatcagcagcacgcaggattcgctgcgccaggtggccagcgatgtcgccaccgtacgcaccgatatcgccacgctcgatagttccgccgcttaccagaaaatccgggatacgctgcatctggatgacaagggattcggcgagttcatgggcaatcccgtcactctggccacgaaagtcgtgtatgccaccgacaattacgggtccgcagtcaccccgttctacacgaatctggcactgtgggtaggcggtttcgtgctgattgccatctacaagcttgaggtcgaccgcaagggcattcgccgtatcaccgctacgcaagcatatcttggccgctggctgttgctggtcaccatcggattcctgcaagccgtcatcgccaccatcggcgatctggtgctcggcatccaatgcgagcatccgctgctgttcatcttggccggaatcttctgttcgttcgtctacatcaacattatttatgcactggccgtggcattccgccatatcggcaaagccatcgccgtaattctggtcattgtgcagatacccggtgcctccggcctgtatccgattgaaatgatgccgaacttcttccgcgaactgcacccgtggctgccctttacctacggcatcaacgcgatgcgcggcccgatcgccggcctgtacgcgaaccattactggctcgacatgctgcacctgttctggtatctgccggcggcgcttttcgtgggacttgtcgtacgccggtatgcgatgaacctgaacgcgctgttcgaccgtcgtttgggagataccgacctgatgatcaccgagcacaacagcatggtgaacgaacaggtgagcttgaactccgtattccgcacggtgtccgacagcaaggaactgcgcgatatcatcgcccatcgcgcgcaccggttcttcgcacggtacccaaagatgatcgttgccggcctggcattgctgaccgtactcccgttcgtattcctggtgctgctgtttgtcacccaagagaaaatcgccatgctgacctcctggattctgtcgattattcttatcgacgcctatctcattgtggttgaatacgcacgcgaaacctacgccgtgcagcttggcgtcagcgccatgagtgccgacgagttccgcaatgtgatgctcaacggatatgtgtggcggcgtttccacggccacggacgtcacgaagcggcgatggacagcgatccggatatcggcgaaaccactgaacgactcacactgttcggcgatcaggccgccgagccgactgcgcacaccgcacagtccgagcagtccggtcaatccgggcagcctgagcaacccggtcagtccgggcagcctgagcaaggagacgcacgatgaagcttatctggaaaatattcgtacgtgacgtgcgccaagccacccgcaatgtgatcgccgtaatcgtggctatgggattggtgattgtgccggcactgtacgcctggtacaacatcgccgccagctgggacccgtacggcaacaccaaggccttgaaggtcgccgtggcaaacgtggataagggctataagtccgatctgatgccgatcaccatcaacgtcggcgaaaccgtgaccaatacgctcagggccaatcatgaccttgactggcagtttgtggatcgtgctaaggccatcgatggcgtgaactcaggcgaatactatgccgcgctgattattccaaagagcttcagctccgatatgatgacgctgttttcaccgaagatcaagcacgccaagctcgaatactatctcaatgagaaaatcaatccaatcgctccgcatatcaccgaccagggtgctaccaccgtggccacgaccatcgaccagacattcgtgaagaccttggcgagcgtggcgctggatttggtttccaacgtggccgattacgcgcaaagcccgcaaatggagcagtacgtcaacaacgccaccagtcatattgctaccatgtcgtctcgttcgaccggcactgcgtcgcagatggattcctatgccaatctgctcggggccgccaacagcatcattgattccaccgataagctgctggggtcaacaggctcagctgcggccacaaccaaaaaggcgttgaaacagacccgcaacggcgtctccagcctcgacaaggcattgtccggagccaccgatggcgtcggtacggcattgcagcaggccggttcatcctacgacaccattgccaagcaaatcgatgccgcttttgccgatgtgggctcacaatcctcacagatatcaaacaaactaaccgatatgcaatccaaagtggaggctcaggccgacagctttggaaagtatgccgccgctttacgagatctcgccaaacaagcggcttcactgcccgtgggcggagataccgttgccgctcaactgaacgcggctgcagaccaagccacaaaggcgcagcagagcatgcagcaagccgccaccgcgttgggcgatgcggccacgcacatagcaaacggcactgccgatgccgatacagcgcgtcgagatctgaaatcacaaatcgccgccgccaaacaatcgattactcaggcttcagacacgtacaagagcacgctgaaaccgcaactgaacaatctgacctcgtccatggacgaagtggccacgcaggcaagttccgtaatcgacgggcttgcgtcgaccgtcagcagcgtgtcaggtctttctggcggcgtttcagacagcctgacggacatccagtcggccttgactaacgcagctaacgctttgacccgttcggcgaagaaactcgacaacttgtcttcccaactcgcctctatcaccagtggcggcaccaacgacctgtctgtgatttcctctgcgaagcccgatgccattgcttccatgctggcggcacccgtagcggtcgaccgcatcgcgctctatcccgttgccaactatggttccgcgatggctccgttctacacgattttgtctatttgggtcggtgcgatcattctggtcgccatgttgaaagtatcgatttccgaccatgagaaggctcgtatcttagggctgggcaatgatctgccgctcggttcgggagtgggtcttcgcgaggccatgattgccgggcggattgctggaccggccgccgcgttggatgtgctgaagaagccgcgtgccgagtcttccggcaatgcgcggcagttcggtttacgcttgcaccacgaatatttcggccgatacatgattttcggtttccttgctttgctgcagggcacgctggtctgcctcggcgacatgttctacctcggcgtgcagtgcgagcacccgatccggttcatgatggtcggctggctgaccgcgctggtgttctcgaacatcgtgtacacgttggccctgtcgttcggcgatatcggcaaagccatcgccgtggtgctgctggtgatgcaggtggccggttccggtggcacgttccccatcgagacgttgcccccgttcttccaggccgtttccaaatggctgctgttcccctatgcggtggacgcgatgcactcggccatggccggctcgttcggcatggagtattgggtttccatgggcaaactcgcgttgttccttgttccttcgctgcttctggggcttatgctgcgcaagccggtgatccgcctgaacgattggatcatccgcaatctggaaagcaccaaggtgatgtaagtgttggacggagtgtgtccgagcgccctgaacgcttagcagcctacgacctggcgtgtttggaccgtaacctgtctcagacacggcgttggcgaggcctgtggagcttctgacgctaacgtctacgtggcttgtagccctttttacgactgtgtggcttgagttgctggttcagcggcacatgccggtaactggattgtggatcgcgatgcgtgaggtgccagcatccgcagtattcgcaacggtacacccatagctcggctccgcgctcgatcaggctttgatcggcggcacgctgagcctgtgccttatcgtgatacatgattttattcgacgtagcgcaacgtttaggggtgaagtaatgcatagcagaagccagtgtagagcgaccccataaccaagccagtttctggctttcctctttgaggggagtcgtccgcgcggcggaccagggggcctgggcgtcgggctcccacggtcgcggacgcgccgcgccgttcggcctcgccgtcggggctggccgggaatggtcccgggcgtgggtctcatgggtatgcggggaggtcccggtgcctgtgtgggtttgggtcggggttggtttcgggtatgcgggaagccccggtaccttcaaggtatcggggcttcctgtacgtgtgatgcggcggcgtgctactctcccacaccctgtcgggtgcagtaccatcgccgtgccaggccttagcttccgggttcggaatgggaccgggcgtctctcctgggccatggccgccgcaaatcttctcttgtacggtcagacgctggggtctgccggcctgtggcggcctgggaaccggataggggacgcgattgccgttgatgtttcgtcttgtggccagacaatgctcatcgtcgtctggtgtcgtttgcaggaggatgatgcggtccccgaacggatcggggaatgatagtgttgcctttcgtccgttagtaccggtcggctccacccctcgcggggcttccacgtccggcctatcgaccacgtgttctgcatggggactacagcagcccgaggctgcacggaatgcttatcttggagcaggcttcccgcttagatgctttcagcggttatcccttccgaacgtagccaaccggccgtgccactggcgtgacaaccggcataccagaggttcgtccacccaggtcctctcgtactatgggcaggcctcctcaacattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgtccgtacaccggcaccggatcactagtcccgactttcgtccctgctcggaccgtcgtcctcgcagtcaagcccgcttgtgcacttgcactcgccacccgattgccaaccgggctgagcggacctttgggcgcctccgttactctttgggaggcaaccgccccagttaaactacccgccaggcactgtccctgaacaggatcactgttcgaggttagacatccaatgcgaacagagcggtatttcaccttgcggctccgcacgatctggcgaccatgcctctcggcctcccgcctatgctacacaatccacaccgaatgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcacccgaaggctgacggatcctcttaaccttccggcaccgggcaggcgtcagtgcatatacagcggcttgcgccttcgcatgcacctgtgtttttggtaaacagtcgctaccccctggtctgtgccacccccaaaagctccccgcgcgaggcggctcaccatcgggggtctcccttaaaccgaaggaacgggagtgatttgccgagttccttgaccaggattcgctcgatcgctttggtattctctacctgaccaccagtgtcggtttggggtacgggcggcttcgagcctcacgccgaagcttttctcggcagccgggatcaccggatatcgggccacaaggcccccaccatcgcacctcgcccacacgccccgcggatttgcctacgggacgggctgcgtgcttgaccacggaaaaccacctccgcggccggctacccttctgcgtcactcctgcgctgacctactacaaggatcggtcccaacaggcccaggcatcccaccccgaaggggaagcaagcccggacccggaggttagtactccaagcctcggttctggcggctgaaagccggtacgggaatatcgacccgttcatccattcgactacgcctgtcggcctcgccttaggacccgactcacccagggacgatgaacgtggccctggaacccttggtcatccagcggacgggatcttcacccgtctttcgctactcatgtctgcattctcactcccatgaagtccacggcgcgttcacacggccgcttcgcccctcatgggacgctctcctacccagtacaaaatactgccgcgtcttcggtggtgtgcttgagccccgctacattgtcggcgcggaaccactagaccagtgagctgttacgcactctttcaaggatggctgcttctgagccaacctcctggctgtctatgcgactccacatcctttcccacttagcacacgcttcgggaccttagacgacggtctgggctgtttccctttcgacgacgaagcttatcccccgccgactcactgccgggatacacgtcaccggtattcggagtttggttgctgttggtacccgatacgggcccgcaagcatccagtagctctacccccgggacgcaatgacccgacgctgcacccaaatgcatttcggagagaaccagctatcacggaatttgattggcctttcacccctaaccccaagtcatccccccggttttcaacccaggtgggttcggtcctccacacggtcttacccgcgcttcaacctgctcagggctagatcatcccgcttcgggtccaggacacgcgactttaaacgccttttaagactcgccttcgctacgcataccccacacgggttatgctcgccacatgccactgactcgcagactcatttttcgataggcacgccgtcaccccacaaagaggctccgacggattgtaggcgcacggtttcagagactgtttcactcccctcccggggtacttttcacctttccctcacggtactcgttcgctatcggtcagacaggaatattcaggcttacccgacggtccgggcggattcgcacggggttccacgggacccgtgctacttgggagacgcgatcggcagaccatgcgcgttcaggtacggggccctcaccctctgcggcccggtattcaacccggttcccctgacacatggttttctacaactgccggccggcccgtcggagccggcacacgcgatcccgcaacaccccacacgcaacccccgacgggtatcacacgcgcaaggtttggccatcatccgctttcgctcgccactactcacggaatatcctttcctgcaggtactgagatgtttcacttccctgcgtaccccccggccgaagccggtaccgacccatgacggccggtgggttcccccattcggaaatcctcggatcaaagccctgtaggcggctccccgaggcttatcgcagcctcaaacgtccttcatcggtcctgtctgccaaggcatccaccatacgcccttgcaagcaacacacaccatgaaggtgcatggccgcaagattcctctagcaaattcccagacgacaaatcatcacactaaaaatgatcacaaaacgatcgaaacgaacaatagagttcgattcgaaatcaacagcaaaacaaagattcaaaaccattgttttgctcgcgtccactatccagttctcaagccaccacgcaccgccacgccaaccagaccggcacacggccggcccgcaggcacgacgggcatcgaatcgcgccaggcaaaagcctggggtggcgatccgggagcccaaaagcgcatccgcaccacccccgcggaacatcccacgacggacgaaccgaaagcccatgatctcttccacaccagcaacccgtccacacgcgaccatcgcgcgggagggtccgcaccggacgccgaacggcatcctgtattctccgtagaaaggaggtgatccagccgcaccttccggtacggctaccttgttacgacttagtcccaatcacgagcctcaccttagacggctccatcccacaaggggttaggccaccggcttcgggtgctgcccactttcatgacttgacgggcggtgtgtacaaggcccgggaacgcattcaccgcgacgttgctgattcgcgattactagcgactccgccttcacgcagtcgagttgcagactgcgatccgaactgagaccggttttcagggatccgctccgcgtcgccgcgtcgcatcccgttgtaccggccattgtagcatgcgtgaagccctggacgtaaggggcatgatgatctgacgtcatccccaccttcctccgagttaaccccggcggtcccccgtgagttcccggcacaatccgctggcaacacggggcgagggttgcgctcgttgcgggacttaacccaacatctcacgacacgagctgacgacgaccatgcaccacctgtgaacccgccccgaagggaaaccccatctctgggatcgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttagctccgacacggaacccgtggaacgggccccacatccagcatccaccgtttacggcgtggactaccagggtatctaatcctgttcgctccccacgctttcgctcctcagcgtcagtaacggcccagagacctgccttcgccattggtgttcttcccgatatctacacattccaccgttacaccgggaattccagtctcccctaccgcactcaagcccgcccgtacccggcgcggatccaccgttaagcgatggactttcacaccggacgcgacgaaccgcctacgagccctttacgcccaataattccggataacgcttgcaccctacgtattaccgcggctgctggcacgtagttagccggtgcttattcaacgggtaaactcactcacgcttgctccccgataaaagaggtttacaacccgaaggcctccatccctcacgcggcgtcgctgcatcaggcttgcgcccattgtgcaatattccccactgctgcctcccgtaggagtctgggccgtatctcagtcccaatgtggccggtcgccctctcaggccggctacccgtcgaagccacggtgggccgttaccccgccgtcaagctgataggacgcgaccccatcccataccgcgaaagctttcccagaagaccatgcgatcaactggaacatccggcattaccacccgtttccaggagctattccggtgtatggggcaggtcggtcacgcattactcacccgttcgccactctcaccaccaagcaaagcccgatggatcccgttcgacttgcatgtgttaagcacgccgccagcgttcatcctgagccagaatcgaaccctccacaaaaagaatgcgaagagacatcgacagatgactctcaaaacaaaaattgacgagcacgtccttaaggaaggacgccctcaaaaaacctcacccctcatcaaaccctcccgggtacccgaccaccacgacaggcgatcaggcgaggaatgaactggcaatcattgactataaagaagtagtacaaacacgctcttgagttctcaaaccaccaccacacacccacctcacagcccccaccgaagggaaccactcgctgagcggcagcaaggaaataacttacacgcattcgcagactcgcgcaaatcgggcgcacgaagataagccaaaatcgttgaaacgacaggcttcgctcggcgtgtcgaaatcgacgtttcgcacgtccatatcttcagtctagaactagatatcgtcgaaaaatggattgaaaattttggtcgatgggcgtgtcgcgaattacctcttacggcgcatgtgatgcaccgccaattatcggaatcatcattgatccagtacaccgataaggaccattatgttcggattactatatgctcgccagtcgtgcaccaattaaccgcctggtagcgatgcagttgccgtattgcttgccttggcacgaccaacgactgaatggcatcagcacattcagagtcgccgattcaatccatgcatcgcagcatagatcagtcgtggtctcacgggtatggggaggccccgttgccgtgtgggtgccggggtgtcctgtttgtgtccgggtatgcggggaggtcccggtgcctgtgtgggtttgggtcggggttggtttcgggtatgcgggaagccccggtaccttcaaggtatcggggcttcctgtacgtgtgatgcggcggcgtgctactctcccacaccctgtcgggtgcagtaccatcgccgtgccaggccttagcttccgggttcggaatgggaccgggcgtctctcctgggccatggccgccgcaaatcttctcttgtacggtcagacgctggggtctgccggcctgtggcggcctgggaaccggataggggacgcgattgccgttgatgtttcgtcttgtggccagacaatgctcatcgtcgtctggtgtcgtttgcaggaggatgatgcggtccccgaacggatcggggaatgatagtgttgcctttcgtccgttagtaccggtcggctccacccctcgcggggcttccacgtccggcctatcgaccacgtgttctgcatggggactacagcagcccgaggctgcacggaatgcttatcttggagcaggcttcccgcttagatgctttcagcggttatcccttccgaacgtagccaaccggccgtgccactggcgtgacaaccggcataccagaggttcgtccacccaggtcctctcgtactatgggcaggcctcctcaacattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgtccgtacaccggcaccggatcactagtcccgactttcgtccctgctcggaccgtcgtcctcgcagtcaagcccgcttgtgcacttgcactcgccacccgattgccaaccgggctgagcggacctttgggcgcctccgttactctttgggaggcaaccgccccagttaaactacccgccaggcactgtccctgaacaggatcactgttcgaggttagacatccaatgcgaacagagcggtatttcaccttgcggctccgcacgatctggcgaccatgcctctcggcctcccgcctatgctacacaatccacaccgaatgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcacccgaaggctgacggatcctcttaaccttccggcaccgggcaggcgtcagtgcatatacagcggcttgcgccttcgcatgcacctgtgtttttggtaaacagtcgctaccccctggtctgtgccacccccaaaagctccccgcgcgaggcggctcaccatcgggggtctcccttaaaccgaaggaacgggagtgatttgccgagttccttgaccaggattcgctcgatcgctttggtattctctacctgaccaccagtgtcggtttggggtacgggcggcttcgagcctcacgccgaagcttttctcggcagccgggatcaccggatatcgggccacaaggcccccaccatcgcacctcgcccacacgccccgcggatttgcctacgggacgggctgcgtgcttgaccacggaaaaccacctccgcggccggctacccttctgcgtcactcctgcgctgacctactacaaggatcggtcccaacaggcccaggcatcccacccccgaaggggaagcaagcccggacccggaggttagtactccaagcctcggttctggcggctgaaagccggtacgggaatatcgacccgttcatccattcgactacgcctgtcggcctcgccttaggacccgactcacccagggacgatgaacgtggccctggaacccttggtcatccagcggacgggatcttcacccgtctttcgctactcatgtctgcattctcactcccatgaagtccacggcgcgttcacacggccgcttcgcccctcatgggacgctctcctacccagtacaaaatactgccgcgtcttcggtggtgtgcttgagccccgctacattgtcggcgcggaaccactagaccagtgagctgttacgcactctttcaaggatggctgcttctgagccaacctcctggctgtctatgcgactccacatcctttcccacttagcacacgcttcgggaccttagacgacggtctgggctgtttccctttcgacgacgaagcttatcccccgccgactcactgccgggatacacgtcaccggtattcggagtttggttgctgttggtacccgatacgggcccgcaagcatccagtagctctaccccgggacgcaatgacccgacgctgcacccaaatgcatttcggagagaaccagctatcacggaatttgattggcctttcacccctaaccccaagtcatcccccggttttcaacccaggtgggttcggtcctccacacggtcttacccgcgcttcaacctgctcagggctagatcatcccgcttcgggtccaggacacgcgactttaaacgccttttaagactcgccttcgctacgcataccccacacgggttatgctcgccacatgccactgactcgcagactcatttttcgataggcacgccgtcaccccacaaagaggctccgacggattgtaggcgcacggtttcagagactgtttcactcccctcccggggtacttttcacctttccctcacggtactcgttcgctatcggtcagacaggaatattcaggcttacccgacggtccgggcggattcgcacggggttccacgggacccgtgctacttgggagacgcgatcggcagaccatgcgcgttcaggtacggggccctcaccctctgcggcccggtattcaacccggttcccctgacacatggttttctacaactgccggccggcccgtcggagccggcacacgcgatcccgcaacaccccacacgcaacccccgacgggtatcacacgcgcaaggtttggccatcatccgctttcgctcgccactactcacggaatatcctttcctgcaggtactgagatgtttcacttccctgcgtacccccggccgaagccggtaccgacccatgacggccggtgggttcccccattcggaaatcctcggatcaaagccctgtaggcggctccccgaggcttatcgcagcctcaaacgtccttcatcggtcctgtctgccaaggcatccaccatacgcccttgcaagcaacacacaccatgaaggtgcatggccgcaagattcctctagcaaattcccagacgacaaatcatcacactaaaaatgatcacaaaacgatcgaaacgaacaatagagttcgattcgaaatcaacagcaaaacaaagattcaaaaccattgttttgctcgcgtccactatccagttctcaagccaccacgcaccgccacgccaaccagaccggcacacggccggcccgcaggcacgacgggcatcgaatcgcgccaggcaaaagcctggggtggcgatccgggagcccaaaagcgcatccgcaccacccccgcggaacatcccacgacggacgaaccgaaagcccatgatctcttccacaccagcaacccgtccacacgcgaccatcgcgcgggagggtccgcaccggacgccgaacggcatcctgtattctccgtagaaaggaggtgatccagccgcaccttccggtacggctaccttgttacgacttagtcccaatcacgagcctcaccttagacggctccatcccacaaggggttaggccaccggcttcgggtgctgcccactttcatgacttgacgggcggtgtgtacaaggcccgggaacgcattcaccgcgacgttgctgattcgcgattactagcgactccgccttcacgcagtcgagttgcagactgcgatccgaactgagaccggttttcagggatccgctccgcgtcgccgcgtcgcatcccgttgtaccggccattgtagcatgcgtgaagccctggacgtaaggggcatgatgatctgacgtcatccccaccttcctccgagttaaccccggcggtcccccgtgagttcccggcacaatccgctggcaacacggggcgagggttgcgctcgttgcgggacttaacccaacatctcacgacacgagctgacgacgaccatgcaccacctgtgaacccgccccgaagggaaaccccatctctgggatcgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttagctccgacacggaacccgtggaacgggccccacatccagcatccaccgtttacggcgtggactaccagggtatctaatcctgttcgctccccacgctttcgctcctcagcgtcagtaacggcccagagacctgccttcgccattggtgttcttcccgatatctacacattccaccgttacaccgggaattccagtctcccctaccgcactcaagcccgcccgtacccggcgcggatccaccgttaagcgatggactttcacaccggacgcgacgaaccgcctacgagccctttacgcccaataattccggataacgcttgcaccctacgtattaccgcggctgctggcacgtagttagccggtgcttattcaacgggtaaactcactcacgcttgctccccgataaaagaggtttacaacccgaaggcctccatccctcacgcggcgtcgctgcatcaggcttgcgcccattgtgcaatattccccactgctgcctcccgtaggagtctgggccgtatctcagtcccaatgtggccggtcgccctctcaggccggctacccgtcgaagccacggtgggccgttaccccgccgtcaagctgataggacgcgaccccatcccataccgcgaaagctttcccagaagaccatgcgatcaactggaacatccggcattaccacccgtttccaggagctattccggtgtatggggcaggtcggtcacgcattactcacccgttcgccactctcaccaccaagcaaagcccgatggatcccgttcgacttgcatgtgttaagcacgccgccagcgttcatcctgagccagaatcgaaccctccacaaaaagaatgcgaagagacatcgacagatgactctcaaaacaaaaattgacgagcacgtccttaaggaaggacgccctcaaaaaacctcacccctcatcaaaccctcccgggtacccgaccaccacgacaggcgatcaggcgaggaatgaactggcaatcattgactataaagaagtagtacaaacacgctcttgagttctcaaaccaccaccacaccagcaagacggaaaaccaaccagaggaaggaacccgccgcgctgagcggcaacaggtgaataacttacacgaacacacgaacacacgcaaatcgaagcgcgcaagaacctaaggaatcggcggaatagcgcggttccctcggcgtgtcgcacagagcccactttgctctgatgaggctaggttaactcctcaaatgtttctgaaaagcatcaaatccactatgcggctggcgtgtcgcgagagttttcagctagtcggccctgcgttcatctctcggcaaccacactgccggcgcacaatcggcacatgacagcgctccgtcatcggatttcgttcatgaatcgcgggtatacctgtggttatgaccaagaagattgctgtattaaccggggcgggcatttccacgtccgccggcatccctgatttccgcggtccggacggtgtgtggaccaagcatcctgaccaaatgagcgtttacgacatcgatctgttcctgcgcaacaaagaggaccgcgagtactcctggcgctggcaaaaggaatcgccagtatggaatgcgcagcccggcactgcgcataaggcgctggtcaagctggaacaagccggcatgttgacgctgctggccacgcagaacttcgatgcactgcatgagaaggccggcaacagcgacaacgtcatcgtgaacctgcacggcactatcggcacctcgcattgcatgaagtgccatcaggaatatgccacggcggacatcatggcccgtttggatgaagaacccgatccacattgccatcgcaaactgaagtatcgtggcgatatgccatgcaatggcattattaaaaccgatgtggtgtatttcggtgaggcgctgccggacggagcgatggagaagtcgtacagcctggccaccaaagccgacgaactatgggtaatcggatcgacccttgaggtgtacccggcggcgagcattgtgccggtggccgcgcaggcgggcgtgcccatcaccattatgaatatgggtcacacgcaatatgaccatcttgcgagccgcttgattcatgaggatatcgccgctgccctgccgaagttggtggacgagacgattgcggagaacaagtagccctcagcataacgaaagcgccggtaggtgggttaagcaaccgatgattggcttaaccacccaccggcgctttcgcgccacctcccgctagcgggaggtattggaacacacttctgcgcggcctcccgccagcggtattggaatcagtagatgcgcttgggctggaatccggcttccctgagtgccgcgaggatgcggtcgatgtgctcggggccgttggtctcgaccgtgacgccgagagacaccgcgttggtgtagtggccggatgccttgaactggtcgtgatcaagctgaatgacgttggcgcgctgctcggcaagcagggtggccaccttgacgagctgacccggagtatccggcagctcgacctcgaagttcatgatgcggccgcgggcaatcatacctttctgaatcaccgcacccatggtcacggtgtcgatgttgccgccggacataatcggcaccaccacgtgcgggccggtggcggcggcgaacttgcgcgaacgcaggttcaggtgttccagcgcagccagcgaaacggcgccggccgcctcgaccaccagcttgtgcttctcgagcatgagcagaatcatttcgttgatgtcacgctcggtgacggtgaccagatcgtccaggaactcgttgatcagagcgaagggcaggtcgccggggtgcttgactgcaacaccttcggcggaggtaaccacatggtcagccggagacacacgacccgcggccagcgagtccttccatgccggggagccctccggaatcgcaccgattacgcgcacttcaggcttgaatgtcttgatggcgagcgccacgccggcacccaggccaccgccaccgagcggcacgaccacgtcagtgacgttcggcacgtcttcgaggatctccagaccaatggtgccttggccgcagatgacttcgtaatcgtcgaacggcggcacgtaaatcatgccttccttgtcggcgagctcagcagcgtgggcggcggattcgtcgaacacatcgccgtacagcaccacatcggcgccgtaggccttggtggcatcgaccttcagcggcggggtgatctgcggcatgcagatggtggccttcgcaccacgctcacgggccgcataggccacgccctgggcatggttgcctgcggatgcggtgacgatgccacgggcgatctgctcttcggtgagcgatgcgatcttgttgtacgcgccgcgaatcttgaaggaaccggtgacctgcaggttttccggcttcaggagaatctcatgaccggtcatctcgctcaataccggcgaagggataatttccgtatgacgggcagtccctttgagacgtttggcggccaacttcagttcggctgcatgatcacgctgcagcgccttcaaaacatccttttgttccatagcttttaattgtatggcgcggggacaccgaaaacagtggcttatctcgctaacgagcgctcatttacggtaattcccgttcgtaatcagctttcgaggggctgatttggcttcgcggggaggtctatctcctcttcgaggggctgcctgatcgtgcaatgcgtgagtatgacacatcatttgcagcggtattatgcggttttcggagcccggctattcaggcaccaaccccttgaaacggagatagacctccccgcgaagccaaatcagccccttgaaacggagataccgcctagcaacacttataggctgacgacgacgccctcccatggtgcaagctcacggccggcaagagcggtcacagcgtgcgcggcgtcatacgtgctgatcaccacgttcgactcggcaaggccatcggccactgctaacagttcggcggattcgcgaggcaaatcaacagttcgcccggacatattgaccacgaccaacaacttctcgtcaccgagggtacgagtgaaggcatacacatgcgcatcgtccgcgtcgagcagctgccagtctccggctaccaccataggcatgtcgtggcgcagagcgatgagccgcttgtagaaggagtacaccgaatccggatcatcgaattcgccggcggcgttgatctcggcatgattcggattcacggaaatccatggctcggcggctgcgtcaggtgcggtgaaaccggcgtagacggagccatcccactgcatcggtgtgcgtgagttgtcacgaccgcgggcggcgataccggccatcatggattcgggcgactgcaccttggcttcctcaaccctttgacggtaagcgttcagggactcgaggtcacggtactggtctaggcgcgtgaagtgggcgtcggtcatgcctagctcttcgccctgatagatgtacggggtgccgcgatgcatgtgcagcatcaggccaagtgccttggccgaacgcacacgagattcctccgaggagtcatcaccccaacgagaaacgacgcgaggctggtcgtggttaccagtaaacaggcttgcccagcctgcattcttcacggccgcttgataaccggccataatgctcttgagcttcggcaggtcaagtggcagtggcttccatttgacgccttcgcagtcaaaatcaacgtgctcgaataggaagagcatatccagctcgccattggccggatcggtgatgtattcgttgcgctgggctgtgacgcctggcgcctcgcctacagtcaggaagccgtcacgcccttcgaatacctcacggcgcatttcagccaggaattcatcctgacgggggccgtccgcacagaacggattcgggtcggagtagccttcctcacccacgggcagatcttccagctcggaaccgtactcgccgggcagcttgccagacaggtccgtgcgcttggagataagggtgatgacgtccatgcggaagccatcgacgccgcggtcaagccaccagttcatcatgtcgtacactgcacggcgcacagccggattttcccagttgaggtccggctgcttcttcgagaactgatgcaggtagtattcgccacgctcagggcaatactcccatgcagaaccgccaaagtaggagccccactggttgggctcggcaccgggctcgccggcagtggtgccgggacgggcgggacgccaccaataccagtcggcgtgctcatcatccttgtttttggacgcttcaaaccaggtgtgttcatcggaagtgtgattgacaacaagatccatcacgatcttgagcccgcgcttgtgggcctcggccagcagctcgtccatatcgtcgagcgtgccgaacagggggtcgatgtcctggtagtcggagatgtcgtagccgttgtcgtcctgcggggacctgtagaccggagagagccagagcacatccacgccaagatcggcaagataatcaagccgtgatgtgatgcccttaagatctccgaaaccatcgccgttcgtgtcttggaaggaacgcgggtaaatctggtaaacgaccgcattggaccaccatggattcggggtggcaccgttggtgcggatggaatctggaattactgtgcgttgtgaagtggtcatcgttggctcctccattatttatggtctacattgcctgttgctcatagtctaaaaagcgctgaattacatttccattggggaactgcgttggtgtgccggaaacaaaaactgcaaagagccggaaggcactgctacggctcaattctcataagctgcacatgctatttagcaacatatgggccctttcgctgtttgtggtgggtgactgtgccgtggggtgatgttggtcgggtaggttggaggcatggatgcctctcacctgttcaccgccgcgcttcggctgcggtcgccttggagggtcgggtctgcggacttccgtgacgccgacggcgacgggcgggagccgcacatcacgatcggcttcgagcccggcagagggttcatgctcctgttcgaggcgtgggtgtggctatatcgcctgtgctcgtggatgatgcactcgaggctcgaacctatgaaggagctcgcccgcttgttccgccgccacttcgccaccataatctacctgacctgcggcagctcacatattaacggttcttctgattgcgacgcgcaagagcaacttcgggcgcgcttggattgcctgcttgaacccactggtgcggggatagatgatttagttgacacgcctgcgggaatctggtggggatttcgctggcacaccggatttcaagcaaaccccgcctcgggaaccgctccggacttcggcgttggcccggttcgtatgtcaatcgattgccgtctgaaccgggacagaatccgctgtcccggttcgcgatttttgtccttttttacaaacagggacaagccaatctccgcagttcatatgctccgtaatacaaaatcggcggaatagagccgatcccggaatcaacatgttgtcccggttttcacataaaacgattgacattcataccgggacaatgaaaattgtcccggttcgtgaaaatcgcccgaaaccgcgaaccgggacagcggattctgtcccggttcgcgcgtcaaacggttgatatgtggaccgggacaagccagtggcacggcgacacagcagatgcgctcaattgcaccgtaagccgtacggtttcgtcactttttcattcgcacaacgagcaaaaccacatgacctttgtgcgccaccgccacatcaaccgaccgtcgcctttattgtggcggtttccagtatggcaacaggacagaaaagcctcctccggtgagagccggaggaggcttgggtggaagcggacctttacttcacagagtcctgcaattcaggactggcctacggccagacccaacatgacctcgcgagtacgcgacctatccggccgcccgggccgggaaacagcccacagggctgtttccttaatcggctcgtctcgctcgacgcggtgaagtaaagcagcgcctgcgctgttttacttgaccgctcccctcatcacaccaccaacgacccacttttgggcgaagatgtagacgatgaggattggggccatggccatcaggtagctggagaaggccatcgggtagttggtggcgaactgcgagctgaagacgtactgggcgagcgggatggtctggttcgactggtcggtcaggatgatcaacggcaggaggaagtcgttccaggcccacagtgcggtcaggatggcgatggtggcgttaatcgggctcatcagcgggaagatgatggtccagaaaatgcgccacgtggatgcgccatcgatgcgggccgcctcttccagcgagaccggaatcgaacggatgaagcccgtggcgatgaacaggttcgtgcccaagccgagcaccgtgtacaggatgatcaggccgacctggttgtccagatgcagggagcccatctgcttcgcaatcggcagcatgacgaccgggaacggcacgaacatggcggcgatgaagaagtagtacaggaagcggaagaagcgcttatccatgttgcgggccacggcgtaggccacgaaggtgttggtcagcagggtgagcaccacggcggccaccgtgataatcgcggagttgagcgcggccttcgggtagttgaccttggcggaggcgtcggcgaagttatgccactgccacgaggtgggcagagcgaaggtgccggcttcggccggggtcttcagcgcggtgacgatggtgaagtagagcgggatcagaatggtcaggctcagcactgccacagcggcggtcagccaccagttgatgcggtgatccctgcggaacttggcgggcttaccggctttggacggagcaactgttgcagtagtcatttcttatcctcccctaaatcagatttgttcctggctgcgggaaatgcgcagctgcacgaaggcgataatcgccagcacgatgaagaagagcacggcgttcgcggtctggtaggcgtactcgccaccggtcaggccacccttccaaatgaggtaggtgacggtttcggtggcggagttcgggccgccatcggtcaaggcgacgacctgatcgaaggtaccgagcgcgttcttcatggacagcacgaggttgatggtgaagaacggtccgatcagcgggaaggtgatcttccagaacttctgccagggattgacgccgtcgatggcggcggcctcgtagatttcgtcgtcgatggtctgcagaccagcgaggtagatgagcaccgagtaggcgatgccctgccagacggcgaggaaaacgatcgggatccagctgagctgctcattggtcagcagcgaggtggacagccacttgatgccgagtgccttgccaagttcgggcaacgggttcatgaagatgtacttgaacacgtagccgatgaccagcacggagagggtgtagggaatgaagaagatggcacggaagccgtttttgaaggcgatcttcgagttcagcatcaccgataggaacagggcgatcacattgatcagcactgtgatgagaatggcgatgaagaatgtgaacaggtaggcgtggcccacacggttgtcttgaaagagagcgatgtagttcttcaggccgatgaacttgtagtcgccgtatccctgcgaattggtgaaggaatactttacgccgtcaagaaatggcaggtagaggaagaaagcgaagatgatggccgccggaaccgccatccaataataggcggggtccactttgcgggtggagaaggcggaaaccttcttcttggcgggtttcttggcagcggacttagcggccggagcagcggtcttagttgcagttgcgtgtgacatgatgttctcctctcctaccgatcactcgaaggtcctggcttggaccttgtcccattcggtctgcatctggttcaggaagcggtcggtgttgccggaggtcaccatggtctgcaggtagccgccgatgttgatggacgaaggaatgtagtggtcgcagaagtcggccagtcggttttcctcgaagaacgggcgcacggtttccagcgcatcgttgccgaagtaggtgtccttcagcggcgtgatggcggactgggcgtcggcgtaggcgtcaagctgatccttctgcatgaggaactcgacgagcttcatcgcttccttggggtgcttggtgttcgcaccgatggtgagcatcacgtcgtcgccggcggtgaggatctgctcgctggcgtcatcggtggccggcatctgggcgaaaccaagttcgatatcggggttgatcagcaggatctgcgggatggcgtaggtgccgagcgggatgatcgcggccttgccttgggcgaagttctgcgtgccctgctggtaggtgacgccggtgtccgcagtggagtaggtgaagagctgggattccttctcgactgcggtcttccacagttcctggaacgtggtcttgccttgcttgagctcggtgtacttcgactcgggaaccagcgtgccggtcagcgaggcgagcggggcctgggtggtccaggcgtcggccactgtgccctgcagcgggttgatgccggcgtccttgaaggtgttgagcatgtcggtgaactcggcccacgtggtcggcgggttctccgggtcgagacctaccttgcggaacagcgccttgttgtagatgtaaccggaggcgttgccggcaaagggcagaccatacaggcgcttcttggaggaatcggtggtctgcaccaggtttttggcgatctgcaccatgccggggttgagggtatccacgatgggctcatcggtgaagtcgtagaaaacaccggatgcggcgaagttgccgaagctgatgtcgccgttgaaggtgattacgtccggcacgcggttcttgacgaagcgggtgcgtagatcggtctgggcgttggcggagttgttgatgttgaccttgatggtcgggttctgcttttcgaagtcggcgaccatggatttgaactggtctgcagcctcggacttgaactggaagaaatccagcgtaacggtacctgcggtgctcgatccgcagcctgccaggccgaagccgacggcgatagcgcacgccacagcagcagtgcgcacggccagacgcttcagtctaggcgttgaatgtggggaatcggacagcatattgttgactcctttatctctttccttccggcttcagcgccggcggctcttccactttcaaaagtaacgattgcgccatttcattcccagcgccagcgagcccgcttgcacaagaaacaaaaagcgcggtattttgtgattaacgcaataaataatgcaaaggggcttaagcatgtctgacgccaatgcgattccgcaatggttttccggatccgagcatacgcatcgcgtggcggcagccatcgcccaatatgggccgattgcgcgcaccacattggcacagatgctgggattgagccagggtgcgctctcccgcattaccagcgatttgatctatgccggagtcatcgaagaactgccggctgtggccagaactacaggcaagctgcctgaacggtttactcccaaggagagctcggatcgtcgcggccggccgcagaccgcattggtattatgctcgaacgcacgcaccttcgtaggcgtcaaagtgcacggcacatccattgtgtcggccgccgtgaacgcgcatggcgaggtggtttccagccgacatgagataccaattggtgctgatcagtcggcagaatatgtgacatcgtcgatagccacgctggttcgtgaatgctctgatgatgtcgccgccaccggcctgcccgctcccactgccgtgggcgtagcggtcggaggtcacgtgatcgatgattccatcgtcacgttcgccccattcctgcactgggagggcaccacagatttaggcgcaatggtgtacgaggccaccggattgccatgcggcgtattcaacgatatcgattcgctgctggtggatgcctcctggttcgggccgggagtgggcgtggatacgttcgccgtagtgaccatcggcgtgggcgtgggctattcgctggctgtgcatggcgaaccggtcagttacccggacaagagttttggcctagtggggcatgtgctcatcgacccggagggcccgcgctgcaccagtgggcatatcgggtgttcgcaatgcctgactgacgattcgattgcggaacagtattcggcgatcatcggccgcgcagcgaccttcgatgattttgcgcacgatgccagagcccatgtgccgcaagcctctcagctagtgcaccgcacttgcttccgattgggatcgctggtggccaccgtggcgaacatcgctatgccggggcatgtaatgatcgccggcgaatcggcatttttggcgaagcttggtaccgattcgctgcgtgacggcatccgcttctatcggcatagccaaactcaaccggtgaagttcacgattatggatcacgactggcagctctgggccaaagccgctgccagccgtgtaatcgtgaagcatattgggtaggtcactccgccacagctttgaacagtactgcctgctgagggtggagggacgggggacggatgccgtaacgctgcagggcttcgccggtcaggactacgccttcctcgttccaccagccgagagtgctctggccgttggtcagaccggtcaaatccaagctcgggtcaagcgggctgacacggtaggtgcgctcggggtcaagtccgggcagatgcacgggcgcggccggataggtctggctcgtggtcagctgggtgaagcggtagatggcggcgtcacggttcggcatcaccataccgtccagacgcacggccggatcgttggagtcggcgtgcacgcaggtgtcgatggcgaaccagtcgcggtgcttcttgaattcggccacccacacggccagcttggcgagcgcctcgtccggctccttcaacaggttccattcgatgcccatgtggccgaagaacgccatggccatgcgcagttcctggctggtggcacgctgggtggagtgcgcgggactggcgcccacgtgctcgcccatcatcgccggcggcaccagcagcgaggtgtagcgctggatgtccgcgcgctcgaccgggtccacgcagtcggagacccagatacgatcggcgtgctctaggatgccaagatccacgcggccgccaccagaggagcagctttcgatctcaaggcccgaatgtgcggtcttgaggcccttgaagatgttgtagacggcaagggtctgcgcgtgcacggccgggcggccggagcggcgggaaccgggctcggtgacgagcttgttgtggtcccacttgatgtaatcgataccaagctcgccgacaagctggtccatgcagccgtagatgtagtcgaacgcatccggattggtcagatcgagcacctgctgagtgcggccctgcagcggcagacggccggcagtgggcgagagaatccaatcggggtggttacgggccacatcggaatcggggttgaccatttccggctcgaaccacaagccgaattccatacccttggcgtgcacgtagtcggcgagcgccttcagggacttcgggccatcgggccagacgtcctgcgcaatctgccagtcaccgaggccggaggtgtcgtcgcggcgggaaccgaaccaaccgtcatccaccacgaatcgttccacgccggagtcggcggccttgtcggcgagcgccttcagcgtatcgaagttgtggtcgaagtacacagcttcccaggtgttgaggatcaccggacggccgtgcgagaacaggcgcggatgcagggagcgcacgtaggagtggaagcgggcggcgatctcattgaggccatcgccataggagccgaacagccacggggtgtcgtaggagttctggccttcgccggggccggcgagcgtcacttcgccgccgaacaggagttcgccgccgccgattacgccggtcgtgtagggcagacgttcggcggacagtacggagttgccgctccagcccacgtgcaccgaataggcgtcgccatgctcgaagccgaaaccgggcacgccggcggtcaggagcagggatgcgtcgaagtcagggcggccggcgagctgcggcttttcgaaacggccgacggtcagcggctggcgctgcggactgcgttcacgtagatggtgaccggtggtggtgaggatttcgccggcggattcgggcagcgggaagccgagctcgatcttgccgatctcgagcggggctccggcgtctgcaccgaacaggttggttacggtggccttctgacggaccaggccgccggggagcagttcgaggtgccactcgacttccacgccctgctcctcatcgcgcgcggtgactatgacgccgggcacgcggaccggaccggtggcacgggcatggccggccacatcggtgtagctttcgccggacacggcatcgagggtggcttccagcacgccgccggcctcgatattggtcacggtgaacttggggaagagctcgacgccggcgcggcgcagcaccacgcgctgctcgccgatccagctttcggcctgggtgggcaggatggacggccaagcggtgtcgtcgagcgcgccggacacgcgctgcggcttcagggcgtcataggcggccagcagggtgtcgggcttggccagcgggcgaccccagtggacgatgcgcggcaggtcgctgccggcaaacaccagaccgatcgccacattggcggcgggctgggtcaggtagacggcggtgagtgcggtaccgtcagcggcggcaccggtgaaagtggaggtgttctcggccatattgcctccttcgacgtgtgtggattggcattgcactactggtttcgatcgtagaagagatggaatatgttgccttggtgccgcgtgttggttgcgtgaggtaagtaatgcgtccgtgtctatcgccgctgagcgaagaaatcagtcaggatggactgacactcgccttccaacacgccgccgtgcacttcagggctatggccgatatgcggatcgcgcggaatatcccaaatcgaaccgcatgcaccgagcttgggatcccaggcaccgaacgcgatggtaccgatatgggtctggatgcaggcacccgcgcacatcgggcacggctcaagtgtgacggccagcgtgcaatcggcgagattccaagcgcccaaggcttgggccgcctgacgcatggcgatgatttcggcgtgggcaagtgggtcaccatcagcctcacgcgtgttgtatccgcgcccgacaatctggccggccgcatccagcaccaccgcaccaaccggtacgtcaccagcggctgcagcctgaccggccagttccagtgcgcgacgcatcgcctcgtcatattccataccaacgagtgtatgcctttttctcatatcgtctcatgatgtgcataatcggccgcaatcttaacgtttttcttcatggttcccatatacttttggtggagaagagatacgagaaggcggcaacatggcggtatttgagctcatcctatgcatcattgcggcggtggtggtgagctcgtttgccagtcgcttcgtgcccaaagtctccacgccgctggtccagattgtgctgggcgtgctggttacgtatctgccgtttttcccggatgcaaagctcgacccggaactgttcatggtgctgtttatcgcgccattgctgtatttggaagcccacgaaatcgataagtcggcgttgctgaaaacgctggatctgagcctatcgctggctatcggactggctatcgtcacgatggcggcggtcggattcactttgcatgccgtctggccgtccatcaccttagcctcagccttagcactcggcgcggcactcggcccgaccgatgcggtggccgtcagctccctcggtaaagaagcctcgctgacgcagcgtcagcgcagcgtgctcaaaggcgagtcgttgttcaacgacgcctccggcattgtcggcttccagttcgcactggccgccgccttcaccggagaattcgccgtggggcaggccgccggcgaattcctgatgtccttcttcggcggcaccctgttcggcctggtcatagcggcggccaactggctgttcgaaaccgtgcggtccctgggctgggagaccaccaccacacgcattctgatggagctgttcctgcccttcctgctgtatctgggcgcggaggaattcaatgtgtccggcattctgtcggtggtggccgctggcctgttcatccgattcgaccgtaccggcgtggggccgaatgtggcacgtacgaatatcgtttccacttcagtatggggtgtgctgagtttctcgctcaacggtgcggtgttcattcttctgggcatgcagctgccacgcgccatgaaagccagctggtccgacccgtatatcagcaacctgaaactcatcggcatcatcctgctggtgacgcttgtggtgatcgcactgcggttcttctggatagtggccatgctgcgcgtggcgcgcgacgtgcatacacggcgacggcgcaagatgacccccgaacgttggcggtccgcgacggtcatgaccttcggcggacccaaaggcaccatcaccctgtcgctgatgttcaccatcccgtattatctcgccgggggcgcgccgttccccatgcgcaacgagttgatcttcatcgcatcgggcgtcatcgtcgtgacgctgatgctggccaatttcctgctgcctttgcttgcaccgaaccgtggcaaggatcccagcgccgagatgattccggtgaccatcgatgtgttacgcgccacggtggaggaactgaccggacgcatcacgccagagaatcgccgtgcgattctgatggtaatcgaccagtacaccaagcgcatcgggcgattgcagcagcgcatcggcgataccgatcctcagggattcgagcaattgcagatcgaagcgctgcattgggaaaaggaattcgtgcgcgaccggcttgccgacaccaaggcgcatccagcggcggatacggccacgcaagagctgaacgtcgaagcctgcgagcgcatgcttgaccagattatgaatacgctgcgtcacacttccactgatcctacttcggggcatgcggtatcgcagattcgcggtcgcttacgcatgttccagcggcagatgagcaactacgccaaacgcacggtgtccaagattcgccataccacgccgttggtgagcgaggatcggattttcgcgcgcacccgcgaactgcaggtcgaggcgattcatcatgttatcggccagcttattgacgagatgggccaggatacgtacaacaccgagcattgttcggcgctgttgctggattatcgtcgcgctgcggcttcattgcaggcacgtccgaatatgagcggcactacggaaaccatcacgcaggtcgaggacgtaaagcgcgagagctacggcatcgaactcggtgtgattcaggacatgtacgaagccggcgacatcaaccgaacccaagcccgctccctgaggcgcaacatctacgttatgcaggtcgatgctgattccggcatctagtttccttggctcccttctctgaggggagccaagttggggattgctatttccgtttccagtgatggcggctgactacagcacgccagaagtaatgtcgttgtcaagtagccactggcgcaaatcggcgaactcctcaagactcacattgtgatccagaccgtggtagctcttggtcttcagccacgtatgctcttccagccaagcggcggtggcgaacagttcgtatttcgggattacgccatcgttcttgccgtacgtatagaacacggggatatcgtaatcagccaggcgagagtcggcgggggccgtgccgggcacctgaccgggtgtattgaagccggacagggagacgacggcccggtaccgctcgggattgatacgcaacaaatgcacggcgaccagcccaccttgtgaaaacccaagcggcaccacgtcacggtcggcgggaatgttgtcggccacccatcggtcgactgctgtggcggcggcatacgcgtcgtagtcacgatcatcgccgataggcaaggcatcgtggaaccacgcgtagttgccggggtcgggactgccctcacgggccggcgcgagtgtcagcggcccgcgcaatgccacgaagtcgttatatggagcgatgaggcgcatgatgtccgccatgtcttcttcgctggatccccatccatgcaggcacaggaacagcggatgcgtggcatgctggtcgaagccgccgcgcgaggtgacgctgtgttccacggtgagtggctcgccaaaacgtccgggtacagtggtggattcgcggccgatcaggggctggctggcattcgcttctttgctcataccaatccaatatagaggtcttgcgcgctgtacgaaaaacgatggaccatgatttcaatcacattgggtaatccgcgccgactcgccttgggactttccaagggataccggcaatctatcaggcgttaccgctgtttgcggctgcggtgtctgcggctgcggtgattgtctcaagttcgccgccccactgctgctgcagtgcggtcatcttgctggcctcgccgaacaccatccaacgtttgccgctcagcaatcgccaatcacctttcgtttgctcattatcagcgtattggctcagcagttcggaaatcttgctttcgataggtgcccggctgatggctgcggacgattccgattcaaaggacacgaaggccactctcggatcagtgcacatctgtacggtggtgatgcctggcaaaccgcccgtatcaagcccctgccatccttctttgcacgcgccggcagcttgttctatgccttgctccatctgtgcggtatcttcgacgggtgccttgtcgttcgactgctgaatcagtccttccgggaacaatacgcccatggccacgccgataaccaagcaaactatggcgcacaccagtgcgatgatgccgcccgcacccactcccccgtgagtggcgtaccgaggcatggtagctcgcgcagcgatgaccagaatcagggtgatgccgataagcaccgccgccgtcaacgcaatgtatcgtcctggcactgccgtcataaaggaaatggcgtaaggcgcgatttcatgaaccgccgaggtggccgatatcacgacggctagcagtccgctgacaacggcaagtctgcggcacaatatcgacgttgggctgctggcttttgtagcggcgaatcgccggccggcattccgcctggatgggcgtcgattctgtgcacgacgtgagctgcgcgaatcgtcatactgaccatcgccgaagaaatcgtagtcctcatcgttgcggaccatcggtgcccccttcctgccgattacacagctagtgtaccgctatggcttgggaatggcggtcattcggggaatgattcagggcacaaaaaaagaaccccggcggttgcccgccggggagagaaaggagagagaagaagaaaggggattcaattgtcgggaactgctgcggctcctgatcagctttccgctgacatcttttatataaccactgctttctgggtctacctctaagtttctctgaaaaaaacctgagaatacttgcgattgatggaccgcggaagcgtgaggagcctctcatgtttccgcccaaggcgctagacttgaaggcagtatttatttgcccaaggagttttttcacatgctgctgtccgaccgcgacattctcgccgcacagtccgcaggtcatatctcacttgatccgtggacccccgaaatggtgcagcccgcttccatcgacgtgcgattggatcggtacttccgtttgttcaataaccacgcctacacatatgtcgatccggcggaaaaccaaggcgcacttaccgaacagttcgaggtggctcccgacgaaccgtggattttgcaccccggcgagttcgcactgggttccacgtgggaatacgtcaagttggacccgtccattgccgcccgcttggaaggcaagagctcactgggtcgattgggtattctgacccattcgactgcgggcttcattgaccccggtttcgaggggcatattacgcttgagctgtctaatgtgtcgacgctgccggtcaaactatggcctggcatgaagatcggccagatgtgcttcttccagctgagctcgcccgctgagcacccttatggctccaagggcaccggctcgcattatcagggccagcggggtccgacgccgagccgttcctacgagaatttctaccgcgcgcacatcgacgactgagcgttgcgacgtaccattcggccggcggatgccggccatttgcttaatcccaaggagatgtcatgaccaacagcgatggtgggttccagttcgacttccagcagcacgaaaagccggtcaggccaacggttcctccgattcccgggcaagagacggcagcatatagcacggaacccacggcacaggccacaccggctctgcagttcccgcagtctgtgcagtctgtgcagtctgtgcagccgacgcagtttgcacagcccacacagcccgcacagccgacgcagcccatcgatcaggccatgacgcaaccgttctcgccgcaattcccggctgcggttgccgcacaagcaccacagccggcggcagccacacagccagcagtatccgaaacaccaatcgccgctgcgcccggccagcagcaatacgtttgggatcaggcgacgcaaagcttccgcccggtggaaccgacagcgccggtgacaccagcagcaccagcggcaccggcgacatcgcctgtttcggcagcttcaaacgccgcgacacaagcgttccagcccaatcaggccgagcagcctgcggtagatgccgaggcaacacaggtgttccaacctgattcagctgcggccacacaggcatatggcgcatcatccaccgtatccggtgagaccgttgccatgcctgcaacgcaagtagcgtctgccgatgatgccgcagccacacaggtgttccaaccggccgccctggccgcttcggcacaggctcagcctgctgtgatgcctccctccattccgttggctcaggtctccgatgaggacgattccgatggcgccgagcctcgtcacggcggtagcggcaaaaagaacaccctcaaaatcgtcggcattgccgtagcggtagtcgccgtgatagcgctggttgtcgccggcctgctctggtggcattccaacagcagtaaggcgagccaagccgtggcattggccgagtgcaaggtagcggccaagcagtacacgaatgcgcagaagaagctcaccaccgccatatccaatggccaaaccagcgcgcaaacatccaccagcgatgtggccgatgccaatacgctcaccacgctgaatcaggcgttgcaagacgccggcaacccggctgacaccgccaagtgcgattccagcctcaacgccactgagttgaagtctcacattaaagagctgcagaatgatgccagcgacatggctgacaagacggatgccatcaacaatgcgatcaaggccgttaacacttcaaaggcgacggccgataccgacacactgaaatcgaacctgagctcggctatttcgcaggcgcaaggcacgctagataattccgcgggcagtgtggccgatgaaaacacccgcaccgcgctgcaaaacaccatcaccgaggccaatacggtgatgaacgggaccagtccgtccgaatccgacgtcaacaatgcgatttctaaactgcagaaggccgagtccgacgtcaccgcctcgatgcaggccaagcagcaggcagatgccgccaagcaggcccaggagaaggccaagcagcaagcccggcaggaggcgcaacaacaggcccagaagaagcccggcgacaacgggaccgacaacgacaacggcaacgggaccgacaccaactcccaacacaccggcaactaaaatccacgcacgccccacatacggcaccgcccatggaggcggaatggcccgaagcgccgctctgataggcgactataggaaacggcgataaccacagggcgttgcgtcaacgatgcgacggatagattgattccaacatgaaacggatcgtcccgcacggacacatcctgattttcagagaagggaacatcatgtccgacatcgcatacgactggctcactttgggtgcggccgccgtcctattcgccatcctgtcattcctcaaacgcaagaagaacgcgggattcaccacacgggtgctgctggcaacggcattcggcgtcgttctcggcatcgcatgcaaaggccataccgggtacgtcggcgcggtgggttccatctggtccagcgtgatcaccgcgctggtggtgccgctgctcgtgttcagcatcatctccagcatcaccaacctcggagaatccatccgattgaagaacatcggcgtgaagaccgtgttcttcctgctgctcaacaccaccaccgcctcactgctcacgctgcttctggcgcaagcgttccagttggggcgcggcttccactacaccttgtccggcgactacacgccacacgacgttcccgcggtcctcgacaccatcgtgaacctgttcccgcgaaacctcgcggacaactgggtcaacaaccaggtggtgcccatcgtgctgttcgccatcctgaccgcactcgcctacaacgccgccgcctccacggacaaaggccgttccgcggtcgcgccgttcaagaccttcatcgacgcgggcaacgtggtcttctccaaagcaacccaaatcgtggtcggatacaccccgtatgcggtgctcgccctcatcgccgaagcggtgagcggcagtgatgcggccaccctgctgccgctggtgctcgccttggccgtcgcctacatcgcaatcgccctgcagctgttcctggtgcagccgcttgtgctcgcgaccgtgacgagactgaacccgatccgattcttcaaggcgttcttccccgccggagtggtcgcgttcacgtcggagagcagcatcggcacgattcccgtcaccgttcgccagctacgcagcgccggcgttccgggcgacatcgcctcgttcgtggccggactgggcgccaatctcggcatgcccggatgcgccggcgtgtggccgatgctgctggcggtgttcgccgtccacgctcagggactgaactactctcccgcacagtatctgttcctcgtggtgctcacgctcctggtctcgatcggaaccgtgggcgtgcccggcaccgccaccatcaccgcgacctcgttgttcgccgccgccggcctgccgattccattcatcgccatcagccagccgatcagccagatcgtggatatgggccgcaccgcattgaacgtcgccggcgccgccaacaccgcggtgatcgtcgcgcagaccgaacatcaactggatgccgacctgtattacgggcgtaaggagtattccgacgaactcgacgtcgacgggtccgacgccggtccggcccccacgccgacgacggcaccggcagtgcccccgcgcctgccgaatgcggtgcttctcgccagcggaggcgacgcctgctgcggcatcagacccggcaagtgattagtattcaagatttgtcgtgcctcctgttctgtgccctgcatgaacaggcacagaacaggaggcatggtttttcatattcacggcattggccgtacttccgtccattcgtgtacaagatttcgatgatgaacgacgatatgtcaacatcacaagaacatcgcggggacgtcaggatgagcgagacatccccgcgaaaatcaggagagcttacgtgatagagacagagccacccctgcgatggcaagagtcacgcctacggcaacgataatatccgtcgagatgccggtcgcactcagttgcttcggttggccttgcactttgtgattggtaaccttgtcacggttgccattctgatcggtggaatctggcgtcggaaccggcacggtggcatcaagcgccgccttcaatgcctgcgaccacgctgatacttggtccgctgtgtagatcttgccggtcaaaccatcgatggcggcatcacgtgccatacggagtgcagtttttgcatccgattccgccgtatcggcaccaatgatctcactggatttatcaatctgctgttgcaacacggagatgtcaatccctaataatccagcttccaatgtcggatcatatgtgttggagaaaccttctccgtagtcaccaccaaggactgctttatttgtctcgtataggttagcggccttccccaccatatcccgcgccttatccgcggatgcggcgttgtcgtcaatcacctgacgcaacgacatgcgatcaaggtaatggttcgctgcagtctttgccgtatccaacgccatgccctcgctctccgcaatggcggtcttggtccacagcaagttggacggtacaatccgacgcaggtcttcatcatagttgcgaccgtctcggtcgagcgcgtaaacgaacatgccgccaagattatgctcacgcacatatgacgccacttgatagaaatggctttcttcatacggctcggtggcatcataccagcgattgttcatgtccccttcttcggggaacgtcaggcccggcacaaactcgttgccgatataaggctgataatcggcggcggccctagcggtgcgatcggaggaagaaccgtactgctggtatgccacgtagtcaaagcattccgccacattcttgaacggattgagataagatccattcgtgtcataaaggaacatcgtggtatccggcttggcggatttgggaccgatgtgtttggacagtgcacgaatcacattgtcggagatcttcacatcggcatcattcgggtgcgcctccatgtcgatatccagaccatccaagccaacggagatcatgtatttatcgattacttgcttagcataggcatcataatcagcttcggtcgcctcgctctcggttttgttctgctctttcatgaaagtacgaaaaccattgaccgccacgccggtgtaatcaatgccccgaaccagcttgatgccacgcgaatgcaagtacggtgcataatcagatttgagcttatcgtagaacggttgcgcctgttcttcctgtcccgatggaacatagctgaatatattgaccacgtcgacgccgtacggaatatcgtacatcgaaatccagttatcgtctggaaggtcggtgttgacacccttcatcgtgacatcacgccacgcgcggtagtacaccatgaaatggcgaccggtcgattgtatggtttcctgtgtcggagaaacggcgtccgcattcgctaccggtgcaaacgcgcatgttgcggccatcgctgccgctacgatgcctgcggtcatagacgccacataacgcggcatcatctgtttgatgaaagtcatagttccgctttccttactgttatggttttaatcttcctcatcaatcgaggaaaaggcgacgccccgatggcagatcggaccatctttggcaccattgccggtcggaactaaatcgctttagtataaggataggcgctgatcaagacactctgaaacatcggcatgtacatctccacgaatccaagcacaagaccgccagaataccctacgaacgacctcccgaacaagaacggcattgtctatttcagtaaatccagcgaaccgctacgctatatttagccaaccaaaacaacggtgggccggactcacgcccgacccaccgttgtttgattgcccgacaatcaggccaatacgatgatcaccgccttgccatcgcgcgtagcacaatcttgcgcagctcggaggcaatcagcacgaacgcggccaggcagatgcactccacccacgccatcgggctcagcgccatggtgccgaacggaccattgaggaacggcacgtaaatcaccacgagctgcagcgccacggacaaaccaatcgcaccccatagccacttgttggagaacaatcccacgaacgcggactgcagatgcgaacgggaggcgagcgcgttgaacagctgggcgaacaccagaatcgtgaagcccatcgtacgggcctcggtcatctgcgcctcatggccgatggcctccaccgaacgatcggtgaacaatccgccggacagatgcatgtccataccaatcagcgtaaccaccgccataatgatgccgacgaagatgatgtcgccccacatcgaagcatcgatcacacgatccgtcatcttgcggggcttgcggcccatcacatcgtcggtctgaggatcgacgcccatggccaacgccggagcggcatcggtcagcaggttgatccacaacagctgggtggcgagcaacggcaccgtgacacccacggtctccggctggcggatgccgaggaagccggcaaacaccacgccaagaaacacggtgaacacctcgcccacattggagctcagcaggtagcgcaagaacttgcggatgttgtcgaagatcacgcgaccctcgcgtacggcggccacgatcgtggagaagttgtcgtccgccagaatcatcttggcactctgcttggtcacctcggtgccggtgatgcccatggccacgccgatatccgcggacttgacagccggagcgtcgttcacgccgtcaccggtcatggccacgatattgccttgccgctgcaaggattcgacgatcctgagcttatgctcgggcgccacacgcgcatacacggacacttcggacgtggccttgtcgaacgcggcctcatcgggtagctggtcaagctggtcgccggtcagggcctgaccgtccttggcgatgatgccaaggtcggaggcgatgcgggcggcggtcagcgggtggtcgccggtgatcatcaccgtgcggatgccggcacgatgggcctcggtcacggagtcgcgcacctcagtacgcggcggatcgataatgccgaccatgccattccagatgagatcggtttcgatggcttcggcctgatcggcgatgtcggacacctggcctgcagcgttgacgcttacaccgggcacatcagccaaagaactggtttccagcggacggcacgcctcaccaagcgtacggtacgcctcggaggagagacgttcgacggtggcgagaatcgactggcgatcgccttcggtgagtttgcggacctgtccgcccacgcggatacgcgagcagtagctcaacagcacgtccggcgcacccttggcgaacacggtgagattgtcggcatcggcgctgtccttggcgatgatggacatgcgcttgcgctccgaagtgaacgggatctcgcccacgcgcgtgtatcgcgtgatcttgcgatcggccttgactttgcgggcggccacgataagcgagacttcggtggggtcgcccacaatctcccagcggccgttctcctcgcgtagttcgccgtcgttcgcgagcgtgccggccacaagcgtggcgacgacctcatcggccatgatccgggcctgctcggactcgggatcgacgccgccggccagtaccatacgcccttcgggcgcgtaaccggtgccagtgatctgcacttcgccggacggggtgaccacacgttccacggtcatctcgttgcgggtcagcgtgccggtcttatccgagcagatcacggaagcggagcccagggtttccaccgaatgcagcttcttgacgatcgcgttgtgggccgccatgcgctgcacgccaagcgccagcaccacggtcagaatggcggccaaaccttccggcacggcggccacggcaagcgaaacggccagcagcaaggaatcaatcacgtcatggacgtcgttgaagccttccagcacggcgagcgccaccagcaccacgacggcgatgacgcacaccgcaatgccgaggatcttggagacgtaatccatctccttctgcaacggggttttctcgtcctctgtggcggagagcatgtcggcgatcttgccgacctgcgtattcataccggtgccggtcacgattgcgcggccggtgccttgcgtcacggaagtgccgttgaagatcatgttggcgcggtcgcccagcgccttggcctcggtgagtgtgtccggcttcttgccaaccggcacggattcgccggtcagtgaagcctcggcgatgcgcaggctggccgcgttgaccagtcggccatcagcggagaccgaatcgccttccgcaaggacgatgatgtcgccgggaaccacgtcggcggtgttgatgcgcatgaccttgccatcgcgcagcaccgaggtctgcggggccgtcatttgtgcgagcgcttcgacggccgcctcggccttggcttcttgcatgtagccgagcacagcattgacaatcaggatcaagatgatcacgatggcgtcgaacggaagcgcctcgccgccttccgcgccgggctgcgcattggctttttcgatgaaccaagcgatcaccgagataatagtggccgcgatcagcaggtagaccagcggatcttggaattgggccaggaatttcttccatttcggtacgggcggggcgctggcgagctcgttcgggccgaatttggccagtcggcgcttggcttcttcctcgctcaggccgtgggatgggtcgacgttcagggctttggccacgtcgtcggcgctggtcagacttggatccgtatcccccaatagcgcttcctgtgcgcgcacttcttccgattccacgaccccgttcgttgcggtcgcggactttgcggattgatcattacgatcatccatggtgttctccttggtatcgccgcggagtagtcagcctcgcgccggcaccgggttgtctctcccgggcggcgcaggactgcgcggttatgggcatcgacgcaattgcagccgatgcgtacgatgccattattccataacccggcggcacactggtcaagccatgacgggcgagctgggcgcggacatcgtcgagcggtacaacgactcgcccatcgctgcggccgcgctgcccgccctgacctcggtgcgcccgccgtacgcgcgtatcgtcaccgaggtcttgcgtctcatcgaaatcgggcccgggaatcccacgcacatctcgttgccaccggaactcgtcgtgcgcgcctcgagctcgaatcggcttatctgacggcgagggtgcccacttgcgcgccgacggccaccgtaccggaaccggtaagatccaaagcggcgatggtggccgggttggtgaacaccacgatgacgtcggtggctttgcccgcggccttgaccgcatcgagatcgaccttctcgatgggatcgccggctgagaccgtctgcccggcactcaccagcatcgtgaaaggcgcgcccttgagttgcacggtatcgacgccgatatgcaccaacacctcgacaccgcccggagtggtgatgcccacggcgtgtttggcgtcggccacggtggtcaccgttccggaaacaggggcgacgaccagcccggaggacggcaccacgccgaacccatcgcccagaatcttggcggcgaacgtgtcgtcgggcactttctcgatggactcccagacaccatcgcatggggcgagaaccgacatcgctgcgggggcgggcgccacctcatcgctgttgtggaacaaaccggagaacaatcccataatgactccttgaaaaccaatgatggacgataacggacgactgcgtgacgccgatcatgtcgacgtcacgcagcccagtcatcatgccatgcgccagactgccaagcgctaggctttatgcagctcttccatggcatcggccacagcctgcacctgcgtgccgaccacaacctggacattcctgtcgtcgatgaccttcacgccgggcaccagcttgcggatggcgtccacatccaccttggcggtgtccttgacgcccagacgcagacgggtcacgcagttctcaatgtcgacgatattggccttgccaccaagcagcgcgtagagcttcgcggccagcgcggcgtacttgtcgcgggagaccgcggcggccggggcggcgccggtgtcgagaatgcccgccacggcggcggcgccctcatcgtcaacgccatcgccacggcccggggtcttgaggtcgaacttcttgatcatgaacgtgaacacgaagtagtagatgaccgcaaagaccaggccctgcacgataagcatccacggcatatgcgcctgcggcacacgcagcgagaggaaccaatcgatgaagccggcggagaagttgaagccggcgatccactggaaggatgcggcgatgaacaccgacagggcggtgagcagcgcgtgcaccacgtacagcgggaaggcggcgaacatgaaggagaactccaggggctcggtcacaccggtgaggaaggcggccagaccaccggcgagcatcagggagccgacggtacgacggttctccggcttggcgcagcggtagatggcaaacgcgcccgcaggcaagccgaacatcatgatcgggaagaagccggcctggtacatgccggtgacgtactcgccccacggctggaatccgccggtggccagcacggccttggtggtgccgttgagaccgcccacaccgttccagaacttggtgatgtcatcaatgccggcaaggttgaaccagaacacgttgttgagggcgtggtgcagacccgtggggatgagcagacggttgaagaaggcgtagatgccggcgccgaccgcgcccatgcccatcagggactcgccgaaggcgaccagaccgttgtagaccagcggccacacgaacagcagcaccagggaaatgaccgacatcagcgcggcggtcaggatcggcacgcagcgacggccggagaagaaggccaggaagtcgggcaacttggtcttgctgaaacggttgtacagcgcaccggacacgcagccgaccatgatgccgaagaacacgttcttgttgccgatggcgccaggagcaaaggcggccggcgggttctcggcgtcgaagcccaggaacatggaggccgagcccatgatcgtggtgatggtcatgaaaccgaccagaccggacagggccgaggcgccgtccttgtcacgggccatgccgacggccacgccaacggcgaacagcaagcccagattgtcgaggatcgccgaacccgtcttgcacagataggcggcgatgacgttgccgccaccccaaccgctcggatcgatccaatagccgatgcccaggaagagcgccgcggcgggcaggcaggcgacgggcagcatcagcgcgcggcctagtcgctgaatataggctttcatttctttctcccttcatgcgggttttccagcggtggagtacttctctgtgccctgctccgccgtcacgcgccgaccctccattggaccggccgatatccggcggggcgagtaccgctttcaacggataatagtacgccacagacgtcatacgtcgcaactcagcgcactgaaatcaagactcggagaaccgtgcgcggatttcggaaacctaatcgaacgtgcaaagcgtctgagccgcggaatgccgccattttcggtcatgttcgtttgtgcggaaacagttcggatgggtgcacggttcttactgagaatcgtcctctgcacccatcgcggcggccatggcggcgtctcgggaacccttggtgacccgcaggcccacggtgacgccgaccaacaccaccgtgcaggcgatccacagcatccgcccgccgaagccgccgatcacccagccgccgatcagcggcgccaatgcgatcgacaccgaccacaccacgttatagacgccctggtacgtgccgcgggcggtggcgggcgccatggcggcgaccgtggtggtggcgatggggaacgtgcccagctcgcccagcgtccacaacaccacggcgatggcgaacccgccccatgaatgggccacggcctgaaccgcgtagccgatagcggtcaccgcaaggcccatcacgagcacacgcgaattgcccatgcgcgcgaacagtttcatggcgggaatctgcagcagacacagcatgccgccgttgatggtcagcagcaccgaatactcgcccagccccagaccaaggtccgtcatggcaatgggcaggccggaggtgctttggaagtacacaaggaagtagccgaacatcagcagggagaagccgaggaatggagtatcggtgagcacgcgccgccaattgcgagacatggcgccctcggggcgggccgccggcgccgaagtcgtcagatgcctcacttcgcggaagaacacgatcagcaatatcgtgacggcgatcatcaccgccgcctcgacgtagaacatcagcgaataggagatcttgatcagctgattggccacgatcgggccgatcgcatacccgaaattgatggcccatgattgcagcacataggcgcgctgttgacgcttgggaggcaccacgtcggcgatgtatgcggcgatggccggactgggcagcgaggcgaacgcgccgtatacgaacagggccgcgcccaacgccacgggatcggcgaggacggagacgaccagaagggcggcggccgcgccgatttcgccgatgatgatcatcgactggcggccgaaccggtcggacagcgcgccaccgaaaagacagccgatgatggcgccgaaaccgtacatggccacgaccgcgcccacaacgccttcgtcgaggtgcagcgcggagaccaggtagatcgacaggaacgacgtcacgaagcggcccatccacaggatcagaatcgccagccacaatccccagtacagcggggatagtccgaatatcatgcgttgcttcttcactcccaataccttaccggcttccgatggcggaatggccgtgtcttggcgcggggtgctgggacaatggcatctatggctaacaaaaaaggaccgaccaaggggtcgggtggcaagcatcgcaacaaactgaagggttacggccccactcccaaggccgaggaccgcgtctatcacaaggcgtacaaggccaagaaagtggccgaacgtcggcagatggccgacccgcgtctggcagcccgccgtcgagtggacaagttcgcttcggcggacacctcggatctggtgtacggccgtaattccgtgctggaagcactgcgcgtaggcgtaccttcttctacgctgtacatcatgtcgcgcatcgagcatgacgatcgtactcgcgaaatcgtgaagatcgccggtatgaacggcctgcacatgctggaggccgatcgtctggagatggatcgtatcgcccgctccggcaaccatcagggcgtgattctgaaggtcgatccgttccagtactcctcgctgaacgagctggccgatcgtgccgagaagaaggccaaggcaatggaggccgcgaattcggcggccgcccgcatcgccgcccgcccgctgttcattgcattggacggcgtgaccgatccgcagaacctgggtgccgtgattcgttcggcggccgcattcggtgccaatggtgtgattctgccggaacgccgttccgcttcagtgaacgccgccgcctggaaggtgtctgccggtgcggccgcgcatatgccggtggcgcgcgtggtgaacctgactaaggcacttgagggcttgaaggagcgtggatactacgttgtcggccttgacggtggcggcgataagctcgtcggtgagaccggctttgaatccgatccgctcgttgtagtgctcggttcggaaggcagcggtttgggccgactggtgcgcgaaacctgcgacgcgattgccggcatcccgatcagctcgtctgttgagtcgctgaacgcttcagtagcggcgggtatcagcctgtacgcggtgtccaacgcacgacgcaaggctgcggcggagtgattgtcgcttgagaccgtaataggttgtacatacacggaagcccctctatttgaggggcttctttgtgtgatgggctcacctacagacagtccattggattgtccgcttaatgactccacactgccgcatccggatcgtcatcggggttgtagccgtcatcgtccgggtcgctgtaggtggattcgtcgtcaatgacgccggaatcggcctcttcgttaagttcggcgagtgccttggaatcaaggttgtagctcggcagaacgttgtcgatgtagctggtcacggcctcgcccatcggcacgtcgtggccggcctcctccgccaggaaccagcgatggtcaagcacctcatggaagaactgagcaggctcgatctgggagcgatattcacgcggaatcatacgcacggtcggctcgaacacctcacgcatccagtcggtggccacgatttccagctcctcgccctcacgccacgtggaggcacggtaggcgtcaagatcgttgagcagacgccgggcctggttctcctgcacgtcaaggccggtgagacgcagcagcttgcggttggcgtatccggcgtccaccacgcgcgggcggaccagcacacgcttgccgtcctcggcggtcttcatttccagctcgtccacgtcgaagcccagctcgttgagcttgttgacgcgctgctcgatcttccacatttcgtccgggttgaacttgtcggtgtcggtcagggcgctccacagcgagtggtagcgttcgaccagccggttgcccacctcgatctcatccacgtcgccgggcagcagcttgccggacgccaaatccataagttcgccgatgatgttggtgcgggccaagtcgatatcgtattcgcgctggccatcggtgagctggacttgcaggtcaccggtctcggcgtccaccaggaaggcggagaaagcgtcggcgtcgcgcaggaacaggacgttcgacagcgacacatcgccccagtagaagccggccaggtgcaggcgcaccagcagcacggcgagggcgtcaatcagtcgttcggcggtgtccgggcgcaggttgcgggcgaacaacgcacggtacggcagcgagaacttcaagtgccgggtgaccagaatcgcctccagcggctccccttcacgggtgtgacggccggtgaccacggcgatcggggtcacagttggcagttcgagcttctgcagtcgacgcaggatctcgtactctcgctcggccacctggcgcgtgatctccttcatggcgtacacctcgtcgcccacgtgcacgaatcgcacgacgtggcgggagatgcctcgcggcaggttggccagcaggtcctcgggccaggtggccaagggcttgtgccagggcagcgtgaacatcttcgggttcgagctggcggcggtgatcttcaatgcttgtggctcagctgaactggcgtgttcgtcttcggctttgacagacgtggccttcagcgcacgcggatccatctggggcaaatcgttcaactccatgtgttcgattttacgtgtcgttcgcgatgtgtgctccttggccacgacttcggcgcgttatgtttacgggaaaacaccgtttggtctctccctcagaccgtctagaaggcaaaagaaaagccccgcagctatgcagggcttttccaacgaggccataagagaggaagagaataacctcgtttaatggttgacgaagcgattagacctcgccaagtatccactagttcagacgcagctcagtcgacggagcgaacaggtgcatcttggccgggtcgatcttgatcttgacggtcgcgccaaccttcggcagcgcacgcggattcacacgaatcgtggtgagcttgttctggtcggacatgacctgggaggcctcggcggcggatccatcggtgacgatggtaccgtagatgtagccatcggagcccagatcctcgacgttcacaaccttcagggagaaggcgttcgggtcatcgaccggcgccaggcccgcgtcctcgggacggaagccgaccacgatctggccgttgtcttcggcggtgagcttgttgacggcctcggccggcagatccacggtgtcctcaccgatcttcgccttgccgttgaccaccgggtgggtgttcaggttcatcgacggggagccgatgaagccggcgacgaacacgttggccggacgatcatacagttcggtcggggcgccgacctgctgcaggatgccgagcttgatgacggcgatgcgatcgcccatcgtcagggcctcggtctgatcgtgggtcacgtacagggtggtgacgcccagctgacgctgcagtgcggcgatctgggtacgggtctggacacggagcttggcgtcgaggttggacagcggctcatccatgaggaagaccttcggctcacggacgattgcacgacccatggccacacgctgacgctgtccaccggacagagccttcggcttgcggtcgaggtactcggtcaggtcgaggatctcagcggccttctcgacgcgcttgcggatctcgtccttcggagtgccggcgatcttcagggcgaagcccatgttgtcggcaacggtcatgtgcgggtacagagcgtagttctggaacaccattgcgatgtcgcggtccttcggctgcatcgtggtgacatccttgccaccgatgaggatgcggcccttgttgacctcttccaggccggcgagcatacgaagggtcgtagacttaccacagccggaagggccgacgaggacgaggaactcgccatccttgatatcaagattcagatcatccacggagggcttatcgttgcccgggtagatacgagtgacgtggtcgaaaacgacttctgccatagttactaatcctttcagaggcaggtacgtgcctcacgatccgttgtaaagggattcgttctttactgtgcttccgccctcgccaccgacgtacaactttgctttcggaaactgcaagcttcagcgtttacttttttccggttcagtgaaggttctcttcgttgagccgagaactactatacacgggccgtgggccaaggcaagtggcgtgtctgaaatgtagttaactttatgggcgtttctgggggtgttgtgtggttcggcccatgacacgcctgtttctcgaacgtgcgaaccggtacgcccggcgtagagcaggcctgctcttcccggactgatggattccatcagtcgcctactaatgcgacacagactcgaaggtgacgccgttgcgggcggctttgcgctcggccttgcgctcctcggcgttttcgatgcgctggatgcgcagctggcgccagtcctcgcgcatgtcgcggaaacggtcggccagcgttacgtcatcgttctcggcatcatcatcagtactgctgccatcggccttaccgaacgtgccatcggccaccttggtgatgcccagcttgagcagtccgagcaactcacgcaacgtttccggtactggctcatcgccctcatcggcggacttggtcaggccctcgatgcggcgacgaagcgcatcggcgtcctcgggatcgatcttgagcccggcgatcagcgactggcgcatggtctcgtaatcgaggttggcaaagaaattcagctgttgcagcgtcatgaagcccttgagctcggggaatcggtggacgatgtattcctcgcggtcgtcggcggcgcgggtccagtcgcgggtgagctgcggatcccagctggcggtaatcgacccctcgcgcatgcggtagtggtacagcgccttgggcagacggaccacgcgcgtggcctcgccgatcacgttgcagatacgggagagatcctcgattttgcgacccaccgggaaggagaatccggtgccctgataggtggaggcgggtgccaggaaggcccagaaatagccgtcaatctcagccttgacttgctttttgatggcctcgaccggggtcaggacctgcacctcggtgaagtcgttgtggcgatagttggacagcagcggcttgttgttctcggagatggtgtcgaactggaacatcaccagatcggcatcgtattcacgcatggcattcaggcagtcttccaccagcgtgggcgccacagtgtcatccgaatccgcaaagtagatgtatgagccggtcgcctgggcgatgccggcattgcgtgcgtcggacagtccgccgttgggcttgtggatcacccgcacgcgcgggtcgcgggtggcccaagcgtcgcacatggccgggcagtcgtcaggcgagccatcatccaccagcagaatctcgaggttgcgataggtctgcgcaaccacagacttcacgcattcatcaaggaatttctcgaccttgtacaccgggatgatgatgctgaccaacggctcctgttccatgcctccagcgtagcgccgtcgcgcgaacgcggcggcgccacgggttcgcggaccgcgaaacccttagaagtcccagtcgtcgtcatcggtttcttcggctttgcccatcacgtaggatgagccggaaccggagaagaagtcatggttctcgtcggcattcgggctcagggaggccaggatcgcggggttcacgtcgcagatctcagccgggaacaaagccgggtagccgaggttcatcagcgccttgttaccgttgtaccgcaggaacttctcgacgtcatcggtcaggcccacgcggtcgtacagcgactgggtgtactccacttcgttgtcgtacagctcgttgagcaggtcgtacgtgtagtcctgcagatccagacgctcggcatcgcccagctgggcgatgcccttctggtacttgtagccgatgtagtagccgtggacggcctcatcgcggatgatcaggcggatcacgtcggcggtgttcgtcagcttggcgtgcgcggagaagtacatcggcagatagaagccggagtagaagaggaaggactcgagcagggtggaggccaccttgcgcttgtacgggttgtcgccctcgtaatagtcgagcacgatctccgccttcttctgcaggaactcattgttctcgctccagtcgaatgcggcatcgatctgctcggtggagcacagggtggagaagatggacgagtagcttttggcgtgcacggattccatgaaggcgatgttggtgtacacggcttcctcgtgcggggtgagcgcgtccggaatcagggagacggcgccgaccgtgccctggatggtgtcaagcagggtcaggccggtgaagacgcgcatggtgagcgtgtgctcgtcctcggtcatcttctgccagctagggatgtcgttagagacgggaactttttcgggcagccagaagttgccggtcaagcggtcccagacctcaaggtctttctcatcttcgaggcggttccagttgattgcggagacgcggtcgatgagtttcagcggtttgcgcggaatggaaatcggtgccatgagtgttccttactactcgttgtcattgtcgttatcgtcgttggacttgttttcgaactcctccggcgcggtcagccggagcagtgctctatagatggttcgtgacattgtgggttccttagagtggcctctggttgttcgatgtgtgcggagaccgccgtctgaggccgaaggcgtacgaaggtacgtcgagtgccgaagaaaggcggtatacgctccatcgaacgatcagagcatgcagctgacgcagccttggacttcagtgccttccagggcttgctggcggatgcggatgtagtagagggtcttgatgcccttgcgccaggcgtagatctgagccttgttgaggtcgcgggtggtggcggtgtccgggaagaacagcgtgagcgacaatccctgatcaacatgctgcgtggcctcggcgtacgtgtcgacgatggccttccagccaatctcgtaggcgtccttgtagtactcgaggttgtcgttggtcatgtaggcggccgggtagtacacgcgcccgatcttgccttccttgcgaatctcgatcttggaggcaatcgggtgaatcgagctcgtggaatggttgatgtatgagatcgagccggtgggcggcacggcctgcaggttctggttgtagatgccatccttcagaatcgcgtcgcgcagggcctcccaattggccgcagtcggaatcgcgatgccgtacttggcgaacagttcgcggatcttggcggtgcgcggttccagcgaacggcggccatcggtgtacttgtcgaagtagttgccctgaccggccggcttggcgtaatcggatgtggcgaagctcttgaaggcctgcccatgttccacggcgagcgcgtgcgaggcacggtaggcgtggtaggccacggtcatgaagtacatgtcggtgaagtcgaggccctcttcagaaccgtagtggatgccttcgcgggccaggaagccatgcaggttcatctggccgaggccgatggcgtggccctcctcattagcgcggcgaatcgaaggcaccgcgttgatgctggtgtgctcggccaccgaggtgagtgcgcggatcgcggtctccaccgtgtgggccaagccaccatccatcgccttggcgatgttgagcgaacccagattgcaggagatgtcgcggccgacatgcgcatacgtgaggtcctcgttgtatgcgctcggctcctgaacctgcaggatttccgagcacaggttggacatggtcacgcggccctcaatcggattcgcgcggttgaccgtgtcctcgaacacgatgtacgggtagccggattcgaactgcagctctgcgatggtggtgaagaacttgcgggcatcgatgtaggtcttcttgatgcgatcgtcggccaccatctcgtcgtaatgctcgctgacggaaatgtcggcgaacgacttgccgtatacgcgctccacgtcgtacgggctgaacagcgccatctgggccttctgcttggccagttcgaacgtgatgtccggaatcaccacgccgagtgccagcgacttgatgcggattttttcgtccgcgttctctcgcttggtgtccaggaagcgcaggatatcagggtggtgggcgttgaggtacaccgcgcctgcgccctgacgtgcgccgagctggttggcgtaggagaaggagtcctccagcatcttcatgaccggaatcacgccgctggactggttctcgatgtgcttgatcggggcgccgagctcacgcaggttgctcagcagcagggccacgccgccgccgcgcttggagagctggagggccgcgttgatgccgcgcgaaatcgactccatgttgtcttcgatgcgcaccaagaagcagctgaccggttcgccacgctgggccttgccgaggttcaggaaggtcggggtggcgggctggaatcggccggcgagcatttcgtcggcgtattcggtggcctgcgcttcgttgccggcggcgagttccaaggccactgccgcgcaacgctgcgggaagtcttcaaggtagagacggccgtcgaatgttttgagggcgtaggacgtgtagaacttgaaagcgccgaggaaggtgccgaattcaaaaccggcggactcgacgtgctcgtagaagcggtcgaggaattcagcggagtactgggcgaagacgtcggggttgtagtactggttgctgatgaggtagtcgaggcgttcggcggtggaggcgaactgcttgctgttggcggccacgtgcccagtcacgtattcgcgttcggcggccttgtctttgtcgaactggatcttgccgtcggcgtcatagaggttgagcatcgcgttgagcgcgtggtaatcgtgcgccgggtcgtactgttccgctgcggtatcggcagtgttgtcgagcgacaggacggtggcggtgaggtcagtcattggaaatccttggaatatggcagaagtgtgtttacttagacagttgctcccccagtcaacttcgttgacagctcccctcggagaggggagccaatgcctcgagggggtcaagatttactgttcggtgaagaagcggacgaggccgtttcgcacggcggcggtgtcttctggggtgcccatgagttcatagcggtaaaggtatggaacgtggcatttggccgagatgatatctccggcggcgcagtacgcctcgccgaaattggtgttgcctgaggcgatgacgccgcgaatccactcgcggttggctggatcgttgaggaaacgtttgacctgaatcggcactgctttcttgaccacgccgccgccataggtgggcaccatgatgacgtacggttcgcggacgttcagcgccgggtcggcggcccgcagcgggatgcggtagacattgatgccttcgtcctgcaaacggcatccggacacgaaccgtgcggtgttttcggaggccgacgagaagtagaccaatgcgccgatcgtcttgccttcggccgcgaactcggcctggctcacgcggacaccgtggcggcggcgcggttgtcggcggccacctgctgggcgacttcgcgaatcaggtcggggcggtagccggtccaggagttgtccggcgtgatgaccaccggagcctgctggaaaccagcggcctgcagctgctcaagggtggaggggttctgcgtcaggtccacggtttcaaacggcacacccagcttggtgagctggcgcttggtggcatcgcactgcgggcaatgcggcttggtgaacacggtgacggtcatggcgactccccttgatgtggttctgatggacagtgaagcgaaggccatattacagcgatgtgatttgaaatcaaggcactatatgtagtggcgtgtaccatacaacaaacctagatatagtgatttcgttgatattccgccattcctaagcagccacgaaaatcggcgtgcagcgacccgcccaatcacatgtggcattgttcacatttgcgcttcaaccgccatactcgcgtttcgggggctgatttggccttttccggagatctatctccgtttcgaggggctggtactcaagtaagcgcatccccaaaatggcggaatgacggtggggcgaagccgtttatacccgtgttctagcgggccaccagcccctcgaaacgggagtaaacctctacggaaggccaaatcagcccctcgaagcggagaacggatacctcggcaccccgtgtggagccagaaggcccggccggatgtccaaacgagcatccggccaggccttaaaagtagttgttcagttttgataatttttatcacgctcggcctcccaggagagagccagaataatgcaccagcaaggcattaggatggagggcatgagcgatttgaacgcgttgaatcttgagcccggcgaagtggttggtgggtacacgctgatctcccggctcggctcaggagctatggggtcggtgtggcgtgtccgcgacgacggcggcaccacctatgcgatgaagattctgcgcgattcgctggccgacgagtcggtggcaggctccggctctgcgtccgcggccctgcacgaccccgacctcaagcccgatgtcacgccgcgcgaacgtctgcggcgcgaggccatggccttgaagaaggtcaatcatccaggcgtatgcggcattgtggatatggaactcgacgatacgttggcgttcatcgtcactgaactcatcgagggcaagaatcttaaggatgatgtggccgccaatggccggtatgtgggcgacgatctggaacgcttggcccgcaagctcatcgatgccaccaaagccgtacatgcggccggcatcgtccatcgcgacatcaaacccaccaatgtgatggtctcagcagccggcccggtgctggtcgacttcggtatcgcgatgggcgaaggagaaagccatgtgacccgtaccggcctagtgatgggcactccgggattcatagcccccgaaatcatcgacggcgccgagtccgatgaggcgaccgattggtggtcagtggcttccgtacttgccttcgccgcaaccggcgcaccggtattcggcaccaagccgatgatggcggtacttgagcgcgaggcctcgggcaacgcgaatctttccggattgccggccggcacattggctgccttccgttctgcactggacccggatcgcacgaagcgatgcacacctgaccaactgctcaacgccatcgccttggatgcgttgaatcccgccgtctggcaaggtgcacaggccggaccgttcgccgccggcgccattgccggaggggccaataccatcgcgccagcggccggcacagccggcgaaaccgaggcggtgcccccttttggcgcggccggtcacgttgaccgcaataatccccgcactatttggcgagcaaccgatgaggccgcacaggcactgaccgacgaggccaccacgacattgccggatagcgccgctcccgcaatttccgatgaagctacggtccagttggcgggggcgacggttcccttgactgaggcaactacaccactgaccagcgaagccactactccactcacgcccgttacgggggagcctctgctggccccgaccacgccgcttgccgagcgcaccgccgtgttgccctcgccacagccgacggcattccctccgaccccgccagttcagctggttggaggcatggcccaaaatggctggaatccagctgccgccgacgtccaagccacggtcgtggaccccaatatccgcccggcattgcaacgagtcattgatcagaccgctcaatttgccccgacagaggcattggtgcagcaaccgctcgcccccaatccagcggacgtcaaacgcggcgaatatctacaacgcggtgtctttccactgttgttgctggcgctaccactggccgtactggctgccagcatgcctcttatcgctctgctggcagcagcggcgatgctgtggctgttgctcacattggcctacaacaccgagccccaactcgagcgcgagggcaggcgcggtggtgaacgcaaaagctccgatacgtggattcgcgccgccaccctgccttggcatatcgtcaaagccctgctgctgtcgttgccgcgtatggtgctgctcatcgttatcgccatagccggaacggcggcggccacgatggcgcttgccttaccgacgcaaaccgtgtactggtacttcacgccggaacgaggcgtgccgattccactgctcaatgacgtaccgctgtcggcatcgggattggcgctcggcggcttcatggccatcggatggctggtcacggtattcggcccgcaagcaatgatggctcgactgggggcaggcgtgctgcggggattgaacccccggcaggcacagtctccaatgccgctggcctacgatggctcgcccgcagtgccgtcacccgcggcaatggcaccggcatcggccacgcgcggcaagcgcagcaccatgctattcactatctggatcatcgtcaccttagcattgtgcacactgccgctcactggcatggcgattgactggacgccgctggtctgaccactcccctgcggccaagctcatcagaccgcaccacgacctctgacgcgccgcctttgacgcacataccgaacgctgtgtgaccagagtcacgtccaccttcacacggatttcacgctatatgagctgtgagcacagtcttcctcagggccggccattataatggggcgcagccgtaagtatttcaaggggataagactatgccagattcaaagcgtcaggccaaacgtgccactcgcgccgaacgccgtgcagccgaagaaacggctttgcaggtccaagccgcgcaggccgccaaagagcgtaagcagcagactcttattggttgcatcgttgtggccatcatcgtggtgctggtggccatcgctggattcgccgtatacaaggctatgaacccggcaaactctggcgaacaggccagcatgactgtggacgaggcgtacagcaaaatcgacaaagtcaagaccaagcccgccaaagccagcgacaaggccggcttccttatctccagcaagggctactcgcagaaaatcgatgacgctccgaccgtctccatctatatggagccgttgtgccccggctgcgcggcagtgaaccgccagcttgacccgacgctcgtcaagctgatgaacgccggccagctcaacatcgatttgcacttcctcaatttccaggacaacaagagctccgacaactactccaaccgcgcgttcaacggtgccatctatatcgccgagcatgacgacgatcccgatcacctgatgcagtacctctccaacatctacgctgaggatttccagcccggtgagctgtccaactatgtgtcggtcagcgacaacaagctgaagaagcaggccatcaatgccggcgtaagtgaggacgtggccgccgccgccttcagtggtgacaacgaatatgtcgactggctgaccgcctccaacaactacaccatccttcgccctgaactgttctccagctccggctccttctcctccccacgctcaccatcaatggcgaatactgggatctgcaccagctatcgctggcgaaaacgtctatggtggacggcttcctcaaggccatcggcttggactccgatcaagtgggcgtgaaaggccagatgccaccgatcggcgccaacaagaagccgatttcgctgaccgattaattaccggcgcggcttggcccgaattgaccactcgggaactaccggtatactagagatttgttcaaaacgatttacgcgttaagaacaatcgcctctttagctcagatggccagagcggccgccttgtaagcggcaggtcgtcggttcgatcccgacaagaggctcgtcgcgcagaaaaaatggcgtattatgtgatacgtaggcttttctacgcatataattcttaccttgggtaagtactccaggagccttccccaattatgggcttcctggaatgagggcggagcgtcccccaaccagctccgcaccttcaagggggcgggaacatccccttctctcccgccccctttttctttttttttgagttcagaacaatctgacgagcaggaatggtgacggtggccggtgaaaccgcagtacgggtccgaacaaccgttacgatgggtggcgtaatcgttcacccagcaggaagagtatggcaatggcacggcgttggaccccgcagcggtttgttacactgcgtcgcatccgcgtaatcgcctgtatcgcggcgaccagtatcgcgctggctggatcattcgcgttcaccgcgcgtaaatccgtagccctgaacatcaacgggcaaaccacccaagtcaccacatatgcgatgacggccacccgtcttctggaggaacaaggggtggatatcaagacccacgatatcgtcactacctcgtccggcgaccaactcgccaatcatgccgtggtcaccgtacagtccgcctaccagaccactatcaacatcgacggcacgtccgttcccttctggaccgtggccaccagtgccgaccagctgctgggatttttcgaggaaaaccagaacaacgccacaaaaatcaccgtcgacatcaacaatgtgtacaaccagctcaccggcggactggtcatcaatcaggatggcccggtcaccgtcattgcggacggcaagacttccgtggcccccaacggcaaactgcccgcggcctccattcttgactccaaaggcatcgtgctgaacaaagaggaccgtgtgagcgtcgaaaaggacggcgataccactatcctgcgcgtacggcgcgtgacgcatggcgaggaaacacgcacagccatagtgccatactccacacaaaccatcatcgactccaatcttcctgaaggccagtcggagatccgtcagcaaggcgtcaatggcgagaaaacccaggtgtataacgtcacgtatgtcgatggcgtggccgaatcggagacgctgaaatccgaaaccgtcaccacgatggccatcgaccagatcatcgccgtaggcgccgccaagtctgataccgataagggttccgataaaggttccgacaaaaaatccgactccgccgataacggcaaggccgattccggtttcaacaatcagcacgagtcgtccggtaacaatgccaacaacacaggcgacaagaacaacagcagctctggcaacaacacgaacaccgataccaacaacaatgccggcaacaccggcggcaacaccggcggcaacaactccggtaacaccggcaacaccggcaacaccggcaacaccggcaattccggtaacactggtaattccggtaacaccggcggcggtacgaacaacaattccggctcttccggctccgattcaggaacaaccaccacgccctccggccgactctggcacgccaccgtagcccaggctcaggcctatgccgccggtgccgccgcgcagcgcgggtggacaggcaacgactgggattgcctggtcaaactatggaaccgcgagtcccgttggctgtggtatgccgaaaacgcgagctccggtgcctacggcattcctcagtcgcgaccagcagacaaaatggctgcgttcggcgccaattaccgtgacgatgccgccgtacagatcgattggggtctgtggtacatcgcacaaacctacggcagcccgtccaaggcatggcaacattccgaacaaatcggttggtactgatcggttacgaagcccacaaggaacacacgcttatgaacgacaccattcccgccaccggtcacctgttaggtgccgccgatatccgtcgtatcgcggccgatgccggcatcagccccaccaagaaattcgggcagaacttcgtcatcgaccccggcacggtccgtcgtatcgtacgcgaggcgggagtgaccgctgccgatcatgtcatggaagtcggccccggcctgggatcgttgacattggcgattctggaaaccggcgccaccatgaccgcagttgaaatcgatccgccgttggccgaacgactgccgggcacagtcgccgaattcatgcccgaagccacgtcacgactcaccgtcgtcaatcgggatgccttaaccgtcaccccggagaacgtgcctgatttcagcgatgacgcatcgtttacgctggtcgccaatctgccgtacaacgtggccacaccaattctgctcacgctgttggagcgtttcgacaacctcggctcgttcttggtgatggtgcaaaaagaggtggccgatagactcgccgccaagcccggttccaagatctacggcacgccgagcgtgaagctcgcctggtatggcaccgccgaacgggtgggcaccatcggccgcaatgtgttctggccggctcccaatgtggattccgcgctcgtcaaattcacccggtatcaggccgatgacccggctgccccgggaactgcgaacagcacagacgacggcacacaacgggaactcgtatttcgtctgatcgatgcggcattcggtcagcgtcgcaagaccctgcacgcggcattgaagaccattgcgccttccgaggcattctccatcgccggcatcgatccgacccgtcgaggagagacgctcaccatcgccgaattcaccgctctggccaaggccatcgaatcgtgtggagatggagatgaggcacaatgagtccggtaatttcacatccacgcccagccgctgcccgacatcagttcgatgagctctcccccatcaccattacggtggattgcccggctaaaaccaatctcaccttggaagtggggcctgctcacgacgagtggggcggacgccacgaactggacaccatctactgtgcaatcggtgtatacgacaccgtcaccgcaaccgccaagcaacccggagcgggattctctctggagctcgaaggcgcttatttgggcgacttggcctcctcacgcagcgacatgcgccgcaaccatgcggtactggccctcttcgccatggcccaggcggccgaacgcgagccggatgtggcgttgaccattaccaagcgcattcccgtgggtgccggactaggcggcggttcagccgacgccgcggcgaccatgctggcggtcaatcgtctctgggagctgaactggcctatagagcgcctgcgcaccattgccgccacgttgggcgcggacatgccgttctgcctgaccggtggccttgcatacggcaccggtttcggcgaacgcatcacggatatcgcccccggcagccgcgatgagctggcgctgatagaacagggattcagcggcgaagtattggtcggcgcgtaccagtcgcaactcagcactcctgaggtctaccacacctttgacctcgtgggagccgcagaaggcgaccgcaatcatctgcaggctgcggcaatcagcctgcatccccgcagcgggcaggccatcgacgccgccacgcaggcgggtgccagccatgcattcgtctccggatccggcccctcagtggtcgctttcgccgccgacgaggcagcggcacaacgcattatcgatgtgtggcgcgatacggctgtggtcgatcgcattattcgagccaaatctcccgcacaccccaatatcggcgtcagacagtgacgctaaggtagcaaccagccacccgacccatgaaagaagtccaccgatgacgtatcaggttgatgaacgtgaagcccgcaaggcgtacgtgcgccgccgccagaccaccgtcttttccatcagcggcgcggtattggcagtagtgctggtcatagccctactgttcaatttccacgttttcggcctcggcgaagtggagactccggcccaccagccgaattacggcaacgcggcgccgtgcgcggtcaaggacagcagcggcaaagcgcaatacgtgtccaacgcttcggtcggcattcgcgtgatgaacggcacctctcacggccaattcgccaaggccgtgggtgaagctttggccaatcgtggattcagcgtgcagaaaatcgataactattccagcaccaacgttgaacgcaccaccatctacttcggtaagaacgccattaatcaggcgtatacgctgatcggcaatttcaccgacgccaccatgatcatgacggctcgcgaggatcagctcatcgatgtggtcatcggcgccacgttcaacgatctgcaggacaccaaatcctccccgcaatccggtaagaccatcaccaatatcgagggttgcaaggccgccgatagcatgaccaagctgcccgccgacaccaaacacgacgcatacacggcgaagtaaggcgcatacagcttcatcttcgcgaaaaaccgtacgctgacacgtattcagcgtacggttttttggtatcgggctagtatcggactactgaatctcggcgtaccagcgcttgagttcttcgacggccacatcgtggtccaccggaccgttatccaggcggtattccagcatgtgcttgtaggcgcggccgatcatcgggccaggctccaggcccagcaactccataatttcgttgccgtccagatccgggcgaatcgcgtcgaagtcctctttcttcttgagttcgcggacgcgctcctccatctcatccatggcctgggagaagatcatcgccttgcgcttgttttgtgtggtggcatccgcgcgcgtgagcctgttcagccgctcgtagaggtgcccggcatccttgacataccggcgtacggccgaatcggtccacggctcgtccacatagccgtggaagcgcaggtgcatattcaccagttccgagatgtcctcgaccagatggtggtcaaaacgcagtgccttcaagcgcttgcgggtcattttggcacccaccgcgtcatggtggtggaagctcaccttgccgcccggctcgaaccggcgggtcttcggcttgccgatatcgtgcatcacggcggccaagcgcaacgtcaggtcgggggcgggcaccgggccgtccgggccggtttccagggcgatagcacgttcgagcacaatcatcgtgtgctcgaagacgtccttgtggcggtggtgttcgtcgatctgcaattgcagggccggaatctccgggaagacgatgtccgcaagaccggattcgaccaacgcctcaaggccggcgcgcggacggtcggagagcagcagcttggtcagttcgtcgcgcacgcgctcggcggatacgatgtcgatgcggtcgcgcatcgaggtgatcgcctcggccgcgtccggcgcgatacggaagcccagctgggccacgaatcgcacggcgcgcatcatacgcaacggatcgtcgtcaaaggactgtcgcgggtccaccggcgtgcgcaacacgcccttggacagatcactggcgccaccgaacgggtccacgaattgcaagtcgggcacgcgcagggccatcgcgttgacggtgaagtcgcggcgggacaggtcgccctcaagcgtgtcgccataattgacctcgggcttacgcgagtccggatcgtacgtgtcggagcgataggtggtgacctccaccttgacctcggtgccgtccgggcggcggcgcatggcacccagcgtgccgaacttgcgccccatgtcccagaagccgtcatgcccccaccggcgcagtatcggctcgaactgctcaggccgtgcggatgagcagaagtccaaatcgtggctccttctatggagcagcaaatccctgaccgggccgccgaccaatgccagctcgtaaccctgttcggcgaacagtcgaccaagttcgatggcttcgggccatacttcgaaatccaatgggcaccttcccgcgtgcgacgtttttctgccctaccagcataccgttaccccacctgcacacggggttgagtaaggtggagaatatgattacgcccgccgaccttgcccgcatactggggcaaacaccagattcggcggatagccatacccaagaccacctgctgtatacgtccgaaactccgcatcattccgccgattcgggcgattcttccgatgtcggcggcaccgcgagccactccaccaatcaggccgttcatcaagacgaagtagacgcagtaccgactgcgcaacattccggtgtgcccggcacgcccgcaacgcccgtcacgcccgcaccatccgaatccgaaatatcggactccgccagcgacatgcccgcaccgaagccgatgatgcccacaccggccaccgtcttcggcatgcatgccaccgtcaccatcgccactaccagcggcactatcgaagggcaggccgatggtatcgccggcgaggccggtgccgagacgattgccgaggtcgagccgattatcgccacggcacaaacgtccgtaaccatcgtcacgaacgatcccgcggcgaccgcccacgcggccgtagatgctgccgttgcggtcgccaaggccgccgccgcgcacaccacagcgataccgactccgcgcgacgtgctgatgccgcctgcggcacgtaccgcaccggccgcagtgccggccaccatgccggtctcagcgccgtctgcagcaccagtgaggcccgtaacgtcagcgcatcccacgccggccacggtcttcggccggcatccgtccgcggatgttgcctcgccggaaccggcagtgccagtagaaccggtgacgccatccggcccgactccggccatgatgccgcaacgccgtacgtcggacggtccgaccacattcgcttcactggatgcccaggaactgccggtcgtacgcgaatattcggcaggcggtctgattttcgatgaccagaaccgcgtggccattatcgcccgtcattcccgctccggccatctcgaatggtgcttgccgaaggggcatatcgagaaaggcgagaccccgcagcagaccgctgtgcgcgaagtgcatgaagagaccggcatcctgggcgaggtgatcgattccatcgccaccatcgactactggttcaccggcaccacgcagcgcgtgcataagctggtccatcacttcgcgctcaaacagaccggcggcgaactgacggtggaaggagacccggatcatgaggcggaagacgccctctgggtacgttttgaagatttggacgacgtgttgagctatcccaacgaacgcaaaatcgcgtggctctacgccaggaagaagaacaggcaggcaaacgagtgaacctacccggagtcttacgacattgcacacgtctggcacacgcactggcggctggcgtcgccgttgtggcgatgctggccgctccattgaccgtctacgcgaacgatacgacggacacgaccgattcatcatccgatacgacggacgcaacgggcaatcagaccgagaatcagcccaagcagagcattgccatcacgcaaagcacccccatcgtcacctccaaatcgggctatcatgtcaccgcggtcatcagcaatacggacagcacggccacgtcaagcggcacactgcacctgaccaccaatacgctgttcacctttgtctcgcgcaccgatattcagaattgggccgagaacaacgcccccatccccacccccaacgagttgggttccgttgacgtgccatcgattcccgccggcggcactgccaccgttaccatcgaggtgaacgccaatcagcagacccttgcctccatagggagctgggggccgaagccgctgatgctgtcgtatatcgttggcaatcggatactcgccgatttgccgagttttctgacccgatcttcggatgggctcaacaccgcgacaacaccggccatgaacctgaccgtggccatgccctacaccgccagcggctggcaggtcgataataaggccatcagcaatcgcattgccgaaaccaccacttcctcgacatcaacatcgtccaagtccaacggcacggacaaggccgacaagtccgataacgccgacgccagcaacgcggccaaaggcactgatacgcaagccatatccttatccgggcaggatgccgataccgcgcgatcccttgggcagacattcgccaagcaccgctcgctgcaagtgatcgcggatcctctgtattggcgtcagtccgcagtgcaaccgtccattgccggcatcatgcagcccgccgactttgacatcaccgcctataccgcgctgggtgataccgcggcctacgaaaaggcaggcatcaccactgagcagtggaacgccaagcaggcggccgcatggtatgccgacggaggcgactccgaaacaccctccgcgtacgcatggcagggcaacaactgttggacgttggatgcgctgaccgcagcacgcgagcagggctatgacacggtgattgccgatgcctctttcgatgccgaccagactgaagccgtacacacaggcacctacgtggtggatacgcctgccggcgatgtcaccgtgctgaaggagcaatcgaccttgggcatgctggccaagggccaacccaccagcacggacgcgcaggccgagtccagcgatgccggtcggttggcccgactggtcgctcagagcgcgttctaccagatggaacagccctatacatcccgatacctgcttatgacgttctcccgcaccacggaggccggctggatcgatcaggtgatgagcgccttcgagcaggcctcttggttgaatctgacggatctgaagaccatggccaaggccgatccgtacaatgtcagcgattcggtcaatcccgacaaggccgatgatgccaacaccgccaatacccggtcggcattgagacagttggccgacagccggcatgacatcatgcgcatggccacctccatattgaggaacgagattgattccgacgaggtctcgtcgttggacccgcaggccctggcccggcagaacgccaatgacaccgcctcgcatagcaacgatccgatgcaatggattggctctctactggtgctgcatgatgatatggcgctgcggtccatgtctggctccccccagccgacagccacgcgaaaagccatggtcaacgccgcgaaaacactggccagcgatcttctgaacggcgtacgcatcaacccatcggaaccggtatccgtgttcagcgaatccgcgaaaatgccaatcaccatcagcaatgaccttccctacgccgtcagcgtgcaggtcaactcactgactgactccatgcagatcgtcacctcgcgaaccgctgacatcgatattcccgcgcatagcgacgctcaggtgaccttcaccatccgcgtttccacttccggctcatcgacggcccatgtgtcgttgaccgaccgggaaggcaacagattcggcaacacgcaggacaccgcgatcaccagtgtgatgcgcatcagtgatgccagcggcttcattatcatcggcttcgccgtgctattgggcattatcggcctgtggcggcaattccatcggaagaaggaccccgacgaatgagttcaaccgtaggtcgtaattccctgatcatggccacgggaactgctgcttcccgtgtgaccggtcagctccgcacgattcttctcgctgcggccatcggcaccaccggattggcggccaacgcctatcaggccggttccatgattccccaatccgtgttcacgctggtgtctggtggtattttcaacgccgtgctggtgccccagatcgtgcgcacgttgaaagaaaaagacgcccaagaacgactaaatcgtctggttacgttggccatcggcatcctgttggccatgaccgtggtgatggcggcggccagccctctgcttgcccgcctgtacgtgggtagcgacgatcaccagatgatagccctgaccacctcgttcaccctgtggtgtatgcctcaggtgttcttctacggcctgtatacggtattgggtcagatcctggccgccaaagaccatttcctcacgtatgcgtggagctcaaccggtgccaacattattagttgcgccggttttactggttttattctgctgttcagcaaggccaatgaacagcccctcgaattctggaccgccgacaagatcgcgcttaccgcaggcacctggactttgggcgtggccttccaagcgctgatactcttcctgccactggcccgtatcgggttcaagtacagacccagcttcgggcttggcggctttggactcaggtctatgggtcccgtggcgttaggctctttgggcgtggtggtcaccagcgagatctgcggcattatccttacccgtatcgccacatccgcaccgcagcgcgcccacgaactgacgggtgccagcctgttcagcgtggcaggcaacgcgacctatcagaatgcgtacacactgttcatcctgccctattcgctcatcgccgtatcggtatccacggctatgttccccaaaatctcccgttctgtcgcagctgcgaatctggatgaggcacggcacgacctagtcaacgcactgaataatgtgggcctgctcatcatatttttcgccgccgccatgattgtgttccccgaaccgattatccgcgcattgcttccgtccgtctcgatggacgagaccatgctgatttcctacgcgcttatcgccctatctgtgggcactcctttgggatcggcgttcctgctgattcaacgtacattctatgcctttgaggacggcctgcaccccttcttgtctgcggtgatgcagtatgggttcacctcggtattcatgatcatcggcatgatggtacttcctcctgagcattgggtactcggcatcgcctgctcggtgacactcggcggattactggcgttgccgctgacgttgatgatgttgcgccgcaagttcgaaggcaatcttggcggtcgggagatcacgaggacatacgccaaggccattgtggcggcactggcttccggagttgtggtctggctgatcaaacgaccggtagtcgcactgttcgacgcggatattcgaccagtaggcgggcacatgagctggtggtctgcgctggccatctgcgtggtgctcaccatcgtgctgaccatagtatatgtggctgtgttgtgggtggtacgcaccccagaactcatcagcgcctatcactcgatactggcccgtctacacaagactccggccagtgaagacgttgctgtgacagcccagccggaaaaagtcgacgatacgcaaatcaatcctgagacggagcccgtcaaggatagccccgcacgtagaatatctaagaccagtctcgaacaccaatcacacggagccgaacgcactatgaaaccgcaactcggagacacaattctcaaccgatacaccttggtatcatcgttgcgtgcggagcctggcattcaggcatggaaagccaacgaccgtgtgctggcaaaggattgccagctgttcatcattaccaatcgcagcgctttcgccgcaatcgatgagctcgctggtcgcatcgccgccactcgccctgatcgtgtgattcccgtactgaaataccgtatggaatccgacgtacttctcattgtcatgccggtggatagcggccaatgcctgactgactacatggtggataccgccaagccgctcagctacagcgccatccggtcgattatcggagaatgcgccaacgtgctgcgcgagatcattgcggatactcccagcagcatcgtcatcacaaccgacaccgttcgagtgactacctccggtgtgcaaattgccgatgcaccatgtgccacgatgctggccgatacgtccgctaccgatctgcgtacggacagtcctgaacggtatgcgattcgccagcttgcggcattactctataccctgctgacacgcacgccaagccaagcgacacccacattcaatctgcgtgccttgccgcaagacacccctggcgaattccgcgtgatttgcaagcgtggattggccttgagcgagcccgacgagcatacgttgccaatggctgcccttgtagaactcgacgccttgttgggtaattggaagccgctctctgaactgagcgatgctgatattgctttgccgagcgtggaaagcgattgctcgattaccaaggcgatactgaagcctgccaacgagactgatatcgtgcctattcccagcacgttgattaacagcagcagtcttccggaattgtctattaccccttccctgccggttcagccggccgccgtccccgctccgcacgtgatgtcaccggttcctctgactgatgggtccagtattgctgacggcaaccagtctcagtctgatgcccaccgtctgtttgacttcaacctttctgacgcctgggagcacgagaatctttccggtgaagacaccggtgactggtacagcgaaatgaatccagcccccatcggcggtccgagtgataatactcggttgacagtgcctattgttaccggcggtatttccgacgccaccgtgggagagacaaccagtcgtattcccatgttcctcgccagcggccgtgctgtggctcctggtgaggaatcgctgcgtgccttggaagaggagcaggcccgcattgccgaagtaagcgccattcctccgagcttcacaccgaaggatgtgccggatgacgaggatgacagcaagctacccgatgaacatctgttcggtaaactgtcgaccaaggtcgttgccatcattgtggctctgatattggtagtggcagcggctgtttgggcagtgtatgcgttccgatcctccggagacaatcctgccgatgcttccagcaactccagtgaaggtgactggcctgatatcaatgctgacgctgtgccattcggtggcagcaagaacgcgacgaacggtggcaccactgacgattcttcaaagtcaagtgatgccactcagagcgaatccaaggactcggcatcagacaagtccaagaagtccgagactgctgattcgtcgtccaagaagaccaaggccaaaaagtccggcgataaggattccagcgctgctccgcaaccgcgccatgagaacaacacggcgtttacgatttccagcgccaacttcctgtcgaatcctggcggccaatccgggtacgcatactacatgcaccttgaccagccgcaggatgcgtaccgcatggttatcaccatccgcacatccggtggtaagggctatattcgcgcgaataccactggagaccccactcagggcaagcaggtggccgaattcacctttgctgaaggtggcactactgaagtgaagttcaccaaagccgtcaatacgcaggatctgctgctgtgggtgccatcggatagcctgccgcagagccagctgtacatcgagaaggtggaggtcttctaatcggcatctatgccgataactgacccaagaaggggcggcaccgttcgcatacattcgacggtgccgccctttcttcgcgtctggctgaatgacacggaatatcgtatgggggtgtgacaatgtttcacgtgaaacataacgtcatcattatcggttctggtcccgctggctacacggccgccatctatcttggccgtgcaggtcttaatcctgttatggtcactggtgcgttgtcgccaggtggacagttggtcaacaccactgaggtggagaacttccctggattcccggaaggtattcttggcccggatcttatggatcgcatgaaggaacaggccaagcgcttcggtacaacctatatcgcagacgatgtctcttccatcgatgcgtgtgaaagtgattcggtcaagccaacctatcgtataacgctctccgatgactcccagttggaggcatcggcgcttatcatcgccacagggtcgtcattccgtaagcttggggtgcctggcgaacaggagctgtccggacatggcgtctcgtactgcgccacctgcgatggcttcttcttcaggaacaagcctatcgtggtcgtaggcggtggcgattcggcttttgaagaggcattattcctgacccggttcggttcttcagtcaccttgattcaccgacgcgatagcttccgtgcctcgcagatcatggtggaccgagccaaagccaatccgaccatcaccctgctgaccaacacagtggtgacctccattaccggcacctcctcccccacacagaacaccggtgcacctattgccattcctggcttgacaatcaaacgaccggctgtggcaccggccagtgtcagcagcattgccgtacgtaacgtggtgaccggagaagaaagcacgctggacaccaacgccgtgttcgtggctatcggccatacgccggccactgattttgcggccggtgttgtggaccgtgacgatgatgggtatgtcgtggtgcagggtgccagcacggtgaccagtgcgccaggcatctttgctgcaggcgattgcgtggatcgtacttatcgtcaggcgatcagtgcagcgggcatgggctgccgtgcagcgctggatgcgcaggcctatcttacggactgattgcggcggactaatggcggcttgctgttctgtctgctgcctgtgacataggagcaacgttaggtcagtgttacagcatgccgcccttggatagtacgtaccagtcagaggcatagaaagacccctcaggcgacggagaatcatgatgtgtgattgtccgtcgcctgaggggttttctattgcgacaggggctacagcgcgggcatacgcccctgccaggaatcacgcagaggctatacgtcttgtgttgtacaccgcactgcacagcaataatgccagcgacaacacgaatgttcttatcgcgttacacccatttggaatcggcatcgccttggctcggcaccagcagctgcaggatacgatccatatcctctggtgacgagaagacgatttcgatgcgaccatgcttggtgctgcccttaatcgacaccttggtatcgaaatgattttccaaactctgctggatggcggaaccaacccaaggattggtcttagacgtcttaggcttcttcggctgctcccccgacgcaaccttcatggcgacgatttcttcggtgctgcgtacagaaagaccttccgcaataatacgagaagccagcttgtccatttcctccggatcgctcaggcccaatagcgcacgcgcatgaccggacgatagcacaccggcagccactctcttttgcacagaggccggcaggttcagcagtcgtaaggtattggcgatttgcgggcgagacttggacaccgacttggacagttgtgcttgcgtcaacccgaactcttcgatcatctgctggtaggcagccgcctcttccagtggattcaaggccacacggtgcaagttttccagcaacgcatcgcggagcatatcatcatccgcagtggttttgacgatggcgggaatcgtctccaatccagccaactgagaagcacgccaacggcgttcacccataatgagctcatacgggctgtccaaatgaccggcaaacggattcgtgctggattccgtctcgtcgtgcttggcggctttggccgcagcaatccggcttgccggacgcttgcgcacgactatcggttgcagcacaccaacttccttaatggaagcagacagctcattcaactcatcctcgtcgaagatggtacgaggctgatgtgcattgggcccgatatcagacagtttgagttcagccagataaccaccggctaccggcttgagctcgtccttcttatctgtgtcagcggtctttgcctccgatgcagtctgagatgtttcacgtgaaacatctttgacaatgacggatgtacgatgtgccgtctgaggcgcagacgacttgccgccctgctgaggcgcggcgaccttaccggtttgaggtttctccgtaccgaaaaacaggtcgctaggatgagtaatgatgtccaatgcgggcatggatgcgcgtttaccggcggctttcttggctgccttgctggatgataccgtctgaggcgcggcaggctttgattcctgctgggcagtagccttcttggcgggggttatgtcagcagtggccgccggagtagacgaatcctccgcaatcattgcgggctgctccgccactggttcctcccctggcaatgtggggaacaaagcgccaaggcccttaccgagtcgtgattttgatgccattacttgttcctcctcgcatcaatggtgtcaaggacttgttgcgaacgctgtgcgatctccaaagctgcttcaccatacgatatggcacctatgccacgaggatcataggcaatcaccgattgggagaaactcggcgcttcggagatcttgactgaacgcgggatggtagtattcagcacaatgctgggatagtgtcccttaacctcgttatatacttcacggctcaataacgttcggcgatcaaacatcgtgacgagcatggtggacaccagcagtacgggattgaaatgctcttgcaccaaaccaatcgtgttaatcagctggccaagaccctccaatgcgtaatactcagcctggataggaatcagcatctcggtcactgcacacatggcgttgatgaccaacaggcccaagctgggcgggcaatcaatgaacacgtaatcatagtgtttatctgattgacgtaggtagaggtctagggcctccttcagcaaggtgtttcggttgggcagatcggccacttccaactcagcaccgctgagatcgattgatgcaggcacaacatcaagtgtgggaaaatcaggacagaccgtgatgacatcccccagatcggaacgcccctcgataacgtcatagaccgagggctctcccgatgcatgagatacacccaacgccgtagaggcattgccctgcgggtccatatcgatgaccaacacctgcgcgcccttgtctgccagcgccgcagcggtgttcaccgtggatgtggttttacccactccccccttctggttggccacggcaatacgacgggtacgtttaggtttggggaaatcggttttcttgagtacatcgtagcgtgagctttcatcagccatctggctaccaagcactgaaccgtgaccatcgaatattcgctgaagcgtttcggaagccgattctataggttccgactgatgatccttggtggccatcgctcctccttgcacagacgtaagttccagtgttctcattcgtatggacatgatgctcgttatccacaattgcgatatgcaatgtggataagtgtggataagtgtgaatgatgttgggtgttagattgtgtattcacagacgaaaagcattgaaaaatcaatgttttcatcattgtgcacatcgtcccgtaaaaatgtggataatttttacgcacatacggaaatgtggataacttaatcagtactccactcatcgcttatccacaatcaccacgtgggtaggctcaagatccggtccgacagccgcttcaacgacgcgtggacgacgaccaccgaattctgcaatctccttgccagccttgtcgatttcagcctgagcagaccgtcccttcaatgcgatcaactgtcctgacggtttcagcaacggcaacgtccagccagagagtttggtcataggagcaaccgcacgacacgtgacaacagcgaacggatgaatttcccgcttccgtacctgctggatgacggcatcggagcgtccacgaataatctcaacgttctgcagttgcatcaggtcaacacattcatgcaaccattcgattcgccgctccatcggttcaatcagcgtgaagtcatgatccggcaaacacgcggcagccaccaatccgggaaaaccaccaccactgccgacgtcggcaactgttttgaagcgaataccattcgttgcattccgaacgtacggcacaatcgcagcggaattcagaatatgccgttcccaaatgatatcgacgtcacgggggccgatcaatccacgaggttcaccctcttcggcaatcttggcatggaaacgctccaacttcggcaacgcatcacccaagacctcagcaagtacaggtgactcctgcagctgatccgtcatagccatctccctcaccatgtttcacgtgaaacaatcaacatggaaaaggcgtcgctcattacgacgccattccccctgcggtcactcttgtctgtttagagacgacatccgttgaacgtccctgtcatctcaaaaactcgtcgacctattactcctgatcaagctcgtcgtcttcggcaacatcctcgactttgttcttgagatacaccgtcacgtaacgatgaggctcctcaccgtgcgagcgagacttcagcccctcttcccgaaccacatcgtgaacgactttacgttcgaaggaattcatcggcttcaagtcatacggctcgccggaatccctcactgcgtcaatggcatccagggcgatatcacagaggtgctgacgcttgcgcttcaggaaaccgtcgacatccacaatcagatgagaacgctcgccggtcttctgctgtacagccagacgagtcaattgctgcagagcatcaacgacttcaccattacggccaataagatgtttgatgtcggtatcgtcatcagcaacgatctgcacggtggggcggtcattacgcacgcccatctcaatgtcgccctcatagtcggcgatatccagtaggccctcaaggtaatccgcggcgatatcagcctcttcgttgagctgatcaatcgacttcacgtcatcctgtgccatacgctactccttcatgtcgtgtttgaattacaagtctaagccctgctcccccgaacagagaaagtaatgtcggtgcgtgttcgatgtttcacgtgaaacaccgaacacgcaccgacatagtcgtcacttctttctgcgcttacgcacgggctgttgacgctgatagccatgagtggccttacgctcggcctcttccttggccttggccaatgcttcttcttccagagagggcaggccggcctttgcgcggcgagcattctcattacgatgatcgcgcttttccttgtccgccgcagccggagagccaggggtcgggaatgcgtacacctgccacaatgtgcggcagaggttgcacacgttgttggtcagccagtagaccagcacggcgaacggcatggtggcaccagagaagatgtacatcaccgggaagagccacagcatagccttctgcatggtctcggcctgtttgttcatcgatgcggcgggcatgttgcgcttcatgttgaagtactgcataaaccacaggcagaagcacatcaggaacacgaaggtaccgatgaccaccttgccactagtggcagccctagagaagttatcggtcacgctgacaatgccgaacacatcggtttgggtgaattgcttggcggttgctacgtcgaacgcgcccaacgcaccgcgtttaccgttggcaatgtagggaatggccgacagcgtatagaacatggacatgaacaccgggccctgaatgagcataggcaagcaggagccagccggattggcgtcattgtcttgatacagtttcatggtttcacggctcatggcctccttggaagcctgatccgtcttgcctttgtacttgttctggatgcgcttcatcttcggcgccaacgcctgcatcttgcgcatcgacttcatctgcttgcagaacagcgggaagatacacgcctgcaccaccagcaccaggatgataatggcaagcacccatgagacaccaatcgggctcatgcccagcatcacgaagaagtcatgcacgatcttcatgatccaggtctgtaaccactcaacgggagtcaggattttatatagaaatccccaaaacccgctatcaagcagaaattcatttgagttcatcgttgggcctctctttgggttgtggccaatggtgtcagtcggggctcttcatgagccttcgaccacgaaaatctgtaaaaaatggaataccgttgtggaacatcgtcgattcccccacgactccacggccggcaacgcagtaatctcagcacggcgagcactccccctttgaacgcgccataccgttccaacgcctcaatggcataattcgagcacgttggataatacttgcaacaaggcggtgtgtttgccgagatgcgctgttgataccagcgcaccccaccaatcatcaccgccttgaaagaagctgtcatgcctcagccaccttatgcgccactgtggcaaaagccttcgcgatctgctgatctagcgaaacgaacgatgcggtcgcagcactgggcttggcgcgcaaaacgatatcgcaatgcgcgggcaacagatcctcatgggctctggccaatacacgaaacctacgcttcaccgtattacgggtgaccgcatgtcctaccgatttggagacagctaatcccaaacggcgatgcaccgtccggtcgtcatcatcatgatggtcgtcgggcaccaaatagtgcacgacgatatccttgccacctgctttgcgccggcgtttcagcacggtgacgaaatcacgatggctttgaagccgctccacctcgactatgcctgtggcactgatcggaatgatcaggcggagagggacttgcggcccttggcacggcgacggttgatcaccgcacggccagaacgggtgcgcatgcgcaggcggaagccgtgcttcatgtggcgacgacggttgttcggctggaacgtcctcttcataatccattgctcctaggtctattcggcaacgcttcgcgctgccctcacgtgagtcaagctatatcaaagtactctcacccctaccctcaagtcaaaacggacggagtattttcacatttcgacacgttgcgagacacgcctcagatctcttataatcggcggaataccaaccattcacggccaaaagttatccacaaattacatgtttgttattcacaatccaattatttcaacacgcgacacggtggataacttgtctaaaccagagtaaatattatctgttgtacatatttcgccacagcgacagaaggggccaccatggttaacgcttccggcgaccccgtaatcgaggccgcccacatctggtcagacacgctgacggtgctcaaacacagcgcttcgctcagcccacgagaaaaaggctggttggaaggcgttgttcctgaaggcgtcttcggttcgaccatcgtgctgtgtgtggacaacaacgacacgcttcaagccattcagggtgatttgaacgattccctgcttcaggcattgcgtacggtaaccggcgaaaatatgtttcccgcgttcaaggtcgtgccgaaaaccgagccagaaccgctttcggcggcaaagccggcgcagccatatccttcggaaatttctccgactgtcgccgagttcggtaaagaatcctatggcgcaaagccggtagccgcaccgcgggaaccgatgcccgccaccgagtcgcagttcccggtcggtcagcagaagatgaatcgcgatcccgagactcatctcaataagaacttcacgtttgattccttcgtgcctggcgattccaaccgttttgcccgtacggtcgcactggccgtggccgaaggttccggtcaggatttcaacccgttgtgtatctatggcggatcgggactgggcaaaacccacttgctgaacgccatcggcaactatgcactggtcaaggatcccgggctgaaggttcgatacgtcacgtctgaggaattcacgaacgaattcatcgacgcgctgcaaaacccgaaccaaagccaaggtcagattgctgaattcaaccgtcgataccgacaggttgatgtgttgcttattgacgatatccagttcctcggcggcaaggaagccaccttggatcagttcttccatacgttcaatgcactacatcaggcaaataagcgtattgtcattgcttccgatgtggcacccaagaatttgaagggtttcgaggctcgactcatctcgcgcttcgaatccggcctgaccgtagacgtcaagccgccggatctggagacccgaatcgccattcttcgcatgatcgcctcgatgaacgggtcgaaaatccccagcgatgtgttggacctcatcgccgaacgcttcaccgagaacattcgtgaacttgagggcgcgcttacccgtgttacggccgtggcctcgctgagtaatcagccggtgacccgcgccttggccgagcagacgttgcaggacttcttcaccaccgatgtggaaatcaagcccacggacatcatcagtcaggtggcgaagtacttccacctgacgtttgaggatcttgtcggtaaatcacgaaccaaaaacgtggctgttcctcgtcagatcgccatgtatctggctcgcgaaatgaccagtatgagcctgatggatattggccaggtctttggcggacgcgatcacaccacagtaatgcatgcctgcactcgaatcagtgaccggatgcagcaaaaacaggagatctataactacgttatggagctcacggttcgcctcaagcaaagcaacaccaactgacacaacgcttctgagagacgaaaaacggcacttcttggactgactttccggaaagtgccgtttttggttgctcaggcggattctggtggatacgtcgaggcaacggattcgagacatcagattcctcatggctcccctttatgaggggagctgtcgtcgcagacgaccgaggggagtttcgacggggaacacgcaaaaacccatgaaacgagagaatcgattctgaggaccgattttgcgggtttgggcgagcgagacgaaaaaagtgccgaaaacggtctccagaatcgattctcctcgacgaaaaacagccttcaacacgccgtgcgaaagtacgaaaaccaaaaaagttatccacatagttgtgcacagatgtgggtaaactcggcggataactcgtggattacccactattttgttgtggaaaactcgtgcataactgcgacctcgatgtggaaaacccaaatccgacgaactggctgtggaaaactcgcccacttatccacaagccatgcagaatttgtccacaattttcggggacttatgaaccgttgcattcgtagggctcaaccctacttatccacactatccaccggccttattatggcgattacttactcagttacgtgaaaagcatcatcgccacagtaacagccggtcacccatcgtacgtaagttcgccacccaacggctagaatatttctcagccaatccgacgaagggaacaatcacacatgaaagtcgaaatcgataccgcagccctggccgacgccgtagcctggacctcccgagtcatcgacgcacgtccctccaacccgattctcgctggcgtcaagctggaagccattgaaggaacgctgcaattctccgccttcaactacgagatttccgctcgccaccacatcgaagccggcgttgacgaagccggttccgtactggttcagggcaaactgctggccgatatcaccaaatcgctgcgttcggagaaaacgtacctggttaccgacggctccacgctgaccatcacgtccggcaagtcgaagttcaccttgcagctcatgcccgacaccgagtacccggatctgcctgtggtaccggccatgctcggccaagtcgatgccccgactttcgttcaggcagtgaaccaagcatgcgttgccgtctcccgcgaagagaaccgcccggtgctgaccggcgtacgcatgcagttccaaggcgacaaggtcgtcatgacctccaccgatcgcttccgtttggcccgcgccaccttcacttggactccgcagaacccggacgtcgacaccaccacgctggttcgcggctcactactcaaggatgtggcccgcgctcttgatgagcaccagaacatccgccttgatttcgacgccgatagcccgacgctgctcggcttcgaaaacgccggccgcgtctccacctcccagctcatcgacggtgaattcccggcggtcgaccgcctgttcgccgacgaatacccgattcaggccgtagtcaacaagcaggatctgctcgacgccatcagccgtgtggctttggtcgccgaacgcaatgctccgattcgcatgaccttcaccggtcaggaagtggcgctgtccgccggatcggtcgacgaggcccaggccaacgagacactggacatcgacatggatggcgacgacatcaccgtggcattcaacccgtcctacctgaaggagggtctgtccgccgtgaccgaaccattcgtgcgcatcaagatgacgaccccggtcaagccggtcgagttcaacggccagcaggaagctgattccgacgagtccatggactaccgatacctgctcgtgccgatgcgctttaacaactgaagtccctgaatttccaacgattcgataatgcacatctcccgtctcgcactcgaccactaccgctcatggagtcaggtagtggtcgatttcgtaccaggcgtgaatatcctgttcggcaagaatggcttgggcaaaaccaatctggtggaagccgtcgaagtgctgtccaccggatcgagccatcgcacgtccagcacgttgccgctgatcgaacgcgggcagaccacggccaccatccgcgcgaacgtcgctgatgatgccggccaaaccactacgtatgaagcgtcgattcatgcgcgtggtgccaaccgagcccgcatcaactcggggtcgtcgctgtatctgcgcgatatcatcggcaagattcccagcgtttccttcactcccgaagatcagcgattggtgtccggcgatccgggagcacgccgcaccatgatgaatcaggctgcggctctgctcgagcccggatacatgcagacgttgcaacagttcacgcgcatcgccaaacagcgtgccacattgttgaagcaattgaatgccaatgccaataatggccagccgatggatgcggttctgagcggtttggaaatctggaccggccagttcatcgaagccggtgtggtgttgacccgtatgcgagcccatgtgattagcctgcttgccgagccatttgccgcgatttacgccgacttggccggtgccggcgagcaggtgacgctcacatatgcgccttcattcgacgaagtgctgatgttcaacgatccgcatccgcagatcagcgagcatttccaacgcatctaccccggtgaagtggctcgcggcgtgaaccttatcggtccgcagcgcgatgacatgaaccttgacttggccggtattcccgcccgcgagttcgcttcgaacggcgagatgtggacgatggcgttggccttgaaaatggcattgttcgaaatcgtgcgtgaccggttgggattgcagccgattgtgattctcgatgatgtgttcgcccagcttgatgacagccggcgcgcgcagattcttgatttcgccagaaaacaggatcaggtgctgattaccgtggccgctgaaggcgatgtgcccgactatgaatcggcccatcgcatcgacgtggccgcactggccgaaccagcttccgtgatactgccaactctgggcaatttgtccgatttgcgggaaaacgagagtttgggtaagtatgacggaaaaaccgcggtggacagcgcgtccgtagaacggaaagtgtcatgaacccgccgatcgcccgccaactcaacctggacgagaccaaactgccggccgaaatattcgagcggatctcccgtcgcggggcgaccttgaaggactacagacgccgccgtgaagaggccatcgaaaacttcggcaaaccggggcgcgatccggctgaactgggcagcgtgatgaccaccatcgccggcaatggcgtctgggcggcgaatatgaagcttgcgcaattgcgcaaccattgggaccaagtggtggggcaggccatcgccagccattcggcagtcgccgatttcatggacggtgtactgaccatccgtgccgaatccacggtctgggccacgcagctgacctaccttatcccccaactcaccgataccatccgtcgcaatctcagaggattgaccatcaccgagattcgcgtgaccggcccggccgccggatacacgcgcaaatgggctcggcggcggtagccaagataccaaacaaattcgcagaagcctcgctatggcgctcgtcgggttagacgagtaaaatcacatgcagtatggtcaaatggctagaagagtcctttacgggcctcgtaagccatatcacctccgtgaatgaccttcatgacggaggttgaccctgtagtcacggaaggaagcctgttggcagacgaaaccagcaaagaggagcagctgaaggcggctgcggaacgcatcaacaatgcggaattgaccgaaggcgaacttgacgaatccatggctcccgagcattatgaggcctctgatctgagggtgctcgaaggacttgaggccgtgcgtatccgccccggtatgtacatcggttccaccgggccgcgcggtttgcaccacctggtctatgagatcgtcgacaactcggtcgacgaggcgctggccggatacgccagccatatcgaggtctccattctgccggacaacggcatccgcgtggtggacgatggtcgaggcatcccggtcgatgaggtgcccggcgagggcgtctccggtgtggagaccgtgatgaccaagctgcacgccggcggcaagttcggcggcggcggttatgcagtgtccggcggtctgcacggcgtgggcatctccgtggtcaacgcactctccacccgcgtggacatcgaagtgcgccgtcagggcttccactggacccagacgtacatcgaccagcaccccaccgcgcccttgaagcagggcgagccgatgaccgaaggcgagtccaccggcacgtccgtgaccttctgggccgacccgaagattttcgagaccaccatctacgacttcgagacgctgcgctcccgcttccagcagatggccttcctgaacaagggcctcaagatcagcctgaccgacgaacgcgagaacgaccaggccggcgacgaggtggccggcgacgcggcggacgagccgggcgcgaagcaccagaccgtcacctaccaatacctcaacggcatcaaggactacgtcgagtatctggtcaaggtgcgcaaggccacgccggtggaagaggacgtcatcagcttcgaggccgaagacctgaagctcggcatctccgccgaactcgccatgcagtggaccaccgcctactccgaggccgtgcacaccttcgcgaacacgatttccaccaccgagggcggcacccacgaggagggcttccgcgccgcgctgacctcgctggtcaaccgttacgcgcgtgacaagggcatcctcaaggacaaggacgagaacctctccggcgacgacgtgcgtgaaggcctgaccgccgtgatctccgtcaagctcaccaacccgcagttcgaaggccagaccaagaccaagctcggcaactccgaggccaagaccttcgtgcagcgcgtgatgaccgacaagctcggcgactggttcgacgcccacccgaacgaggccaagaacatcatccagaaggccatcgaggcctcccgcgcccgtctggccgccaagaaagcccgcgagaacacccgccgcaagtccatcttcgagtccgccggcatgcccgacaagctcaaggactgccagtcctccaacccggaagagtgcgagctgttcatcgtggagggcgattccgcaggcggttccgccatccaaggccgcaacccgatcacgcaggccatcctgccgctgcgaggcaagatcctcaacaccgaacgtgccagcttggaccgcatgatgaagtccgacaccatcgaatcgctgatcaccgcggtcggcggcggctatggcgaggacttcgacatctccaaggtccgctaccacaaggtcatcatcatggccgatgccgatgtggacggtgcgcatatcgccaccctgaacctgacgctgttcttccgctacatgcgcccgatgatcaccgccggctacgtgtacgtggccatgccgccgctgtaccgcctgaagtggaccaagggcccgcacgacttcgtgtacaccgacgccgagcgcgaccgcgtgctcgccgaaggcaaggccaacggccgccagctgcccaagggcgaaggcatccagcgctacaagggtctgggcgagatgagctaccaggagctatgggagaccaccatggaccccgagcaccgcattctgaagcaggtgcacatcgaggacgccgccgcggccgacgagaccttctcgatgctgatgggcgatgaggtcgaaccccgccgcctcttcatccagcgcaacgccaagaacgtgcgttggatcgatgcgtaacggaatcctccaacctccctcgtcagagggaggtacacaacggacttagacaattaaaggaacaacagtggcagatgaaaacaacaccggcgacgagcagttcacgccggacggctcgatggagccgttgagcccgcaggaggcggacaccaccgactacggcctgatggagagcggcgaacgcatccagcgcaaggacctgcagcaggagatgcgcgagtcctacctggcgtatgccctctccgtgatcgtcgagcgtgccctgccggacgtgcgcgacggcatgaagcccgtgcatcgccgtgtgatctacgcgatgtacgacggcggctaccgccccgatcgcggctacaacaagtgctcccgcgtggtcggcgacgtgatgggtaagtaccacccgcacggcgattccgccatctacgacaccttggtgcgtatggcccagtcctggtcgatgcgcaacatgctcgtcgacggccagggcaacttcggctcccccggcgatgacccggccgccgccatgcgttacaccgaatgccgcatggccccgctggccatggaaatggtgcgcgacatcgacaaggacaccgtcgacttcgtgcccaactacgacggcaagacccaggagccgaccgtgctgccggcccgcttcccgaacctgctcgtcaacggttccgccggcatcgccgtcggcatggccaccaacatcccgccgcataacatgcgcgaggtggcggacggcgtccactgggcgctcgaccatccggacgccagccgcgaggaactgctggaaaacctgatccgcatcatcaagggaccggacttccccaccggcgccaccatcctcggccacaagggcatcgaacaggcctaccgcaccggccgtggcctcatcaccatgcgcgccgtggtcaacaccgaggagatcaacggccgcatgtgcctggtggtcaccgaactgccgtaccaggtcaatccggatcgtctcgtcgtctccatccgcgaggccgtgcgcgacggcaagatccagggcattgccgacatgcgcgacgagacctccggccgcaccggccagcgcctcgtgctggtcctgaagcgcgacgccgtgccgaaggtggtgctgaacaacctgtacaagcactcccagctgcagcagaccttcggcgccaacatgctggccttggtcgacggcgtgccgcgcacactgagcctggacgccttcatccgccactgggtgaaccaccagctcgacgtgatcgcccgccgcaccgcgtacctgaagcgcgaggccgaggagcgcgaccacatcctgcaggggtatctcaaggccctggacatgctggacgaggtcatcgccctcatccgcgcctccgaggacaccgataccgcccgtaccggccttatggagctgctggacatcgaccaggtgcaggcggacgccatcctggccatgcagctgcgcacgctgacccgcatgaaccgcgacaagatcgtggccgagcatgaggaattgcagcgcaggatcgccgactacatcgacatcctcgccaaaccggaacgccagcgcaagatcatcggcgacgaactcgacgagatcgtggccaagtacggcgacgaacgccgcacccgaatcctgccgttctccggcgagatgaacgtcgaagacctgatcgccgaagagaacgtggtggtcaccgtgacccactccggtttcatcaaacgcaccaaggccgacgaataccgcgcccagcaccgcggcggcaagggcatcaagggcaccaagctgcgcgaggacgacgtggtggatcacttcttcctgacctccacgcacaactggctgctgttcttcaccaacaaggggcgcgtgtaccgcatcaaagcctacgagctacccgaaggctcgcgcgattccaagggccagcacgtggccaacctgctgcagttcgcgcccgatgagaccatccagaccgtgctgtccatcccgaactatgaggtggccagatatctggtgctcgccacccgatccggcaaggtcaagaagaccccgctggccgagtacgattccccgcgtcagggcggtctgatcgccgtgcgactcatggccgacgagaacggcgagaacgccgacgagctcatcggcgccgcgttgtgcaacgcgcaggacgacatcatcctggtgtccaggcttggcatgagtctcaagttccaggccgacgacgaacagctgcgcccgatgggccgtcagaccgccggtgtgcagggcatgaagttccgtgcggacgacagcctgctggcgatggatgtggtgccgagcgactccgacaaggacctgttcgtggtgaccaacgagggcttcgccaagcgcaccgccatcggcgagtaccgtctgcaggggcgcaatggtctgggcgtcaaggccgtgcagctggtcgaaggccgcggcgcgctggtgggtgcgctcgtggtgtccgaagacgatcaggtcatggccatcatgaagtccggcaaggtgatccgctccaatgtggacgaggtcaagcgcaccgggcgaaacacccagggcgtgaccttcgccaagcccgacaagggcgacatgatcctctccatcgcccgtaacgaggagaaggacgagcccgaggaagacggcggtacggcaacgaacggagccggtgagaccgtgcaatccgacaagaatgtgaacaacccggacgaggcgtgagcagcgtcccgaaaagctggtagcctcgcatacaacagaggctgccgtccagcctggtaaggagaaacgatgagcgagaatctcgaagacaacgagacccggatcattccgtcggaagacggcaatacacagaacgattatgccgagccgctgatcggcgccgaccgcgctccccgtgtggcccgctccgtgtccagtgatccggaggagtccgcgttgccttcttcaggtgccgccactcctgtgcgtccggcacctcgccgtagcgcccccagggctcgccgcatgagcttgtcgctgacccgcgtggatgcttggtccgtggccaaggtgacgttcatgctgtccatcgccgtggcgattattcaggtcgttgcctccgcgatcgtatgggtgctgcttgatgtggtcggtgtattcagccagattacgcagattgtgtcttccaccggtcttgatgcaggcggtttcgatctcaagaacgtgttgtcccttaccaccgtggtgtccggcgtcaccatcttctcgattgttgaggtggtgatcttcaccctgctggccaccattgcggcactgatctacaacgtggtcagctcgctggtcggcggcgtgcacgtcacgctcggcgacgactgatatagcgatactgacggaactcccctcagtgaaccgcaccccggttgttggactgaagtaattcagattcgatgatcggaggtgcggtttcttatatgtggggatcgcaggcgtcgttgctgggccgagacttgggactccggcgacgctggggtggcaggcgtcggtgttgggacagattttgtatctctgacgacgctgtggagggcttaccgtcgtcagcggtacagatcttggagttctgccgacgctgagggtgtgttctgtgtcgtttgcgtccaattattggccctctgccgacgctgggcacagcaagcgtcgttgctgggccaagttctggactgccgccgacgcagagaatgcacacagcggtgttggtctgccagcgtgtggcagcttggcgccgttgaggaaggcctatgtggtgtggttccaccaaaggactggcaggttggctggcgtcagcggttgatctgccgatgttgttgctcgtcagtctggactgttgggctttcgttttgacagcggaaggaagatcctcctcgcggtagggcaacaattattagtatcgtaattaaggtaatcgtgattacattaaccatgatactcttattattgggcggtagacggatcggagggctgcaatgtttgtcgcacgagagcacgagttacaagtgctggaaaagctgtttaccagtgattcattcgaaatggtggtgctgtacggtaggcggcgtgtagggaaaacggcgttgatcgacgaatttgtcaaagataaacgcgtgctgtacttcacggccatacagcaaagcgccaagatgaatcttgaagatttctcaagagcggcattgtcgttctttggtatgccggattccaccccgtcgtttggcaggtggtctgatgcgttatcgtttgttgctgaacgtgctgcacagactgacgaacgtatggtgttcgtattcgatgagttcccttatgcggctgccgccgagccagcattaccctccatgttgcagatagcagttgaccatggattcctcgccacaaaagtgacgatgattctatccggtagtaacgagggattcatggaaaacgacgtattggggcgtaaaagcccgctatacgggcgtcgtacagcacagattcgactcctgccattcgattatgcggatgcggcaaaatttctaacgaacacatctccgcaagaactggtccaatactatgcgactttcggcggtacgccatattatctggctcgtatacaggaagccgatggctttgaatccaatgtgctgcgcttgatgttcgacaacttgggcgtactgcgtgaggaacctatgatgctgttgcgtcaggagcttcgtgaaccggcatcgtattattcgatattgcaatctattgcgggtggtaattcctcgccaaagcttatcgctgaacatgcgggtgtcgaatctgattcgattggagcatatctgaaaacgctggtcgatttgcgcttaattgagcgaaaagtgccgtttggtgaagatccgagtaaatcgcgcaagggaatgtatgtggtgagcgatcccttctttgcatattggttccgctttgtggggcgcaacatgagcattttggatggtaatatcagcgaggaggttacgagcagactcgcttttggaccatcgtttgatacctatgttgggcaacaatttgagacgatttgcctgcaatggcttattcgaaacaacgctatgggcaacctcccctttgttgccactcaattcggcaaatggtggggcaatgatccgattgctcacgagcaaaccgatatcgatgtgattgctgcggattcgctcgataaaacgattctgttcggtgaatgcaaatggcgtaattcattcaacgaaacggaggctattgaaaggctccatcagcgtgctggcttagtccgcggctatcaggcaggtaatgcgtggcttatgctgttcaccaagaatccggtgagtgagtccacgcgaacccgctacatggatgatgaacgaatggtattcgtttctgcggaagagttatacactgcgtgatgcattactgggtgattgtgacgcgggatatccagagtcctgccgacagccacgtggcaattacgccaactcacgcaccaccaaatcggtgttcaggtgcatcacgcgcggtgaagagactccgttgatggctttgatgaccacgtcggccatggtccagccgcactgatccatgtgctgatcgacggtggtgagttccggggttatggaggtggaagctgagctgttatctgcagaaggccgaatgtacccctctgaaagcagatagcttggattgatgatcatatccaagaattcactcgtatagtggtgcgtaatgcttacgtatttggggatagcacttgttgcgttcgttgtacatatagcaatgcccttgcctcctcacggggaagcaagggcattacgctactgcttagtactgcttagcggcaagcgtcacagcacgccctgggcgaccatggcgttggctaccttgacgaaaccggcgatgttggcgccggccatcagatcgccttcctcgccgtactccttggcggcggccagggagttggcgacgatggattccatgatggacttgagcttggcgtcgacctcctcgaaggtccagctcagacggtagctgttctggctcatctccagaccggagacggccacgccaccggcgttggcagccttggccgggccgtacagcagcttattggacttgtagacctcgatggcttcgggggtggaaggcatgttggcgccctcgcacaccaccttgcagccgttggctacaagagccttggcggattcctcgtcgatttcgttctgagtggcgcacggcagcgcgatgtcgcacggcacggtccacacgccggagcaaccctcgtggtattcggcggatgtaacgcgctcggcgtactccttgatacggccgcgctcgacctccttgatctgcttgaccacggcgacgtcgatgccgttcggatcgtagacatagccgttggaatcggacacggtcacgaccttggcgcccagctcctcggccttctgcgcggcgtagatggccacgttgccggcaccggagatcacgacggtcttgcccttgaaggagtcgttgcgcagcacgcgcagggcttcctgggtgtagtagcacacgccgtaaccggtggcctcggtgcgggccagagagccaccgaattcgaggcccttgccggtcagcacgccggagtattcgtcacggatgcgcttgtactggccgaacaggtagccgatctcacggccaccgacgttgatgtcgccggcgggaacgtcggtgaactggccgatgtgacggcacagctcggtcatgaaggcctggcagaagcgcatgacttccgcgtcggacttgcccttcgggttgaagtcggagccgcccttgccgccgcccatcggcagcgtggtcagggagttcttcaggatctgctcgaaaccgaggaacttgatgacgctctcgttgacggtcgggtggaagcgcaggccgcccttgtacgggccgatggcggaattgaactgcacgcggtaaccacggttgacctgcaccttgccttcgtcgtcggtccaggcgacgcggaacttcaccacgcgctcaggttcgacgatgcgctcgagcacaccgttcttctcgtattccgggtgctttgcgacgaccggctgaagggtgtcgagcacttcgtagacggcttgcagaaattcgggctgatcgccatcgcgggccacgacctggttgtagacgcgcttgacgtactcgtcagtgagcattgttctcctcgattcgatagatagataagacgttcttattctatgcacccgaccctgtgttgcatagagggcgctcggataacgggaaagcgttcagcgcagcgcgcaagatgcgtcatggcacaggtcgagtgcgatgcgcaatcgcatggttgtggaccggacgccggcacgattgacggaaccttggtgttgctgggttttggcatgaaaaagggctttcggactccgccgaaaaccctgaccgtggagccagggattcccggtgtttgtcgctatttcgccgttttctcggtgtatcacgacattgggtgccttgctacacaccctgccttggtcgggcccctgtcccggctttcctttgtccgtatcccgttattttccgaaaaggccactatgggtgcccgttcgggtcagagtgagcaccagcacgtccttctctatgagatagaccaacagcaggtctggtgtgatatagcactccctgaagccggtcatattgcctgtaagcgcatggtcatgataccggtcgggcagtgtgccgccctcggacagaatggatacaacctgtttgaaaaggccggcgtccagtccgcgtcgtctggcgagtttgaagtccttcctgaatctggacgtggtcttgaccgtgtaccggatgccgctcatgcatccaagtccttgaacaaggcgttcaggtcccggtagcccttcacgttcccgtcccttgcgattcgcttcgcctccaacatggcggagacggtctccctgttcggctcatccaacgagacgttgaacggtatgccgccctgtcgcagggattggcggatgaatatgttgactgcggtggtcaggttcatgcccagctccccgaacagttcctcggcttgttttttcagctcagcgttcattcggacgttgacggtggttgtcgttccgctcatctttggctccttccttggaagacgttcatatcatatatcccttgtctatagaaaacaacacatcatgtatatagcgttttacatcgtatgtaaaacgctggtttctattaggctctgttgcaccagaattggtatgacggagtcgaaagatttctttcctgtgcgtatggttccagtgtcgttcatcgggtacccattttgagtatctcggtggatacccaaaacgccgacatttacggacttccgtatgttcgccgttctcaccgtatactttgaaatcattggtacttcgccgttttgatatgaaaaagggcttccggactccgccgaaaaccctgaccgtggagctagccgggttcccacgccgcagcctcatggtcccgcccctagaggccgggtcccacgagcaacccgcccgtgtcatgcccggacgctgcgacgaaccggtccggacccgatgccattacaagctattggacgtgcccattatggaatgcttcgacgaggaccggaaagcgttgatgcccctgccatccacacgtttcgacccgatccgttgggaaagcgggaaagccgacaggtacgggcgtatcgagatcgactcgaaccggtacctcgccggcggcaagtggcacggcgggaaacttttggccgcggccgggtgggacagcgtgcggatcaccgatccctcgtccggcgagatgatcgccgaatatcctaggcgatacggcggagcatccagcacgctgcaggacccggccctggtctcgctcgccctgcgccacagggacgggaactggaggtatacgcccaagggcccgacctgaccggctacgaccggttcatcaccggcacggacgccacacgggacgatgagtgggaggaggcgcggtgagtaggagacccggtcccaggatcccggagattaagcgacgccgggccgacaccatcgccaaaagcgaacgcgtcatgaccatgagccggcacctgacattgacccgtggcgtcctggctgaccacctcgatggcgtggggcagtatccgtgcggcggctttcttgtatccggcgaacgcgtccatcgccacgaccctcacacgctcgcggaacgcctggccgcgttcctggagccatgtggtgaacgccttctcgctcctgccttcgaccatgtccagcaggcgggccgtcccgcctttcttcctgggcgtcaggtccacgatgatggtcacttacctactgccgaacggggtgtgtcgccacacgtgctcgtccacgccgatctcctcgacaccgtcgcactgggcgcaacaccgtgcggcgggcccctccggctcgcagcgtatctgccacacgcccccgcgagtgcccatggccaggtgccgttgcaccaggggacgcaaccccaatccgtccaggccgagcaacacccatccgtcgaacgtgctaaactcaatgccaagccgcacggtatccttcactttttctttcacacaacgaatgaaaccgcacggcccttacacaccaaaatcggaagagccgggtaaatcaacgattcaaggaagaatcaaatgaaaaaagtaaggaaatacctcgcacgaatcatcgcctgtatcttgtcgatggcgacattgttggtggtggctcccgttgcgaatgcaagtgtcccggatgctcagtccgatggctacgttccttgtgcagtaccgtcagtggatacggaactcgagaacctgctctggaaaatcgttgatgtcggtgaatatttcagctttgaaggtgatcgtctcaccgtctcgctgtcagaggagcaactgaagaccgattacggtttctccgatgcagaatatgtgttcctggtcgataacgtcctcaatccacccacggaggacatccaagacatagagtcgcttccaacgacctatgccagttgcagcggcgtatacatctcctacatagatttcaccgtaggattcgcggcagcgcttttcgcggcttcctcggttagcccggcggctcttgccgcagcattcaccgcagttgcctcggcaatcagtgggcccgtcggtaccatgatcgctggaggcgtcgctgtcttgggcatcggattctttgctgatctcgccacaaaaatcatcggcgcagttgctcaaggaaagggagtatgcctcacactggcttgggaattcccaccgttgaaatctgaaatcatatgatgcagttgtaaggcattattgtgatgaaaaagtgggattggaagtcatggctctgtgcatggctgttcgcttcttgctcaattagtggagcaacggagatcaagcgcggggccatgaccccattcgcagtcgtgtatctgattactgccgttgtggcattgatattgtttgtgtggtcgtgccttaaaacacagaacataaagctttcggttattcttacgacggcgcttatagtgccagtagccgttatgttgatattcaacgggtctctcagcagatttctcgtctacatctatttcgtagcaatacttttggccgcgttagtgcacaagtatggcagaccacagaaaaagcagtagcggccatgcacgtgcaaacaagaaaggcccgtccgggtgttgaaactcggacgggctggccgttatcgacggctgggtgtcatcgcccagatggcgattgccatcacgacgatgtcggcggcgatggagtgcatcgcgggtgcgaggctgatgacgatgaccgccatcagccacacgtgcaggctgaccacttctccgattcgtaggtcaaggatggcccccagccatatggagattcgtgtggtgttgggcatggcggcatagatggtctgaagttcctcggctgtggccgggggtatttgagcttgccgggattttgggattgcgggggctttcatggtaacgggtgatttgtctacggctccttcggccactgccttcgcgtacacggctttcaagaggtggaacgttttcttgcggggcgtcgctcccccgaaattgcctaaattggctagccaccggtttatgtcttcagtcgtgatgccggcgaggtggtatctccagaagaatgcgtgggacagatgcgcaaggtattaccgatgctttcttttgcttcctgcggttagttcggctccgtcggaagaatagttgagccatgtgggtgcgaattcttccatgacgtagtcgcagaacagtactctgcggcgttttacggcgtcttcctgccttttacgtttccactgtttaataccggctctgtcggcttctatacggcttctttcggtgtttagccatgcctatgccgataactggtctttgaacgtttttgtgatgacctctccccgataactgtattttgctcgataggaatttcggtctgcccgatatacgacacttccaaattttgtgtgcatgagcccactatgacgtgatgggtgcccaattcgggtacctcggcgggtacccatttcgttgacattggccgcctttccgtacattctcgtttgtgccgtatgccttgaaaacgttggtattccgccgtcttggcgtgaaaaaagggcttccagatttctctgaaaaccctgatcgtggagctagccgggttcgaaccggcgaccctctgcttgcaaagcagatgcgctaccagctgcgctatagccccgtgagaaaaaaagagcggctcgcggccgcttcatttttcctgtgggcccgggaggacttgaacctccgacctcatccttatcagggatgcgctctaaccagctgagctacgggcccgatccatacgcttcaaaagcgcacaagtgattacaataccattgaacggcggtatgtcaataacggcgtgtcgtgattgtcgcttgcgccatgattgccggcgcggcggtcaatgtccagcaacacagcggtcaatgttcagcaacgccacagccaatgcccagctacgtaaccttgcgttctcacaccgtaatgctgcggttacacctcccgccctgcacagaaatgtccaatacacagccaaaaacccaactagtgtaaacgcactctagaaaagggatacggggttgcggaccctatatttctatgatcagggcgagccaccaaagaatcaccgcatgtgaccggcactgcgaatccaggattacatgcggcgcgtaggctcatggcccatagcgctgttcgacatgatcgtcgcgtgcatacgtcatatgaaactgaggtttagggagaagaagccggagtacgacttatctccccaaacccttattgcttcagccagtgtaggtattcgtcgaagaggttgtccactgttcgtctttccagtcggtatgtggggaatgcctcgggtgtgttggtgatgacttggtatccgcccaacggtgcttccgttgcggggatcatgtcggcttgtatcaggccttggtcgatgcaggtccggagttcttcccaggtcaggcggaacacggatgcggtgtagggtttggggaagctgtggtggaattcgcggatggtcgtggttccgtcgctggttttccgccagatgaatcgttggagtctgatgccggttttcagcgtgatgtattcaccgaaccgtccggtgtcgatgggctggtccagccaggtcctgtattcgtccagcttgaggttcatcgtcgtcggatccaatggttccagcttgtcagtggtcgggtgcagcatcgcggtctcgtgccggctgattcgcctttccttgaactggtaggagatgaatccgacggagtttccctggtatccgggttgcacgtaggggatgccgtggcattcgccgtggttggtgcggtgttggtgtccgcagatcagcccgtcgatgccggggatggtggagaggatgcggtatgcctggtcctcgccggtgtcgtattgcgtgggtcgtccgctggccatgtcgcattcgatgccgccgtggtaggcgacgatgagcaggtccacgtccgcgcgtatccggttgacggtggtcctgatgctttcgaccgcgtccaggacgtggatgtgctgtgtgttgcggaacgcggtgagttggggcagggctccggtaaccgcgcccacgatgcccacacggatgccccgggcttggacgagtcggtatggatggaagatcgggtggccttcctcgtccgtcacgttgcagcacaggagccgttcgtgcaggtgggggttctggcttgcgggcagtgcggtgccgtggtcgaagtcgtggttgcccagggccatggcggtgtagccgcaggcggaggcgacgcgggtgagcggggattccctctcggccgatcgggcggtgaaggtggcgtaggcgcttcctagcaggtagtcgccggcgtcgatgagcagcgtggcgtcgtccacgcccgtcatccgcttggcggcgtgtgcggcgagtatgccggccgcgtgggcgttcgcggcggacgggtcgccgggcacgtccgcgagggtgtcgggcaggaagccgtgcaggtcgctggtggcgaggatcgtgatcgtggtcatgtggcaggccttttagaggagtttcttgcgtagccatccggtcgccgcgtcgatgagcgcgaccacgatgatgatgcccagcaggatgatgctgaccctgctccattggcggctttggatggcgaagatcaggggtgcgccgatgccgccggcgccgaccaggccgagggtggcggcgctgcgcaccgcaatctcgaagtggttgagggacagtgacgcgaagatgggcatgagcagggggatgcgtccgaagaacgtggtcttccagaagttggcgccgaccgattccatggcttcggcgggcccgttgtccatggattcgatgttctcggcgtacagtttgcccagcatgccgaccatgtggacgcccagggcgaggacgccggccgcggggccggggcccaccaccttgacgaagatgatggcgtacacgagttcggggaacgccctgagcaggtcggtcacgaacttcgccgcgccggcgacggcgggggtgtgccgccacagggtggtcgcgctgatgaaggaccaggggaacgcgatgaccgtggcgatgaccatgctcaggaaggcgatgcagatggtctggagcatgaggctgactaggtcctcgccgctgccgtcgtagacgtacgaccagtcggggtggaacagttggctgatggtgtccgacagggaggtccaggacatgggggccttgtcggaccagttggtggtcgcgaagcagacgatgaccgcgatgcctatgagggtggccatgaggtggtgtgcggtgagacggatacgcatcagcggagcctctttctgatgatctcgctgacccagtcgacgatgacgacgagcacgagaacggtgagtatgacgagcgacacgcggtcgtagcgcatcaggctgagtgaggagttcagcaggacgcccacgccgccggctcccacgtatccgaggatcacggaggcgcggatgttgatctcgaaggcgtacatggcgtagctggcgatgtcctgcccgatctgcgggaggatcgaccatgtggcgatctgcatgcggttggcgcccacggagcgggcagcctcgacggggccggggtcggagatctcgatcgactggtagatcagctggccgacgatgccgaaggtgaacacggcgatggtgatgatgccgctgacctgtccgatgcccatgaacacgacgaccagggcggcgagcagcagcgtggggatcgtgcggatgatgtccatgaccacgcgggcgaccatggcgaccacgcggttgcccgtcacgttgctggtgcacaggaacgcgaacggcacgccgaacaggagtcccagcgacgtgcccaccacggacatgcggatcgtctggacgaggggcatccacaccttggcaaaatacgcccagtcgggcgacaggaggttcgagaagaaatccgcggcctgccccatgttggcgatcgcctcgccgaagtcggtctcggtcgcgtccttcgcggcgaggaagcagacgacgaacactataacggtggcgagccgtttccacaggttccggtgcaccgtgtccttcagggggcggccggccgacggtgtgcgggtcatgatcgctcccccgtcttcccggcgtcgtcgccctcgtagatgtggcggaacatgtcgtcggtgagttgggcgggggtgccgtcgaacaccaccgttccccggcgcatgccgatgatccggtcggcgtatttcttggcgaagccgacggagtggatgctgatgagcaccgtggtcccgtcgtcctggttcatgcgtttgaggtcggtgaggatcgtctcggaggtgaccgggtccagggaggcgaccggctcgtcggcgagcacgatcctggcctgttggacgcgggtgcgggcgatggcgacgcgctgctgctggccgccgctgagctggtcgcttctcgtctgggccttgtccgcgaggcccacggtcttcaacgcgtcgtcgatcagctggtagtcggactccgggaagaggccgagcagtgacttgagggtcccgtaccggcccagccggccggacagcacgttcttctggacggtgctgttgcccacgaggttgaattgctggaagatcatgccgatcgagcagcgcatcgccctcagttgtctgcggctggccttggtaatcgactggccgtcgatcatgatgtcgccgccggtgatgtcgttgagtcggttgatggagcgcagcagcgtgctcttgcccgcgccgctggggccgatgatggcgacgaactcgccgtcctggatggtcaggttgacgtcgttgaggcccagcacgtcgttgccgtattccttggtcacgccacgtatctcgatcatgggttttcctttccccgtaacgggcgaaggggcggccgccggcgtcgcgtggacgggcggccgcccccgtcaacggtcagttggccgcttccttgatgtattcctcgatggtgtcgtagttcttctcctcggcctgcgtgtagcccttgtggccccacatggccatggcggtcttgccctcctcgtcgttgggcatgtcgaggaacgcctgcttgatcttgtcctgcagggcctggtccatcgacggttggacggcgatggcgtcgttcgggatgtcgccctcggtcaggtagaggacgcgcagctccttgaacaggtccttgccggcgaacttggaggcgaacacgttgcgcgcgccctcgaacacgaagcaggcgtcctgctggccctcgagcacggaggtgatctcgctggggatgtcgttgaccgtggtgagcgtggactgcgtggtcgggtcgacgccggccttcttcaattcgaccaccgggtagatgtagccgctggcggaggaggggctcagcgtggcgatcttcctgcctttgaggtcggtcagcttcttcaggtcgctgtcggcgcgcacgagcacctcgcccttgaacgatccggacaacttgccctcgaccggcttgccggtggtgcggtcgtaggcacccagctcggaggtgaggatggccttggcggcctgcttgtcgcgcgcctgcacgtaggcggcgggcggcatgatgccgatgtcgaccttgtgcgaggacatggcctccacgatggtcgtgtagtcggtggcgagggtcacatcgaccttgcgtccgagcttcttcgacaggtagtccgcgaagggcttggccttggcctgcatgctgccgtcgttgttggtgggcacgaactggagttccagcgccttgtcggcggagtcggaacccttcgacgagccgcaggcggccatcgtggcgcacagcgcgaccgtggtggcggcgaccgcgatggtcctcagcatcttgttctggatggaaaaaggcatggttcgaccttcctcaatgggttttcgttgtgaaaaaaggatttccgcgtgatgatggatgatgcgcgggcccacggcgggacccgcggcggatgatgaaaggaagactggcgtccggccgatgccggcgccggatgatgggtgaggtgtggtgttgcggctcctatctgtccaggtgttcggaaatctgtgagatgacccccgggtcctcctcgcccctgcccagctgcccggtcagggattcgatgacgatgtccaggggaagacgcgacgtgtcgatgagctcgtcgttaaacgtggtggccggcgtggacgcgaccagggtcgtcgtggcccgcgtggccagggaggagttcgcgaagctggtgaccgccaacgcgtcggccccgttcgccgtggcgacctcgaccgcgtggacggtgtgcctgttctccccggaaccggagattgcgatgatcaggtcgcccggtttgagcagggaggcgctgatgtcctggcccagcgggtcccggacgaaggttacgagacggccgtaccgcaggagacggctttcaaggttcgccgcgaccccgctggacaggcccgatgccacgatgacgatgccccgcgcgtcgcggatcatctccaacgcccggttgaacgccccggcgtcgaggcagtcgggcagctcccgcagcatgtcgagcatgccccggatcctggcgatgatccgctcgccctccgagccggcctccccgtcggcccgcgcgtgcccgcgctgctccagcaggcttctgatcgcgttgtcgcgtgcgatgaggatcctcatctcccggtacccgtggcaccccagatcggcgcaggtcctcaccaccgtgcccgccgacacgcccgtctcgcgcgcgaccgtcgcgatgggcaggtccccgatgacgtcggagttctccaggaagaagcgcgcgaccttgcgctgcgccggatccaacgcgtccaacgcaagccggatgcgggcgaggatcgattcggccggcccgttcgcgttcacctgtcccatgacgcgcatccctccaatatcgccccgtacatgtcgggaaggagcgccgtccggtacgtcgcgccgccatgccggcccgtgccgccgatgtacgcggcctcgcggcccgcggcgagcaccggggcgatgtcgttgtcccaatggtcgccgatgctcaacaggcgcccacgtcccgcgagacggtcgaacgcggcgatatgatcgccccagcgtccgggtttgcccgccccgtcgacgatcaggtcgaaacgaccctccagcccgaaccgtccgacggtctcgcgcaccccatgcagcggcgaattggtcaacagcacgcgaacgcagcccaacgaacccagatcgtccaggaaaccgggaagaccctgcggcatgtccacatggacaagaccacgggccagctcgtcccggctggaaagatacgcctgctgcaacccatccgccggcacatggcccgcgcacatgtcgctcaccacatcgtaaccgtcgttccaatgccggccatcatccgtgacggcgccgccaagatagagatccagcgtcctgacggcccgttcgcgcaaccccgcgggcaaccgggcgaaggcatggcgcgcgtaggaacgcacaggcccgtcgcccaggctgatcgtcccatcgaaatcgaagacgaccgtgccgaccggctggcgtccgtcggtccgtgaccgctgctcttcattgctcatgcctccattaaaacacgaaatgaaaaacgttcaatgacttttgaacataattccgacatggttggcctactgttcatcttcctctgcttgacgtggcgcggatcgaatggcgggatgattctcggtgccttgcgattccgaagtgcggccgggcaccccgatgtgacttggtatcttgccatgtgccacttgagtgtttgaggtttgcggcggaccgggcggatacgtgatgatgccaagccccgataagggggtctgcgttccggggcatctgccggccgtccggcgtcacatcgtcaggctgtccgggtcgaggaggaaatcgtagacgctcatcgtgaggatgccgtgctcgtcgcggacgggtttgaccacgtcgcatacgaggacgatcttctggaagctgtcgtcgatctcgagcagcgaggccttctcctgcgcgaccttctccggtgtgggcagttggtacgcggattggatgtagcagcgccggttgccgaggttcgccacgaaatcgacctcgaggcgtttgcggtacggcacaccttcgcgggcgccgcgccggtcgaccacgcccacatcgacgttgtagccgcgtgttcgcagctcgttgtacacgatgttctccatgatgtgcgtctgctcgatctggcggaaccccagtcgcgcgttgcgcagccccatgtcctcgaaatagtatttcttcgggctgccgatgtacttgcgtcccttgacgtcgaaccgtctcgcctcctcgatgacgaacgcgtcctcgagatggccgatgtattgcatgatggtgttcgtgctgatgccggaatgcagcacgctggcgaacgtggccttgatcttggacggattggtcagggcgccgatggaggaggccagcacgtcgaccaggtcgtcgagctcctgcgacctgcgcagcctgttgcgcgagacgatgtccttgagataggtctcctcgaacaggttcttcagatagagggacttctgctcgtcgcttctcatggacaaggtgagcggcatgccgccgaacatcacgtattcggcccagccgtgttggacgtcgccgtcgtacgcctgcatgaactcgacgaacgacagggggcggacgcggacctcgtcgccgcggccgcggaactcggtcatcacgtcggtggacagcatcttcgagttgctgcccgtcacgtacacgtccacgttgcgcatgcgcagcagcccgttgagcaccccgtacagacggggcggttcctcgccgcgcatctcctcgtccgagatcgcgtactgcacctcgtccagcagcacgtagtacggttcctcgcgattcgtgatacgggatctcacatagtcgtacagggcgagcgggtcgcggtagcgctcgtacatcagatcgtccagtgcgatctcgatgatgtggtcgtcgtccacgccctgcgcgcgcagatggtcctcgaacaggtcgaacaggagataggtcttgccgcagcgcctcgcgcccgtgacgaccttgaccatgccgttgcctttgcgcgcgacgagatcgttcaggtacttatccctggagatgcgcatcgtattctccgatcaatgtcctgttcccatgccgctatcgcgtggatttgacatttatgtcagtttcactcaataggaactcattctattgcgcgattttgacatagatgtcactttcgctcaataggatgggtgaatcatgggaggacagggcgtgcgcgtggtgggtaagtggcggttgccgattcgtgaggggcggcattgtgtgccgcttgttgtccgccgttgtgcgagaatgacttgcatgccttatcgccgtcgtcaatccaccgctccgaagtccggtgcgccgaaatccgttcggtccgctgccaccgagcagtcgttggatattgatggcatccatctgcacctgacgcgcaaacccatcaaaaacctgtatctgcgcatcaaaccgccgagcggccgcgtcgaaatctccgcaccgatgcggatgagcgagagtcgtatcgcggatttcgtcaaagagcgacattcgtggattcttgcccagcagcagtgcatggctgaggcgcaacggcgctccatcatggcattgaacgagggtgccggcttcgagaacggaggtcgtggcgtagctggtgccagcggccatgatggaggcgttgccggtcgtccgaaaaccggtgatatcagtcgtccgggaattggtgacgccgggccaggccaagccggtacgaatgtccaaccgtattttgaccgctcccaaatctggaccgacgaacgcaaacgacaagcggcggccgcgatcaacgccgcgttgccacagctgctggccaagtgggggccggttattggccgacagcccacgcatatcacgctacgggtcatgacctcgcgctggggatcgtgtacgccgcgaaccggccgcatccgtctgaaccttcaattgggagtgatggaaccgcaattcctggaatacgtcttggtccatgagatgacgcatctgtgggaaagcggccacggcgccggattccaacgccgcatgaccgcctacctacccggctggaagacgctacgccgcgacctcaaccgccgcgtggtgctgtgacgatgacaggtcaggcttcagtgccggcgatgtggctgatggcctgatcggattcgttcgcatggtccgaatgcgccaccatctcgatggccgccggacacccgctcaccgacgaactcgaacggcgcatcagcgaacttcagctggagctgaagcagtgtgaaggccagcaagggcgaaccgatcggtccagccgagctactcagaccaaccagcccagccagtccgttcagaccgacctaactatcagagcgggccctctgaccagtccgaaccatctgaccggcctgtacttgttgactaagtgtgcggcccgtcattcgttatggaacatgccggccatgtatacaggcaggtaggttacattcccttcgactgagacgttgcacgggccaagcacatagcctgtattgagatggtattcagggtgggcgagcacgttgtccattgcgcgatggcgtttgtaggatttgccggacttcacctcaatcggcagcacgtgatcgttgcggtcttggatgaggaaatcgagctcgccaagcttcttactgttgtagtagtacaggtcaaatccgtgagcgcgtagctcttgggccaccgcattttcatagattgaaccgtagttgatatcagggttgccgtcgagtacgtcgagcgcggttttcttgagaaacgagccggtaagcagacccacgtcgttgtaaaagagtttgaagaggttacgttccttgctcatctccaacggtgtgcacggttcgtccacgttgtacgcggcgacggctacatccgcattgaccagccaatcgaaatcggaagcaaccgattggaatctcatgttcttttcgattttggcgaaggtaaagcgcttgtttgggttatttaactcgctgggcaccaaatcgtagatagcgcggatatgcagccggtcttctttgcgcgcgtattggctgatatcgcggcgatattcacgctttatgttctcttgtatagtgcgcacgtccgcaacgctgccgtttgccacgaacgagtcgactgcggcaggcatgccgccgatgaccagatatttggagtatagctccatgagcctttgatgaatgaactcatccacttcctggtgcttggcaaagcattcggcaagcatatcgaatacgtcgttgccgatatgctgcgaccagcagaactcttggaaatccagtggatacatatccagctcggtcaggtacccgaccggtaccgagcgtatatcttcgagctcgactccaagtagcgagccggaaagcgcgtaatcgaaccgaccatcgtctacaaggaacttaattgcggtgaccatttccttgcaacgctggacctcgtcaaagaaaatcagggttttgccgggtactaatggcgtatttacggccagttccagcctcatcagtaggtttttggcatcgcggggccgatcgaataatgcaacgaggtcagggttctcgatgaaattgagctcggcgatatggtcgtaatgctgttgggcaaagtgcctgatgatataggttttgccaatctgacgggctccggtgaccagcagtgcagtgcgtttcggcgcggatctccaagcttccagctgtgtctcgatttttcttcgcagcatgagaatctccagtcatttgtaggccttgcatctatgctgggcacgttttccaactgtttatagagcatattttacacttttccaaccataagaatgtggttttggctacgttttccaacctcagaatggggagttttatacacttttccaacttatgtatgtggagattctctatttcacgtgagacgaaagtggctcccctctttgaggggagccacggaatacagcttttacttatgccaggtgagagcgcatgaaccactggaacttttcgagttcctgcacgtggtcctggatgatgttggagctgatcacatccagctcgtccagctcggcgatggccttgcggtcgtcggcgatgaaggcgtcatagtactcgatcagcgccttgagatactcctcggtgcccacgcggccctcggcgtcgaacgacttccacgtgcggttgcgcacgatggcgtccgcgcggccgtccggggtgccgcccagagtggcgatgcgctcggcggtctcgtcggcctgagccagcacggcctcgacctcggggtcaagcatctcgtgaacggcgatgaagttcgggccggtcacgttccagtgtgcgtgcttcaggaccagagcggcctcctgctcctggctcagtcggttctgcaggatggcgatggccttctcactggccgcttcatcaaggcccggcataacaaatgcaagtgtcataatgttccttctttctgtaggtggaacctgtccatataattctacgatttttggttatgccccgggctgaacgaataggtggtgaatatcatgtggttagttggcgtcgtcggtttggggttcctccggcagtggcgcatggtctggggcgccggctttgcggacttcgatggtttcgatgcggcggccatccaccttggtgacgaccatgttgtagccgtcgtcggaatgcagcacgtcacccaccgcacccatcttgccggtcttggacaggaagtatccggcgaccgtctcatacgggccgtcctccagctcgatgccggtcagatcggcgaagtcctcaatggtcatgctggcttcgatcgtggccacgccattgacgaacgcggtgcgggtggtgcgttcgccgcccttctcgctgggcagatcgtactcatcgcgaatatcgcccacaagctcctcagtcatatcctcaagcgtcacgatgccgtccgtgccgccgtactcgtcgatgaccacggccagatggatgccgcgcttacgcagcagttccaggctcggcagcagcttggaggtgccgggcagggagatgccttcgcgcaccacatcgcgcacgatcttggcgttcggatcgcgcacgtccagcagatcgcgcacatgcacgaagccgatcacgtcgtcgaaatccttgccggtcaccgggtaacgggagtacggctggtcgcgtacgaacgcggcggcctcggccaggggctggtcgccctcgatgaagaccacgtcggcgcgcgggcgcatcacctcggcgacgatggtttcggacgcatcgaacacatcgtccagaatcgtgcgttcgtccttggagaggttggtgttggagctgaccagcacgcgcagctcgtcgtcggacacctcggactcggtctgctgcgggtcgaagccgagcaggcggacgatgccgttcgtgttcttgccgatgagccagatgatcgggcggcagacggcggcgaaggcgtcgatggcgggcaccacggcgcgcgcgatctgctcggtgcgctgcatggcgatgcgcttgggcaccatctcggagataacgatggagcagtaggagatgatgagggtcaggatgatgttcaccaggccgccggcgatgccggggtgcacaccccagctttcgaccaccggaatcaggtagggggcgatggaagaggcgccgaacgaggcggacaggaagccggagagcgtcacgccgatctgcacggtggagaggaaggtgttcgggtcacgtgcgattttggcgactttggcgccgcgagcgtcctcctgctccatttgctcgatctgcgagccgcgcagagagaccaatgccaactcggtgccggagaacacggaaccgataacgagaaatacaaaaatcaggaggatgttcaaaccaagtgacatgcctttaactctaggggagtggcacgtcaaattggggtgtgctggctgggcagggtttgctagctgcgctggctatgtgaggcgtgatgtgtgttgacgtgtgtgatggtgtgaaagagtacgcaatgatacgcaatcgtgtcatatggtgtaatttcgtgtaatttggtacgcaatcgtgtaatatggtacgcaatcgtggcagatggtatgtgttgtgggcaggagtgtggtcatggcagtcaatcccttcaaaccaaccgccggtaaaatgccgccgattcttattggccggcactccattatcgaagatttttccgaggcgctgaccaacggggtaggggctcctgggcgcatcatgctggtcaccgggcagcgcggcttcggaaagacggttatgctcaccgaatttcggcgcatcgccaaagcgcagcattgggaagtcattggagagacggcgtccgcaggactggtcacgagactcatagcggcattatcgccttcgggattgcgtctggatcaggccaatatcagtccttccattggaatttccggcattgccacggcgagtctcgggcaagcgcacttttccgcggaatccaatccgctgacgttgcgcaacgcgttgaacaagcggctgggcagtaagaaactcggcaaagggaagggcattctcatcaccatcgatgagacgcaagcggcctcacacgatgatttggttgccattgctacagccgtgcagcacgtcattacggatgccgatgaaagtgatacgcctgatgaggataagaagggcgttgccatcgtatttgccggcttgccgtatatggtcaacgatttgctggataacgaggtaaccacattcctgcgccgtgcgctacgccgcgaattggataacgtgccgcttccagacgtcaagaatgcgttcctggaaacagttgcggattccggcaagaccatcagtggggaagatgcgcttgaagccgctcgccagtctgaaggatacccgtacatggtgcagcttgttggctactacatgtggcaatctgcgcagcgtcgaggttcagatgtcattaccgcggacgacgtgtcgaccggtgtttccgatgcgttgctcgccttcgacgatgccgtatgcgctccagcgcttgatggcaccaccagtgcagagaggctgttcctcgcggccatggccaaggattcgccaaatcccacgcaggtgggtgatattgcggatcgtgcgcgcagaagtcgaagctgggtgagcaagtaccgggcggttcttatcaaggataaactcattcgcccggcaggtcatgggcagctggaatttgcggtgccgcatttggggcagtatttgcagtcgttgtagcaccaaatatcgggttgggttcattcattaggtcaattatgcgttcatttggtgggttgccggcatggtgaggtgttggaatggcagcatttcaatagtcggtatcggggtccagcgaccaaatgaacgcataattgacctaatgaatgaagtaagccggttgcaggcgagttgcaatccggttctacgaatgccgacgcatcttggccacggcattgctgacgcaaatacgcagcacaatggtgaagacgaccaccataatccccagaatgccaatgttgaaacagaactgatccgtggtgtgctcccatagatcatccttttttgaacatcggcaccttggtggggccatacagcagatcgttgagcccgatatccgaggcggcggcggagaagccccaacgcccggggaagatcatgctgaccaattcgagactgtcgcggccagtgaccgtaatcatgccgccggagaacaccaactgggccataaccagcaccaccagcaatggcatcgtctgttctcctgacttcaccaacgccgagccgacctcgcccaacaatgcggaagtccacgcagtcagccagatcgccaacaccagttcgggtatgccggaatcagtgaccacaccatggtccgggccgggcttgccgaggctgaccgcagtggtcagaatcgccgcctgcaacaaggtttgcaaacccatcacgatgagtttcgaggcggtgtatgacgtgggcgccaagcccaccgcgcgctcgcggtcgtaaatcgctcgctcggagacgatgtctcgcacggacaaagccgatcccatagaacaggcgcccagtatgacgagcacaagcagttgacgaatcaccagagtgatggtctgtttgatgcggaatggctttgccggttactcatgctcggtgtgccgcatgatggtggattcggcctgcatccgccagctggcgcaacatggtcatcaccataagatccagcgccgggtcgaggcccgaggtcggttcgtcgagaatcagcagttcggggctgaaggacccgtgcacgcggttggttgtgagctgggactcgagccttaccgcttgcgtgctgcctgccagaacagtgccgacggcatccgatggggaaggggatgcggaggaagatgcgggtgacggggatacgggtgatactggcactggcgatactgtcgtcgttgccactgctgctgggcggggttgctgttgcagatgtgcgagggccgggttggcggtacatgtggcagatccataatggatagtaagggtaggcggcattggttcagatttccgtgtacttcaatctcttttaacacagatgtaccgcgaacacattgcacccggcaaacaagtcctgactgatggtcagaaactcagcacctcgaccttgccggtgctgagctggtaacgggcgccgacgatcatcaactggtcggcggccaatgcctgctggataatgggggattgttccaccagcgtctcaatggtgtgggccacatgcacacgctcgatatcttcatgcgcgtcgagctcggcttcgcgcgcctgccagacggacatgccggcttggcgcagaataatcgattcggcggcggcgatgtgctcgtcgaggtcgtccatcgcgtccgcggcctccagtgagccgtcggcttcggaagtgatggtgtgcatcaggtcatccagctcctgctcggcggcctcgattgcgccgcagtgctcgtgaccgagcacacagatcaggctgacgtgcagtttcttgaccgcgtactccagcgaggcgataaccgcgctatcgatgagttgcccggcggtgcgcacggtgaacaggtcgcccaggccctgatcaaaaatgatttccggaggcacgcgcgagtccgagcaggaaagcaccgcggcatccgggttctggccatcaagcaacgtttgacgggtctcctgatcctgccatggatggtcgggcttgccctcggcaaagcgccggttgccttgcagcatgcgactccacgttgcgtttgcggtcgattcctgttcaaagtctgactgagccatgaaacctccattatcagcgggctgctgattgccatattagcgagtattcgcgcatagtcgtgattggggcaacggccattcgggcacaagagttgcgggtggtgtgataaggctcatacgttacacccgcgcgagccgtggctcaccacattacgataggtggtggtaaacgcttgaagattaacaattcccgaaaggaccgatgatgactcttctgcagcatgaactgaccgatttcaaggtgaacgcattccagaacaacgagttccacgaagtgaccaaggacgatgtgctcggccactggtccctgttcttcttctacccggccgacttcaccttcgtgtgccccaccgagcttgaagacctggccaagaactacgccaagttcaaggaaatcggctgcgagatctactccgtctcctgcgacacccacttcgtgcacaaggcttggcacgacgccaacgagaagatcgccaagatcgagtacccgatgcttgccgacccgaccgccctgctggccaaggatctcgacacctacaacgaggccgatggcatggccgagcgcggcgacttcatcgtgagccccgagggcaaggtcgtggcctacgaggtcatctcctccaacgtgggccgcaacgccgaggagctgctgcgccgcgtgcaggcctcccagttcgtctacgagcacggcgaccaggtctgccccgccaactggacccctggcgaggaaaccatcgagcccagcctcgacctcgtcggccagctgtgatcgacactgaataggcggtaaccttggctcccctctctgaggggagctgtcgctgaaagcgactgggggagtgctcgcgagagctagcctgatccgatatgctcccctcagtctcactacgacagctcccctcagagaggggagccagtgtatgtaagggagttttcatgactcagaccaacaatctctatgacgtcgtcgtcattggtggcgggccggctggcctgacggccggcctgtacctggcccgcgctcgctaccgtgtgctgattcttgaaaaagatgatttcggcggccagatcaccatcaccaacgaagtcgtcaactatccgggcgtgggccgcaccacgggccgcgcgctcacccaaaccatgcgtcagcaggctcaggactttggtgccgaattcctctccgccgaagccaccggtctcgacgtggatggtgacatcaaaaccgtgcacacctcacgcggcgacctcaagacgttcggcatcctcatcgccaccggcgccagcccgcgcaagctgggcttcgagggcgaggccgaatacgccggccgtggcgtggcctactgtgccacctgcgacggtgagttcttcaccggcaaggaagtgctggtggtcggcggcggattcgccgcggccgaggaatccgtgttcctgaccaaatacgcctccaaagtcaccgtgctcgtgcgcgaaccggactttacatgcgacgccgcagtggccgccgaagccaagaacaacccgaagatcgacgtgcgttatcaggtcgagctgaagggcgtcaccgccggccaaggcggcctgcgagaagcctcgatcctgaaccttgccaccggccagaccgaaacgtggaagcccgccgacgccggcaccttcggcgtcttcgtgttcgccggctatgtgcccgccaccgatctggtgcgcggcgtagtggagctcgatgatcacggttacgtggtcacgcacgactacctcgaaacctcggtgccgggcgtatacgcggccggcgatctgcgcgtcaagaacctgcgccaggtggtcaccgccaccgccgacggcgcgattgccgccgtggaactggagcgttatgccaagcagatgagcgagaaaaccggcttggtgccgccgcgtcccactgcttccgcttatgaggagtccgaggccaaagccgcctccgccgcttcggccgctggcacgacgcccgccccggctcccgccaaacgcagcgccgatgccgcagccgcagccagcgccgccaagaagtccggcgaactgttctccgccgccatcaagcagcagcttggcgtggtcttcggccgcatgacccgcccggtcacccttgcccttgagctggacagcaccccgctttcggcggaattgcagggcttcatcggcgagatggtcgcgttgtcgaatggcaagctgaactcggtcgccgtcgatgccgcagggctgatcacggcggtggatggtgcttctgtgcctacttctttggtggttggcgagccattggccgtcactttgccggacggcaccgaactgcccacttatggttcgttggacgattccggccgcgccacattcgacgtcgccggcgtcctgccgctcgcccgcccaactgtgcgcatctgcgtgccggctgagggcgacggcaaagccggcaaggacggcaatggttcactggtcttcaccggtctggccttccacggcgtaccttccggccacgagttcaactcgttcgtgcttggcctgtacaatgcggccggtcccggccagccgctgggtgatgacctggtcgaacgcgcgaagtccatcacggacccgctgaacatcatgatcctcgtctcgctcacctgcacgatgtgcccggaaaccgtgcttgcttcccagcgcattgcctccctgagcccggccgtgcgcgccgaagcctacgacgtctcgcacttccccgaacttaaggaccagtacggcgcgatgagcgtgccctgcatcgtcatcacccacgccgacggcacccagcaagtcgaattcggcaaaaagagcatcccccaaatgctcgaactggtcggcgcgtaagccgcacgacctcaggtactcaacagcaacaacaacgattctgccaaaatcgtgacgtacatcgactgatgcgatcgatgcgcccgactccggcagaatcgttgttttgcggcatctcagcctcggtcttcgacggccttcgtgacgtttctgtcgccgaggtacttgaccaggctgatgctgatcagggccacaacgaacaggccggtgagcaccgggatgagtgcggcgtagcggtgggcctgatcaggcgcgtgggcaactacgaacgaggccaactggttgccggacagaccagcgaatgcccaggcgctcagcgtcagaccgtgcgtggtggagacggttttggtgccgaagtgctgatcaagcagcacgggcagcgtcgagaaaccgccaccatagcccgcgttgacgaggaacagcatggccagcacggcccacagcagagcgttgtcgatgctgttggtgaagatctgcagcaagcacacggcaatcgacatgatgaagattacctgatagacggtctcgcggcgcttcaggtggtcggagagtgtggagaagcccacgcggccagccgtgttgaacacggagtccacggcgagcaccagtccgatgatgccggagatggcggcggcaaacttggcggggctcaggttggcatactgcgggaaggccttgagcacatcgtgcaggatgtccttctcttggctgatgagggccaggccgcaggtgatgttgatatagaaggctatccagatgccccagaacacgggcttcttgaggattgtcttgcggctgacgtgtgaggtcgcgggatcgtacacccagccggccggacgcttgatgagcaggaagccgacgaacatcatcaccgcgtagaccgcggcgaggatgaaaaacatgctgaccaggccaaccgtgccgatgagatattccatcagtgggctggcaatggccttggccaggccgaagccggcgacggcgatgccggtggcgaggcccttgttgtcggcgaaccaaagcatcaggttcttgaccggagtcagataaccgacgcccaggccgatgcccatgatcgcgccataacagatgaacacgcccggcaggaagttcagggcgatgctcacgcccgtgccggcgaagccgaccacgaagcagaccatggagacgagtgcggatttcttgatgtttttctccaccattggcccggcaaacgcggcggacatgccgaggaagaagatggcgagtgagaagccccattccacggaggcggggctggcgtggagacggtcagcgataagctgcttgaacacgctccagcaatagacggtaccgattgggatatgaatcagcagtgcgggaataatcgcgctggtccaacgattctcggtaaaccttgccatatatggacggatcctttcgtaactggtgtacgatgacctgccgacccgaacgagagtcgcaccgcccatatccacgcacatcacgacggcatgcccccgtgaaccatccgggctgcacgaatcgaatcaaatcgaatcgtgcgaactgcgaacaattcgctaaacatccttggtgtgcatttcatcggcgctgctggctcttgtcgacgccgacaaacagaactataacgctgttatggggttgctgtggctggtttctgcggttggagaccgtgagctttctcacatcgaaaacagttatatgagggtattgatgtggtcgatacacgacgtctgctcgtggacgcggcatatcccttggaacacaacggttctgccaaaatcacggcgtgcatcgattgacacgcccgattttggcagaaccgttgtttcacccctggcaatgctatggtctaagcgttctgatgggggccaccatgacaccgtctcggcgggtgaaactgtattcacctgtgcctgtcgccaccataaggaaactgggttttgacatggtggtggtgtcgattttgtcggcgagctttattaggttggcagcaccttcttcgatgagtcggttccctcccagcttgacttcgatgagcccgtatcggccatcccgcaggtgaaggaccgcatcgcactcaagcccagttctgtcgcggaagtggaacacatcgccatcgagggcgtctgcgtatacgcggaagtctcgtacgcacacactttcaaacaacagtccaaaagtctcgagatctttgatgaggctggctggcccgattcctaatgctgccgctgcgatggagggatcgacaaaatgtctggtatctgaagtgcgtattacactcttggagcgcaaatttggattccacgcaggcatatccgataaggggatgcggacggaaagttggacgcttgggcgtccggattggagtccgcatgttttcgatggaggatcggcgcagggccgttgacctgtatttcacggagggcatgaccatcaggaaggtcattgccgagcttggttacccgtccgagggcgcgctggtgaaatgggttcgcgaggacccgcgttacacgggcgcgtgcaggcgttcgtatacgctggaatgcaagacgaatgcggccagacgcgcgctcgagggcgagcccctcgcccgcgtggcgcgcgacgcgggttgcacgccgacgagcgtgtaccagtggatgcgccgctaccggagcgaggggatactgggactgatggacaggagaaacgcgccgatgccggccgaaccgatgcccgcggccggcgatgacgtggaggagctgcgccggcaggtggaggtcctgcggctggagaacgcggtgatgcgggagacgatcgatgttttaaaagccgacgacccgcgcctcgacccgtccatgctgacgaacagggagaggacgcgggtcgtcgacgcgatcaggggtgaattcggcctggcggcctgtctgaaggccgtggggctgaaacgcagcacctactattacgagcgcggcgcgatcgccgcgggcgacaggtacgccgtgctgcgggcccgcgtcgccggcctgttcgagcagggtgggcgcgcatggggataccggaccatccaccgcatgctgcgccttgacgagtccgacccgatcgtcgtctcggagaaggtcgtcaggcggatcatgcgcgagggggccatgcggcccgtgtacctgaagcggccgaagcggtggagctcctacgccggcgagatcggcgaggccccggcgaacctcgtggagcgggacttccacgccgacgcgccgaacatgctgtgggtcacggacgtcacccagttcaccatggacgggtacaagtgctggctttccccggtggtcgactgcttcgacgggatggtggtctcctggaccttgtcgcgctccccgaacgccgacatggcgaaccggatgctccttgacgcggtcgccacgctcagggacggggaacatccaatcatccattccgaccgcggctgccactaccggtgggacgaatggatccgcatctgcgaggagcacgggctgatccggtcgatgagcgccaagggatgcagcccggacaacgcggccgccgaggggttcttcggcaggctcaagaacgagttattctacgggcgggactggaggggcgtgggctacgaggagttccgcgaacgcctggccgcctacctgacccactacaatgaaaccaggatcaagaagtcactggactggatgagccccgtgcaataccgcagaagtcttggactggccgcctgaccgtccaaaaaaacatccgcaccccctaacgcccgattttttgcgcactttcggattccgggtctgacgtaagagggcatggcccgcgtcctgtgtacgattttcattcgccaaaacaaaaaaccgcgattggaagccaggagacggaaccaagaccctcgaacatcatacagatcgaccagaacctgctcgagaccaggctcgaccgcctggtcgccgaaaaggtcgccgagctattgaacgcgatgctcgacgccgaggccgacgagatcgccaaagccgccaagtacgagcgcaccggggagcggaaggcgtacagggccggccactacgaccggagcctgaccgccaaggccggcaggctcgcgttgaaggtgcccaaactcaagggcgcggtcttcgagtccgcggtcatcgaacgataccggagacgcgaggagagtgtcgaggaggccctcatcgacatgtacctggccggcgtgagcacccggcaggtggacgacatcagccaattgctgtggggcgacaggatgccgtcccagaccctgagcgacaagctcaagaaggtgtacggggagatcgaggcgtggcgcacgaggccgttggaggacgagtacccgtacgtgttcatggacggcgtgtggcacaagcgttcatggggcgggcacgtggagaacgtcagcgtcccggtcgccatcggagtcaacgcggaggggcaccgcgaggtgatcggcgtggccgagggcatgaaggaggacagggacagctgggagcagttcgtccgctccatgatcgaacgcggcctgaagggcgtgcgcctggtggtcggcgaccggtgcgccggactcgtcgccacggtcggctcgatgctgcccaaggcgagataccagcggtgcatggtgcatttcatgcgcaacgtgctctcgaagacgccgccgacacaccgcgaatgggcgtccgccgccctcaaggccatattcgccatggaatcccgggaatccgccctggccaaggccgaacaggtcgccacggagatggaatccaggaggctcaaggccgccgcgagctgcctgcgcgagggcgtcggcgagacgacgacctacctgctggacgagttcccggacgggcaccgcaggaggatccgcacgaacaacatgatcgagcggccggacagggagatccgccggcgcacgcgcgtggtgggcggcttccccgacgggaacagcgcgttgatgctcatatgcgcccgcatccgtcacgtcaccgcgaacgaatggtcgacccgccgctatctcgacatgtcccggctcggtgacaacctcgtggaagcgaactgactatcgcgccatggacggccacgatccaaagtgcgcaacttttcgggcactacccaggccgatacttggctgatcgaagatcataccgacgatttcttctgcgatcaggtattgcgcggtcttgcgcgagacttgcgtttgacggaacaggcgttgaacgaatcgatcactttgcagcagcatgtcgacgcgaatcgcattctgcaactgtacgaacgtttggtgcgtatcttcaccgcaaaaggatggtctttcgaacgcaaactgtacgcatcgacttctcgcgaaggcaacaaggccatgaatctgaattcgttcatcgggttgatgggccactcgttgaagcgtgtggaaacgtcggatggcgtgattttgcgtgacgtgcgcgaggacgaatctccggatttcgtgatgcgcgattccgaatatgtgttgacattggatgccgattccatgctgctgcgcgattactgcctgcgtttggtgtaccagatggaacagccgggcaacgagcgtatggccgtgattcaaaccccgtattcctcgtatcgtggtgcgccgacgcgaatcgaacgcatagcggccgccaccaccgacattcagcacatgctgcatcagggcatgacgtactatgatgccacgttctgggtgggtgcgaacgcggtgattcgcaaggccgcgcttgacgacatttgcgtggtctcaactgagggcacgcgcacggtgaaaacgtatattcaggatcgcacggtgattgaagacaccgaatccagcattgatttgggctatttcggctggcatttggttaattatccggagcggttgagttatagtgccacgcctccggatttcggctcgctggtggtgcagcggcgacgttgggcgaacggtggtctgctaatcatcggcaaattcttccgcattgtgcatgcccggcatcagcagggcaatgatgtgaagctgggcgagtgggcgttgcgcgtgaactacatggcgtccatcgcatggtcgagtttcggcttgatgttcctgttggcgtatccgttcgatcagcggttgctgagcccgtgggtggtgctcgcttcgttgccgtattttgccaccatgtcgagtgatttgaaacgtaacgggtataagcgttctgatattttccgtatttacggtttcaatatcgtgctgttgacggtgaatctttccggtacgctcaagtcgattcagcagggcatgacgaacacgaagattccgttcgcgcgtacgccgaaggtcaataatcgtactgcgtctccggcattgtatgtgacgatgccgtgggtgatcattatttattcgtgcatggtgttctatgccgatacgttttcgcataattggggtagcgcggtgttcgccggattcaatgcgatcgtgacattctgggcgctgaccgcatatatcggcatctggcattccgtgcaagacatggtgctcggtctgattcgctggtttttcgtgccgatcaaggagccgcagcaggaggcggtccgcaagaagtcctcttggcgtgacaccctctactttggcgaccgccaaatgatctacgagtcccgcccgctctgattgatatgcgcgtgccgggccgttcgcgcgtattccgaaagcataaaagagttgttatcttcgtgtgaaggtatcattgaggtacaaacttttgaaaaccttgtccgtatcggcttgccggtcggtcggaacgggctgagaaggtttgcaaatccgcaaagaaggtttccgccgtgctacttgtcctacgttagaagtggctaggctaggggcgggtcgaagcgaccttgtgtcgagcgcctcctagggtccgatgggaatgggatcgtccgtgcggagggacggtaaacaaagccttcgatggcgcggtaattccgggagcaagacccatcgtgctcccggtttttatacatatggcaaggggttgcgttggcggatggcggcaggtggaagacaatccgcgcgcaagcagttgcatatgcgcagcgtttatcccagaagagaatggtgttgcgctgctcaaacaatgttgtcatcgaaatcaactaggacgcagataattttctgcactttctaggggtggattgtctgctgccacgaagcgtatatcaagacaagaataatcgacggaaatcggtttctaggcttttcgttgagttatctcaaagtactttgagtgatgagacgttactttcgggtatgcgctgtcttcatgacgaggcgaccattgacaagaaaatcgcggtcatgaatttcatgctacaagccgagtccgctcgattaacgtcggtgctaaaatgcgcggaaaatgattcagtttattcgtttttcataggcgatggcaatcattgcgttggaatcacgttgcataaagtgcaaaatccgatcgatccagatggaaaggtctattttccgagatcttttcagtattatgcccgcggaattgagtccatgaaggattttgcagacaaacttgacgtgtcgagcataactttggtgcctgtcccatcgccggttgatacaaaacctgtccgtcacagaaagcgaaagaagtagctgcaaaatctgcggtagtttgtttgttcctcttattatcggggaatgatgggcaggcgtgtcaaaacgtttgacaaatcggagttactgttttacgattagtgaaacgtttcgacgaaacgattcgataaatttgtcgaacagggtccgtaggagagattccgggagacttggcggatggtttcgttggatgatgagtgaggattgcggcacgcgcaatgtgtggcgcaagcgatttggagagccgaaggaggcggaagatggcgggcatcaaagatgtagcccaggaggcgggagtgtcggttagcaccgtttcgtacgtgctttccggcaagcgttccatctccgccaaaaccaccgataaggtgatggccgccgttgaacgacttggatatactccggatgccagcgcccgtaaaatgcgtggtatgcgcaatcatatttttgcgctcagcgcgccgattcgcggtgatatcaatcaggccaaatacaacgcttactttctgcagaccgcatggcaggcaaagaaccgtggctacgatgtgctgttgcttaccggcgaggacgcggtggccgacattcggcgcgtgacgcaaagcaacttggttgatggcgtggtgctgctcgacattgaggaacatgacgagcgtaccgcccaggctggctcatattccaaaccctgtgtggccatcggttaccctgcagagcatgaaggctgtgcctgtgtcgatatcgattttgccacggctggtcgtatggctgtggattgcctgtattccaaggggcatcggagtgctatgtttttgcgtgacaatgagaccgattgcgatcgcggttcgggctatgtgctgctgttccgcaaggctttgctggaacgtgccgaagagttgggcatgacgattcatgaatccttcaagcatcgtgacgatcgctttgatgccgtggaattcgtgcgtgagctttgttctttggatgagcgccccacggcgattgtcaaccaggcgaacgccaatgtgctgaagttggtattgcagcaattacaggcttcgggattgcgggtgccagatgatatttcggtattgtcgtgcggcacgtatttcgagggagagctgatgccgcagccgattaccgagatgccggtcatgccgcaggaattatgttctaaggctgtggatctgctggtcgacgccatcgatgagcgtcgcgacatcaagggattggtggaactgtccgctccggtcatgcatagtcgaggttccgttaccaaagttggtgacgtgtgaaaagaaaactgtaggagtatgtccgtgaaaggcggacggatttccgtatccataatcgaaacgattcgaaagtaagtgaaggcgttgtagccgaagcgaagatggtgattgccgaattgaaaagcgctaatccgcggccatcgtcgaaacgtttcgaaaaaaggaggcgacacatatcaatcttcataactgaaaaacaacttgagacataactcaacaacacaaccaccaataacaaaggagaaaccatgaagatcacacgaggcatcgcacttgcggccgcggtggcaatgtcgctgaccacgctcgctgcatgcggcagcgacaccgcgcaagatgaggaaacgccagacagcctgtcgttctggtattacgaggaagacgacgctggccagacccaggcatggcgtcgcgccgcggaagccttcgaaaaggaaacgggtgtcaaaatcaatttcgaacgcaagtcgttcacgcagatcgcgcagaacggcagccaattcctcaattccgatgaggcgccggatcttatggaatccaatcgcggcaacggttcggccggcgtgctctccaccatggggctgctcaccgatttgggtgattacgtcgatcaatacggttgggacaagaaggtgaccggcgccaatgcggccgtggccaagtatgatgaaaacggcatcatggatggtgacacctggtacggcatgaccagttacgcggaattccagcgcgtctactacaacaaggatctgttcgccaagtacgggctggagattccgaccacctatgacgagttcgtggacgtctgccagaaattcgtggatgccggagtgacgccgatcgccgccgacgcgcaggaatacggcgtgatgtggctgtggtggcagctggtttccaaggaggccgacgccaaattcatcgacaactggcagctctacaagggcgatgtcgactggaattccaacattctcaccaattccgtgagcaccatcaacgactggctcgacaagggcttcatctcccgcaacgccaccggtatgaaggccgaagacaccacgcaggcattcatcaagggggagtatccgatctatcagaccggcacctggaatcagggacgtttcgtcaagcagatcaccactttcgattgggacgccgcggtgatgccggaatcgaatttcgcgattggctgcgcaggcaatctgctggtgattccggaacgctcgcaccacaaggatctcgctgcgaagttcattgactacgtgctttccgacgatgtgcagaactacctcggcaacgccggcggaattccggtggcgggcgacgccagcaagatcaacgacgagaagagcaaggccatgatcgaggaatacgcctcctacgccaatgatggcaagctcagctactacccggattacgccgcttccaaccttaccgatgctgttccggcggaattccaggaactggtgaacggcaccaagaagccggccgacgtgctcaagggtatccacgagaagtacgacgtcggtgtggaagacatgggcgtcaagaccaactgatcgtatatctgatctcatatccgacatcgcacgggattattccggttttgctcagtatcaatcatgaataatcccgtgcggtatcgcaaattacaacttgcgaaccaatatcgcaatcgtcaatattcacaggcaacgcagcgcaaccaaaggaaaagccaaaatgtcaaagaagaccaaaaacggggagtctcaatgtcaaggcttcccggaaaccgttccgcaaaattcgtaccatatcttgttcccggactggtaggtctgctcgttatcgtcgttattccattcgcatggaacatttatttgagtttcactcgctggcgcggagttggtcctgctaaattcgtcggattgcagaattggaaacgtctgttcgctgattccacgttctggatttcattcgctaattcattctggattattgtggctatcgtagttattcctacgattctcggactttttatttcgtcactgttgactgacgttattcagaagaaattcggtggaaagacggcttcttttctgcgggccatgttctacctgccgcagctgctgccagttgcggtcgcggccatcatcatgggctggattttccgcccggaagatggtgcggtgaacgcgctgctcgttaagctcggcctgggatcactgcagcataattggctcggtagtcctgatagcgcgcttccggtactgatgttcatcctggtgtggattcagctgggctatccgatagtgattttcatgtccggtctgcagcgcgtggatcctgaactttacgaggcggctggtcttgacggagccaactggtggcagaaattccgtgtggtcacgctgccatccattattcccgaactgctggtggtcatccttactgccaccatcggtgcgctgaaaaccttcgcaccggtctatctgctcaccaaaggcgggccgggaacggcaactaccgtgccatcgtactattcctacaatcaattcttccaagtgcaacaagtcggctacggcgcggccatctccacagcgctcaccgtggtcatcatcgtgttctccatcgtgttcaccatggtgcagaagcacgtcgaaaaggaactggtctgaacggtccaaaccgtaacagacccgccaaatgtaagactcgcaagacttcgaaagccgaggaaaacaaccatgacgcaaaccatgaccgcatcggcagcgcggaaagcatccaagaaaacccaacatgtgcgctcgaccggcgattggatcaccctcattgtgctcatcgcagccgcactgctcgtgcttttcccgctgctcgtactcaccatcaacgcattcaaaacgcctgtcgattacaatgccaccggtccgctttctctgccgaaacacttcaccatggatggcattatctccttctggaccaccaccaaattcccgctgaaattctggaacagcctggttatttcactggtagtggcagtggccgccgtcgtgctttccgtgctgaactctttcgcgctcggcatcggcagggtcaaaggcaacacatggattgtgctcgccatcatgctcgccaatatgatgccgcaggaagcgctgctctacccgctgtacaccatgttcaagcaggtcggactgtacaacaccaaactggcgatcatcatcatcttcaccatcatccaaagcgcatacggcacatatctgctgtcgtccgtatacggtacgtttccgcaggccattctcgaagcggcggccatcgacggcgcctcgcgctggcagattctgcgcaaggtggtgctgccgatttcctggtcgaccatcagtgtgctgttcgtgttctttttcgtgtggacatggaacgaatacatgattccgatggcgttcctgatgagcgatgacgtgcagaccattccgctggcgctcgccaccttgcaggggcagcgcacgatggatgcgaccacgcttgcttcggcttcgctgctcagcattgtgccgaccattatcttcttcattattttccagcgcaagttgtcgcaaggcatcaccgccggtgccgtaaagtagcagaaaaggggcgccgatgactcaacataacgattggagcgctatgcagcaaagttcgtatcatgatatgcaggtcgattcgtcgggtgcgttcgccgcgcgcagtccgatggactcgcttgcggttgcggtaccagggcgcacgcgttgtgtgaacgccgagaatcccacgggcggcaagggcactgcggccagtgcggccagtgcacttggcccgtcgcgcaaaggcagcccctgcatccaaaccgtgaaagcgggggagaacgtcactttgatggatgtggacggtccgggcgtgatccgccatatttggatgaccgtcactgaccgcacgtcgcctaccggtccgaacgtgcttcgtgacctgatcttggaattctattgggatggcgagaaaaccccgtccgcgcaatgcccgatcggcgacttcttctgctgcggccacgcgcaggcctgccgagtcaattcggtgccggtggtggtcgtacccaatcgcggcttcaactgctatttctccatgccgttcgaacatgcgcgcattgtgctccgcaacgatcataatgaagacgttcccgcgttcttctaccagatcgactacaccgaatatgactcgcttccggccggcaccatgcgctttcatgcgcagtggcgtcgcgagcgcgtcaccgaaccggcccgcgattatgtggtgcttgacggcgtgcacggtcgtggcgcgtatatcggcacgtatctggcgctcaccgcgttagaaagccgatggtggggcgagggcgaagtcaagatgtacatcgatggagacgatcagtaccctacatggtgtagcaccggtgccgaggattatttcggtggcgcgtggagtttcgctgattttgacgagcgtgggcgcatgcatgagcagacattctgtgcgccgtacgtcggattcccgttctactcgcagcgtctcgcctcgcatcgcgagagcgcgtattgggatgtgaatacccctgtgacccgcggactatatcgctggcacattcccgatccgatttatttcgagcatgatttgcgcgtggaatggcagcagatcggcactgaagagggtggcaatttcgaacgtcaggacgacgtcgcttccgtcgcgtactggtatcagctcgagccgcacacgccgttcgatccgattggagatcgtcatttccgccagccccgctgattttcacccccgaacctgtgatttccggtctatccggtcggtccgggggtgttgtgctgtctgcacgacttgcgttctgtgtctgcacgacttgcgttctgtgtctgcacaacccgggttttaacccgattttgtgggttgtgcagacgcagggtgcgggttggtgcagacgggaaatgcgacttgtacagacggggtcagatatcacggcgtctgcggcgctgattatcgtgcgaacgttctgcgcatccacgcgacagccagttgcgtccagatctgcatgctcggttcgatgccgtcgatgccctgccatgcggtttccgcaatgcccaacgacagtccgtgaccgccctgcgggaacaggtgcgcctccacactgacgccagccttcttgcaggcgtcgatcagcatcagtgtgttctcatatggcacgacttcgtcgggaacggtgtgccatacgaacaccggcggtgttttagtgtcgatatggtgttcgatcgatacggattcgagcgtttccgtatcgtttcggcgctcgccaagcagcgagtcgaagctaccgcgatgcgcgagcgggccggacgtgatcaccggataggcgagcattaaaccattcgggcgcaccgcatccggatcgtaaccatgggcggcgagcacgtcgtcgctggcggacgtggcgagattcgcagccagatgaccacctgcggaaaaaccgatcacggcaatcgcttccggatcaacatgccattcggctgcatgctcgcgaatcatcttcatcgcatcagcggcttccaaaagcgcaattggaaaaacggaaggcttcaccgaatatcgcagcacaaaagcgttaaaacctgccgccagaaactgcattgcaatcggctcggcctcgcgatccgacgtcatttcgtaaccgccgcccggaatcacgagaacggacggacgcacacgatcgggaacgatttcttcactgttatcaaggcaatatccgacgaatttcgctgcgctgccgtcgatgccggaaatttctattcgaaatatttcatatatccaccataggtggaacacggcgcacgttatgcaggaattatttggtcccgctatttttcgtacggggctgcggacgttttcttggagataatcacgcggccattccttggctttgacggtattgtaccgggctcatccaaccaagcgactgtttgatgcgctcgtggttgtaccagcgtatgtactcatcgaccaaggcgagcacctcgttgcgggtgtgttcctcccacttctcggggtggaccgcctcggtcttcatcctgccgaagaatccctccgcggccgcgttgtccggcgaacagcccttcgcctggtctccagtgggatgatgggtttggccatatggccggcataccgggaatccatcgccggccaacgctccagacactgcctggtcggataacccagatgctccaccacctgggccgtcgtcatcggcgtggtgaaatacaactccaccgcacgctctcgttcctcaagaccggacatacgaaaatctttccgttcggtctccaagaaaacgtccgcagccccttgtcccactgttccccatttatggaagcgtaatttactaaatcatgattccataaaccgaacgatggctgtattcatcttcgagagcggttgaaaccacgtcgacacgccgaaggggtgctcgcagaaccgctgttgccgaaaagcaactattggaattccgccattgtgcgaaacctatccgccgttctgtgagcaccccttcggcgtgacgtcgtatccggcgcgttcctacgagcagagccaatccatgacgttggtgatatggatgccttcgtcggtcatgccctcgctatgccagtcgagggtgagcaccgtgcgggggaatgcgtcgcccaatcgccgcagcggggctaattcccgctcccgggtctgctcctcggtcatgttcaacgtgacctgaatgtactgcttgttgtttccgcgcttcgcgatgaaatcgatctcgccgtcgggcagcgatccgatggtgacatcgtaaccgcgtcgctgcagttccatgaagacgatgccttcgagctgggctccgcgatccgagccgttgaaacccgtggcgagattgcgaaaaccgttgtcgacggggtagaacttgcgttgcgggcgcagcagttccttgcctcgcatgcgttcctgttgcgcgctgtagacgatgaacgagcgttcgagcgcgctgatctggttgtcgacggtggcgtaggaggcgttcgcgccggcgcttgtgagcgtgttggcgaccttgttgacggagaacaggttccccgacgttgagaacagatatcggctgagtttttccaatgtggcgatgtcgcggatgccgtaccttcccgccacgtccttcatcacaatggattcgtagattgaggtgagtatttcggtcgccttgtcctgatccggctggccggtgacgaacaggccgggcatgccgccgaacatcatgtattcggagaacagctggtccgtggaatccgtggttccctgagcccgatgatggcgttggtattcgtcgaaggagagcggatatatggggatggtgatgtagcgacccgtcagatgggtcgccagttcgccggatagcagtcgtgcgttcgatccggtggcatacacgtcggtgtcgtcacgggaatgcagccggcgaaccacttcctcccatccgggaacgtcctgtatttcatcaaggaaaacgtagaaggggccgggttgggcttcttgcgtggcttgcatcaggtcggcgtgcaggtcggtcgccgaatatccgatgggcgtgtcgaaggaatcgaagcgacgggtgaagatattgctcgcgggaacgccgtcgtcgagcagtgattgcgcataatgttccagcagcgtgcttttcccgcaccgtcggacgccggtaagcaccttgatctccggggtgttccggtggctgcgcagcgtgtcggtgagcttgtctcgtgcgatatatcccgtcatctccacgcctccgatttctagtgtattgcaaaacagtcgttagatcgacgttgattttcagtatacttgaaattgtgcgttctggggtaatgattctatagtgtactcgaaatcgcgtggtgggtgtcgtctgccgctgtcggccggcggatgctgtgatatcagggttccgttactgtttgagcggcgctgccactgcctactcacacatttcttgtacgtaaaatgtgttttactcacacattttctgtaggagattgggattggtcatggatcgtacggctatgaagcagcttgaggcttggaagacgtctcgaaaatagaaagccgctcattatccgaggcgcccgtcagacgggcaaaacgtgtctgtcggaggagttcgggcgtacacgatatgaggtagtggcgcgtatcgacctcatgaacaatgagcgtgcgaggagtttctttgacggctatctagatgtgagcaggatattgcgtaacatcagcctcgaaataggtgttcctatcacgacagataccttggtgctccttgatgattatggcggggacttctcgaaacacgcgccgctacgtatccttgagagaattcgtatagtttgggcttctctaccatcgcagctggcaaaggagaatcgaaagttcgtaagcctgcgtgtggctgttggtcatttcgacctgcataaagcagtgcgcaccagtcttgctgggtatcgtgacgatgactggctgctgaatgtgccattatgggcgattggtcggcttgccgcattgccgctatagaagcccaagcaaaaaggggcctccggcgcgaagcggaggtccctgacattaatcagctaggggcaatcgtgtataggcttatatctcagcttcatacttgccggctatcggccatcggctgatagcggatatgtcgaaagcggcgatgattagatttacgttactggatatggcagtatgggtgcctctttgcccctttcatcatcttgcaataattcttacatgtaagaactctctgttaacatgtaagaattattgcaagatggtgaaaggggatgctcatgttgccgactaaagaaagtttgacagttgagttcaagagcgagcagaagcgtcctcaatcgcatgatgaaattgttgacaacgtagtggctctagccaatactgaaggcggcacactgtatctcggtattgaagacgatggcactgtgaccggcgtatgtgacgagcatcgcaatatcaatggacttgcggcactaattttcaataagactgttccgcagcttcccgctcgcgtggcgctcttgtatgagaacgaggtgccgatagtcagtattgaggtgggtaacagtcagcaaatcgtgtctactagtcaagggaagacactacagcgccggctgaaagcagacggctcgcctgaggtcgttccgctgtttgtttcccaattcattagccgtttatctcagcaacggttctacgatttcagtgcgcaacctgccccagaggctcggttgggcgatttgaatccagactcacggaacaagttgagaagccatattcgcagtgccaatgcgcaaaactcgttgttgtcttttactgatgaggatttcgatcgggcgcttgagctggttgttgacggcccgtatggattacagccatctgttgctggtctgctcaccattggttcggttgatgctattcatcgatcgattccagccgcatcggctgtttttcaagtgatgaaaggcatgtctccaaaggtcaatatggatccgttcgtgttgcccttggtggatatgtttgatcgtgtaggcgagctgatggagccgtggaatcccagccacgaagtcatgagcggcttgattcgtgtcgatctgccagacttcgatcgaggggcattccgtgaggcaatgattaacgctttctgccatcgcgattatgcgcgaatgggttcggtgaggttcctggttgatgatgatgggttgaccatagccaaccccggaggattcatagagggtgtctccgaagataacctgcttactgcacaaccgcgttcccgtaatccgcagcttgctctgattttgaaagctgccggatatgttgaacgtaccgggcgaggtgtggataccatctatgccgggtcgattgcggcaggcggttctttcccggattactcgcagtccagtgccgaagaagtcattctgttcctccgccgtgtggtgcctgacgaggcattcgtgaccatgattggagacgaggaacgtcgacgtggggctccattgccggtctggtcgctgattgtgctctcgctgctgcgcgagcatcgtaggcttaccgtggtccagttgtgcgatttctcccatttggagcatcgacgcatcgtgtccgctgttgagaatttggtggaagctggtttggtagagggggtcggcagtgggagctctcgctcgtatatgctgagtgcccaagtgtacaaacgttcagaggggttggcgtcttacgcgcgtcagcgtgacatcgatgccacccggcgcagtggccttgttctggagttcgccgaaaaaaatgatggtgtcgtcactacagcggatgtcatggatttgtttggcctgagctatatcagtgcataccggttgttgaagaagctcgaagatgtgggcaagttgcgccgcgaggggaatgggccgtcatcccgatacgtgttgggatgattggcgcgcgtgaaagtaagttctttcatcaccttgcaataattcttacatgtaagaactctctgttaacatgtaagaattattgcaagatgatgaaagatgcacacaaaacggggaagccccgctcgatgtgagcggggcttccccatatgcgctggtgtgtagatcagcctgtgttctgcaggccggcagcaacacctgaaacggtgcagaggatcagatagatgaatcctgcctgctggctttgcgagagctcttcctggtccaccttcttgcgcatcgcctcgctgaacccggccgtgcgtgccgaggcctacgatgttgcgctctttcccgagctcaaggaccattacggcgcgatgagcgtgccctgcatcgtcgtcacgcgggccgacggcacgcgacgggtcgagttcggcaagaagagcatcccgcagatgcttgcactggtcggcgcgtaggcacggctcggcgcggacgttcccgggccgtgcgatacgggtgaggaagcccgttgcgaaatcaccatcatggaatcctatctatcaggaatcctgatggcctcccataagaaacggtgagtacctacagcgagtgtctgctttccgccttacgtacactgtgcacagatacatcgagaaagggattgtggatgtatctcaaggtaagggattcgcggttcgggggattgaaagaacactgacattctttcggtgacgcgaatccccgatacaacgcaaggagggattatgcgtaagcatcttgtagctgtggtcgcggcggcggcagcattgctgctggtggctggttgtggcggcacgagcggcggcagtaatgcggaatccacggaaaccaccgtcgacggcagcctgaacaaggtcgtggtcaagggcgatccaagtaaaagccccgccaaggccaacggccgtaaggacacattcatcgccacgatcaattctccgagcggtgtgttcttgccggggttcaatgacaatggctgggatggcaacgcgcagcagccgattttcgcgagtctggtggtgaccgatgattcgggacagtatattcccgacttggccgagaaatgggatatctccagtgatcagctcacgtacaccttccatctgcgcgacaatctgaaattctcggatgggtcgccgctgaccgcggacgatgtggctttcagcctgacgctgttcaatgatccggcttactcgggcggcagtgatttctccgacatcggcatcaaaggcgttgatgcgtacaagtcgggcaaggctgattccatctccggcatccgggtgatcgacgagcggaccatcaccattgagaccacgaaagcgaatccgctgacattgggcattcttggcggccaggtgctgtcgaaagcatattacggcaaggactaccagcgagggcaccttgattatctgaaggatctgtacggcaagcctttgggcgccggcccctacaagctgtccaaatatgtggatggtcaggaagtgcggtatgttgccaacaagtactactatggcggcgaaccgaagatcaggaatctgatttttaaggtcacctccaaggacacggcgctgtcgaacttccagaacggcgaaaccgattttgatggtttcagcccggacaaagataatcttgacgcactgaagcagcttggctttgccagtgtgcgcgaaagcacggtgccggacatgagtgagatctggatcaataacctcaaggccccgttcaacgacaagcgagtccgtcaggcgttgatctatggtctcaaccgtcagcagatcatcaacgtggcgtataagggattcggccaggtggcgaacgtgtatgccgctcctacgcaatggtcgtacaccgataagggagtcaacaagtacaagttcgatccggacaaggcgggcaagctgcttgacgaggccggttggaagaccggctcggacgggattcgcgaaaaagatggcaggaagctcaccgtacggtacctgacttccaaggacacggatgagacgatcccgattgccacggagaactacaaagccatcggcattgacttccagcctgaagtgctcgatggcgacaccatcatcgaacgatggacgcagggcggcgattgggatttggtcggcggattccgcaccaacggtttgtcggatccgaacgacgcgatttccgaattcgtctcgcacgacaagtccatcaacctcacgggctaccacaatgaggaagccgacaagctcgccaaggaagggctgtccactcaggataagacaaaacgcaaggccatctatgcggagctctacaaggttctgaacaatgatccgcccaccattccattgagctatcggcagtccatcacggcatggaacacccgtgtcaagggtgttgagaactattcgaccggcaatagcgatgcggcgctcgtcctcgcgaagctttcgatcgaataggcggtcggctgcgtttcgtgtccaaagcgttggataaccgctgatcggcatgcatcatcgtcgtggccccttgcgaggtcggcttggggccacaacgttctgcggtgtttggatacgccgctgtgattgttgatcatgcctgaaaggaaattcggttcatgttgcgatatacgttacggcgattcgcccagatggtgttcatgcttttcctgctttccatcctggtgtttttcctctttgcgttgatgcccggtgatttcttctcgggaaacaggaagctgaaacccgctcgactggctgagctgcgcgcattatacggacttgatcagcccaccatcgttcgctacttcatatggctgaagaacgtcttccacggtgacttcggatggtcgttgcaatacaatgagccggtcacgcgcctcctgaagacgtacatgatgaattccttcatcgtcgctttggccgctgtggtcattgcgtggaccgttgctgtggtcattggcgtgttctccgcgactcaccaatactctctggtcgataaactggtcactgttgtcgtcttcgcctcattgtcgttcccttccttcttcatcggtctgctggccatcaaatttttcgcggtcgatcttcgttggctgccgaccggaggcatggtcgatacggggtcgaacagtaccgggttcgcgtatgttcttgaggtattgcggcacatgatcatgccgacactactgttggcgttcttctcagccggttcgttgacccgctatttccgttccggaatgttggatgtgctgcgcatggattttgtccgttgcgcgcgcgcccgcggcatctccgagcggtcggtcgttttcggccatgcgctgagaaacgccttgttgccggctatcacgctgcttgccttcgagattcccggattgttctcaggcgcgatcatcaccgaacagatattcaattggccgggtatcggcagcattcagctggcggccttgaacgcgcgtgactatgaggtgctgatgacttgtacgctgctgctgtcgtttttaacgattctggccaatttcctggccgacatcatgtatgccgctgcggatccacgtgtccggttggcgcagaaagttcagggttgacatggaactacgtcgcagtgaatcacgatcacggtcgcagcgatcagccaatgggggaaagatgcggaattctggcgttcgaccgttatggtatcgcaatcttgtccggttggcgcacacacgtgccgcggccgtcagcatcgccacgctggttctcgtgctgttgctcagtgttctggggcctttgttcagtccatacgggcaaaaccagttggatgttcccaatgccgaacagggccctactctggaccatctgcttggcacggatgattacgggcgagatatccttacgcgattgatgtatgccggtcgtatttccttgaccatcggattggcgtccacggtcctttccgtggtgcttggcgccacgatcggcattgcgtccggttattttggcggatgggtcgatgccgttatcatgcgtctggcggatttgctgatgtcgattccaagtctgcctttgttgatcatcatggccgcattgctctcggagttcaaggttcccgcgagttcccgcatctatgtggtgatggtcatgttgtcgattatcggctggccgggtatgtcgcgcatgatccgcggtgaagtgctttcattaagggaacgtttgtatatgaaagccaccgaggcgttgggcctgagcacaaggtcgaggctgcttcatcatctgctgcccaatgtgctgccgctgttgattgtgcagaccacgttaagcgtcgccggcggcattctcatggaatccacgttgagcttcctggggcttggagtcgtgccgccgaatgcgtcgtggggaaatatgatggcggcggcttccaacctcatggactttcagaaacgtccatggctttggattccgccgggggtcgccgtattcgttacggtggtggccatcaatgtcttgggtgatcggctacgcgacatctacgatccgaagaatgaaagggcgtgaggcatggttattgcttacgatacgggaaatggttcggatacgcatgagccgttgctgcgcgtgcgtgatctgtgcgtcgaatttcctctggatggaggagaggtccgccatgcggtcaatgatgtgagcttcgatgttcctcaaggttcggtgacgtgcttggtgggtgagtccggttccggaaaatccgtcaccgccatgtccacgattgatttggtggatgagcctggacgaattgtgggtggaaccatcacctttgatggtcgtgacgtgttatcgctcaaccacaagaatcttgagcggctgcgtggtgaaggaatctccatgatcttccaggaacccatgcattcattgaatccggtgctgcgcgtaggaaagcagcttggcgagaccatacaggtgcatagcggtgcctccagggaatccgcctggaagcgttccgtgcagtggctgaagcgtgtgggattaccgaatcccgagcgcgtcatgaacatgtacccgcacgaattgtcgggaggcatggcccagcgtgtgatgatcgcaatcgccttgtgctgtggcccgaaactgttgattgccgatgagcccacgaccgcgctcgatgtgaccatccaggctcagattattcatctgctgttgaaactgaaggaggagataggcctttccatcctcttcattacgcatgattttggcgtggtcgcggaagtggcggattacgtcgtggtgatgtatgagggcaaggtcgtggaacatggcgatgtgtatggtatcttcgaccatccgcagcatccatataccaaggcattgctggaaactcgtccgatgatcggcgcgcgtcgtcatcgcctgcccacggtccgtgatctggtgcctcggttctcggcgttgtctggtgggaattccctggctgtgctcgatgatgcctcggcgcccgaggacggggaatggaatcatgggcgcaatgattcccgcgaaagcccgatagcgttggcgaagccggatgagcctttggtggaggtcaaacatcttaagaaatactttgtgtcgcaagaaggtttcttctctcgcaccacccatacggtgcgtggtgtcaatgacgtcagtttcgagatatttcccggagaggcagtgggcttggtgggagaatcaggctcgggtaagacgactttggggcagaccatcctccgactgcagaacaagaccagcggggaagtcaggttccgggggcggaatatattcgatctggaccgcgatagtctgcgtgatttgcgcccgcagatgcagtacatcttccaggatccatatagttccctgaatcctcgtctacccatcatcacggcgattggcgagccgatgctcgagcatggactcgccgacaggacgaacgtgcgtgatcgggtggcggatgtattgcggctatgcggcatggatgccgatgccttggatcgatatccgcatgagttttcgggcggtcagcggcagcgtatcggcattgctcgggcgatgggtttgaagccggatttcgtggtggccgatgaacccgtggcttcactggatgtatccgtgcaggcgcagatcatcaatcttttcagtgatctgcaggagcggcgaggcacgactttcatgttcatctcgcatgatctcagtgttgtggagcacttgtgctcacgactgatgatcatgtatctgggtgtgatcgtggaagtcggaagtcgagaggagattttctccaatccgatccacccttatacgaaggagcttttggatgcgattcctgcggcgaatccgaaggggaggcatgctctgcggaagtcggattccgaaccttttgcggttcgaagatcgtatgcgcatgacattcgtgaaggacaggtgccggagttacgcaaggtcaatgagcatcattgggtggcttggagctgatacctgcaggattatgcattgcgtctttcctctgttggagtggatcgggttcacaacgagtgggaggcggtgccggtcctaggtctcggtgatctgggcggatgggctctggatttgttgcagatctggggaagctacctggcgaataccccgaaagaggacctggcgtcatggctgcacactcatctcggcgagcaagacgcccgtatgggattcagttacagcgatgttctcgcggactgtgatgcatggttgttggcgcggtccatgcagagcaattcctccgaaaggtctttgtccaccgctatgcgggacatgttcgcgcaaagcgagacgaatcgaattaaacggttctatcagtcccggttcaagggaagtgcggacaacctggtcatcgcatttcgaaagctcgttgatggaatcgatcttggaatattcgataacgtatccggaagtaaaaaagcactgctcattgcgtcacatgcagaccgactcccgagtcaagcggaggctggtatattggcattatcctatgctgaatctcttgaaaatcgaaccgttaatcaatcatgattgtgatcgcattgcgtggaatgattcagccattccacgcaatgcgcctctggtaaaacgtcatagagtcattagagcggaaagtagcgttatcacaaaaacaggaaagaccataaccagcacgagaaacgatatgattcccacaaggacatgcgaggcggaaggggaatgatcacgaagttccggatatacagatcgcatatatgaacgcacgccaaagatgacaagcgccgcaatccagcagactaccccataatcaatactaaggtaagtctacgtacatactcagttgccgtagttaaattcatgcacgaagaggaagagaacgttagaactctgcagattatagtatcatcatcgccattggtgccccattccgcccacaaaataagtgctggtgaaagcagcagtaatcccagccaccatagcacacgtctggccttgcccaaaaccacatagcatctactcgccttaaggaatttggtagctgctgctttcggtgccaaagcatatttcttgccggaaaaactttctgacatatcttctgtgccgtgtttcttcccaatgccatcggttgtagccggattcgctttgcaagcgtggcgttcgttcccggcgtcgccccccgtcctgatgccgtccgtggacccggtgttcccgcgcccgtccgctggcttgtccatgtcccctccaatcatccggggcccgttccgcgcgtccgttctctgcgcgcccgcccggcgtgcgccgtcgccggccagtctagggccgtatgacgcgagcggggaggcccgcgccgtttatcggcacggaacctccccgctcgcttttcccgatcggtcggccgggaatcagcccgtgttctgcaggcccgcggcgacgccggagacggtgcacaggatgaggtagatgaatccggcctgttggctctgcgagagctcttccttgtccaccttcttgcgcagcgacttgagcgccagcacctgagtgacggacagcgcgtccacgtatggggagcggatgcggatggcctggccgagcacgtgacggtgctgcagcggccacttgtcacccacgatggccagaacccacttgcgggtgagctccatctcgttgagcaccttctcattgaggtcctcgcggtcgccgagggcaaggtacatcctggcgatgcgctcatccgtcttggcgatggacatctcgatgttgtcgatgaacgtggagaacagcggccattcctcgtaagcctgacgcatggtctccagatcgccgaacttctcgcatgcggtgccgagaccgtaccaagcggccaggttgatgcgggcctgggcccaggagaagatccacggaatcgtacgcaggtcgtcgagcgacttggcgccgaggccacgcttggccgggcgggagccgatcggcagcaggccgatttcggtcagcggcgtaacgatcgagaaccacggagcgaagccatcggtgttcaacaggtcgaggaaacggttgtgcgcggcctcgtcgagctgagcggccatgtcggcgtacctctcggtcatctcggtgttgcgcttctccacgctcggcgcggactgcagcaaggtcgccgcagccacggactcgacgtggcggatggccagcaccgggttgccgtaacgggcgaagatgacctcgccctgctcggtgagcttgaagcggcacttgacggaaccgaccggctgggcgagcaccgcgcggttggcggggccgccgccacgaccgacggcaccgccgcggccatggaacagggtcaggtcgatgtcgtgcgactcagcccatttggcgatgcgctcctgagcggagtgcagggccagcgtggcggaggtcgggccggcgtccttcgaggagtcggagtagccgagcatgacctcgagcttgttgccggtggccttcagacgagcctgaacctcggggatcttgatcatttcctcgagcacgtccaccgagttctgcagatcctcaagctgctcgaacagcgggatcacgtcgatggtgggcacgtcctccgggtgggagaaggccaagcggttgagctcgtagacatccttgatgttctgggcgctcttggtgaaggagatgatgtagcggcgggcggccttgaggccgttgcgcttctggatggcaccgagggcgcggaaggtgtcgagcacctcgtgcgtcatcggctgcagttcgccgcgctcgccgtgcaggccgtgctcgcggatatccgcaagggcgcgggcgtgcaccacggagtgctgacggaactccatctccaccatgtggaagccgaaggtctcggtctgccagatcagatcctgcagcgggccgtaagcggaacgcttggcaccggcggcggccagcgaacgctggaccaccttgaggtcggcgaggaagtcgtcgcaggagtggtacatgaggtcggcatcgcgctcgatggtgtagtgcagacgatcggccatcaccagcatgaccgcgcggtgcatctccttggtggagatcagggcggccttgtcggtcaggcgctcgctcatttccttctggtggctccagaggcttttgagctcggcgcttggcggcgtggtctcggcttccatcgtgaggttgcggcccacggtgcgggtggcttcctcaagggcggcgatcacgtgatcggagaacttgcgggccacggcgcggctcaccttggcggtgacgttcgggttaccgtcgcggtcggagccgatccagctgcccgggtggaagaacgcggggcaagcgggctcgacgagaccggccttatcgcccaggacccagtcgtcgaagcgacggtagaccttggggatggtgttgaacagcgtgttgtcgaagatgtcgagaatcgtgtccgcttcctcaaccggggtcggcttcttcagcgcgatcggagaggtgcggaacagggcgtcgatctcgttgtagagacggcgcaggcattccttcttatccgagccgccgaggcgcttgtactcctcaagcaattcggaaacgcggcggatcttgccttccacggccttacgacgggcctcagtggggtgcgccgtgaagacggggtggaattcgagctggttgagcagttccttggccttggccgggccagtctcattgatgagctggtggtaggcgacggtgagctcgttgatcgggtcgaccgcctggtcaacggacacgttgttctcgcgctcgtggagcacggaaacacggtagttctcctcggacaggtttgccagatggaaatacgtggcgaacgcgcgggccagcagctgggcgtcgtgcaacgtcatgttgtcgatgacgttcacggcctccttcaggccatcctggtcggggttcggatccttcagctcggcgaaatgctcggcgctggcctccaccgcgtaatgacgcacggtgtcgaacgtagacagcagttcggggttgtattcgcccagtacgttacgcaggatctcaagacacagatccatgtcgtacttcaggctttcgggaagatcatgctcctccgggccctttcggccggtcccggtagtgacgatggcggcgtcagcgggagtgatctgttcttcaggtgttgccatatagcctcctttgccgaataacaggttgctcggtctaccggtcgtctgcggctcctccgcagttgttgaggccagtcgttgcgagcccacagcccatattcaacgtggttgttgtgtgggcaatagtgtatccccgcgaaatcgctatttgcgttacggagtccatatagtgcgtcaagttgtccacctatagagaccgaatatcggacagcatatgagacactgtccgattcgcggaagatttgagcaccttacgattgctggcgggggaggcagggagtagtaatgagggatgtgagcgaacagaagaaaaaaagtgcgcccgaagcgaaaggcgcaacggctgtacgtaaattccacacccactccattccgctggacatggaagatattgcgcgcgattgggaaaaaccggtggtggacgccggtatcgccgccaaagccagcgtgattgtacgggtcggcatgctggacctgggagccggcaccggctccttccgcgtgcgtgaaatgatgcaccgcatcgcctacccgctgggcgtgcacgtacgcgccgacgtgaacctgacggatatcgaggccacctgcacggatggtcgtaaccgcatcaccgaagtcgtggatttgccgaccaccggcgtgaacaccgaacgtatctggctgctggaacatttcgccgactggttctccgtgaatctcggcaaggggtcgatgtatcacgtcgattcgcaactgtccgatggcgtggtcaagcatttggacgaacgtgacgcttcgcagtattctgctgatctggccaagcgcctgcgcgaacgtgccaaggccgaggctgaggcggccaacggcagcgtggacgaggcgctggatcttgcgttgaaaaccaaggtactcgtgacctccgtggccaagtccttggatgatgacaatgaagaagcccaccgacttttggcggacagcgcggaagtcactccggtcgaagacaaagcggccgaagagaaggccttcgacgatgccgaagtgtttaccggtgactccaatgagtcggttgaatcggcgaacgcggcgaacggcgcaaccgccgaaagccctgctgcaagcagtacgaagcgcaagaatcgcgtgcccaaggaatacgccgaacacttcaacgagcgctccgacgaagagaaggccaagggcggtatcaccgtgcggcaggcgcacgagcggctcgatctgattgagcgtcgcaagccgctgtacaagccgtggttctccggtctggcttccgccttggcctgcgcggccttcgtgttcctgctcggcggcggcccatacgacatgatcggtgcgttcgtgggcgcgggccttggccagtggatgcgtcgccggctgtttgcataccatctgaaccagttcttcgtcacctttgtgtgcgtggccgcggcggcgctcgcctgcaccggcaccttgcgactcatcggcattttcgacccagtcgcgctctcgcacgatacggcctacatcggcgccatgctgttcgtgatccccggtttcccgctcatcaccggcggactcgacatggcgaaaatcgacttcccttcgggcatccagcgcgtggcgtacgtgctgtgcatcatcctgatggccacgctggcaggctgggccgtggccgtgatggtgcacctgcacccggaaggctttgagccactggggcttgacccgtgggtcaacggattgctgcggttcgtggcggcgttcgtcggcgtgtggggcttctccgtgctgttcaattcgccgcagcgcatgtgcctgaccgccgccctaatcggtgcgatcacggacacgctgcgcttggaattgcaggacttcaacgtggcacctgagatggctaccttcatcggcgcgtttctggcgggcattctggcatcggcgtggcgttcatccgtgcgacgtggctggctaccgccgcacctcggctacccgcgcatctgcctgaccgtgccgtcgatcgtgatcatggtgcccggtctgtatatgtatcgtgccatgtggtacctcggcagcttccagaccatgaatgcgctggactgggcgttccgtgcgttcatggtgatcatctgtctgccgatcggcttggcgatggcccgcgtggtgaccgacaagtcctggcgctacgacatctgaccgtcatcttggctcccctcaggtgaggggagctcggataaaacagcgtctcagtatggaagcggtggaaggtgcttgagcccttgtatccactaccatcaggcgaagtgcgttgcggccgtattcacggctgtgacggtctgtatgacgccgctccggcgtcaatcgcatatcagcacatagttctgccatggcggtagccgcttggcgtcatgattgaggaggggtcgcagttggccaacgatttctggattctgctggccatggtcatctattttgcggccatgctgtccatcggattcatctactccaaacgctccaactcctcctccaaggaatacttcgcgggcgggcgcggcgtggggccgtggctcacggccctgagcgccgaagcctccgacatgagcggctggctgctgatgggcctgccgggcctggcctacttcaccggcgcggccgacccgatgtggaccgccatcggcctggcgctcggcacctatctcaactggaagcttgtggcccggcgactgcgccgctactcggtagtggccggcgatgccatcaccattcctgacttcttcgccaagcgtttccatgacaagaagggcgtggtctccaccatcgcggccgtgatcatcctggtgttcttcagcgtgtacgtgggcagctgcttcgtgaccgtgggcaagctgttcgccacgttgttcggtttcgactaccacgtcatgatgatcatcggcgcggtggtcgtgttcgtctacaccgtggtgggcggctacttgtccgtggtgatgaccgacttcattcaaggcatgctcatgttcttcgcgctcgcggtggtgttcatcggcaccgtggccagcgcgggcggcatcgacaacaccgtggaattcctgcgtgccatccccggctacctgtccggcacgcaggtggccgcgcccaagctggacccggccaccggccagcagctcgtcgaggcgggcaaggccgtgttcggcgcgccctccgactacggcatcatcaccatcatctccatgctggcgtggggcctgggttacttcggtatgccgcaggtgctggtgcgcttcctgtccatccgcagcgtggaagaagtgcgcaagtcccgaatcatcgccacctcctggtgcgtgatttcgctgggttgcgcggtgtgcatcggcttggtggggcgcgcgatgatgcccaccgaactgctgacctccaccgatgcggaaaccattttcatcgtgctggcgcagaccctgctgccgagcttcatgtgcggcgtggtggtctccggcattttcgcggcctcgatgagctccagctcctcgtatctgatcatcggcgcttcggccatgggcgagaacatcttccgcgggctgctgcaccgcaaggccaccgacaagcaggtcatgatcgtggccagggtcacgctggtggtcatgttcctgttcggtattctggtggcatacgaccagaactcgtcgatcttccaggtggtgtcttacgcgtgggccgggcttggcgcctcattcggcccgttgatgctgtgctcgctatactggcgtcgcgccaacaaggccggcgccgtggccggcatgctgtccggcacggcggccgtgctgatctggcacaacctcgtcaagcccttgggcggcgtattcgccatctatgagctgctgccggcgttcatcatttcgctgctgttcatcgtggtggtttcgttgctgaccgccaagccgaacgagcgtatgctctacgagttcgaccactacatggacgatccgctgcccggcaccctgccgtccggcaccgtgctcgtcgacgagcccatggaagccatggagtccgaggtccgcagcggcaaatgacacgtgcctgctgtgcggtcggctcgtatggcagaggagtggcttttttgtggttcggcaggaaccattgaggccaaaacggacttcgaggggctgatttgacgttctggagaggtctacttccgtttcaaggggctgatgcctgagtagacgcggctccaaaacggcggaatggcgttggcgtaagggcattgatacacgtggtctagcggatgatcagccccttgaaacggaagtagacctccggcggaggccaaatcagccccttgaaatgggttttgaataccgtagcgcggtgcggacggtgcggactgactctaccgggcttattattcctgcgtcgtcggaataattggcagcagaggctcgaatttcagccgtttgtacagcggaatacggcgtagctttcggacatcgctaatttgctgggtggtttgccgcatcgtgagctggaccgttttgcccgtaacctcctgtatcctttcggcaactcttcgggcaagggcctcttctcccgcttcgttgccaatatctaatttggtgacttgaatgtacttccagccagcgtcttcgatcatctggcggcgtctcgcgtcattcagccattgcccggcatgatgagagccttcgtattcgatgcataccttgaattcagggtatgcaagatcgagatatatgggtctggtgttgtttcctacgaatattggataattcacctgcgggcaatccagaccgtatttcaagagagccaaacgagttcgtgtttccatggaggaatctgtgcccgcgcgcgccaaaagtagggcgcgacggcatttgttatacccgcggaacaaatacgaattggctccattctctttgtcggctcgcacctgggcctcggcctcatcgagatacagagaaagggcgtcgatggttgttctgcagagccttcgatctcgtcgcatcatggaatcagcgagaacgatgagttcttcaagttcgagatacgcggagaacatggcccatgtgcaagctggtgaagtgcatgtgaattgtccctcgattatgaccgtgtctagtgggaaaggccatacaaccactttgacccccacaatgtgccgtttgtcattggcgtgtggaaccgcaacaatggttgtagttgcaaggcctctgtgtttgcttgatatgcggggtacttcaattgacaaaagctccaacgctgttgtcagggcataaggtgggcgccatgcgcttcgtcgttgaacatctgcgcacgtctgcattcgttgatacttctgcattgtcagctcggtcaatgccgttgagctacccatgatgatcaccccttcgtgatgttcgctttgtcctcgcagtgtagagtccggctaccggccttgtctaccgccccaatttttcggtggataaatgtggataagtcggtggataaactatgggtgttcatcgcagttgcaggccatcccgcaattacatggaacgtaggggtttgcaggcagccagcgggaatcgccgccgacggtgcgattcagcttgaacgaatctccatggcgttcatgcaaaggtggcatgatggcgggtatgagtagcttggtgcgtattgtcaatgccggtgttccggggtctcaggaccacgtggatgtggtgcttcgcgatggggttgttgcgtctgtcggccctgctggaacggtctcggcttcggacggcacgatgcagactaaggcgcatacgacatcgttggcatacgcgacgaatgccattgcttctggcagcgtctcaatcccaacgtcggccgccgcacccaccgacgaaaccaccatcgacgccgacggcctgtgggttattcccggcctgtgggactgccatacgcacttcacgcaatgggctaagacgctgggccgactggacctcatcaatgcccgttccgccgccgaagcgatggacatgttgcgccgtcatctggatgagcgccgcgccgccggcacgcttgacccggatgccttcgtggtgggcatgcgattccgtcactcgctgtgggccgacgacgagcagcccacactggctgcaattgacgccgtgaccggcgaacagccggtggccctctccagcgcggacatgcactgcggatgggtgaactccgccgcggcccgcaggcttggcgtacatgtggacgaatccggtctggtcggtgaactcgaatggttcaacgcctacaccgccttcgacaaggtgccgggcgctgctgaagagactgaccgtctgctgcgcgaggccgaacaggacgccgcaagcaagggcgtggtgggcatccgcgattatgaaatggccgaaaacatcgatacgtggatcaatcgtttcgcggccggcattaacggtttgcgcgtggacgctggtgtataccccgagcggttgcaagccgccattgacgcgggttggcataccggcaacccactgccgggcagcgccgggctcggccatgtgggcgccatgaagctcatctcggacggatcgctcaacactcgctccgcctactgctccacgccgtattcgggcatcgagccgccgacgtatggcacgctgagctacacgccgcagcaaatcgaagactatatgcgcctagccgccgagcatggcttcgacattgcctgccacgccattggcgacgaagcgaacaccattgcgctcaacgcagtcgctgccacgcacgcacatggatcgatcgagcacgcgcagatgctcaaacccttcgatatcccgcgtttcgccgagctggggctcgcggccagtatccagccgcagcacgccatggatgaccgcgacgtcatcacccgtttctgggccaacccggccggcatcccttatccgttcagggccctccacgacgccggtaccacgctgcgcatgggctcggatgcgcccgtggccccgctggacccgtggctggccatttccgccgccgtgttcggcgccgaaagctctgaccgcgacccgttccagcccgagcagtgcctcgatgtgcgcacctcgctggcagcctcgaccgccactggccgtgaccgtcttgcatccggcgacccggccgatgtggtgttgctggacgccgacccatacgccgccgatactccggaagccatgcgcgctatgccgcaacacgtcgtaatgacattgctgtgcggggagcgtacgtattgatgcaagccatcggcatgaagtgaccagaggtccgtcttgatagccgcgttgcacggaaaacatgttgtgttttttgaattgagagttactaacgcttgattctccgtttcaaggggcgtatttgagcctttccggaggtctatctccgtttcaaggggctggtcatgcgctcaatctcagataaaatcccattcacgccaacgtcattccgccgtttttgtgcctcgcctacttgagcaacagcccctcgaagcggagatagacctccggaaaacaagaaatccgcccctcgaagtgaagataggacacagcagacgccgcaatgcaaaaaacgccgtgtcagttgcccagttggggctgacacggcgtcttgctacgagcggcgggaaaatcagtacttcatgcccatggcctcgcgcacctggtcgagggtctcctcggcgatggcgttggcgcgcttgttgccgtcgtgcaggatgtcacgaatggagtccatgtccttggccagctcggcgcggcgctcgcggtgcggggccaggaactcgttgactgattcgatgacgtatgccttgagtgcgccggcgccggaatcaccgatctcctcggcgatgtccttcgggtcgcggccggtcactagaccggcggtggtcagcagggcggagacctgcgggcgggcaaccgggtcgaaggtgatgcggcgctcggaatcggtcgggctcttcttgatgagcttggcggtttcctcggcggtggcgcccagcatgatggagttgccgtacgacttgctcatcttgcggccgtcgagacccggaatctccggtgcctcagacagaatggcggccggctccgggaacactgggttcttcttggcgtaacgctcgttgaaacggcgggcgatggtgcgcgtgatttccacgtgcggcaggttgtccttaccgattggcacgacgttggccttgcagaagaggatgtcgcacgcctgatgcaccgggtaggtgagcagcagaccggtcagcgcgtggccggacgcctccatctcggacttcacggtcgggttgcggtgcagctcagcctcggtgaccagggacaggaacggcagcagcagctggttctcggccggcacggcggagtgggtgaacatcatggtcttgttcggatcgatgccggcggccatgtagtcgagcaccaggttcagtacgttgtcttggatgtgctcggtggtgtcacggtcggtgatcacctggtagtcggcgatgatgatgttcgtgttgacgccgcgctcctgcatggcgacacgctcacggatcgagccgaagtagtggccgaggtgcagccggccggtcggacggtcgccggtcaacatggtgaaggacgacggcttggcctccagcttggcgagcgtttcgtccgaacgctttttggccgcgaggaagctcgcgcttatctcattgcctgccgctgtcagttgctgctcgtcggtcatgcgaaaatcctttaaatagggctcagataaacgctttttatggtaaaagtgtgagccgacaacgaacaagccactattagtggtactctctattgttgatgaatcgaacagcacagtaatcgcagggggtcagatgggccgcggacgtcaaaaagcaaaacagcagaaaattgcccgaaagctcaagtacctgaccaccgataccgattacgatgagctggcaaaagagctgagcgagcaggagccgggaacgggctctcctgacccgttcgccgatattgatgatcagtatgcggacaaggatgtggattctgctgctgacgccgacgccgccaaggtctcgcccgccgcgcaggaggacgacctcgacgagtacgccaagtgggcagccgaagccgccgcaaaggcgaccagcggcgagttcccggcctccgcgccggccgcgcccaagccgaagccggccccgcgcaagccgattccgatgcccatgccctcagcgctgaagccgaagaagagctgaacgcacgtaggcatatgtcggatatcagcgggcgggatggatcgcagcccaccatgctcatcatggacaacgaccgcatggccttgatggcattgcagtcgattctggcgaaggcactgcccgacttcgaattgttgccgccggtgagcgagggcagcaaagccattcagctgtgcacggccaccaaacgcccgcctgctgtgctattggccgatatcgcgatgaacgacatcaacggcccggatgtggtgcgtgcaatccgcagggaaaacgcgaccacggcgatactggccattaccgcctcgattgtgggccgacatgccaaagagatggcccgggccggcgcacagggcatcatgagcaagaacgatgatgtgcggttgcaggccgtggcgattcgtcaggtacaggccggcaaaatatggggcgatggtggcgacgtgcggttcgagaccgcggccgttgcgtccgcgcgcatcaaggccgagaaggacaaccggctgagcgcgcgtgagatggaggttgcggaactgtggtcccgaggccggaccatgccgcagatcgccaccgaactgtccatcaccgaaaccaccgtgcgtacgcatttgatgcgtgcggccgacaagctcggcgccggcaatctcaaggaacttatcggcgcatggattcgcatgaacctgcactgatgaaggcgccgatgggtgtgtggggacacggtagaagaagcgcaagacgcataaggggagcggcccggtgaaacgtccgattatcatttcgcggcattcgtcgtattcgtatagtcacgccgacggcaagaagcatcatcagattgatatcgatatagaactcaagcatccgctggcgatgttcggcccgatcggtgtgcttgcggtggcagccatcgtctatgcggtgaccgggtcgtggctggtcacggcgtcggcggcgctgacggcaagcgtgctgctggtattactgggcattgcgttgcgctggcgcaagcgcgtggtgaatcaggagaacgaaaacgagcagatggaatcggcgctggccgatttgcgccacggcaaccagctcgcgatcgaactgcacgacacgctgtccaacgatctgacgtatatctcgaccatcgcccggaataatctggccgcgccagccggcatcgatggtggcgactggcagcgcgtgctggatcgcagccaacgtgcctttgcggaagtgcatggcatcatcgattttctgaccgagcagagcggaatggacgccggcttccgggacgagtccttgccggtcggtggcaccgggacatctgaggtggcgactgcagaaccagggcaggttgattcgccgacgaaagaatccgccctggctcgtgacccggtaggcaccgggagctgtccagcgattgcgaatgaggtggttgacaatgccgtgcccgagaacgccggtggcgatgaccgtacgcaatccacagcgggcatgccgcagtccttcgtcacgcgtgtgaaggcgcagatcaccgataccgaggagtttctggaggcgcagggctatcgggggacggccgcggtcaacggcatcgccatggtcgtggaccccgaggcggcggccgaggcgctgtcgctgataacggagatcggcacgaatatccgccgccatgcaccggcgggagatgattcctatctgctgttcgtcacgctgtctcccgaatggattgagattcgtgagaccaacgatatccgtgacgatgccgacgcgcagagtggcctgtccgcgcaggagctgtcggggcgtgggctggccatgcatcgcacccgtgtgcaggagttgggcggtgaattgaccacccgttcggatgatggcacgtggatgatttacgtgcgtatcccgtgcgtgcggggctgatggggcagaagctgcgatgtccggcgtccggcgctgattgtgccctgtcctcacaaatgaggacgacgaccgcagccatgtccccataaccgaggattgcgggtgttcggctcggcggcggctccctatggtggcgtccataaggaccaatcccagggagggcaacgatggcaagtgatacggaattatggcggggaactgattacggatggtggctggctgcggacacgtccggtgcggtcggtgccagtctgatcgcgttcgcggtgccactgatgatgctcgccacgacaggatcttctgccgccgccaccacgacggaaagcatctgcgtggtggtgcagacggtgctgggccttgccggcggcgtgattcaggaccgatatgatcgccgtacgctcatgctgatctggggtgcgtccggtgtggtgctctcggcggtggcggcggcagcggtgatgctgttcggcaatgcgccgaagacgagcggccatggggttaacggggcaaacgctccggcattcggcggaccgtatgcccacgtgcttccgatcgcgctgctgtgtatcgtcgtgctgttttcggtgcgcgatgggctgttggagaatacgtcgaatgccatgctgcgtggcgtggtgccggatgagcagctaccgcacgcgatggcgttgaatgatgctcgtgattcgacggtcacgttggtgggtggtccgttgggcggtctgctgatgaccgtgggacatgcggtgccgttcctgaccagcgcggtgctgagcgtgctgggcatggtgtccgcatggcgtatccgccgctattggaaacgtgcgactgtgagcgatagcggccgtccgggcaatgttgataccggttcggaggtcggggccgtctcggacgccgatgatgccgatgactccgccccacgctggcgcgacgcactggacggcatgatctggctgctgcgcgaccggttccaacgccatctcatcatcgcagcggccatggtgaccggtgccagcaatgccttcctgctgctgaccgcgctggacatctcccaaggtggcagccagctgatatccgccggattcatcaacgccgcctccgccgttggcatgttgctgggcgcactgatggcctcgcaactggtcaaccgtgtgcccggcggcgtactggtgggcgtgatgttcgtcttgctggctgtaggattcaccggtgccgcgttggtgccctccatggttggcaaggccatatttgtggcctgctcggtactggcattgcccgcgggcaacgcggtgcttggaggcctcagcaataccttggtgggcaaggacaagctcggccgcgttggagcgggcagcatggtgttgcagtacggtgcctatggcgtggccgtggcactcgccggctggggtatgcagaccatcggctatgggccgacctgcctgattctggccgccgtgctggtggccgccgccgcttacgcgctgacgatgcgcagcctcgtcaccctacccacgccggaccgctgggccgagcatatccagcgctggggcatcgcccagttctgatgggcggcctgcggcggcgattacagcggcagcaggtcgcttaggtcgtcgcgctcgccgaccgcgctgatgtggccggcgtccttttcctctgcccacgtggtgatgccgcaggccagtcgcagccagacttccggctccaattcgatgacgtccggtggggtcaggttatgcgggtccgattccggtccgtccagaatcttgaccgcgccccacggcgcgacgcgcacctccacgcccggcccgggcgcgcgccgttccagcaggaacagcgagtagcgcacagccatcgcccataccgggcgcggcagaatgggggaggcggtcaggcgatgtggcgtgttgtcggccagttccagggctgcggcacgccattgcaccagtgcgtcgtgccctcgtttcaagtctttttcgagaattactgccatatgctccatcatggcaccggatccggaagatcttccgtaatgcaaacgatggcatacggtgtgatgcggaactgtgagacatgtgatacgcttctcgatgagaacgtatgcaagagcgctccgccatcgtcgttacggagagttcatgcttacgtttgtgagacgatacctatcgcgcggcataataattacgggcacttatcccggaaggaaagtcagaatgaccgaaatcaccgcaccgaagtctcccgtcacggcggaacaattcgccgacgagattcgtgaacaactgaaatacactcaaaacgtcaccgccgagcaggccacccctgctgacgtgtatgtcgccgcgtccaaagccgtgcgcaaccacctcgccgactcctggttcaagacccaggccgacaccgtcaacggcaacaccaaggccgtcggctacctgtccgccgagttcttgatgggcaagcagctggagaacgcactgctgaacgctggcctgaccgaccagttcgacaaggctgtggaagcccttggcttcaagccgaaggacatcgtggacgccgaatacgagccgggcctcggcaacggcggccttggtcgtctggccgcctgcttcatcgactccctcgcctcgctgggcgtgccggccttcggctacggcatccagtacaagtacggcatcttcaagcagaagttcgacgagaacggcaagcaggttgagaccccggattactggctggccaacgaagagccgtggggccacaccgactacaaccgtgatcagaaggtctccttcggtggcaaggtcgtcgagaacgccgacggcaccaagacctggcagcccgcatggtccgtgcgcgccgtgccggtggactacctggtccctggctacaagtccggccgcgtgaacaccctgcgcctgtggaccgccaagagctacgacgagttcgatctgctcgccttcaaccgctccgagtacatggacgccgtggccccgcaggtcaaggccgagaacatctccaagattctctacccggaagactccaccaaggtcggtaaggaactgcgcctcgagcagcagtacttcttcgtctccgcatccctgcacgacgccatccgcgtcttctacccgggccaggacaagccggacctgacgaccttcccgaacaagatcgtcttccagctcaacgacacccacccggtgatcggcatccccgagctcatgcgcatcctcatcgatgagtacggctacgactgggataccgcgtggtccatcaccaccaagaccttcaactacacctgccacaccctgctgccggaggcccttgaggtctggccggccagcctgatcggcgagctgctgccgcgtcacctcgagatcatcgagaagatcaacgcgcagttcgaggccgagctcaaggccaagggcgttgccgccgacaccatcaaggacatggccatctacactggcgacgccgtgcgcatggcctacctggccacctacggcggctcccacgtcaacggcgtggccgagctgcactcccagctgctgaaggacgtcaccctcaagaacttctccgacgtctacccggacaagttcaccaacgtgaccaacggcgtgaccccgcgtcgcttcgtcaagctcgccaacccgcgcctgtccgacctcatcaccgagggcctgggcaccgacaagtgggtcgccgatctggaactgctcaagggtctcgagccgctggccaaggacgatgaattcgtcaagaagttcgccgccgtcaagaaggccaacaagcacgcattcgtgggcttcgccaaggaccactacggcatcgatatcgacgagaacaccctgttcaacaccatggtcaagcgtctgcacgagtacaagcgccagtctctgaagattctcgccgtgatctccaactacgccgacatcaagtccggcaaggtcaaggccgaggacatcactccgcgcaccgtgttcttcggtgccaaggccgctccgggctactacctggccaagatgaccatcgagctgatcaacaacgtttcccgcgtgatcagcagcgatccggccgtcaagggcaagctcgccgtccacatgctgccgaactacaacgtcgagatggctcagaacctcatcccggccaccgagcttgacgagcagatctcccaggccggcaaggaagcttccggtaccggcaacatgaagttcgctctgaacggcgccctgaccgtgggtacgctggacggcgcgaacgtcgagatccgtgagcgcgtcggcgccgagaacttcttcctgttcggcatgaccgtcgacgaagtcgagaagaagtacgccgagggctacgatcccgcctcctactacgaggccgatccgcgcctgaagcaggccatcgatctggtggccgacggcaccttctccaacggcgaccgcaacgcctactccccgctcgtggccgactggctgaccaaggactggttcatgaccctggccgacttctccgcctacatgggcatccagtctgagatcgaggccctctacgccgatgagctcgaatggaaccgcaaggccctgctcaacgtggccaactccggctacttcagctccgaccgctccatggaagactatttggaacgtatctggcacactgctcctctggccgactgagtcggtggggcggttcccctcggagaggggaaccagaacataagaagccccgcaaccgacatccatcggttgcggggcttcttgcgttgaaagaccgccctatcaggcttcggccggggcggcttccgcctcgccatcggcctcatcctcggccttgttcagacccaggtcgaccggcgaggagctgttctcccacggctcctcccacggatcgtaatctgggttctgctgcttgtagatgtacaagccaacaagcgcggcgagcaatccgccgaacagcagcgcgaagaacttccaaccgttagaagacttgttctccatgacggctcctttccctagggatcgtctggtcggtatgcccattcagaccgactctgctccctattctaggccgctgtttgtgacgattgggtggaatgacattcgtgggcgattcatccacgcccgcatgccctcggtcggctcagcatcttcgcggcgcgtggaacgcatccgagaccttcgatacagtggactgcatgcatattcctacacagcgggagattcgataccagtgggagcgcggtggtccggtgatgacctgggcgctgattgttgcgtgcgtggcagtgtggctactggaggtattgctgggatttattgccccgggcctgagggcttggttgatgtacctcggcatggcggctccggtcagactggtggctgagccgtggacgctcatcacttcgatgttcctgcatgcgccgaactcgctattgcatatcctgttcaacatgattgccctgtattccgtgggcccagtgctggaacgaatgatcggccactggcggttcttgggactgtatgtgatttccggccttggcggctctctgggacttatgttgtgggctgcggtggctccgggaggcatcggctggcagatggcagcctatggggcttctggagccttatttggcctgtttgcatcattgctggtggtatatcgccgtatcggcgccgatatccgctccatgttgatctggatggcggtgaacttcgccttgccgttcgtggtcggtggcgtggcgtggcaggcgcatgtcggcggctttgtagtgggtggaatactcacatggctgctggtgggtggtgtgccggcgtggcgcggtaaaagcctgaaatggcgcatgcaagtgtacggctgggtcatggtggtgctggtcattgcgttgattctgttgtgcaatatggccaatccttatgggtggatgagtttcggctccctgcactgatatggcttgatatggctgtaaaaaacgattgatgccgggtattgcggaacatgcagtgcccggcatcagtgtatgtgcggaaagcggcgatgtggatatcgtcgttcggtgagtgggtgtgtgccgtatgaagatatccacagtaatgagatgcgcgcaatgacgagttatccacaatggtgacttgtgcacaagtgtgtagaaaagtgcataagactgtggataacttatgtggataagttaggaatgccacggtattactgggtttgttgcagtggataactcgggtgtataactgttccctcgctgtggcgatgtatgccaagccaaagttatgcacgagatatacaccgagaaacgccgcttatccaccacttatccacatggttttccacattcggtggaaaactacatgggtgtgattcatccacaggctgtggataacgtagtggataagtcgtggataagtggtggatagctgtggatgaacaggctaaggcacgaaaaaggccggcctccgcatacgggaggtcggcctttcgtataagaactaagaacaacctaacgatagaaaaacgatctaccgatagataagcgcaacgagtcggaactcagcgccatcccatcgtcatcaggaatccgatcatgatcagggcgaagccgatgcccaggttccatgcgccgatgcgcggaatcggccaggagccggacggggaaaggtagtacaccacgcaccagatcagaccgatgatcatgaacgcgcagaacagcggcacgaaccaacgcggattcgacttggtgcccttgatggtctcctcgacgcgcttggtgttctccgcctgacggttcatcatgcgctgcatctgcggggtcagcgtggccttatcggcagtggcgttgagcacggcctgcacctgctccatattcacgccgtaagccgcgtcttcctcggcagaagcgttctctgcgttctgctcggtgtctttgttggcggtctcgtcagcagcggtgctggatgaggtctcgctctgccagtccttctggttgttcgagtcggtttcgtgcagctcttcgtcagccatcagcatagtctccattcaataggctaaaagtcataatagtggctacactcgaaagcggcgaccagagtcggcaggaagacgggaaattcatggccaggcatatcggcaagcatggcgcacggcgctccctgtggggcggcgtcgcggtgttcgtcgtcgtcgccctgaccggttttctgctgagcaccaacgtgagggtcaaccgcacggccgacgtcaccagcgatacggccgatctggtggagcaaggcgtggacgaggccaaccagctgcagcaggacgtcagcgatctgaccgaacaggtcgccaatcttacggacgcgctcaaggccgatggcaccgacggtactgacagcacgcagaaccaaggcaaggactccagcaatgtggattccagtctgatgctgcccgcgctcagcggcagcggcgtgacggtgaccctggacgactccccgttgtgggagaacgccgtcaacaacaatggcacgaccgccaatatcaacgattacgtgatccaccagcaggatgtcgaatcggtggtgaatgccttgtgggccggcggtgccgatgcgctgatgattatggatcagcgggtgctgttcaattcggcggtcatctgttccggcaacgtgctgtcgttgcacggtaagaaatactcgccgccattcaccatttccgctattggcgacccgcaaagacttcgcgcagctttgaacgactccgaagccattaccattcttaagcaatatgtgaccgcgtttggcattggctacaaggtggagaatgccgaggaccttcagttccccgctaccgccgccttgctgcagcagttgaaatatgccacggtcgatacatcaaagaccacagatgaggagcagactcagcaatgagacacggcaggcacaacagcggcgcaccggcgcccattgatctcgcgtccgtgtcggacgtgcagcccttccccgaggacgatgccgcacgaatggtggcagacccggccaatgccagtagggcaaggtcccgtcgtaccgcagtacgcggcgcgtcttcgccccagcggagcctggtctggcaagcactcggcatctgcgccgaactgctgattaccgctgccgtgatttgcgccctgtacatcggctggcagatgtggtggaccggtgtcgaggcggagcgagcccagaacgaaaccatccagtccgtcgactggagcgaccccagcaacaacgggggaacggtcaccatcgccaaagcccaggagggcgatgcgccggtacagccgaaagacgcgaaatatggcgacttgattgcgcagatctacattccgcgcttcggctcccaatggcaccgcaacatcgtggaaggcaccacgctcgagcagctcaatcgccacggtctgggccattacgacaccacccagatgccggggcaggtcggcaacttcgccgtcgccggccaccgcaacggctacgggcagccgttgggcgatgtggacaagttgcaggaaggcgatcccatcatcgttcgtaccaaggattactggtacgtctaccactacacccggtacgagattgtgctgcccacggacatgtatgtgatcgcccccaatccggaagactccactgccaatcccaccaaacgcatgatcacactgaccacctgtgagccgaaatactccacccccacccatcgatggatcagctatggtgagttggcgtactgggccaaagtgtctgatggcgtgcccaaagagctggctactactgattcgtccggtgcagtgaagttctccaccaccgaaaccccctcgatcgcttcccgcattggctcgctggacaaggtggtattcggcgcgctggtagtgtggctggttctgttcatcgccgctgcggtggcatggcgctggccggtgctgcgcgagattcgcgcgggtgagcgtcgccgcccggatgccagcatctatggcggactgttgcgtctgcagcccggcgtggcaccgattcgatggctgctgctggctctgctgttgttcgcagccgccgcggcgctgttccagtggggattcccttgggccgccgccaatatcccattcctacagcagatgtcgaacttcgtggcagtgagctgacggcagcctagtactatgtcttgcagtacacgtccctcaaggagagccctatgaccgattccgcgcatattttggtggtggataactacgattccttcgtctacacgatcgtaggctatctgcaaacccttggcgccactgttgatgtggtgcgtaacgacgctatcgacccagccgcgccgggtgtactggacggttacgatggcgtgctgatttctcccggcccgggcgccccggccgaatccggcgccagcgaggacatgatccgcctgtgcgcggccaccggcatgccgatgtttggtgtgtgcctgggcttgcaggcgctcgccgaggtgtacggctgcacggtgggccacgcgcccaccatcatgcacggcaagaccagcccggtggagcatgccgatgacgagatcttcgagggcgtggccaaccccatgaccgccacccgctaccattcattggccgttgagcccgattcggtgccggatacgctggtggtcaccgcgtggacgcaggatgaccacaccattcagggcatcaaggtcaaggataagccgatgtatgccgtccagttccatcccgagtcggtgatgacccaggacggctaccgtctattggccaactggctgagcgtgtgcggccaaggcaacgccgtggccaagtcggccggccttcagcccaaagtcacgaagtagcagccgtctacttgtcgccgcctgggccggtgcctcctgtgctactgctgccgccagcgttgccgttgccgttgccgttgttgtcgcctgtgacggcggccttcgtggtgatggtgacggtcgagcccacgtcgacctgggcgccggcgccgggatcgatgccgaccaccacggcggtggggtcggccggaccgttggcctgggccttgaggccgacggccttcagcatgagttcggcggtggcatatttagtgcctgcggcgatattcggtacagcgaccttctccttgcccgtggacacccaaatggtgatggacccgccctgtgcgatagaagagcccgaatcaggacttacacgggtaatcagaccggcctccaccgtatcggagctctcctgctccacagtgaagctgaacctgccctcatactgctgtagcacgctgtccttcgactgaccgaccaaattgctcggtacggtggtcatgccggaagaaacatatatggtgatggtggtgcccttgggaaccgactggccggcggcaggatcggttttcgtcaccatatccttggcgatgtcggcgctgtcttcggttctgacggtggcattcaccttgaatccggcgctttccagaatgctgcgcgcctcttcctggctgcgttccttgacatccggaacctgagtggactgcgggcctgcggagaaccataccttcaccttcgaccccttggccaccttggcgccggcctccgggctcatcttggtgcaggtgccctccggctcggtggagtcggtgtcctgcttgccgaccatggtcaagcccaatgtctcaagcttgagcttgatgttgtccttggaggtggaggcgttgcacacctcgggtatggtgaccttgtcttcggcggacttgttgggcgcgccgctcatggcgaacacgacgcccgcgccgacaagggccacggcgagcaccgcgatcaccgaaccgataatgatcttcttgcgcttcttggccttggccgccgccgcacgctgctgcgcacgggactgcaacgccgctgagttggcaccattggccggtggaatctgctcgaactgaccggtcaccgggttgaatgcctgggtgggctgctgctgcggttccaccggcgtggtgggcaaatcacgttcggcttccttgcgggccttcatattcgacaggtccgtcaatgggttgaacgcggccgccaccggtacgccgccgttcatgtaggtcaggatgtcggtcttgaactcggaggccgtggcatagcgattctggcggtccttggccatggccttggcgcagatcgaatcccacatcttcggcagccccggcaccacggcggatggcggcgtggcgacttcggaaacatgctggtaggcgatggccacggcggaatcaccggtaaacggcgggcggccggtgagcatctcgtagagcacgcagccagcggaatacaggtcggaacgcatgtcgacggtctcgccgcgcgcctgctcgggagaaaggtactgtgcggtgcccaccacgccctgcgactgggtcatggtggctgcggaatcgtccagagcgcgggcgatgccgaagtccatgaccttgaccacgccctgctcggagatcatgatgttgccgggcttgatatcgcggtggataatgcccatgcgatgcgaatagtcgagcgcgttaagcacgcccaacagcacctgttcgcagtcgcgctggctgagtgcgccgttgaccttgatgatgtcgcgcagggtttggcccttgacgtattccatgacgatgtacggcagacgctcggtatcgccgctttcggaagaaaccagttcttcgcccgaatcgtagatgttcacgatgttcgggttgttcatctgggccacggcgtgtgcttcccggcggaaacgggccaggaagatgtcgtcgttggccagatcggcgcgcatgattttcacggccacggtacggcccagacgggtgtcaagggccacgtggacctcggccatgccgccacgaccgatgagctggccaagctggtagcgtccgccggccaatgcggtgggcatactggtgctcattgcttattccctcccaatcttgaggccggggcctccaaaacaatgcgtggcgtgctggtcactcggcgcggcagtcgattgccggacgtgaccatggcggtgtcggccatttcggtctgctgatccagcagacggcgttcgatgcgtgccagcgtgcgggacaccaccagcgcgtcattcgggcgatccaacgggtccttggccagcattgacatgacaaattcgcgtaactggacgtccaccgagtccggcagtggaggcacgggattgttcacgtgcgctgcggcgatatcgaccggagtggtgccggtgaacggacgctgcccggcaaggccctcgtacgccaccacgcccagtgaatagatgtccgattgcggcgtggcctgctggccctgcgcctgctcggggagatgtattgtgcggtgcccaccaccatgccgtcctgggtgatctggccttggccggtggagtagctcacgccgaaatcggtgatcttcacttcaccggtgtcggagaccatgatgttggccggcttgacgtcacgatgaatcacgccgtgcgagtgggccacgaataggcctcgcgcggtctgaatcagaatgggcagcagttcgatgggatccatcgcgcccttgctgtggaacagatccgccaacgatttcgaggggacgtattccataatcagaaagccgatgccgtcatgctcgtagtattcgaacaacgcagcgatattcgggtgcgccagattggcggaattatgggcttcggcacgcaggcggcgcagcttggcctcggcgttggtcacgtccgagcgcagcgccttgatggccacttcacggccgagctgaatatcgtagcctttccagacctcgcccataccgccttgcgcaagacgcgaatcaagacgatatcggcggtgaataagctgtccttcgataagtttcactgctgcaaagcctcctgcatcatcgcgcgcatgatcgggccagcggcgagcgaaccgtatacatctgtgttatgcaccaacaccgcgacggcgatctgcggatcgtccgccggcgcgaaaccgatcacccagccgtcgatggcagagttgtcggtaccgatttgtgcggtaccggttttggccgccaccttgatgccgtcgatggccagctgcggattggcctcggtcaccacgctttccatcatcgtggtgagcttgtctgcggaatccttgttgaacgcattggccatggtttgcggtttggtctgcgaaagtacggtgagatcggcggcgcgcacacgatcgaccagcgtgggctgcatcagtttgccattgttggcgattgcctgcgcgaccatcgccatctgcaacggcgtggccgtggtgtcgccttggccgatggatgccagcgcaagcttgtcgtcggtcggatcagaggggaatgtggacgcggtggccgtcatcggggtgcccgtggattcggtgccgtcaatggtgatggtgctgccaaacccgagcttggtggccatgtccgaaaccttgctcgcgccgagtttcacgccaagctgggcgaacgcggtgttggacgaccacgcgacggcctcttgcagggagatctgcccgttgacgccgtcggcctgatgctcggcgttcggcagctgtgtggcggtgccgggcagcgtgtagccggcgcctgcaggaatcttcgtgtccgtctgatattcgccggtttccagcgcagccgaggcgacgatggtcttgaacgtggaccctggtgggtacagctgcgaggtggcgcggttgattagtgggctattttggcccgcagaaagttcgttgtaggcctgagacgcggctttggtgtcatgggtcgccagtttgttcggatcataactgggcgtgctcaccatggcgaggatacgaccggtgctgacttcgatggccaccgccgcaccatcgcgcgtaccgagctgatcgtaggcaacctgctgcagcttggggtcgatggaggtttcgatggacgcgccctgattcgtagcgccggtgagcatggccttggcccgctgccagatcaatgaatcggcctcaccgttgagcagcatgctgcgggaggcttccaggccgcgatcggcggtctggttgatggagaagaagccggtgaccggagcatacagcggaccgttggaataggtacgcaggtatttgaatgcgtcgttgaccggctcggatttggccatgaccgtgccgtccgaggccaggatggcaccgcggtaggcaccgagctggtggtacagcgaacgggcgttgcgcggatcgttgttcagcgcgttggcccgtaccgccatgatgatggtggacgacaggccgagaatcacgaacagcgcgaccacggcggtgaaaagctgacgaagatatttgttcatacgcgagtgcctccgttaacgggaggaagcgggggaatcgtgccggtaggcgtgtacggttcatcggcgccggtatacgacggagtggtggtatccacaatggggtcgtcaaacgattccgactcggactgcgacgccgtagccgacgcgctgcgaggctgaacgatcggctcagtggcgcgggccctggcctcaagttccttgttgcgcagcacggccaaagcctcgtactggaacgtatccgaggtcagctccggctcgggcgcattggccgagttcgagatgatgatgagcagggtcgcgagaatatagttggcgatcaggctggacccgccggccgccatataaggcagggtcaggcccgtcaggggaatcaccagcgtgatgccgccgaccacggtgaacacttggaacgccatggtgaacaccagtcccgaagccagcagtttgccgaaaccatccttgattttcatggccgtgatgaagccggaggcgatgatgagcaggtacagcatcagcatggccagcacgcccatcaggccgagttcctcgccgagcgaggcgtagatgaaatcggagttcgcgaacgtgacgcgcgagggatgcccctggcccaggccggtgccgagcatgccgcccgccgccagtccgaatatgccggtgaccagctgccaggagccaccgggggtcttgttgtattgctcattgctgaacgggtgcagccaggcgtcgatgcgctgacccacgtggctgaacgcgccggcggccagcacggcgcccgcggcgaacgcgatcagaccgatgatgatccagcttttccggccggtggccgtgtacagcatggccacgaacatggcgaagaacatgagcgaagtgcccaggtcacgctgcatgaccagcacgcccatcgaagcgatccacaccacgatgatggggccgaggtccttgatgcggggcagttgcagccccagcaccttcctgccgcccacggccagccggtcgcggtgatcgaacaggtatgcggcgaagaagaacgcgaggaacagtttggcgaactcgcccggctggaactggcccaatcccggaatcctgatccagatgcgcgcgccgttcacctccatgccgatgaacggcagcatcggggcgagcagcagcactaggcccaccaccatcgacacataggagaagcgtcgcagcacgcggtagtccttcaggaagatgatgagcagcgcggaaagcacgatggcgatgcacagccacaccagctggcgttgggcaaccgcccagccctcgctctggtcaatgcgagcgatcatggtcacgccggtggcggtcagcagtagcacgcaaggcagaatcgactggctggcatacggctggaagtgtacgatcagcccccacagcaccagaaacagcactacgaccaatgccagcatgccggcgtattgcatagggaattcgccggcggtgcgttggaacatctggatgaacgccaacgcactgattgccatggcaatcagcaacaaggaaatctgacgtagacgggtagcgatcatcgtgcatcccccgtggccgcgttgtcggccgctccgataccggatttatctgaggaatcggatgagcttgacgaaccggacttgtctgacgaggagccggactggctggacgaatccttggtgctgtccttggaatcgctctgggaactgtctttggaactgtccggggaattggacgcctcagccttcttggcgacgtcggcttcctgctgcttggccagtttgcgcatttcggtgcggatgatgcccacatgcgactgtgcttcgtccagcgaaccgaccgtgatgccttggctcagttggtcgcgccatgattgcggcagctgcgcgatggcgatgtcggtggtctcgacttcgtgcgaaagctcaagcccgaaaagattggtcggcacgccacggtagatggccaccgtgccgttggcgttgcccacgtaataatgcgcctggctccacgtgtacgcgccccagccggcaccggccaacgccagtgcggcaagaatgcaggcgacgatcacggcgagcctgttgcggcgtttcctggtgcgtgtgaccttcttctgctcgatctgctcgtcgcggatggccttggccacgtccgggtcgttcggatcggcggacaagcgcccgtccggcttctgcaccaccggaatctcaccggtatcgggattggcccgctcgccggtctcctcgcggaccgtggatggctggaccacgcgcgcggacgacggttcggccgtggtctgcgcgggctccgcctcatgcgcgctggctggctggatcagcgccgcggcgcgttgtgcgggcgaatcgtcctcgcgcagcgcgggagcggtggccaccggcgcgttgacgatgtccgcaatcggctcgagattgcggctggcggcgccgccgaccaacggcgtttggtggggcaggtcgaacgcgtcggcgtccaacgccaacgtggcgtccgcgatgacggccgtgacgttatcggtgctgcccgcccgcagcgccatctgcaccagacgctgcgcgcattcgccctgatcggacagcgcggtcatcgtctccgcgatggtggagtcctccagcacgccgcacaggccgtccgaacacagcagccagcggtcggcgggatgggcgcggcgtatggagatgtccgggtgcgggtcgatgtcgaagtcgccgagcacacgcatcacgacgttgcgctgcgggtgattcttggcttcggatggggtgatacggccggtgttgatgagatgctgcacgtagctgtggtcgcaggtgacgcggcccagatgaccatcgcgcagcagataggcgcgcgaatcgccgatgtgggcgatgatccagtagccggccaccaacgccaccgcggtgacggtggtgcccatgccggcgagtttgcgttcgcgcttggccttgccgacgatggcgtcatgcgcggccatgacggaggtctccatcatatgggcgatcaccgcgacatcgccgtcggtgtcgtcccgttcgatgtgggccagcgaccggatggcgatggaggatgccgtgtcgccgccggcgtgaccgcccatgccgtcgcagatggcgatgagatgctcgccggcgaaggaggaatcctggttgttcgcgcgcacggtgcccacatcggacaccgtggtggaatacaggaacagcggttgtgaagcggcggattttggcatgcggctacctcagttcgaaggtggtggcgccgatgcgcaccgggatacgggcgggcaggatggtgggacggttgatgcgctgctggttgaccacggtcccgttggtggagttcaggtcctcgatggcccactgcccggaacggatgtcacggtacacgcgggcgtgacgggaggagacgaactcatcgtccagcaccacggtgttcgaggcggcgcgcccgagcgtgatgtcggcgtcggacaacggtacggaactgccggcgagcgggccgtcgatgatgacgagcagggtgggctgcgccggagcggcggatgccgcgcccgcatgggaaccgcgatgcgggcgcggcgcctgcggcggctcggtctgggttttgtgcgcttcacgttcacggcggcggcgtgcacgcgagggccgcggactgaacgtctcgatgtccttgcgcagcgaacgcacggccagccagatgaatatccacagcaggatcaggaatccatacttgagcagggcgaatgtcagttcagtcatgggtggacggctttcgggcgtgtgctcgactactcctgggcttgggcggaggcccaatacaggatgcgggtgcggccgatggtgatggtgttgccgtcgagcagcgtggcggcgggcacttggtggccctccacgtacgtgccgttggtggagcccaggtcgcgggcgataacgccgttgtcggtgatgtcgatttccaggtgcttgcgggagatgcccggatcgtcaatgacgatatcgcaaccggaaccgcggccgattaccgtcttgtctttggtgagcaggtactggttgccgttcacctcgagcactgggctgtcctcggtctgcgcatcggtggtgaccggcacggcattgccttgcacggattcggaggtgaggttgaagttgcccttggacaggtcaaggtcttcctcgaagatcacaatcaccgggcccacgaaggcgtaatgctggctcttcgcgtactcggtgagattgtcggccagctcattggccagggtctcgctaccccatgcctcgatacggtcgaagtcaggagtactgagcttgaaacggtattcattcggggccaccgtgcggtcacggcccacgggcatggcctcggcgtcaatctcgcgctccaaggcgctggaaagatcgacaggctgcaggtctttggagccgaacttggcgaatactccgttgactgcaccctccacgcttttttcaaaacggtcgagaacgctcatagtcctccctttctaatcctcacccatcctacgcggtgatgggaatatgaggcaaaaaaccggtcttctgtgtggcgatgagtgcaaaatatccaaaaatatccaagaattcagggcggaaatgggtgcggcgcaccacctgcgccatttttccgcatgccgtgcgggtgcgggccccgggcgtgccgcggacgtcacggcccacggcacgcccgagaccggtcaggccagggcgtcgcgcaggaagtcgcgctggagggtgagcaggttttcggccacggtctcgtcgttggtcatgtgggtaatgcccgtcaacggcaggaaggtgtgcgggcgacccgccgccatcagagcctgcgagaggcgcaggctgtgggcgatggtgacgttatcgtcggcgaagccgtggatcagcataagcgggcggacgagtcccggcgcatcctgcacgatgccgttgcggcggtacacatccgggtcgagacccagatagcgctcggtgtagtgcgtgtcgtacagcgtccagtcggtcggcggggcgccggcgcatgcggccttgaacacgtctggcgcgtccagcacggccagtgcggacaggaagccgccgtaggaccagccgatcatgcacaccttgtcgaggtccggcgcgggaacgccgggcctgcgcccgtcggcattgagcctggagacggcctcgggaagggcgttgacggcttcaatctggtcggccagcgttacgtccttcatatcctcgaagatctcgcggtcccatgccgggccgcggccggtggtgccacggccgtccgccgtgaccaccaggaagccctggtcggcccaccactggccctcccaatagaaggactgcgaggcgacgacctgctggaacccggggccgccgtaaggcttcatcagcaccggcagtttgtcggagtgcgcgtacgggctggacgggctcggcgcgatgatcgccgtgtacagctggtgctcgcccagtcgcgtaaacgtgacgttcggtgcaaagccgggttccgccgccgtggacgagatagtggcgctctgttctcccagaatatgccgcatctgggcgcgggcggaacgcatatcgcggccggagaccacgatgccgcgctcgccgcgcgaggcggtccactggccgggatcggtcgtgaccggcgtgatcgtgccgttgtaatcgatactcaccacatcgaaactgcgggcgtcgtggccgccgaacagagactcggcatccgaagcggcacccgagccggtccaggcgtccggcacctcagatgcgatttcgggcgcacactgcaccacggccagcacgtcgtcgtcggtcacgtcgagcaccgagcgcacgttccacccggccggcgtgaacgggcggccgtccaccgtcagacggttggtgtccgcggccatgtcgttgagcgggcacaccagccggccatccggcgtgtaggtgggcgtgccgtgaatcaggtcgatccactggtcgttcgcatgctcctcaagcacacgcgtggcacccagcgcggccccatccgccgcgaccgccacctcgagcacctggtcgcgggtctggcggcggttctgcaccagcaccagtggatcgtggccgcgacgccagttcacggcggccacatactcatacgcctcacgatcccaatccacgtcggcgttgccggtgatgcccgcgtaccggccgtctccgtcgaacgccagggcgatcacggtcaggtacacgtcggcattgcgggtcagcgcgcgcgggtaacggcggccggcggccggattctcggggtcggccggatcgctgatgtaccaggtcggctcgtcggcggtgtcgaaggactcgaacagcacgtgctgcgaatccggggcccaccagaagccgtcgtaccggtccatctcctcgccggccacgaactcggccagaccgattttccacgtgttttcggccggattgccgtcctcatcctccacgctcacgccgtagacggcggtgatgcggtcacctagctcgccgccgatatcgaccagcatcaggtagctgcccgtggtgtacagcacatgttcgccatccggggcgatgcgcgggttcagcaccggcgtgtacatctccgggtcctcatcgagccattcgccggccagttcgcgggtgtgcggctcgggtgcgccggtctcgtcattccaggcgatctcggtcaggaacaggcggccgttgatggtgaacacgatgcgattgccgtcatcgtctgcggagtagccgacgatgccggtgccgccttcgcgcgcacgctcgcggcgggccttctcctcggccggcacgtcctcgctgtcggcggttgcgcccaacagttcgcgcgggtcggccagtttggtctcatggtgttcgccggactcgtcgaaccagcttagccacagtgcggtcaccagatcctcggggccgtcggagcgcaggaacagggcccgcgagccgtcgcccacggtctgtgcggagcgcggtgcgccgcagccgaaccgcagcgtgcgcgccctgaggcgtgggaaatgcttgattgcgtcattgacatcattggtttcgctcatacctcacaacctacgcgcctgtgcggtcagcggcgtgaggcttgtcctaagatgggaaccatgcaggtgacgatgatcgacgaaaacaagtacgccgaaatgatggccgacgtggtgctgcccgcgctcgaacaatgccgcgaggagggctggttcgatccgtccgccgccgaacgttcggccggggtcgagccgctgtccggcattatggacaccggcggccgctcgggccagctgcactacctgtgctacgattccgccaaattcgacgcgattcgcgaacaaggcgccaccgccgtcttccgcggggccatcgtcatcagccacggcttcaccgagttcgccgagaagtacgacgaactggtctggtacttcctgctcgccggctattcggtgtgcgtgctcgaacatcgcggccacggcaagtccgcgcgcgacgtggacgatcattgcatggtgtggatcgatgattggcggcgctacgtggccgatctggccggcttcgccgaaaccatcggccagcagtacgcggccggcatgccgctgaacctgttctgccattcgatgggcggcggcatcggcgcggccctgctcgaacgctaccccgccctgttcgacaaggcggtgctctccgccccatgatcgcccccgccaccggcatgccgttgggtgtggcccgtgtgctggtcaatgcgctgtgcggactcggcttcggcaagaagcgcgtgttcgggcagtcggacttcacgccggaattctccatgaaaggcaacgagggcgcgtccgaggcgcgtgaacgctggtatttcagactgcgttgcgaaaaccgtgaataccagacctactgcgcgacgttcgaatgggtgcgtcaggcgctcaagctcaaccgggccgtgctgcgcccgtccgcctgcgccgaagtggagacgccggtgatgctcttccaggccggccgagacgtgtgggtgctcaacaaaccgcagaaccgtttcatccaactggtcaaggacggcggcggcgaggccgatctcgtgcggttccccgaatcacgccacgagatcttctccatgcccaacagcacctacaagccctacctcgaaaagatccttggcttctacgacgatccgacgatcgccagcgccacgtactgagcgccgctgtacccatccgatgggtagagtggcttgcggaacaaggcgagagaggcggacccatggcgaacggcgtacggcacacgaaaggcgcaccggcaccgcagaccggctggcgaggcgggcacgtcgtatccgcgcgcgccacgaccatcggtctgatggccatcctgttgtggagcgtcatggccgccgccgtgcgcatcgtcgccgaggatttcggcgccacgctcggctcggcgctcatctacacggtgggcggcatcctgctgctggtgttccggcggcctgcgccgatccgagagttcccacggcgatacctgatcgtcggcggcctgctgttcgtcttctacgaatcgtcgatatccctgtcgctgggcctggcccccaccgccgaagcctcggtggaggtgagtctggtcaactacctgtggcccacgatgatggtgctgatgtcggccgccatatcccatcgtcggcacgcggtccgcgccgtgctgccgggggcggtcgtggccacggccggcgtgatgctggcggtcggcggcaattccgggcttgactggcaggccgccgtgcggcacatcgccgccgaccccctgccgtacgcgctggcgttcgcgggggcgctcgcatggtcggtgtatgcggtgttcacgcccgccatgagtcatggcgtggacggcacctcgctgttctttccgtgggtggccgtggcgttgtggatcatccacgccgcatccggtcagggatggccgtccacgccgccgcgcccgtccgcctggctgttcgtggtgatcgccgcggtggcgatcggcggcggctacgcctgttggggctatggcattctgcatggttcgatggaacggctggccatcgcctcatacgccacgccggtgctgtccaccggggccagcgcggtgctgctgggcctgtcgttgtcgctgccgttctggtgcggcgcgctgctggtggccgccggctcggtgctcaactatctggtcagcgcacgcgaataacccggggctgggcataccgggcgtatcgcccgtgggacgctgggcgaagcctgtggaaatcatgaaaactcgtggcaggttccgtgaaactcgtcgatgctccatgaatcacgggttagtgtggcgtgagcctgcaagtgatggcctgaagcgcgaaggtgaggaatggaagactccgtttggaagacggtcatgggattgtcgctggtccgggggatcgtgccccggaccttgttcggactgaccgtggtcgcggcgatcatactgatcggcatactggcattcggcggcagacgacaccgcacgcatccgctggtcgcctcactggttgccgccacgctcgccggcgcgggcggactactggccacgtggctgatgtccgacgtgttcatggtgttcggcgtatcgctgggttggccggtgaccctcaccgtcgcgggaggcttcgcgggcctcggcttcgtgctagccgccgccgtgacgttacggggagcccgtcgcgcgctggccgtcgtgctggtgccgctggtgctggcgtccaccgcgctcggcgtggactcgatctacggcgaataccggaccatcggcaatctcgtcggctatacgccgtacccccgctcggttcggtcaccgtgcgcaaagcctcgatgagcgtcggcgagtggcgcgacaaggcgcgcaaggacgctctgccatccatgcccgactcgggcagggtgttcgccgtcgacatcccgaacaccgaatccaagttcaaggcgcgcaaggcgatggtctacctgccgcccgccgcgctgtccgaccgcccgccggccctgccggtgatggagctgctcgccggtcagccgggcagtcccggtcgcctcatcgacgccggcaacatcgccgccacgatgaacgcttacgccgccgaacacgacgggctggcgccgatcgtgctcgcacccgaccagaacggttcggccatgcacaacagcctgtgcgccgacactacccgaggcaacgccgaaacctacctcaccaaagacgtggtgaactgggccacaacgacgctgccggtagccaagtcggcccgtatgtgggcgatgggcgggttctcgcaaggcggcacctgcaccacgcagctggtgccgcgtcaccctgacatctacggtgcgatgctgccggtggatggtgagctcgagccgaccgacggcagcgtcgagacgatggtccggcgatatttcgccggcgaccgcaaggcctacaacaggcaggtgccggtcaacgccatcgccgccaccggcacggccggccaggcgctgttcgccggcgccggcaagggggatcggaagtcggtcgccaacatgcgcaccatcgccgcggccgcgcgcgcggccggcatggagaccactgaactggtcgtgcccggcgccgaccatgactggcatgcggtgcaggcggtctggaaccccggtctcgactggttcggcgcgcgaaccgggctgggcgaaatgacgaaatcgttggaggaatacccacaagtggaggtgttgcaatgagcgaagaacaacagcatgggaacgcgcggccggcggccatgccgcagacgcggcggcctctgcgggacgcggaaccctcgcggacgaagcccaccacgacctcccgcgccaccaaaccgcatacggcaaggtccagccatgcggcggaaagctggcgtgaactggccggtgacatgcggcagtgggcggacgaccaccggctggccgtcaccgccacggcggcgctggtggcgctgaatttggcggcgtggctggtggccgcgatggccggattcgcgtttccgctgcggctcagcaccagcatggccgcattcaacgccggcaaactcatctgctcgctgttcctggcgcgcggcgtcatccaacttatggtcgacgccgtcctgtggctcgtcatgttgtcgatagccgaaccatggctcggccgtgtgcgcaccgtcgtcaccgcgctcgcctgcgcggccggcggcgtgctggcgggcctgaccctgtgcgcggcggccggatggatgttccaggactccctgttcgtctcccgcatgcggttcgcattgagcccgctggtgttgccggtcggcgcgctcatggcggccagcgcgttctgcagccacctatggcgcaggcgcatccgactcgtcggctatgtggcgatcctggtcacgttgctctacagtggcaaccccagcggctactgcatactcgccgccgcgctgatcggccatgccgccggccgtgtgatggccggtccgcccgcgcacgtcgaagccgaatggcactggctgcgcagcacctccttcgaggcgcgacgcatattcgcggccatcgccgtggtactggccctggggccggtcatcgccatcacctcccataaccatgcgggcccgctcagcacgatcggcctgctcatgagcccggtttccgtcgacaacggcatgctggccaaatgcctggctggtgacacgcacggcggatgcttcctgcagttcaatctgctgcgggcctcgatgcccggcgcggtgctgcgctcgctgctgcccactgccgtgaccttggtgctggcgtggggcctgtatcgcggacgtcggttcgcggccatctgcaccgtggccatcaacctgttcacggtgaccatcgccgtcgcctactatctggtcgtgccgctgagcttcgcgccggacggcatggcctccctgctgcagcacggcgcgatcgtcgcctgcgtggcgaacgtcctgcccccgctgctgttcgccgtcgccctgctggcggcaatgaaacacttcccgattcgcatcggctggcgcaggctggtcggcggcatcggcgccatcgtgctggcctggctggcgtgcgccgccatatacctgatatacggtattgcccaacccgccaccttctcgccacgcgccaccgcctcgtcgctgctggccgaactgccgggccggttcctgcccatcggctttctgagccatatgaagctgtcgttcgtgccgcgcactccaatggcttcgatcgtgtaccaaggcatcggcctggtgttctggatcgtggtgctggccgtggtgatccactggatgggcgacgtgagcgaatcgaacgagctggcccgtgcgcgcgctgaacgtctggtcgaaaccggcggcgaatcgatgagcttcatgaccacgtgggaaggcaacagctactggctgtcccccacgggcagatcggccgtggcgtatcgcgtgctcaacggcatcgccctgacctgcaccggaccgttcggcgatccggcggaatggatggacgatctgaacggtttcacccagtactgcgtggaacgttcgctgtcgccggtgttctacggcgtgcatcgggaacagcgcgacgcgttgctggaagccggctggaactccatcgaggtcggcagcgagatggtggtcgacccgcgcaactggaagacgaccggcaagaagtggcaggatgtgcgcaccgccatcaacaaggccaaacgcgatggcgtgagcgacgtgctgtccaccttcctggaagcgtcgcttgacgtgcgcgagcagatcgaggacatttccgaggaatgggcgcagctcaaggcgttgccggagatgaggttcacgctcggcggcgtcgaggagctccgcgacccgcgtgtgcggctgctgtacgccgtcgacgcggacgggcgcgtgttgggcgtcaccagttggttgccgacctggcgcgaagggcgcatcgtcggctggacgttggattttatgcgccatcgcaccgacagtcccaacggcatcatggagttcctgatcgcgcgcatggccgagcgtctgcgcgacgagggcgaagccgatcccacgcacgccgtggagttcatgagcctgtccgcggcgcccctggccggcatgaatcccgatcgggacaacgccggggaggacggggcaccggccagcgaaggcacgcaggtgctccaacacgcgctgcagatcgtggccgactggatggaacccgcctacggcttccactcgctgttcaacttcaagcgcaagttccagcccaccgaagtgccggtctacgtgtgctacccggacccggcggcgttgccgcagatcggactcgccgtggtgcgcgcctacgtgcccagcgtgacggccgccgaagtggccggcatgctcagcacgctgcggtcgtgaaggtgtgcaacgggtacgcaggttagccgattcgagcctgagacggggtatctgctttcagagaggtacatttggccccttgcggacaactaactgccttcaaagaggtgcctgaactctgaaatctcgagtatgagcgttgcaatgacaacgtttgtactcggggtttcccgtattcggtgcctctttgaacgaagatagcattctgcagaagcccgaatgtacctctttgaacggagaaagcctgacaaggagggcgcggcaagcgctatctccgtttcgaggggctgatttggtctctcccggaggtctactcctgtttcgaggggctgatgccgaagtattcacgctccaaaatcggcggaatggcgttggcgcggatgggtttttacatgcggtctagcggccgaccagccccttgaaacgggagtagacctccggcgggggtcaaatcagcccctcgaaagcggttttgccggtgcagaggtgtcgttgactgcatcgcgagccgcctcgacgtagtaacgtggggcgtatgagcgaacgtaacgaacacaatgacggaaatacgcaaaccgcatacttcgccggcggctgcttctggggtctggagcgctacttccagaacgtcgacggcgtcacggacaccacggtcggctacgcgcaatccaccgtcgaatcgccgacctacgagcaggtatgcgcgggcggcaccgatgcggccgaaaccgtgaaagtcgagtttgacccggcacaggtcagcctgcggacgctgacattgctgttcctggaggtcatcgacccgttctccgtggaccagcagggcgaggaccgcggccggcagtaccgcaccggcatgttctacacggacgagacgcagcgcgccgtgtatgtggcggctctggagcagctggtcgaccgccagccgcagcgcccggccgtactggtcgaaccgctgcgcaacttctacccggccgaggcacaccatcaggactatctggtgaacaaccccggcggctactgccatgtaccgatcgccgcaatcgcgaacgtaaaacgccgtcagaagtacgtggaacgcatctgggatctgacgcttgagcagttcgcggtcacgcagaacgccgctaccgagcgcccgttcgtcaacgagtacgacgagaaattcgagcccggcatctacgtggatatcgtcagtggcgagccgctgttctcgtcgcaagacaaattcgattccggctgcggctggcccgcgttctcccgcccgattgccggtgacttgctgaccgagcatgaggaccaccgcattccgggccgcgaccgcatcgaagtgcgcacgtcggacacacagattcatctggggcacgtgttccccgacgggccggccgaccgaggcggcctgcgctactgcatgaattccgccgcgctgcgtttcgtgccgcgctcgcgtatggttgaggaaggctacggcgactggattgcggttgtggatggggatgataaggcatgagcatggagaatatcgcgggcgctcgcaagcccgccaagcgtgaggatgagcacacggtcgccggcgagcatcgcatgatgcgccgtgcggaccgcgaggtgaccgatcccgagcggatcgccgcgatcatcgccgcctgcgacatcgttgaagtggcctatgcggatgccgagggcctgactatcgtgccgctgaatttcggctttgattacgacgaggcgactggcaagctgacgctctggttccactccgcgccgcgcggccgcaagctcgacgcgattcgcgccgccgccggtggccgactgcccgtggctttcaccatgcagaccgactgcgaggtggtggcgggccgcaccacgtgcaattggggtgaggcgttcaagtcgatcgtcggcaatggcacggcgtcactggtcgaggatctggatgaatgccgccacggcttgcagacgctgatggcgcagcaggcgcatatgccgaatgtggaattcactgatgcacaggtccgcagcgtcacggtgtggaagattgagtccgactacttcaccaccaaagtccgcaccaaacccgtgcccgcacacatgcatcagcgttagccggggatagcgcgccacctccccactggcgggaggcagcgcgcagcgccggtggatggcccacgtccggacccgatagacttgccgccatggcagcagtgacagtggtaattaccagctacaatcagggcccgttgattcacgaggcagtcgagtcgtcattttttagtggcattcgcagctatcgaattatcgatgatatcggctatcgcagtattcaagtcatacccaacagaacgcatggactccagcaggttgggatttggcgcacatgttcgttctctcacagtgatacctcgatgtgcttaaagttgcttgcaaaatctaatgtaacggacgttaagaacggttttcggataatcaattaagattggcggctagtataagcatctttctaattactgtactcaatacgcaagctggggtctgtctcgtatgtgtcaatatcttgttgtaagaggtgaccaaatcagtgagcattgttttgcgttcatcttggctaaaatgaccatgctcatggacattggttgacaggaatgactgaatatcccagacctccaatcgttcagcgaagcccatatccgctgccaaatcccaagcagttttcactcggtctttcaccgtgataatgattggatgaaggccattcttgatattgcgctggcatttctccataagcaacgtggctggagcggtagtgcagtgtatggcggtatctccgatattgaagtcgccgcctcgcccggtggggtcatctgctactgaagctccgttgatttccacttccggcatgataatagacagctttgctgccacgagctgctgcagcaccgtgccctcgtacatggtaccgggattctctttttgccgcttcttggcctgctctaacagattgcctactgctgcggtgattgagagtgactcatcggcctctagcctgaatggcttgctattgaagaacttgcgtatacgatcaatccaaaaacgctctatctcgctgaaatctttgctggacggccgctcttcattaatgagcgctgcataatctttcattatgcccataaggccgcggctagttcgaccaccttcggacgcgagcaccctcttgatgtggtactcctctaaaatgctttggcagttcgcaccactcagtcctttgacctgtccttctttacccgtgagataatcatcgggattgattggcaatgtatctttcgagaaggcgcggttgagctgcagtatgccggctaggttgcctttggtgttaatgccgtggctctttcgaaactcctcgatggcgtcaatacccatgctcgctctccttcgacgactatcaagctgaccgtagctcgtgttgctgctttgccttgtccaatgtaccgcgaagtgctggcatgaagtagtgctcgccaagccattcgactacaggtactgccactgcgtcaccgaagccgaacaaggcttggttggtgcgcagaccattaaggttgtaatgagatgcgcccataagtgccgcgtactcctttggagtcatccagcgcactgccgtcgaccccttgccgagtcgtaccacggcttgtcttgaagaacccccgcgagctgttcgtagacatcccgaaatgtcatccgctcggacttcccacgtgggtttcccgttccgagtgcgcctgtatgccgttcgataagagatgaacggattgtccttcagcttcatcactctctctgattgcacagcggacagtgagtcaagaaatgccgttagcttgcccttaggccaccatcgggaatcatcgtctgacatctcttcggcgtacatgccaaagcccgccataagtggttccggcggttccggcagaactgccctgtgcatacgcagggaggtatcggcaaacacctgttgcaaccaatctggccgtagtggggaattggcttgcgagccctcaggaggattggttaggccgaccaagaacagtctggggcgggactggggcacaaaacgccgagcgtcgattgacagcgcgtcaactgaatatcccagttggttgaatgcgcttactgctgctgctatatcctcgcctgagtgagacgtagcaagacctgcgacattctcaagtacggctacaggtggcctattgttgcccatctcttccaggaggcggatatactgccagaaagcgctggactgtttgccgttcaaccctgtacgggttccagccagagatatatcggtacaaggggaggagccccaagcaatggagatattgtgaggcaagtcagagccatgtagctcacccatgtccccctcgatcagggtatgttcctgctcattgttgccgaactggttcctatacatctggcatttggcgtgatctatatcgttcgaccacgccacgtggaagccagcctcttcgaggcctaggcgggcaagccctatgccggcaaagaactcaagcgcttgtggtgcggttgagccgatacgggtagccccgctggatgcaccagtcatgccctgttcctttccgatttctgacattcactggtactagtgtacgtgctgcttgctatgaaatcgtatgcgtattcgctgtggcgcgctcctcctatgacatctaccagcattttttggcggcgaaacgcgcatttgattacgcaatcgcgtggattgaagatgtcgggaaaggcgctctcgactattgtggtagccaagagaagcgatccgtttccgaggtgagattcgggaacggtccgactctcggcagtgatttatctacgcagacaagccaaaggagcctcgccatgattctcgtcaccaccaccccgtccgtcgacggatacaccatcaccaactaccagggcatcgtcttcggcgaagtggtatccggtgtgaacatgttcaaggatcttggcgcgggcctgcgtaacatgttcggcggccgcagccagggctatgaggaagagctgatgcgtgcccgcaacgaggccatcgccgagatgcagcggcgcgcggaggcgatgggcgcgcacgccgtggtcggcgtggacatcgactacgaggtgctcggcgccgacaacggcatgcttatggtcaccgcatccggcaccgccgtgcagatttcacggcgtgcctgaggatttgaacgggctgcgcggaggtcgcgcggattataacgcgcagacgatcaggtagatcgccacgatgtggcaggcgtacccgatgaccgtgcccaagtggaacacttcatggaactcgaaccagccgggcacggggttgggtctgcgcaacgcgaagcacacggcgccggcgatgtatgcggcccctccgcatgcgatgagtatggttggcgcggggcctactgcgggagccgtccagagctgcggaataagcgttaccggggccagtcccaacacgacgtatacggtggtgaacacccagttcggcgtccgcagccagacgatatgcagtatcgtgccaatcgccgcggtcgtccagattaccgtgagatatggccggcgaatcgccgggtcgagcgcgaaaagcacgggtgtgttggtgcctgcgataatgaggaagatattcgaatagtcgatgccgcacagcacacgggtcaccgccgtgcttcgccacggcacgacgtgcaggagcgagctgttgccgaacagcagcatggccgatgcgccgtacaccgcgcacgccgctttgacagggccggacggtgcgatgcagatcagcacgatggacgccgcgatgcacaacggtagggtggcgaggtgcagccatccacgcagtcggggtttgcgattgccgaatgcgtccacggggacgatgcggcgtctgaccgttttcagtgctgccttggcttggcggtagtgcgactgcgcggcccggtatcgcgccgacgcgcgattcagtgcggcgacggcatcgtccatccggtcgccggtgtgcggaggcgtggtcgtcgcggcgggggacgccgcccgtgccgtgccggtgggagcgctcatatcgatcacctcgctgtggccggcgcgtttccggccgctaacttacgttaccgtaacgtagtacggggcggcgcggcagtcaaggtcggcaacggcaatccggtgcatgttcgattatcccgattcggtcgcgccgcggacgaaggtgcacggagcgcttcaccgtgagcgtaattacggaatgagagccgccggcaagggttgggtggagcgaaaggtcaaggtcgggagcccggaacggtgccggatgcggcaacgaacccggtcgccggcgtcgctggatggtgacatcgcggcggcggtcgcacggtcggctgccaagccgcattactccgcgcgtgcaacgcgttgattgaaggagtaccgattatggcgatgtttccgtctctgatgaatgacacgatgttctccgacctgttcgacgatccgttcttcgaaggttggcgcaacgtggatcatgccgttgcggacggtccgaccatgcagacgggcatgatgaacactgatgttcgggagaccgataaggactacatcgtcgacatcgacatgcccggcttcaggaaggacgatgtctcgctgaatctgcagaacggctatctgaccgtttccgcgcgtcgcgacgactcccacgaagacaaggactgcaatggccgttggctgcgtcgtgaacgctatgccggctcctgctcgcgcagcttcttcgttggcgaggacgtgaaggattccgacattcacgccagctacaaggatggcacgttgtgcttggaaatgccgatgccggatatgcgataaccctttccgtcgatcttcaggggaatatcagcctttcgtgttatgttttctccctatgaaaaaggtgtatgtatatgtattgaacgacatggcggaatgtgaaataggttatattctacaagcgttcagtatggaaaaactattaaaaaatggaacaaaagaatttgaagtagaaacggttgcttgtaataagaaacccatcctaactttgggcgggttgaccattattccggatcgcgctatatcggaagtcgatttcagcaatatcgcggctctgcttttgccgggttcttccgcttggggcagtgaagacaatcaggagatattgaaaaaggcgcaggagtgtctacgtaatgatattctggttggtgctatttgcggggcaactcttgcgcttgccgattatggtatattggatagattcaaacatacaagcaactctctggaatatctgaatttcttctcaaagaactatgcagggcaggacttgtatgtttgttctaattctgtttcggacaggaacctggtgacggcaaattcggcaggttcattggaatggacaaaagatattttaaagaatcttaatgtgtattccgataagaagattgatgcattttataattactattcaacaggcgatgcgaagtattatgatgagctcctacaatagagggtggtcacgggtcgttggctttcccgcgggagccggattacatgcatgatttgttcgcagtgagccgtatgcactacgatatggctggttatcgtagtgctcgccctcccatggggtgagccgactccttttggctgttgctgctcgatctacacgggccgattctcgcaatcgcacttgtcctgatttggtggcgatgactctttactctatactcggcataaagacccagcaaaggagcatgcgacatgaacgccgttaaacatatccttatgacggtctgcacaggcattgtcctctggctcatgacattggtgggaggactcgcttgggcgatgttctccaccccgggcagccggcagcgcacagaggcgctctggggagccgtctacttcgagacaagcccctccaagaacggggttctgatgcaattcggattggagaacatgcgatcggtcctgctgttgctgctcgcttgccttgcggcgtgcgctgcaatcagtctgatcgcgaaggcctgcatcaaaggccatgcggcaatgtgcaagccgaagcgaatcacccgctagcaggcgcttgcatgtgccgtacttggaccatgcgccgatgccacggccgccatatgcctgacaggattatacggccctcccttcggctggctggtcgtcgtgcaacagatgagtgggatatgaattctatctggtgcgcttgtagggcaacgagtcgctggtcaattccaagccgtcggcgactttggccgcgtcactattggacagcgaaccaaaccacttgtatagatcaccgggcaggaactcgtaacgctgcccgcaacggacgagcgatggcttcaacaaaccggcctgctgccagtcggcaagaacaatgtcgcccggctcgttccagttgatgttgccagtgactttgacgatcacgcccgatacaccgtcgtcgccgacttcggtgacgaccaccggccggactttgccgacgcccggatggtcggggaactcgacccacatcagccacacgtcatagggcttcatatcagaggttgtcatagatgtcatcttccgggtcgtcccaatcggccggcatgatcgcacgccccgatgcggaacgctcgaacctgcgcaccgtgttcaccttgaccacgcgtcgcggaccatagcctccggcgacatagccggccaagtacgcgccgatgagcgacgtgagattgtcgccacggctttccgcaacctcttcggcggtcttgtacacaggcaaagactcaacagctgtcatcacacaccacctttcctgattgctccaattatatcgattgcgcttggcggtttacgagcgtcatgcgacggacttacgcaagagaccacataacccagccggacagggaacgtcagtcgtcgtcatcgtcccatccgcgcggatatagtccgactccatccccgcgatacgcaactggcctgatgatgcagtcggcgtcgtgattgaccttaagttccggatatccatccgcgtcgcggcggatgtcatcatgcacagcatcaacgggatggatcgggccgcgcatgacaggcccccggcttccgccgtaatcaccacgctcggcggattcgctccactgttcaaacttttcgtctggaatattcatagcacgcctccatcgtcacccaacttgtatggaagaatttagggtgtgtttacactagttgtttttgctggtgtttttgagttggatggcgatgagggcgagttggaggttggcgaggaaggtagcgtcgagcctgtcgtagcgggtggcggcctcgcggtagtgcttcatacggttgaagatgcgttccacgacgttccgccccttgtgcgcctgcctgtcatagtcccatgactccgcgcggtttctcttgggcggcacgaccggcgtcaggccatatcaaaatgtgttgtcacgaagctggctgttgtcaaaacaaaagggctggaatcgttggtatttcaacgattccagccctttacttgctggtgcgagtggggggagttgaacccccacgagcatacactcactgccacctgaagacagcgcgtctaccattccgccacactcgcagacaatcgactaacttacacccagatgcgcaatcatacaatcttcggcgtgtcgcggttggcggttggcggttgccgttcggcgatccgcaggtggcggcatgatgccgcggccgtcggcgcgcgacggctacggcatcacagtcccggcttgcgttcgccgttgccgtagaagtgagccatcgcgtcgtcgcggaactcatcgaagtatccgccgtcgatggcggcgcggatgtcgtccagcagcttcacgaagaaatgttcgttgtgaatcgtggccaacgtgaaaccgttgaattcgcgtgcgcgaagcaggtgatcgacgtatgcgcgcgagtagtgacggcacgtgtagcagtcgcatccttcctccagcgggccgaaatcgaacttgtgctgggcgcgtttgatgttgtatcggcccgacctcgtgtagatcgcgccgttgcgggcgcaacgtgcgggggccacgcagtcgaaggtgtcgccgccgttctccacgcaggcgaagatgtcatccacggaggcgatgccgagcacatgacgtggacggttctccggcatcgcgtcgcagatccatgcgcaggtgtcgccgatgagacgcttctcgatcgcgccgccgatgcccacgccgtcgaagtccagagaggcgatctgcgcggccgcgcgccggcgcaggtcctcatagttcgcgccctgcaccacgccgtacaaggcctgatacggcctgcccaggcgttccgccgtcagccgctggtgctcgtccacgcagcgacgggcccagcggaaggtgcgctccaccgagtcttcctggtaggagcgggtgttcatcagcgtggtgagttcgtcgaacgcgaacatgatgtctgcgccgattttgtgctggatgcccatcgaaatctcagcggagaaacgatgtgcgtcaccattcagaggcgacttgaatgtcacgccgtcctcgtccacccaggccatgcgttccttgcccttggcgatgatgtcgtccgacttcatgccggtcacgtccatcgccagcgtctttttgaacccgactcctagggacatgacctggaatccgccggaatcggtgaacgtgggcccgtcccagttcatgaagttcgccagcccgccggccgcgtccagcacggcctcgcccgggcgttcgaacaggtggaaggcgttggccagcagacactgcgcgccgagctccttcatttgctcgggcagcacggccttcatggcggcttgcgtgctcaccggcacgaacgcgggtgtgcgaatatcgccgtggggcgtgtggatgatgccggtgcgtccgtatcgggcaccgtctcgcccaagcccgctggccgtggatggcaggcgggtgattgtttcgaaatggaaggcgctgcggtcgccgggctggccgggctgcgcgcccaacggatgttcaagaaggctgatcgtcatatgttcactttaggcagaagggccagaaaagggccggaaattgtgaagaactcggtttcgaggggcggatttcgccgctcccgaacgtctacttccgcttcaaggggctcccggtcaagtaggccggctgcaaaaatggcggaatggcgttaaatgagggcccttgatactcggaattgaccgcgcgaacagccccttgaagtgcaagtagatgttcccgaaacaggaaatcagcccctcgaagccgagatgcccataagactctgcgatgattacgcatagactttcaatcaacgttcagaaaaccctcagattaactgcctttactaatgaggtagcacacgagaagcggcaatgagcaagcgcccgaatagccgccgaacagacgtgataagaatttaggaaaaggagtagcaatggctgacgaattcaacccgcagggcgtcgaccagaccccgcggaataacgaaacccccaatgatactgccgatgccggcaacgccgagccgaagaacccgtttgtaggcggcgactcggtcgatgccggcaacgccagcgattccaacgagcagcaagccccggtttccccggccgcccccgctgccgatcagcagcctacgcaagccgctaccgacaccgccgccactgagcccatcccggactacgcctccgccaagggcgagagcacggtggtctcctcctcgccggcttctccggcagcgccggccgcagaccagacctcggccacaactccgctgtaccgcccggccccggaatacggcgcttatggtccgaccccgactcaggcacagggccagcagggcggccaggccggcaacaatgcccagcccacgcagcaattcccgttcggtcagcctgcacagcaaaccccacagggccagcaaggcaaccgcaatccctactacaccaataacccgcagccgcagggcaacggcaatccgttcaatccgcccacgcagccgcagcagaacatcggcaacccattcgccagccagtccggccagaatggccagaatggccagcagccccagcagggcggtctgttcggtttcggcactcccggtaccggtacgccgaacggtcaaggtccgacccagccgggacagcccggtcagcccggccccgccaagcagggcatgtccaagacggcgagcaacatcctcatcgccgtggtcgccgccgtcgtgtccgcggccctgtgcctgggcctcggctacggcgccctcaccagcggcctgatcaccctgccgaccagcaattcgctgtccaacgtcagctcgaataagtccggctccgggtccgccaccgccaagagcggcgaagcccccgactggcagaccgtcgccagcgatgtctccggctccgtggtctccatccagaccgcgttgagcaacggcaccgccaagggctccggcgccatcatcgacaccgaaggccacatcatcaccaacaaccacgtgatctccggggcccagcagatccaagtgacgcttgccaacggcaacatgtattccgccacgcttgtcggcaccgacaccaccaccgatcttgcggtcatcaagctcgacaacccgccgagcgacctcaaggccgtgaaattcgccgattccgacaagctcgccgtcggcgagaacgtgatggccatcggcaacccgctcggctacgacgacaccgccaccaccggcatcgtctccgccctgaaccgcccggtgaccgtgaccgacgataacaacaacgagatcgtcaccaacgccgtccagatcgacgcggccatcaaccccggcaactccggcggtccgaccttcaacgcggccggccaggtgatcggcatcaactcgtccatcgcctcgactgccacctcatccgactccgccggttcgatcggcatcggcttcgccatcccgtccaacctcgtcaagcgtgtggccgacgaaatcatcaaggacggcaaggtcaagcacgttgccctcggcgtggtcatcaagtccgacacggttgaagccgacggcgtgacccgcggcggcgcgaccatcaccaagtccagcgccaccggcagcgcggtcgtctccggcggcccggccgacaaggccggcctcaaggagggcgacaccatcgtggccttcaacggcaacgcggtgaacaacaactactcgctgcttggttacgttcgtgccgcggctttgggagacaaggtgacgctgaccatcgtgcgcgatggcaagaccatggatgtggacgtgacgctcgatcaggaggagtcgtcggtgaacggttcgtccggcgccaacggcaacagcaacggccagaacaacaagcgcaaccggaacggcgacggcgccaacggcaacaacggcggcgacgatggcaacggccagaacggcaacggccgcaacgatggaggcaccggtgacggcggcggcttcaccgatccgttcggcctgtggtaaaggcctgcggtaaagcggatggcgcgtcgcgcggcggtggacgatagtcgctgaacgcgcgtcgggccggtcaggggccgtggcggtgagcgagtctgccgcctcggccctttcgcatatccgatgcgttcggcgtgccgcgcagactcggccatgcggcggattgggggcgcgatgcgcggggcaggatgtcccgagcgatacccataattatggatacacataactgaatacgaacatctttacgccgtgtatcggaaggtcacgcgggagctgagcgatgcgaggccccaggcatggacgccggtgggttaacaaggcgtgaccacagcgccgattgcgcgggccacgcttgccgcaatcgactccgtatacgagcgtaaggagcaatgatgagcgcactcatcagattcttcaccaaaatcctcgatatttgccggcttgtaccgatgcttccggtcgtcgtcatcgccgcgattccgttggctttactaggcgattggcatccttgggggcacgcggccgacattgcgatgctgggcgatccgggcttcggccaatggctcatcatcgcgctggtgctgatcatcgtggccgacaccgtgcgcggcatgatcgacgatctgcggcacgggcaggtcggcgtcgatctgctggccgtggtcgcgattctctctactgtggccgtccacgaatactgggcgagctgggcggtgatgctgatggtcacgtccggtgaagccatcgaggagtacgcccaggccaaggccgaacacagtctgaccgcactgatggaagcggcgccgcggaccgcgcacgtcgtcagcctccccggcgtgggacgcgactcggcaggcgatgccggcgatgcatccgagggcttccgccgcgtgggccagtttgcgacggcgtcggccgcgcatcgattcgatacggtgccggtcgaacaggtgcggctcggcgacgtgctgatggtgttgccgggcgaaaccgtgccggttgacggcgaactgttgtcgggctcggccacgcttgacctgagcgacatcaacggcgagccggtgccgcgtgaagtgttcgccggcgcccgcgtgatgtccggcgcggtgaacggctcgactgcattgaccatgcgtgccacccaagtggccgccgattcgcagtaccagcgcatcctcgagctcgtggcctccgcgcaggaatcgcggccagccgtggtgaaaaccgctgaccgcttggccgtgcccttcaccgtgctttcgttggtgattgccggcgtcgcatgggcggtgtccggggtgccgacgcgattcgcccaggtgctggtgttggccacgccctgcccgctgctcatcgccgcaccggtggcgtacatcgccggcacgggtcgtctcgccgcggccggcgtgctgatcaaggcgcaggatgtgctggagaatctcggccgcgtcacccaggtgttcttcgacaagaccggcacgctcaccgtcaaacaaccgcaagtggtgcgcgtcgagatgctgcccggcgcggcgacccagttcgacggggaccatgtgctgatgatggccggcgtggtggaaagctattcggtgcatatcctgtccaaaggcatcgccaaggccggaacggaggcgatggccagactgcgccggcagtccgagaacgatgggcggccatgccccgagtcggacgccgtctggttcggcgtcggccgcgagcatccggtcgtcaagggcatcaacgaggaggccggcaagggcgtttccggcgaggtgaacggacacgtggtgcgtgtgggccggctgtcgtttgccgccgccgggaaggacggattcctgacggccggcaacgccgaccccactggcccgcgtcacgacccgcggcccggaacggaggccgccggcggaacggaagaggatgtccgcacgcgcttcggcctgctgcagccggacgagatggcatcctacgtgtccatcgacggccgattgatcgcacgcatcgtgctgcgtgatgtgccgcgcgccaatgccgggacggcgctcgccaaactgcatgcgctgggcgtcgccagactcgccatgctcaccggcgacaagcgcgcctcggccgacatcatcgcgaacgaggtcggcattgacgaggtccacgccgaactcttccccgaagacaaggtcgccgccgtcaagtccgccgcggaagacggcaacgccgtcacgatgatggtcggtgacggcgtgaacgacgccccggtgctcgccgtcgccgacatcggcgtggccatgaccgacggcacctccaccgccgcctccgaaagcgcccaggtggtcatcatgaccgatgacatcgcggccgtgccgcgcgccatcgccatcgcccgccgcaccaagcgtgtgatgctgcaagccgttatcgtcggtcttgcgctcgccgtgatcggcatgatcgccgccgcgttcgatctcattccggtcgtcgtcggcgcattcctccaggaggccatcgacgtggtgagcatcctctggggcctcaccgccctgatcgatcgagattaggggacacggcccgccgcgtaccgcgacatggagccggccgccgcaccgatcgcatatcggtgcggcggccggcttgttttttgtcgtcgctcttcttgcgttcatgccgtaaggcccgttccgggcgatgccgatgccgcccgtctcgaagcgcggaaccgcgcccgtcggcatccgggcgaaatccatccccgtatattcccttgtgaacacagggttttcggcgtctcgttaacgaagacgtcatacgtgagacgttttggaaacacaagggcaacacgacgcgcgaaaggggttgggataaatgggcatgtaactgcttgggcgtcgtgcgagagaggaacaggcgtatggcgaagttgggaatgatgcgaccggtcgtggccgctatggtgctcgccgcggtggtcgccttgaccagtggctgtggctggggccgcaccgtggccgacagaaaggccatggaatccgatggctccggcactcctgcgcaaagctgtgtggataccagcgcaaagagcatcgccatcggtttcgtgaactcgctgagcggcaccatggccctctctgagaagaccgtgtccgattcgctgcatatggcggtcgatgagatcaacgccaagggcggtgtgctcggcaagaaattggaagtcgtgcaacaggacggcaagtccgaaccggcggtgttcgcggagaaagccaagaccctgattgaaaagaactgcgtggcggcggtgttcggcggatggacttccgcgtcccgcaaagccatgaagccggtgttcgaagcggacgacgcgctgctgttctatccgctgcagtatgaaggcatggaggccagccccaatatcttctatacgggtgcggcgccgaaccagcagatcgttcccgctctcgactatctcaaggagcaaggccgcagaaggctgttccttgtgggatccgattatgtgttcccccaaaccgcgaaccgcatcgtgcgcgcctatgcgaaacacaatggcatgcagatcgtcggagaggaatacacgccgatgggtgccacggacttcagcaccatcgtcaataagctcaaggcctcgggggctgacgccgtggtcaacacgctgaacggtgattccaacgtcgcgttcttcaaggaatacaaggcgtcgggtctgcaggcggacagtcttcccgtcatctccatgtccatcgcggaagaagaagtcgcctcgatcggcccggacaatgtcaaaggccagttgaccgcatggaactactaccagactttgggcgacgaggaaaacaggaccttcgtgaaggatttcaaagccaggtacgggcatgacagaccgacctcggacccgatggaatccgcctacacctccgtgtacctgtggaaggaaatggtcgagaaggcgaagagcttcgccgtggatgacgtaaagcgcgccgccggcggcatcacgttcgatgcccccgaaggcacggtcaccgtcgatggcgaaaaccaccacatctacaagacgtcgtatatcggccggatcggcgatgatcgcctgatccataccgtgtggaagtccgatggccccatcaagcccgatccgtatctcaaggcgtatgcgtgggccgggagcctgcagagtccgggtttggattcatccaagtgagtgaagggagaaggagggatgaacatgcttgcaccgcggattgtcgagggactgccaagcggctcgatatggtcccagcaggcccgattcgtatctcaaggcgtatgcgtgggccgggagcctgcagagcccgggttcggattcgtccaagtgaataaaaggagataaagggatgaacatgcttgtaccgcagctggtcgcgggattgtccaatggctcgatactgcttctggcggcgctcgggctgtcgttgaccttcgggcagatgggcgtgatcaacaacgcgcatggcgaattcatgatggccggtgcgtacacggcgtacgtcatgagcacggtcttcgccagcaagacgcttgcactgggcctcgcgctggtcgccggtttcgtggtcgcgggtctgctcggcctgctgctggacgtgctgctgctttcgcgtatgcgcacccgtcctttggacacgttgctggtcacattcggcgtttcgctggtgctgcagcaggtggcgcgagacatcttcggctccacgggcgtctatgcccaagcgccggaagcgctgaccgagccggtcacgttgttcgggtacgatttcccggcatcgaggctgttcatcttcgtggtgtcggtggtgtgcgtggccgcattgtacgcggtgctgaagttcacgccgctgggacgccgtatccgtgcaaccgccgaaaaccgcgatcttgccgaggtctccggaatctccaccgcaacggtggatcacctgaccttcttcatcggatccggtatcgccggtatcgccggtgtggctttgagcctgctcaactccatcagctataacttcggtacctcgttcatcgtgcaggcgttccttgtggtcgtcgccggaggcgtcggacagctcaagggcgccgtcatcgcatccttcgcgcttggcctgtgccagtccgcgatcgagttgccgacctcgtcgtccatcgcgcagatgtccattttcctgatcgtggtgatcttcctgcagttccgtcctcaaggtctggtcgcggtccgttccaggaatctggcataaggcaagaagggagtgcatgttatgggatctgttgccgcattcgtcaccaagtaccgttcatggatcggttccatcgccgccgtcgcgttgatcatcctcgcgccgacggtcatgagcgcgtacagtctggggctgttgtccaaatatctgtgttacgcgatggtcgcggtcggcattggcctggcatgggggcagggaggcatgctgaccttgggtcagggactgttcttcggactcggcgcctatgtgatggccatccacctgaagatcgaagaactcggtccagacgcggttcccgacttcatggcacagtacggcatcgacagacttcccggattctgggagcttttccgcaatccggtcgtcaccatcatcggcgtcgccgtggtgccgggtgccgttgcggcggccctcggttgggccgtgttcggcagaggcgtgcgtggcgcctacttcgcgatcctttcccaagcgttggtcgccgcgttcgccgtgctgcttgttggccagtccaagaccacgggcggcaccaatggcctgaacgacttctccggtttcttcggctacgatttgaccgacccggccaacaaaaggatgatctactacatttgcgcgttctgcgtgctgggcatggtgctcatcgccgattggattcgtcattcattcatgggcgagctcatcatcggcgtgcgggaccaggagaaccgtatgaagttcctcggctacaatcccgcttccatcaaagtgttcacgttctccctcgcggccgtgttcgcgggcatcggcggcgccatgttcgtaccggtcgtcggcatcatctccccctccgacatcgatgtgattccatccatcatgatgcttgccggcgtggtgatcgggggaagaagcaccttgcttggtccggtcatcggcacgctgatcattcgattcgccgaaacgcagctctccgaggcctgcccgtccgtttggacgtacgtcgaaggcgcgatcttcatcctggtcatcgccttcgccccgatgggccttggccagatcaggaacttccgtccatggctggccggaaggctcggccatgatggcgtgaaggccacggtgccgaacgaggcggcaacgaccacaaaggcggtgaacgcatgagcgacgaaaacaagaccgagggcgccgagctggatcagctgcgcgatgagatgcgcaggatgcgcgatgaagccagacgcttccgcgatgaggccgccaggatgaaggccgagatcgccagggagcgccaggagcttgcgagccagctcgcgaccctggacgcccagggcggccaatggaacgactacctcgaaatccgtggattgcatgtcgaattcgacgggttcgtggcggtcaaggatatcgacctgaccgtcatgcacggtgatctgaggttcctgatcggtccgaacggcgccgggaagaccacgatcatcgatgccatcaccggactggtgccggccgcaggctcggccatgtttggaggggaggagcttatcggacgcaagccgaacgatatcgtccggctgggggtcggccgcaccttccagacggcctccgtcgtggaagagctgtccgtgctgcagaatctgcagctcgccgaaggcctgcacaagaagatgtcggaattattcagaagaaccgagggagcgtcgcgcaacatccagagcatcatggaagtgtgcggtctcgtcggcgatgcggataagacggcgggtattctgccgcacggcaagaagcagtggctggagatcggcatgctgctcgtgcaggacgcgcgtctgcttcttctcgatgaaccggtcgccggcatgacgccggcggaacgtcaggccaccggtgaactgctcacgcgcatcagccgcaatcgcacggtcgtcatcgtcgaacacgatatggatttcatgcgtcaattcgccgactcggtcaccgtgctcaatcaggggcggatcctcgccgaaggcagcgtcgaggacatccagaacaacgaggaagtggtcagaatctaccttggcggaggagaagatcgatgatggcagagaacatgttggagatcagggggttaagcacaggctatggcaaggtgtccgtggtcaacgacatcgacgtgtccgtccgccccggtgagtgggtgagcatcgtcggcaacaacggcgccgggaagaccaccctgttgaaatcggtggtcggtctgctcccggcgaccggtggatcgatcaccttcgatggcgtggatgtcactcgcgtcgcgccgaacaaacgcatccgcatgggaatggcgtttgttccgcaaggccagcaatcctttgggcaaatgaccgtggacgagaatctgcgcgtggtcgccgaccgttacggcgccgaagcgcagagccggtatgacgaagcgatggaggcgttccccgtgctgagggagttcgccgaccgtcgtgccggtcttctctccggcggccagcgtcagcagctatccattgcgagggcgttgatcaccagaccgaagctgatgattctggacgagcccacggaaggcatccagccgaatatcgtggcggagatccaacggtccatccgttcgatggccgaagacaagggcatcgccgtgatgctcgtcgaacagaaagtgcaattcgcggtcgaacgtgcggatcgctactatgttctcgccgcaggccggttcatcggtgccggagatggcggcgtcggcgcggtcggggaggcgaaggacgtcatgcgcgtctgacgtgccggtcgcagtcgggcggggataccggccgctccacgggcccggcagtcccgcccgcggcttcggccatgattcgcggaaacatggccgtagccgtgacgtaatacgcggtccctatggttacgcccataacggattcatggatggacgggtcggcgcgcggtgcccgatccaggttcccgtgacctgcaaggagagtgtcagtgaaaggtctgcgacgaatcgtgaaggcgggattgccgtactatatgggaacggcgatgctgcatattctgggcatcggcatgctgctcatggcggccggaacggctcccgtgctgtttgggctgggaatgctcgcctacacgttgggtttgcgccacgcgttcgatgcggatcacatcgcggcgatcgacaataccgtgcgcaagcttatccagctgaaacggaacccgaacggcgtcggattcttcttctctctgggccattcgaccatcgtgttcctcatggcgctgcttctgggattgtcgtccaagtgggctcaggcgcatatggccgtgttccagcagatcggcggatacgtcggcgccacggtctccgggatgttcctgatcctcaccgcggtgttcaacgcggtcgtgcttgtggacatggtccgggtcttccgctccatgaaaggccatcgcaaggattacgacgacaacgcgttcagcgcgatgctcgactcgcgaggtttcatcaacagaatcttcggcaggctgttcgccttcgtgaccagaagctggcatgtgtatccgataggactgctcttcggactcggattcgacaccgccaccgaagtcgcgttgctggccatgtcggccggcgccacgcagtcgaacatcccgctgtacggcacgctttgccttccgatactgttcgctgcgggcatgaatctcatggacaccacggattcggtgatgatgtccagcgcatacgagtgggctttcgacacgccggtgcgcaaggtctactacaacctgaccatcacctccgcttcggtgcttgccgcggtgatgatcggcgtggtcgaactgttgcaggtcatcgccacggccatgaatcttcggagcggattctggaactgggtgcagggaatcgacttcaattacctcggttatgcgatggtcgtgctgttcatcggtttctggctcgtctcggtgctgatctggaaatacggcaaggtcgagcagcattgggcgtgaccatcgccgccacgcgatccgcggcatcatcggcgtgcgggcgaggagaatcctctcgcgcacgcgcaacggcaacactgtgaggcaatcaacgacaaggggtcgaatatgagactgacgccaagggaaaccgataagctgctcctccatctggcgggggagttggccaaggagcgaaggggcagggggtgaagctcaactacgccgaggcgatagcgctcatcagttcggaggtgatggaacgcgcccgcgaaggcaggaccgtggcggagctcatgcactatgggcgcaccatcgtatccgcggatgacgtcatgcccggtgtcgccgagatgatctccgaagtggaggtggaggtcaccttcccggacggcaccaaactggtctccatccatgaccccatcgagacgaccgaggagctcaagccgggtgaatatattctcgccgatgacgatatcgagctcaatccagacagcgagtccatcgcgcttgatgtgaccaataccgcggatcgcccgattcaggtcggttcccatttccacttcttcgaggtcaacaagtatttgagattcgatcgcaaggccgcatacgggaagcatcttgacatcgcggccggcaccgccgtgcgcttcgaacccggtgaatcccacagggtcgaactcgtcgatttcaggggcagccgtgaaatgcacggcttcaacgcgctgaccgaaggaaggctcgacgatcccaaggtgcgcgaggcggcgttcgccagagccaaggagcagggcttcctcggcttcgatgaggaaacggaggactgaacatgagaaccatcaccagaagcgactatgcgggcatgttcgggccgaccaccggcgatcgggtgcgcttgggggatacgggtctgctgatcgaggtcgagaaggattacgcgcgttatggcgatgaattgaaattcggcggcggaaaatccttccgggacggcatggggcagtcatccgtccagaaggactccgaatcgccggacacggtcatcaccaacgcgctcgtcgtcgattacaccggcatctacaaagcggatatcggcatcaaggatgggaagatcagcgcgatcggcaaggccggcaacccgcagaccatggacggggtgaccccgggtcttgcagtcggcgcgtgcacggaggcaatcgccggtgaagggctcatcctcaccgccggcggcatcgacacccatattcatttcatcgcgccgcagcaagtccgcacggctcttgccggtggcgtcaccaccatggtcggcggcggcaccgggccggctgacggcaccaacgccaccacatgctcgccgggcgcgttccacatcgcccgcatgatcgaagccgccgaagccatgccggtgaacatcgcgtatctgggcaaaggcaacggatcatcgccggaaccattgcgcgagcagattcgtgcgggagcggccggattgaagatccacgaggattggggcgcgaccccggccgtcatcgacacgtgcctcggtgtcgccgacgacatggacgtgcaggtggccatccatacggacaccctgaatgagggaggatgcgtcgaagacaccatcgccgcattcaagggccggaccatccacacctatcacaccgaaggggcgggcggcggccacgcgcccgacatcatccgcgcggccagtttccccaacgtgctcccgagctccacgaacccgaccatgccgttcacccgtaacaccatcgatgaacatctcgacatgatgatggtcacgcatcatcttgaccgcaatgtgccggaagacatcgccttcgccgattcgcgtattcgccccgagaccatcggggccgaggatgtgcttcatgaccttgggctgatctccatgatgagttcggactcgcaggccatgggacgggtcggagaggtcatcacccgtacctggcagacggccgacaagatgaaaaagcaacgcggcccgctccccgaggatgcgcacgacgacaaccgcaacgacaatttccgtgtgaagcggtacgtgtcgaaatacaccatcaatccggccatcacgcacggcatctccgactacgtcggttccgtcgaagtcgggaaaatggccgatctggtgctttggcagccggcgctgttcggcgccaaaccggagatgatcatcaagggaggatcgatcctccatgcgcgtatgggcgacgcgaatgcgtccatacctactcccgagccggtgctgtaccgcgacatgttcggcgcgatgggcaaagccttgggctcctcatgcgccacattcgtctcgcaggccgcccatgacgacgacatcgccggccggctcggtctcgaacggcaggtgcttccggtgcgccactgccgtggcatcggtaagaaggatctgaagttcaatgacaccatcgcggatattcaggtcaaccccgagacgttccaagtgagcgtcgacggcgagccgattcacagcgaaccggtggcggaactgccgttggcgcagcggtacttcctgttctaggcgtcgaagaacgggtgcccgcgccgccatgcgtgaggacgcgggcacccgcacaccggaaaggagggcctcgttgccgaatcgtttccccgtgtttacatgcccgcccttttcggcgtctagcgttctgcgtgaccatcacaggcaatgcaaacgaaaggcggcagcaggctcatgatcgccaaccgcatctccggcaacatcatttcggacacattctccgacggcaagctgaacgttccgatcgaattcgaatggttcgaggccgataagaagcgcatgcgcaaagtcgccgccgacggcaccgagttcggcgtcgcggtcggcgccaccatcgcagacggcgatgtgctcgccgaaaccgccgacaaacgatatttcgcccgtatccgcaccgcgcagctcatcgagattccggtgcattccatgaaggagatggggcgtctgtgcttcgaactgggcaaccgccatctcagcctgaaggtggaggacgaccgcgtgctggtgccatacgaccatccgaccatggaatacacgaagaagatcggattcgatccgcgcgtcatcgagggcggattcgacggattcctcatcgtcaaagcgcatgccggcgccggcaccatcgttcctggcacgaacaaaaccaccggcgatctggccgaagaagagcaggagaccgaacggcatgagccccacgcccatgccatcggcgaacatcaccacgagaaaagcgaatacgaagttaacggcgtattgcatcgcgccgacggcatgcattcgcacgatcacggccaaacctggcatatgcactgatgccgtccgtacacatgaaggaacacacgatgccccatgccggctccccggcggatgaatgcgccctgcgtcatcttgcgatgctgcaggtgtgcgacagtgtttttcccgtcggcgcattcgccttgtcgaacggcatggagaccttcgtgcaacgcgacctgctgcggtcctcggctgatttcgagcaatatctgaaagactatgtggaggttgccgcataccgcgaaatcgggcagatggtgattgcgggcaagatggccgcgggccgcgaccccgatgacgccggtttcgtgaacggactcgccgagctcgacgcattgtgcgtggccttgcagtcggcgagggagattcgtgaggggcagaaccgcatgtgcatgcgcatgatcaaactcgtcgatcagatggaggcccaaccgttgcagcccgtcgattcaaggcgcgggcatggcgtcgaccgcggggaggcgtccaaacggggaggcgccgcccgtccgcgcaccattccacatgtcgaccggtacaagcgactcgtggattcgggaacctgcttcggcatgcactcgatagtcatgggtctgtatgccgccgacaaggcgacatcgctgcgggacgcggccgtcacctattgctactcgctgctcagcgcactcaccgtctgcgcggtcaaagccgtgccgatcagccagtatgcagggcaggtggcgctcagtcgtgcgtttcccgaaatcgtcgccgcggtcgatctggcgctcacgctcactcccgatgacctgggtgtatccggggcgtacatcgacatcgcggccatgcagcacgaaacgttgtactcacggttgtacatgagctgagcagacggaacacgataccacagtgttgaaagaaaggaacatcatgagttatgtgagaatcggcgtggcgggacccgttggctccggcaagaccgctctgatcgagcggctgacccgcaagatggccgacgattattcgatatgcgtcgtgacgaacgacatctacacgaaggaagacgccgaattcctgatcgccaattcgcgcctgcccgaggaccggatcgtgggtgtggagaccggaggatgcccgcacaccgccattcgcgaggactgctcgatgaatctggaggcgtgcgaggcgatggccgcgtctcacccggacgtggacatcatcttcgtggaatccggcggggacaatctgtccgcgacgttcagccccgatctggcggatgcgacgatctatgtgatcgccaccgatgagggagacaagattccccgcaagggagggccgggcgtgacgcgttccgatctgctggtcatcaacaagaccgatatcgcggatctggtgcacgccgatctgaatgtgatggcgcgcgattccgagaggatgcgtaacggacgcccgtacctcttcaccgatctgatgaacgacaaaggcgtggacgacgtcatcgcatggatcaggaaatcggtcttgttcgaggacatgcggtgacggcatgaatcacgccatcgcacgaccacgcaccgcacgaccgtaagaggggcgtatgccggaaagcacattccgcatgtccacggcgttccgtcatgggcgcaccaaagtggacgacctgtatttcgaggcgccattcaagctgatgacgccgtttcatgacggcgcgcacacggattgcatggtcatgctcgcatcccccggtttccttggcggcgatgtggcgcatatcgattgcacgttcggagccgataccgatacgacgatgcgcacgcagagctacgagaaagtactcgacacggctgacggcgaggcgaaacgaaccatcgacctgacggtgctggacaacgcgaaagccgtgttcctgccgttcccggtcatcccgttcgcgcactcggtgttctcgaacgtcacgaacgcccatatcggtgcgcaatcgtcattcatgtatgcggatgtggtcacctgtggtcgcgtgggcatgggggagcggtggaagatgcggcggttcagcagctccactcgcgtctatgtggacgagacgagcgaggagggcggtccccggtctcgcccccgtggcgacggggaggaatccgccccgcgtctggtcttcgccgaccgcctgctgcttgaaccggaccgcttcacgtatacggatacggccatgtggcgggagttcacccactgcggcatggcctatctgcacgttccccgccgggaatcaaggcggacgcagatgacggcggaggacgagctcgtcgaacggattcgtgcactggcgcacgatcgtgggccgagaggcgagatcggcgtgagccgccagaacgaggggatcgcggtgcgtctgctcaccgaccgtggggacgacgccttcgggttccttgccgaagtcgcgcaattgctgcggtagataaccgaacactcgcgcacggcgtgtcgacatgctccttgacgagacccggaaactggtcgatgacctctccgccgcactgttgcgcgtcgaacgcatcatcgacatgctcaagcgcgaacacgaccaagaggcgaaccggccgggcgcgagatgcgcccgcacccccacgaatgacccctatcgcaacggaaggctttgcgctagggtagagcgtgtgactgaatccgtgaatactgaactccgcattgctgtaatcggcgccgggccggccggcgtctattcctccgacatcttcctgcgccagctcaagaagttgggtgagggactcggccttggcgccgaagcgcgcatcgacctgttcgaaaaactgccggtacctttcgggctggtgcgttacggcgtggccccggaccacccgtccatcaagttcatcgcctccgcgcttgagaagacgctcgacaacccgaacatccacctgtactgcgatgtggaattcggcaaggacgtgaccctcgacgaactgctggcccgctatgacgccgtgctgttcgccaccggcgcggtcaaggacaagccgctgaacctgcccggcgccgaccttgaaggcgtgtacggcgccgccaagttcgtcgaatggtacgacggttaccccaccggtgcccgcgaatggccgcttacggccgagaacgtcgccgtgatcggcggcggcaacgtggccatggatgtggcccgcgagctcatgcgtaacgccgacgacctcaaggccaagaccgacattccggataacgtgtacgagggcatcggccgcaacaaggccaaggtgctgcacctgttcatccgtcgtggcgtggcccaggccaagttcagcgtgcaggaactgcgcgagatggagaagctgcccggcgtgcagctcatcatcaacgaggacgacttcgagctggacgacgacaccatcgaggtggccggcaaggacaagctcacccgtcagatggtcgaggaactgttcgccatccgcgagatggccgaagacatgcaagacgatggcgacgtcgacttcgaaggcaatccggccgaccgcaggtattacgtgcacttcaactccgcccccaccgagattctcggcgaggacggcaaggtcaaggccatccgcgtggaacgtaccgagaccggcgccgatggcaggatgcgccgcaccggcgagttcacggactacccggtcgaggccgtctaccatgccatcggctaccggcccgccgaagcccccggcatcgcctacgacgagcatggcgcccacctggccaacgccaacggcgacggccgcatcaccgccgatgccgacggcggcgacgtgcgcgaacggctgtacgccaccggttgggccaagcgcggcccggtgggtctgatcggttccaccaaatccgatgcgctggccatcgtgaccaacatgcttgaagatctggcaagtgccgccgagggcggccgtgtggcgcaagaccgtgaccccgactccatcgaccgactgctggccgagcgcggcattcgcccgatcgacttcgccggctggaaaaaggtcgatgccttcgagcgtgccgagggcgccaaggaaggccgcgaacacaagaaggtcatcgatcccgagcagatgcgcgagctcgcccacgcctgacggttcgcccgcgccgtccggcacccgtccgtacccgcgccccgtgtgggcgcggccgggcggaccgggcgaatattcgacattgcgcttggcgcatatccagcaatcattcagcctgcgactttagtgtgtgcaatatggatgccaaagtacgggtgcacggccacttcaacggcctgaaaacgacgttgctctttaccctgatgtgggccgtcatcatgctcatctggtgggccacgggcggcagcaggcagacgttgggcgtctatatcgtcatcggactggtcaccacgttcggcacctactggttttccgacaaacttgccatcgcctccatgggcgcgcgggaggtcagcgaacgggaagccccggaaatctaccagatcgtgcgtgaactgagcgccaaggccggcaagcccatgccgcgcatctacatcgcccccaccatgagcccgaacgccttcgccaccggacgcaacgaacggcacgcggccgtatgctgcacccaaggaatcctccagatactcaacgcccgtgagctgcgcggcgtgctgggtcatgaactcatgcacgtgtacaaccgtgacatcctgacctccgccatcgcctccgccatggccaccgtcatctcctacctgggctactccctgatgtacttcggcgacgaccgcagcgacgaccgtaacgattccggcggactcggcctgatcggcgcgctgctgagcatgattctcgcgccgatcgccgcctccctgattcagatggccatctcccgcacgcgcgaatacgacgccgacgaggacggaagtctgctgaccggagaccccgaagccctcgcctcggcgctgaacaagatctcctatggcgcgcagtccgagccgatgcgcaagaccgcgggcacccagtccgtttccgcgatgatgatcgccaatccgttctccatggccggcttctcacgcctgttctccacgcatccaccgaccgaggaccgcatcgcgcgtctcatgcagatggccaacgaaatgaacggcacgccgatcgctccgcccatctatgccgcgcgagtcggcagatgacggtataatggttccctgtgcctcgttgcgccgacatgttcggagtgtggggcgcggccatacggcatgcggacatagttcatcggtagaatgaaagcttcccaagctttagaggcgggttcgactcccgttgtccgctccacttgtctcaaatggtgagaccatccaatcattccaacgttttttttttaatcttgtagacacctgctcaatcacttggtcttttgatgagatagtgattcctgcggacatgaggggaggcttctgatgcgtggtcaacagcgcgccattagggttttgtttgtcgcgcagggactgagtctcgctgcgatgagcgttgacctaacggtcactgcgctcgtgggcagtgagctggccccgttcgcgtggatggcgacgataccgatcgccctgatcgcgttggggacggtgttcgccaataccttcgtcaatcgcctcatcgccagcatcgggcacaagcatgtgttcgaggccggggcggtcatcgccatatgcggcggaatcagctcgttctgcgcggtatggttccacaatttcccgcttctgtgcgtcggcacgttcgcggtcggcatctatcaggcggcctccaactactaccgttacgcggcggccgatctcaaccccggcaaaaaggaccgggccgtgtccgtggtgctgtccgccggcgtcatcgccgcgatcgtcggcccgttgctggcgacgtgggccgagggactgttccccgtccactacgcaggctcctatctcatcgtaagcgtcctcggcatactcgctctggcgacggtggcgatgttcccagcagaccagcagatcggaaacacgcggcagcccgttggttcggcgcagaaggtcggcctgcttgagcttctgcgccgcccgcgctttctgctcggtatcgccctgggattcaccgtgtgctgcgccatgaccatgatcatggcaggcgccccgctggtgatggaacatgtgctgcacgaatccgacggcacgcgcatgcaggccatgcaactgcacatgctcggcatgtatctgcctatggcattgattccactgctcaactccaagaaacgctctcacacggtctttgtatctcttgctctagggctaggtcttgccagttgtgtgctggggcttggtcagaacgctccgctcgtcgcgatggcattgctgggcatcgccgtcgcctgggcactcggctacaacgagggcacggtgttgctggtgagctcgtattccgccgacgaagtggcgtcggccagaggcaagggcgagttcttcctcgtatgcggacaggtcatcggcagtctgttggccggctccgtcatcgaattcctcggatggcggaccatgctggcgatcctgacgctgctgtttgtgctgacatccggtatcgccgtcaacagtcgaaaggctatcgcctagctttaattcgttaacaatgtctggctcccctctctgaggggagccagaattaacaaacgaatcaacggcgtaggatactagcgcgcggcggcgagatccagaccggccgcgtcggcgaccctgcgccaccagtcgaccagcaccggcatggtggcgtgcgcgttcaacccgctgggctggggaatcacccacagctgcgcgcctccgaaccggtcggtctcttccgcggtgaggtcctgcagccccagcgcggcggacttatcggcgaacgcctgtcggtacgccgtaatgcccagtatcgcaatggcccggggatggaccctcgcgcacagctcccgcagccgatcggcgccatgacgcagctcggcggtgttcagctcactcgctttcgcggtggcgcgattgacgagattggtaagcccgatgccgcggtcgatcatcatgcgctcatcgtgaaggcgtaggccgtaactggcgtccacctgccacggcgtgagccccgaggcgaaaagcgacggccagaatcggttgccgggataggcgaagggtgcgttgaccgcggccgtccataacccggggttgatgcccacgataagcagtttggggtgcgggcagcggatgtcgtcgaccgtgccgtcgacgaaaccggcgagctcggtgcgcttcggccgccggccttccagcggagaatgtcgaatatcgctcacgggttccatggtagtcgcgccccgttccgacggcataccgccattcggtgagctccgcgcctcgcgggcaaggtgatcttgcgcacattcgccgccgaggcctccccgacaatgcgattcgtcactcggcggcgggataatggaagccatgactatcgcaactgccgaacgctatgccgaaatgctggatgccgcccgccacggcggatacgcctatcccgcgatcaacgtgaccagcacgcagacgctcaacgccgcgctgcagggattcgccgaggccgagtccgacggcatcatccaggtgtcggtcggcggctcctcctacttctccggccaaagcgtgaacgaccgcgtggtcgggtcgctcgcgttcgccgcattcgcgcacgaggtggcgaagcgctacccgaacatcacggtcgcgctgcacaccgaccattgcgccaagcagtacctggacggctgggtccgcccgctgctcgcgcacgaggccgaacaggtcaagcgcggcgaagagccgacgttccagtcgcatatgtgggacggctcgactgtgccgctggaggagaacctggacatcgccgcggagctgctcgagaaatccgtccgcgcgcatacggtgctggagatcgagatcggcgcggtcggcggcgaggaggacggccattccgcggagatcaacgaaaagctgtattccacgccgaccgacggcgtgcgcgtggcggagcggctcggcctcggcgagcacggccgctatatggccgctttcaccttcggcaacgtgcatggcgcatacaagccgggtgtggtcaagctccgcccggaactgctgcgcgacatccagtccgaagtgtgggacgcggccctcgacggccgtcttgggtcgctgggcgcgtcggcggtgtccacgtgcgcgctgccggacatgcccgagcgcaagcccttcgcgctggtgttccacggcggttccggctccacgcccgacgagatcgcccgcgcggtgagctacggcgtggtcaagatgaacatcgacacggacacgcagtacgccttcacgcgcgcggtcgccggccacatgttcgcgcattacgacgccgtgctcaagatcgacggcgaggtcggcaacaagaagctgtacgacccgcgctcctggggccgcgaggccgaatcggccatggccgcccgcgtggtcgaggcgtgccggcagctcggctcggccggcaaggcattgaagtagcgaagcggcgggcggcaccgctgacgggctgcggtcatgtgatgagatcaggacattgatggattgttcgccagacggatggggactgcaatgagcgcaccggcggaggaagatcgtatcatgaggccggatgtaatgtgcctgcggcagttgtccctgcataattaccgcatgttctccgacctgtcgatcaccttcccggatatgtctgacgattgcgccgatggcgattgcgagggcgccgtcgaggtagaaggcgatcgaggcgccgatggccgtggcaattgggtgacggtgatcgtcggtgaaaacagctcgggcaaaacgtcgattctcgatgccgccatcattgccttgggcacgtatctggtgaagatccccgacatcgacaaaccgacattcaaccgtacggatgcgcggctggcccgtatcgaaatgcacaatacgttgacggtggattaccagcagcaattcccggtttcggtgagcgcgcacggcgatgtcatggggaattcgtcgtcttgggctcgttcgctgaaaagcgcgaatggtccaagtggaccacgcattccactgcttatttgcacacgcaggatcgccgggcacatgacggagcggttcccactgtcccggattctgggccccgacgacatggaccggccggttgacgcccatgtggagcactatgtccctcggcaccccggaccttggtataccggcaagggcaggtcctccgccgacgcgctgtcgacaaggtgctgaaactgaacgtcgagcggctgcgggcaaggcgtgccggtgtgcagcagatgctgtacgacatgcttaagggtctttccgatgaggaaacggaggaattctgcgaggacatactgcgttccttggagagtgacggccgccctccgtcgtttgcccccatgctggtgcagatgctgaaagacgagatcgcggctctgcgcggactgccggaggctgccgtgccggcgccggacgcgtgagggcgcgcgggtagcttggacaggccggcggctgcatatggcgtggcagcggtagaggctgtacggtagtctgtgttcggcggaaaaggcgatgttgcggaggtgtgttatgcctggaattgttcttattggtgctcagtggggcgacgagggtaaaggcaaggctaccgatctgatcggcaccaaggtcgattacgtcgcgcgcttcaacggcggcaacaacgcgggccatagcgtggtggtcggcgatgagtcgtacgccctgcacctgctgccctccggcatcatcaacccgaacctgaccccggtgatcggcaacggcgtggtcgtggacccggaagtgctcttcgaggagattgacggcctggaatcccgcggcatcgattgctcccacctcaaggtgagcgaggccgcgcacatcatcgcgccctaccaccgcacactcgacaaggtgactgaacgcttccttggcaagcacaagatcggcaccaccggccgtggcatcggcccagcctacgcggacaagatcaaccgtgtcggcatccgcgtgcatgacctgttcaacgccgaccatctgcacgacaaggtggaggccagcctgcaccagaagaaccagatgctggtcaagctctacaaccgtcgtccgatcgacgtggaccagaccaccgaggagctgctgaagctcggcgaacgcctcaagccgtacgtggccaacaccggcctgattctcaacaaggcgcttgacgaaggcaagaccgtactgtttgaaggcgctcaggccaccatgcttgacgtggaccacggcacctacccgttcgtcacctcttccaacccgaccgccggcggcgcctgcaccggcaccggcgtgggccccaccaagatcacccgcgtaatcggcgtctccaaggcctacgtcacccgcgtgggcgaaggcccattccccaccgaactgctggacgagtccggcgaatggctgcgtcagcagggccacgaattcggcgtgaccaccggccgcccgcgtcgctgtggttggttcgatgcagtcgtcaaccggtacgcctcccaggtcaacggcctgaccgacatcgtgctcaccaagctcgacgtgctcaccggcctgaaggagattccgatctgcgtggcttacgacgtggacggcgaacgtcacgacgatatgccgaccgatcaggccgctttcgccgccgccaagccgatttacgagaccatgcccggctgggatgaagacatctccgactgccactccttcgacgagctgcccgccacctgccaggcctacgtcaagcgtttggaagagctgagcggctgccgtatctccgtgatcggcaccggcccacagcgcgaccatgtcatccagatcaattcgctggtcgactgaccgtctgcaacgaatttctcggcttgactggtaacgacgcggcacatgatatccgccggctgattccgcgattcgaccacttgaagtggaagatggcggcggccggcatagtcattggtctggtttcaggattgctggttgtcgtataccgtctcggcatcgaatacggcacggatgcgtcccgttggatatatgcgcggattcgcgagaccccgtggctgattgcgccgtgggtggttgccgcggtggcggccgcgctggcgatcgcgtggatggtcggcaaggagccgatggctggtggcagcggcatcccgcagaccaacggcgtggtgatatgcggcttgaagatgcgttggcagacgattctgccagtccgtttcgtcggtggactgttgggcgcgttgtttggtctgtcgctcggccgtgaggggccgtccattcagattggtgcgtcgggcgcgcagtgtgtgtcccaccgtttgcgcggccgccgccgtgaggacatgcaggagcattatctggtcaccgccggtgccgcggccggcttgtccgccgcgttcagcgcgccgctgtccggcatgatgttcgctttggaaggggtgcatcggagtttttcccctgcgattctgatgggcgccaccgccgcatcgctgaccgccgatttcgtctcaaaatactgtttcggtctgcgtccggttttggatttcggtgatatcggtcagctgtcgttggaagagtatgtgtggctgattccgttgggattggtggccggtttggttggttcgctgatgaaccgctcgttgcttggcttccagacgctgtacgacaaactgccggcatggagccgcccgatgattgcgattgcgatcgcgttgcctgtcggcatctggttgcccgatgtgctcggcggcggctcgaatctgattgataccgccgaacatgcgcgcgtcggcttgggaatgctgtgtctgctgttcgtggcgaagatgctgttcacatccacgagtttcggctcaggcgcgcctggcggtattttcatgccgattcttgcggtcggttcgttggccggcggcatctgcggtgaagtgttgcatcgattcggtaatctgccatccgacgcagtggcggtgtttgcggtgtgcgtgatgacgggcacgctcgccgcgtccgtgaaaacgccgatcacgtcgattctgttggctgtggagatgtctggaacgttgacgcacatgctgccggtcgcggccgtcgctttcatcgcgctgttggtgtccgatttgctgcgcaccaaaccgatctatggggagttgctggagcggtacatgcgcgcgcaaggcatgcagatggcgatcgcaagccatgtgggcagcggcattatggaactgccattggaaatgggagcgattgcggacggcaagcgggtgcgtgacgtgcgttggccgtctgggtgcctgatcatcggcctgcgtcgcggcgaaagcgagatcgtgccgcgcggcgatacacggctgcgtgccggcgactatctggtggtgctgttcagtggcgaggaggagcgcgaggtgcgaactgcgatgcggcggctgtgtgatgcccggcttgactgagcctggctgaattcggctggactctggatgtccgaatctgcggaatcggacatccagggtgcatacgttggcgctccgtgtaaactcatatgcgttaggaaggcagcaatcgcggcccagctcgttgttgcacggcctatgggcggaacaacgctgtccgcgggaggccagtacagggggagcgcaatggaatcgcaagaacaatcgccgggagacgtggtgactgcgggtgaggactcgcatcccatcacgcaggcaatcgacgctgttgaggtgacgcatgctggtgcaaccgcgcccgccgctaacaccatggatccgcctacgattcccctggcaccgatgaaacgtatgcaggcgcggttcaatccgctcgccgacggactgatgtatgttgtggtgttcgtcggtggatttgttggagtcggctgtcggcatgcgttggatatgcttctgccgtcggttagcgggacgccgttcgttgtgggcacgtttgtgtcgaatatggtcgcctgcttcctgttcgcgatgctgaccgaattcatggcgaccgcttcgtggctgcgtcgccgggtgcggcaggttgtcagccgtggcgttgggctcggcttgctcggcgggctttcgacgatgtccggcgtgatgctggaaacgatggaaggtctgcacgagcggcatatcgccagtgcgcttggctatcttgcgggaaattttgcaggcggtttgctcactgccgccgccggcgtggttctgatgcaggcactgctgtcacggagtactcgaaagcgggttcggggtgcgttttcagctgtttccgtgtccgattctgccgaatcggacacgcagggcgtacgccatgtgaaagtggccgacgtggcgcgttctgccgcgcaggccgcaatggaagccgcgcaggcggcgcagcagattgcacagacgggacaggttccgcgagtcgaaacgccaaccgtgccgccgactgccatccagcctatgcagacaggccgcgttccgcagattcctccgctggccgttcctcagctgacacagccatcgcatccgttgttgcgcgagccggatactccagacttggggcagctgcccgagattcagcagtcgcagccaatccagcagccggccaacccgcttccacccagcttcgagcccaaaccgatcactgcggagatttcgcttgtcgccgacccgactaccggggaggtgcgctgatgatgtggatgatctgtctgttcggcggtctgggagccatggcccgttacgtgctcgacgtgtcaattcaacaaggctggaaccgcgagaatcgaagaacgaaccgcaacttcccgctatccacgctcgtcatcaacggcgtcgcctcgctatgcgcgggcatcgccatgatgtcctactattcgcaatcggtggatatggacacggtcatgatgttcgttgtcggatttctcggtggtttctcaacattctccacggcgctcaacgaagtggtttcattgattcgccagcgtcgttttacgctggctctgggctatggaatagcaaccgtcgcggtgcctctcatttgtgtggccgccggtttcggcattgcgctgattgccaatccggcgtaattttcacgttacacggacggtcgctgagtaacgtgaaagaaatctgagcgcaaccgccatcaaggccgccagtccggatgcaacgctggtgattgcattcgaccagaccaagccgctgccgaaggccttcgcctccgcgggagtcgacactaagaagctgtatttcgttgccggactgtcgaacaggttcgagagaatgtaaatgaatgtaatatttcgtggtaagcacgtgagaatacggcgatagaacagtgatgacggggaaggtgcgatcatggtcggcatgcgcgatgtggcgaagaaggccggggtgtctctgagcaccgtctcgctggtggtgaacggcaacgggtacgtgtctgatgacatgcgcgaacgtgtgcgcaaagccatgcaactgctcaattatgtgccgaacgagcttgcccgcaatctgtatcatgatcgcacgaatctggtcggcgtcatcgtgcccaccatccgccacccgttctttgcgacgtttaccgcacatctgcagcatgcgctcgccgcgcaaggattacgcactatgttgtgctctaccgcagatgaggcggacggcgaaatccagtatgtcgacatgttgcgtcggcacatgatggacggcatcgtcatgtgtgcgcacacttcgcatcccggcgattattggacgtcgattcatcgcccgatcgtcgcgttcgaccgtgtgcttggagacggtatttcgtcgattggatccgaccacgagcagggtgggcgattgattgcgcagatgctgatccgcaatggtaccaaacatgtggtgatgattggcggtccgcgagatcaattcttcgatttggctgcgcgcggagaagtcgaggaaggaccgttcgatttgggaaagaccacgttcccgacggtgcgctattacctcacgttggaacaggaattgacctccgcaggcgtgaaatacgagtacgttgaagctggcgaagtgatggattttgccggctatcatcgtgcggtcagcaatgcgctcgacaaggtgacgaccgacggcgtcgatgccgtggtcagttccgatattggcgcgtcgttctgcgtgcgcgaagcgttgagccgcggaattcccattcctgacgagctgcagatcgttgcctacgatggtacgtatttgactgatttggccggcatgaagctgaccgcggtcgcgcaggatttctcggcgatcgcacagtcggcggccgaccatatcgtgcaggctattgccaatgaggaagtggctgcggctaacgcttcacgcaggaacatccccaagccgttcgagccgaatgtgcttattcccatgacgctggtgccaggcgataccacgcgttgatgctgcgcgttggaacgctgagtggggatcggacaggctgggttgtgtagaacaccgcatcaaaccggttcgacacgcgcattttgcggtattactggacatcaacgtccctttcgagataatatcaaaccggttcgatacgtataagtatgtaaaagcacgcatacactgcgtacacattgcacctgcatccatgaaccaagggaggtcccatgaaaaacaaagtgcagctcattgcttacgccgatcgtctcggcgatggcactcttagctcgatgaccgacatcctgcgcacccgcttcgacggcgtgtatgacggcgtgcatatcctgccgttcttcactccgttcgatggtgcggatgcaggcttcgacccgatcgaccacaccaaagtcgacccgcgtctcggcagctgggacgacgtcgctgaactttccaagacccacggcatcatggtcgatgccatcgtcaaccacatgagctgggaatccaagcagttccaagacgtgcttgaaaaaggtgaggaatccgagtattacccgatgtttctgaccatgagctccgtcttcccgaacggcgccaccgaagaggatctggccggcatttaccgcccgcgcccgggcctgccgttcacccactacaagttcgccggcaagacccgcctggtctgggtcagcttcaccccgcagcaggtggacatcgacaccgattccgacaagggctgggaatacctcatgtccatcttcgatcagatggccgcatcccacgtcagctacatccgtctcgacgccgtgggctacggcgccaaggaggccggcaccagctgcttcatgacccccaagacctttaagctcatctcacgcctacgcgaggaaggcgtcaagcgaggcctcgaaattctcattgaggtgcatagctactacaagaagcaggttgaaatcgcctccaaggtggaccgcgtctacgacttcgccctgcctccgctgctcctgcactcgctgttcaccggtcacgtggaacccgtggtccactggaccgaaatccgcccgaacaacgccgtcaccgtgctcgatacgcacgacggcatcggcgtgatcgacatcggctccgatcagctcgaccgcagcctcaagggcctcgtgcccgacgaggacgtcgatagtctggtcaacaccatccacgccaacacccacggcgaatcccaggccgccaccggtgccgccgccagcaacctcgacctctatcaggtcaacagcacgtactactccgcgctcggctgcaacgaccagcactatctggccgcccgcgcagtccagttcttcctgcccggagtgccgcaggtctactacgtgggcgcgctcgccggccgcaacgacatggaactgctgcgcaagaccaacaacggccgtgacatcaatcgccattactactccaccgccgaaatcgacgaaaacctcgagcgcccggtggtgaaggccctgaacgccctggccaagttccgcaacgaactgcctgcattcaatggcgagttcagctacgaagccgacggcgacacatccatcaccttccgctggatcgctgccgacggcaagaccaaggccgccctcatcttcgagcccggccgcggactcggcacggataacaccactccggtcgccagcctcgcctggaccgatgccgccggtgaccacgagactgatgatctgctgagcaacccgccgattgtcgatatcgactaaccgttggcccataaacgccactccgctgtgcgcgctccaagtagtgcgtccggcgtaagctgggtccatggaaaacaaaccgcccgcagtgcactgaagctagtgcgctcgggcggttttgcatgtggcggggttgcgggtcatgctcagtcggagctggccggtacctcccgccggtgatgagagcaaagaaagagcagcaacatgttggaaccgtacgtgcgcccgggtattgacgaccgcccggatctcgacaaggcattgagtcccgaagacaaggatgccgtggcccgactggccatcaaagatcgtcggcgtcctcccgaggcatccgccgatcagcccgaggcccaggccgtgcgtctggcggccgccggttcgtcggctgctgccgctgccgcggccagcgtggatgcccctgcgcctgatctgtcgtctgcatatctcgatatgcgcgatccgatggtcgccgccaatggtcagcgacccaccacgggccaggtatcccgtctcaactgggggttcttcgccgcttccattctggtcggcgcaccttggatagcattgaataccatcgccatgcccaacgcggtggctcgtctgttcggctacgacaccgcttctgccatatcggtcaccatcaatccgtccaccggccgtccgctgcccgtcgccactgacttggtggtgcctctggccgtgctggtggtcgttggcgtggtggcctccatgttcgcgatgcccttggtctccgcgctgtccgaccgcacacgtattcctctgggccgccgtaccccgtggatggtggcgggtggcgtgctgtgcgcgctgatcacgctggttctggggcagaacacaggcctcgtagtgctgtgtttcttctgggcgctcatgcagtttgcctatgcgatgatttccgtgccgttggccagcgccatcagcgaacgggttccggacaaattccgtccgcgcattgagcgctggcacggtatcggcgtgatgcttggccaagcgcttggtgtatgcatgggtgcgctcggcgtgatgttcgactccttcacgccgtttgcctacaccgccgtgctgtttgcggtttccggcatcctgaccgtgatcatgctgcccaaggagccttccagccaggagcagccacatcaacgattcgagtcgagccaggtgtttgaccagctgcgtccgccggcacatgcgcctgcattcgcccgtgtgttcgccgctcgcgtgtgcatgatgacgggcgttggactgaccggggtctttctgtggtatctcgtgcgcttttgggtgtatggcaaggctgtggtgttcacttccgcgccattgaccattcccgcgggcctcctcatcgccggcatggccgcggcaacgctcatcggtgctgcgctcgcgtcctgggccgctgggccgatctccgagaagatcgaggaacggaacatcgccaccactgcagtggtggcggcatcctgcctgctgtatgccatcggcgtggcggtggcatgggggctcggcgtctggtccaccggcacggcacgcgaaaacggcatgctgctcttcgcgctgatctccggattcgccttcggcgtctacgatgcgttaggccttgaactggtaatgaatgccctacccgacccgcgcaacgccggtcatgatctcggcatctatgcactgtccaattcggtcggactggcgctcgccgccatcatcggcgcgctactggtgaacgccttcgagcacagcttcggctattacctgctcttcccgtccgccatcgtcatggtgctgctggccggaatcgtcaccctcgccgccgagtccgcgcaatgacgggccggtccggctccccggccgccggcggcgttcctccccgcggcgggggcgttcgtctcggcgacgtggcgtccacaatgtgaacccttgctggattggcaagacagccagacctatgtttacattccagttcaggtcgaacggcctgaggaaataccgaaaggaggccacgcgatgactggattcaatgcttctgcgtttgtatccgcacgaattattagcccgtcttcgctggcggactaattcggcattgatgcttgaagccccgtcaacgaaggcagggccaatcaagctgacacaatcggtaaggccctgcaagatgcggggctttttttgttgcgctcacaaggcttacggcagaatcccgcagacggaaacggtagcggacagtacacggcaacagaacaacaacctccctgtgagacgaaataatcgcccgccaatgagagtgaacgagagcaaaacaggagtaacaatgactgcagcagtcgaagagactggcttagggcaggcggcaggtaaagccgctaccttggtacgcgattcggtcaagaccgtgatcgccgcatcgatggtcggtaccgccatcgaattctatgacttctacgcctacggcaccgccgcggcaaactacttcccgcacatcttcttctccgcgaaggacaaccccaccgtcgcactgctgatgagcttgctgaccttcgccatcgccttcatcgcccgcccgctgggctcgctgatcttcggccacttcggcgatcgcatgggccgcaagaccacgctggtcgtgagcctcatgaccatgggtgtcggcaccttcctgattggctgcctgcccacctacgatcaggtcggcgttggtgcagtcgccatcctctgcctcctgcgcttcatccagggcatcggcctgggcggcgaatggtccggcgcggcactggtcgccaccgagaacgcgcctgaagacaagcgcgcactgtacggctccttcccggagctgggcgcgccgatcggcttcttcctgtccaacggcacctacttcgtgctcgaatccttcaacaatcaggacgcgatgctggcttggggctggcgtgtgccgttcctgctgtccgccatcctggtgatcgtcggcctcgtggttcgcgttcacatggaggagaccccgatcttccgtatggctcaggagcagaagaaggtcgtcaagtccccgctgaccgaggtcttccgcaagtcctggcgtcaggtgctgcaggccaccttcctcgtggccgtgacctacacgctgttctacacgctcgccacctggtccctcgcttggggcaccaaggagcagggcgaaggcggcggcggccttggcttcaccaaccaggaatacctgctcatgctcatgatctccatctgcgtgttcgccctgttcatcgtgctgtcctgcctgtacgcggacaagatcggccgcaagcgcgtgctgaccttctcctcctgcgcactcgtcgtgttcgccgtgctcttcccgttcctgctggacggtggtctggtcgggcagaagaacttcctcgccaacatggtgttcctgtgcgttggctttgccctgatgggcgtcgccttcggcccgatcggcgcgttcctgcctgaactgttcgaggcgaacgtgcgctactccggctccggcatcggctacaatctggccgccatcgtcggcgcggcgttcgtgccgaccatcgccacttggctgagctcccactggggcgtccactccgtgggcctctacctcgccgtgatggccgtgtgctgcctggtgtcggtcctgacctgccgtgagacgaaggacgctgactttaccaagtgaaatcctccataactaaatatcgccaagttcacaacgtgaaaaatctcaattccactaagtgaacctctgcagggcttttccgggtcaacaggactaaacctgcatatcggaaaagcccacaaggaaagccaaaactaaaaacagtttctgcagaaccagcagagcacaataacaattaaagatttcacccccataaacaaataaataaaaggagcgccaaaaatggcagcaactatctggtacgagaaggacgccgatctgtccgtgttcgatggcaagaaggtcgccatcttgggctacggctctcagggtcacgctcacgcactgaacctgcgtgactccggtgtcgacgtggtcgtcggcctgcgtccgacctccaagtctgtcgagttcgccaaggagcagggcctcgaggtcaagccggttggcgaggccgtcgccgaggctgacgttgtgatgatccttctgcctgaccagtaccaggccaaggtctacaaggaagaagttgagccgaacctgaagccgggcgctgccctggcgttcgcccacggcttcaacatccactacggctacatcaagccgtccgaggatcacccggtgttcatggttgccccgaagggcccgggccacatcgttcgtcgtgagtacgccgctggccgtggcgtcccggtcgtcgttgccgtcgagcaggacccggacggcaagacctggccgttgtgcctggcttacgccaaggctctgggcgctctgcgtgcaggcgccatcaagaccaccttcaccgaggagaccgagaccgatctgttcggtgagcaggacgtcctcatgggtggcatcaaccacctgtgcgatctcggcttcgacgtgctgaccgaggctggctaccagccggagatcgcctacttcgaggtgttccacgagctgaagatgctcgtcgacctggctaacgagggtggcctgaacaaggctcgctggtcctgctccgacaccgctcagtacggcgactacacctccaccgtcatcaccgacgagaccaagaagcgcatgcagtaccagctcaagcgcattcaggacggctccttcgccaaggagttcatggacgaccaggccgctggcgccccgaagttcaagaagctgcaggaagagtactctcacccgcacctcgagaccgtcggcccgaagctgcgcgccatgttctcctggaacaacgccgaggccaaggacaaggacgaggccgagtccttcaacggcaagatcgcccgtacccaggttcagtgacctatgacctccttctgatgagggaggtggcatcgcgtagcgatggcggagggagagatcgttaggattaaatccctttgtacaagcaagaaaccgccgttcccgttcatacgggagcggcggtttcttgtgttcagtcgaatcagctacagcccacgactatcgagcgcatcggccagctcgtcggactgcttcaggataagcaccagcagaggcaccgcccatgcggtcacgccaccgtgacctccacgggcctgattcgcttcccgcacaattcgcacattgcgattaatcagtggaatcgctgagatggtcaatgcgcacagtagcccaatgcggtccggattgacgccgaatcgtcgcaatggccgcaatgctgccagcacggtatccagcatgtcttcagtgcgggtggtgagtgttaccagatttgcgatcatgaccagttcaagtacgcgcaccgcattgaacgccgtggtttgccatggcacaaagaacacctgcaccaccacggtgaatgccaccacccaccacgcgctccacaattgacgagcaaaaacgtgcggaccaaggccggacatggcataccatattgcgcatagcgcgccgcagacggctatcgcccaccacgataggtgcggaatcaccaataccgttgccatcaccagtgacacgatgagtttcactgcggcagggcatcgatgcagcacgctatcgcctgcgatatacagcgaaatcatagggatgcctcggcttcttcgttgtccgcgacgccgcagtcggcaagatatcgcgcgataacgtggcgtggctcgccggtttcgataatgtgcccatcggcaaagcgaactgccatatcgcagcgtgcggcaagccgaagattatgggtggaaacaatcagcgggcaggcgatatcgtgtatcagcaggttttcgatgcgcgtcgcgttgggcaaatcgagcatggtggtcggctcgtcggcaagcaccagccccgggttgcgcacgagcacggcggcaagggccagcatttgtttctgcccgccagacaggctgtgcgccggagtaccagcgtgaggcgttaggccgaatgattgcagctgacggtcaaccagtgccgaagactcggatttgctcagccccatgccccgcagcgaaaaggccacgtcttcggctggcgtgggcatgatgatttgcgtgtcagggtcggtgaacacgaaccccactttgcggtgcagctgcttggcttgccgtgtggggtcgaagcccatgacacgtatggtgcccgatgtgggcttggccagaccgtcgatcagacggagaaaagtggatttacctgagccgttgacgccaatgacggcaatacgacgagggcctgagcccccagcaagaccaaggtcaagctggcaactcaggtcatcaataatacgtttgccttctgcctcgacgctcacatggtcgaagacgatcatttgctagcgcgcaacgattcggggaatgcggccgggtatgcgcgcatcagcgcggtggcaatcaacgtggcaatcaccactttggcgatatcaccgggaacaaagatcatgccggagataataacacccttgagaggagcgcccataaccaatgcctgaaccgggaatccgatggcatacggaatcagtacgccgccaaccaggctggccagcgcactcttccaccacaccagacgatggccctgatgtgcgataagtccgatcaccaaggctccaagaatccagccgtacagatatccagcgcttacacccacgaaaatcgctggaccgccgttgccgccaagcaggggaatgccgacgaaggtgagtacgagcatcagcaacaccgacagcattccattcaccggtcccagaatcagacccgctaacatcacagcaagggtttgcagagtaatcggtaccggaccaacaggaatgcggataaagctgaacacactgagcaacgcggcgaacatggcaatgcgcaccaagtcgcggctcgtgaaatgaacatgcgaagccataataaatacagtcccttcatagtagttgccatgtgctttcggccgaatctgtccctccgcccgatgctccccatggagctcgtgcggcatattgcttgcacgagtgtgggtcgcagaccgctgcacatgacgagttgtaataacgagcactcatgctaacgatgatgagcggcgtgcgattggttggcctgtacaaaaaatagtgcatctacttgtgcaacactgaatattggtcatagccggaaaggggaggcatggtgaacggcgtgcgtgacggatcgcaggacaaaggctggaatccagccattcgcgggcgtctcgtggatggtcaggggcgatgtgttcactggcattcgccattggatgttgttgcgaatcgtttcgcctgctgtgacgaatattacgcttgctaccggtgccatgatgaactggctggacatgatcgcatcgcgtggcgagacatggattcgctcgctgtgatgtgcggtgtctgccggcaccagatgacgcctcgcgaatacgggcgggcgatggagtctgttactccgtgctgcccttgctgcggcgcacggttcaatcctggatgtgcccttcaccacgatatttatttcagtgattgatggaggcggacgctggcgcaactcttgttttggaattgctatgcgagggtggtaagtctatttctcatgctctggcgtgaaatagctcacgttgtggactctgaccgggctgtggccacgttgtcggtaggattgaactcggtttgaaggacacaatcctcgcaacacaggacttatctgcacaccgtagataccccggcgcccgtggcgccacaccccactactgaaaaggagtgccaataatgacagcacagatctggtatgagaacgacggtgatctttctgttctcgaaggcaagaaggtcgcaatcatcggctacggctcccagggccacgcccacgcgctgaacctgcgcgattccggtgtcgacgtggtcgtcggcctgcgtccgacctccaagtcggtcgacttcgccaaggagcagggcctcgaggtcaagtccgtggccgaggcttccgccgaggccgacgtgatcatgatcctggcccccgaccagtaccagcgcaccatctgggccaacgacatcgagcccaacatcaagccgggtgctgccgtcgccttcgctcatggcttcaacattcactacggctacatcaagccgtctgaggatcacccggtgttcatggttgccccgaagggcccgggtcacatcgttcgtcgtgagtacgccgctggccgtggcgtgccggtcgtcgtggccgtcgagcaggatccgcgtggcgatggttgggctctgaccctggcctacgccaaggccctcggtgctctgcgcgccggtgccatcaagaccaccttcaaggaagagaccgagaccgatctcttcggcgagcagaacgtgctcatgggtggcgtgaacaagctcgtcgagatgggcttcgaagtcctgaccgacgccggctaccagccggagatcgcctacttcgaggtctgccacgagctcaagatgctcgtcgatctgatgaacgagggcggcctgaacaaggctcgttggtcctgctccgacaccgcccagtacggcgactacgtcaacaccgtcatcaacgaggactgccgcaagcgcatggaataccacctgcagcgcatccaggacggctccttcgccaaggagttcatcgacgatcaggatgccggcgccccgcacttcaaggaactgcaggagaagtactccaacgagcgcatcgagaccgtcggcccgaagctgcgcgccatgttctcctggaacaaggatggcgtcaaggatgccgacgaggccaactccttcaccggcaagatcgcccgcgcccaggttcagtgattgccgctgactagcgcataccacaggccgccgctccgataccttcgaagcggcggcctttcccatggtcccaccgcgtagccaaacctccactacgtggtgattctctcatggggcggtgaatctctcatgaggcggttaaaccctcatggggcggtgtttcaaaatggcttaattccgcggtttcaccaatccttcaaaccgccccatggggaaattaccgccccatgagagatttaccaccccatggaagcgccttattgtgtgatgatccacgccgaggtgtcggtggggagttggccatcgggggtcagcgggccggacgccagcaccacatcgccctcgggtagcacaactgggtcatcgccgaaattggtgatcgatgtgaacgtgcgcccgccaaccgccgcgcgggtgtacgccaccacatcgtcgcccatgtccacctgctcggccgtggtgtcgcgtgtggcggtcagcgactcctggcgaatcgccagtgcggcgcgatacagcgcgagcatcgagtccgggtcggcttgctccacgtccaccgcgtaatccttgaaccacagcggttgcggcaggtgcgggtcggcggccggcgtcacgccctcagcgcgcgtagccggcgagaagccgaaggaagcgcccgtgccgaactggccggcggcgcacagcggcacatggttctcgccggtaccgtcatcggccggagtcggacggctgaaatcggccaaggccggctcatcggcggcggtccacggcagcggcacgcggcagccgtcgcggcccttgtccatcgtggcctgagcagtgtggaaagcggtcggatcctccaagtgatcccacggaatatcggccacctcaaacaggcccagctcctcgccctgatagatataggcggcgccgggcaggccgagctccatcaaagcggcggcgcgggcgcggcgagtgccaagctcgcgatcctcgggataggtagtgccgttgcgcagcagccagtcgtgcggcagctggtggtagggcgcgcccttgatctgcggcaggccgtaacgggaggggctgcgcggcacgtcgtgattgttcatgacccacgtggtggtggaaccgccggtttcggccgccgccttgagtccggcggcgatggcctcgcggaactcgtcggcataccagttggcttgcgcgaagtcgaagttgaaggactggcccagctcgtccatcgaagcgtacaggtgctggtgctcgggcaccacccacgcctcggccacggcaaagcgcggcgggttgtactcgttgaacaccttgcgccattcgcggtagatatcgtgcacctcgcgacggtcgaacagcgggtggctgaagtcatgattcagcacgccgaccacgctgtattcgcggccgagctcttccaacggcttggattcgaggtccttggccaggccgtgcgccacgtcgatgcggaagccgtcggtgccgtggtcggaccagaaacgcagggtcttcttgaactcctcgtggatgtccggattcttccagttgacatccggctgcgccttatcgaacaggtgcagataccactggccgtcggccacgcgcgcccaggccgggccgccgaagaaggattgccagtcgttcgggggcagttcgccatgctcgccgcggccgtcgcggaagatgtagcgatcgcgtgcgggggagccgggctcggcggcgagggcctcctggaagaacacgtgcttgtcggcggtgtgattgggtacgatgtccacgatcaccttgatgtcggcctcgtgcgcggccttggccatcgcgtcgaagtcgtccatggtgcccagtcgcgggtcgacgttgcggtagtcgatcacgtcgtagccgccgtccgccagatcggaggggtagaacggggagagccagatggcgtcgacgccgaggctcttcaggtagtccatcttctcggtgacgccggcgatgtcgccgagtccgtcgccggtgacgtccttgaagctgcgcgggtagatctggtagacgacggcctgcttccaccagtcgtcattgagattatttgcggtcatgccgattccctcctgttccgggtgcgttgtggttgggttgttccggtcgcgcccgaactgctgtgtgaaggcccaaccgttgtattgatgatgacaacgatatcatgtgaattacgcatgcaacaatcgatttatcggcgttttgcggtggtaacgtggtcacgcctgcgcgggcgctgctgtcgcggcaggcggcgtggtggtttcgcgcagtattagcggagtgtccggccgtacgaatgccggttcgattgacttgccggcaatggcatccaataccatgtgcccggcagtcgcgcccattgcgaacgggtcctgatgcagcgtggtcagtcccacggcggcggacagggtggaatcgtcgaagccgatgatggaaatgtcctgaggtacccgccgcccgtattgacgcaggcgatacagcacgggcgcggccatttcatcatcctcaaaacagaaggcggtgatgctgggggaggcgttcagtacggcgttcaatgccgcgttgctttcgccaagaccgcgttgaatgctcaggggcgttagctcgatccccggatgggcggcagcggcatcaatgacaccctgcaaacgagcctcggtactgtagcgcatattggtttcggtcggtgcgctgccgacgaacgcgatctgccggtggccgagtgcaatcaggtgctcgatagccgaacgtgtggcggcgtaatcatcaatgctcacgcctgcgtcgaacccatcggtggaggggatgttgatgccgacaatcggcacgtgcatatgcttcagtcgctccacctcagccggttcgatgtcgaaggagctgacaatcaccgcatccgcattgcgccgcacgggcaaatccgcaaagaagtcgtggcgctcggcggcgttgcgcatggggtagggcacggtgtcgtagccggaggggcgcagcgccgagtcaaggccggcgaagatgttcgaattgaaccagctggcgatggtctcgctggcaagcaatgcgatacggaacgattggccggatttcagggcggcggccgagcgagagactgagtagtcgagcttttcggccgcggccatcactcggtctcgagtctcgggaagcaccagatccggcttggcgaaggttcgggacaccgtggatacggaaacgccggcctcgcgggccactgcctgaatgcttgccttggtcatatgccgtcgctccttcgccgtcgcgaacaatcattgtcatgacaacgataacatgcccataacaagtcgtcgtcttcggctatctcgattacgaggggctgatttagaccaatttcccattgccggaatcgatcaccgcttctctcggcgcatcacggcggctagggactgcacgcgtggcaggtcgaagacctcgtcggtatgcaccacgtggcctgagctgtccgccagcggcacgcgccagttcgaatactcgctggaagtgcccggctgattctgggaacggcattcgcccacgccgtccaccaacgctgcctgcagcagcagcgacggcgtatcggtgagcatggcgtgcatcgcctccacgatctcctgcacatggccttccacatcatccgccacggtctgcgatatatagccgttctccaccagacggttcatcatggccgtgcgttcggccatcgccgaggcggcgaacgcctccaccggctcgctcaggagatgcagctcctcgcgcagcttgacgtgttcgaagttcaggtagccggcggtgggtggcagatcgtgcgtggtcaccgaggccaatgcctgcttgcggtagtcctcgggtgtgcggtacgggtcgccggcgttcggcgaatcgtccacgcggttgaaccattccacgtcagtgccgagtacgccgtgatctgccagaatgcggcgcacgtaatccggcacggtgcccagatcctcgccaaccaccatgcctccggcgcgcgtggcttcgatggccagtactcccagcatcgcttcgtggttgtacgttacgtatgcgccgttgagggcgccgagcccctgcggaatccaccacaggcggaacaggcccagcacatggtcgatgcgcaccgcgcccgcgtgctcgtacatcgaatgcaccatctcgcggtacacctggtagccggtggcctccagatagcgtgggctgaacggcggctggccccaatcctggccctgctggttatagaagtccggcgggcagccgaccgtgacgccgccggaggcgaagcgttccggattggcccaggcatccgcgccgagcccgtgcacgcccacggccatgtcttgcatcagacccagtgtcatgccgtggtccagcgcctcctgctgcgcggcgttcacctgctcggcagcaatccactgcagccaacggttgaactcgaacaggtcgtggtgctcctcgacgagctggcgcacggccgggtcgtcgatggtcttctcgaagaaccaacggttctcgccccacggcgcgccccatacctcgaagcacaggcaccaggtggcgaaggaatcgaggtctgggccggcggtggtcttgaaatgctcgaattcgagctcgcgcttgttgttgcggcccgcgtcgaagatcaggcgcagcgccgggcgtttggccgcccacgccgcgttgatgtccatcgggttcgattcgtcgttgcgtgcggccactgaatcatgcagcgcatccacctgcgctcggatatcggccggcagcgtgccgtattcggggatgtcctgcgggcggatgtacgtcacgttgaggaatcggcgcgattccggtaaatacggcgatggctcaagcggcggaatcggcgcgccggcgtgaatcgggttgatgagcatgaagtcggctttggacttgtcagccgcgtccgccagcagcagcttcagatcgccgtaatcgccgatgccccacgattcgcgagaccgcacggaatacatctgcgtcatccagccccaccgctggtgctcggcgaccgcctccggcacgggaatgcgcgcgggggcggcgatgatggccgccttgccctctcgcccgtccaccgtgacggtcagtgtgtggtagcccatcggcagatcgggagcgatggtcaagtccggcttgccggaattgaggtgcggcagcagggcaaagtggccgaacgcggtgccgtcctccagctcgatggagacgatgatgtccgcgtccgacgaacagttcagggtgatgccggtcggtttgccggtggtggcgacgatggtggaggggagcaaacgtttgctgttttccacctcaagttgggtcatggagcgtgcgatggcctcgtcgctggatgcgtccacgtcgagggcattgagtacggcgaccaaggccgcgtcgctgatttcggtgtaggtgccgagctggtcgatgaatgaggtggcaagcccgcaggttttggccagcttgaccagcggacgggtgagtcgttcagcgctttccgtacgctgcgaggcaccggaagcggcgtcgttggtggcgtctgcgatggtgccggtgatggtcgctgcgtcgttgccgtgcgcgtcggtcatgatgactccttgcttgcaaatcgggtactgctagtcgtttgcattgctgttcgagggccgctctgcgttgaggttccggcaatctggcagaccaatgtccgagctgttctgtctttaccgtaactcatattgacaacgattgcaatacattcggtgagttgggcaattagcgggctatccgagcacgacgaacgactgcggggagagcgtcgggtggccgtcccagcgccagtcgaggtagaagtccatgtcgaatccggcctgcatcgattcgttcggtcggccaacattcggcgacgaacgccgcctcggggaattcggggcggattttcgagaacatgtactgccaggtgcggatcgtgtatggctttgccggttcatgcggcgatgatgcctcggccgattcgacgaagaatgttcacccggcgttcttccggcggtatccggacgttggcttgtgatgcctaccgtggaatccggaatcgaaagatccaagcaatgcaggtgcggaacggttccgcgaagctggaaggcgtgacgacgacggacgtggccaaacgggtgcggccggaggagtgcgggccggacggcgcagatgacactgcatggaagaaggaagaacaatgggcaatcacaaggctttgacgagcgccgtagcggcgatcgcctccattgcgacgctcggcgcgctcgccgctccggcgtttgctgtcgatgccgcgaacggcacctacagccccaacggcaagtcggtcgccgagctcgccaagcacggcgcggcgcagcgcatcgccgccatcggcaacaagagcgcgaagaacgtcgtgctgttcatcggcgacggcatgggcgattcggaaatcaccatcgcccgcgactatctgaaaggcgccaacggccacttcgatggtctggacgcggtcggtcagcccggcgcgcttgacgacgtgcaggcgggcaccggtcagtacacgaccttctcgctcggcgacggcagcaaggacagcgccgtcggcaaggatgccgccggcaagctggtcgccaaccccaacccgggcaagctcacccccgtcaccgattcctccgcgtccggttccgcatgggcgaccggcaccaagacctacaacaacgccgtcgacgtcgacatctacggcaacccgcagctgaatctcttcgagctggccaaggccgccggcaaggccaccggcaacgtgtccaccgcggaaatccaggacgccaccccggccgtgctggaatcgcactccaccgagcgtgcctgctacggcccgcagggcaagaccgacggcacttccaacaacgcctccaaacagtgcctcgccaaccagctcaaggagaatggcggcatcggctccatctccgagcagctgctcgacacccgcgccgatgtgaccatcggcggtggttccaagtacttccgccagaccgtgcagggcggcgaatacaagggcaagaccgtgtgggagcaggccaaggacatgggcttccagaccgttgagaacgacccggccgcgatgaacgccctgcagtacaaggatggccagccggtgctcgccctgatgagcgacggcaacatgccgaccaagttcaacccgtccaaggccaccgccaaggatccggccaaggacgccaacccgaccgtgtgcaccccgaatgacgcctggctcggcaaccgtggcgcctcgctcaaggacatgaccaagaaggcgctcgatctgctcaacgccaacccgaacggtcagaagaacggcttcctcctgcaggtcgaaggcgcttcgatcgataagcaggaccacgccgccaacgcctgcggccagatcggcgagaccgacgacttcgaccaggccatcgcctacgccatcaagaacgtggacctcacgaacacgctggtgatcgtcaccgccgatcatgcgcacacctcccaggtcctcaacgcccagccggcctacgcgctgtccaccgtgctcaagtccgccgacggcaacaacatggtcgtctcctacggcaccgcccaggcagcctccaccgacgccgaaggcggctacaacggcggcgacatggagcacaccggcacccagctgcgcatcgccgcttccggccccggcgcccagcgcgtcatcggcctgaccgatcagaccgacaacttctacaccatcgccggcgccctgggcctggccacctcccccgacgagcagaacgcgctctccaaggatggcaccgtgaaggtcgcccgcacgcaggccggcaagtacgtcgccaatgtcgacgggttcaacggcgacgcgctgctcagctacgagctgaaggacaagaacggcgccgtggtgtccaagtccgattccagcaccccgttgtccggcgtgcgcgtcaagcccgcgcagaccacttcgatcgcgctcgacaagatgtcggaaggcgccgagtacacgctcaccgtcaccggtcgccagtccggcaaggtcgcgaccgtcgccatccaggcgccggccgccggctccgccgacaagaagccgggcgccgacaagaacggcgtgatcgcttcgggcaaggtgccgaacgattccgcggtctccggcccgctgggcgccaccggtaccgccgtcatggccatcgccatcgcggctgtgatgctggttgcgatcgcgatgctcattaaggccgcgcgtaacgccaggaacaactgattcggccttggtcgaccggtaatcccgagtcgtccagccgccggaaaaccatcgcccgccgagccgatgcccggcgggcgatcgttttccggcggcttttggctgtgacgcgatacgtgccgtgtgccgcgcttcgcagaaacctgagtgagaatagctcaagttttttgccgaatccgggaatatgcacttgcggtttaaagttgagtggtgtaggctcaagtttcggaagcacgggaatgggcggttgcgaatgcaaaccccacaaccgagaggaaccgcacacggaaccgaccgaaacccgggcgaagaacgaaagaacgaacacgtgcgagacggctcgcgcacaccgcgcgtcacaacccgaacgggtcgtggcgaacggcggcgccggccgggcaatcgcaagtcccacaaaggagcacacattatggcacgcgcagttggtatcgatctgggaaccacgaattcctgcatcgcgactctcgaaggtggcgaacccaccgttatcgtcaacgctgaaggcgcgcgcaccacgccgtccgtggtggccttctccaagtccggcgagatcctcgtcggcgaagtggccaagcgtcaggccgtgaccaacgttgaccgcactatttcttccgtcaagcgccacatgggcaccgactggaccgtcgacatcgacggcaagaagtggaccccgcaggagatttccgcgcagatcctgatgaagctgaagagggacgccgaggcatacctcggcgagcccgtcaccgacgccgtcatcacctgcccggcatacttcaacgatgcccagcgtcaggccaccaaggacgccggcaagatcgccggcctgaacgtcctgcgtatcatcaacgagccgaccgcagccgctctagcctacggccttgagaagggcaaggaagacgagcgcatcctggtcttcgacctcggcggcggcaccttcgatgtctccctgctggagatcggcaaggatgacgacggcttctccaccattcaggttcaggccaccaacggcgacaaccacctcggtggcgatgactgggatcagaagatcatcgattggctggtttccgaagtcaagaacaagtacggcgtcgacctgtccaaggacaagatcgcgctgcagcgcctgaaggaagccgccgagcaggcgaagaaggaactctcctcctccacctccaccagcatttccatgcagtacctggccatgacccccgacggcaccccggtgcacctggacgagaccctgacccgtgcgcacttcgaggaaatgacctccgacctgctgggccgctgccgcacgccgttcaacaacgtgctgcacgacgccggcatctccgtgagcgacatcgaccacgtggtgctcgtcggcggttccacccgtatgcccgccgtcaaggatctggtcaaggagcttaccggcggtaaggaagcgaaccagtccgtgaacccggatgaggtcgtggcggtcggcgccgccgtgcagtccggcgtcatcaagggcgaccgtaaggacgttctgcttatcgacgtgaccccgctgtccctcggtatcgagaccaagggtggcatcatgaccaagctcatcgatcgcaacacggccatcccgaccaagcgctccgaggtcttctccaccgctgaagacaaccagccgtccgtgctgatccaggtctaccagggcgagcgtgagttcgcacgcgacaacaagccgctgggcaccttcgaactgaccggcatcgccccggcgccgcgtggcgtcccgcagatcgaggtcaccttcgacatcgacgccaacggcatcgtgcacgtgtccgccaaggacaagggcaccggcaaggagcagtccatgactatcaccggtggctccggcctgccgaaggacgagatcgaccgcatggtcaaggaagccgaggctcacgaggctgaggataagcagcgcaaggaagacgccgagacccgcaaccaggctgaggccttcgcctactccaccgagaagctcgtcaacgacaacaaggacaagctctccgacgacatcgtcaaggaagtcaccgacaaggtcaacgctctgaaggaagccctgaagggtgacgacaccgagaaggtcaagactgctcagactgagctgatgaccgccgctcagaagatcggccaggtcctctacgcccagcagggtgccgagggtgccgcggctggtgccggtgcggctggcgctgccggcgctggcgcttccgctggctccgcctccggttccgacgacgacaccgtcgaggccgaggtcgtggacgacgatgacgacaaggacaacaagtgatgtccgagttcaacaaggacgactacctgaacgacctgccggatccctcagatgctgaggctgccggccaggccgctcaggcctcttcaggggctgacgcctccgccgagtccgactctgcgcaggattcggctgcccaggctccttccaatgaaggagccgacgcggctcctgccgcagctgagggagagaagtcggatgccggagagaagactggcgaaggccagtccgattccgaagacaccctcaccccctcagcaaggccaagaaggaagccgcagactacctcgaagccctgcaacgcgaacgtgcggagttcatcaactaccgcaatcgcacgcagaaggagcaggagcgcttccgccagcacggcatcatcgacgtgctgaccgcgctgctgcccgccctcgacgatatcgaccgcattcgcgaacacagcgagatggacgactcgttcaaggccgttgccaccaagatcgacaaagccttcgagaagttcggcgtcgagaagttcggcgaaaagggcgaggacttcgaccccaccaagcatgacgcgatcctgcacaagccggacgcgaatgccgacaaggaaacggttgacaccgtggttgaggccggctaccgcatcggcgaccgcgtaatccgcgccgcccgtgtggtcgtggcctccccgcaagaccgatgacatgttggctcccctcgatgaggggagccaacgcgaagaacgtatacgaaaggagacatgaatggctgaaaacgaatggctcagcaaagacttctacaaagtccttggtgtctccaaggacgcttcggacgacgacatcaagaaggcgtaccgcaagctcgcccgcaaataccatcctgacgtcaacaagaccaaggaagccgaggagaagttcaaggacatctccgaagcctatgacgtgctgagcaagaaggaagatcgccagaagtacgacgcgattcgtcagttcggcatgggcggcgcccgcttcgccggcggttccggcgccggcggcttcgatgcttccggtttctccgacatcttcggttccatgttcggccagggtgccggcggcaatggctcgcgcatccgcttctccacttcgggcggcggccccaacaacatcaacgacatcttctcgatgttcggcggtgctgcaggccaaggcggctacagccagcaggcgtacggcaatgccggcggctatggctatgaggaggccccgcgccccgaaaacggcgaggaccgcaactccaagatcagcctgaccctgcgtcaggcggtcaagggcgctaccgtgtccctgtccgtggacggcaagaagttcaaggcccacgtgcctgcgggcgtcaaggacggccagaaaatcaagcttgccggcaagggcaagccgggcatcaatggcggcaaggcaggtgacctgtacctgcacgtcaccgtcaagcccgatgccgcgttctcgatgcgcggccacgacatcgtcatggacctgcccgtcaccgtgggccaggccgtggccggtggcaaggtcgagaccaaggacatcgacggcaatcccgtcaccttcaaggtgccggccggttccagctccggcgcggaggtcaagctcgcgggactcggtgtccagcgcggcaaccagccgggcgacctgatcggccgcgtgcagatcatggtccccgccaagccgggtctggcggtcaagcacgccgccaaagaattcgacgaaaaagccggcgactatctcagcctgtaatcaggaggtgaacaatggcgcggttagccaaccaaatgaagcagttgtacgcaatgtgcgcaaccgcgctggtgatgggcagggccgatctcgacggagccgatgatgtcggcttcgatatcgaactgcccatcttcaccgtcggccaggccgccgaactggccaacatccacccccagacccttcgccagtacgaccggctgggtctggtccgtccgcagcgcaccgatggcggcgcacgccgctactgcctgcgcgacattgcccgcctgacccgagctcagcgcctaagtcaggatgagggcatcaatctttccggtatcgcgcgcatcctcgagctcgaagaagagaatcgacagttgcgccgtgaagtcaagcgcatgcaaaccggcgaccaggaaagcgtcttcgccgctggccgagacggcaacatcgtggaggtgcaacgctccaaccgcgcccgcctctggcgcaacgccatccgccgcgaaacccgcgaactgcccggtcgcgataccgccgccgataccgctgcctgcaccaccggcgactccaacttcactcccgccggctccaagtccatggtcctgtggggttggtgagtctggccgcattgcttcgattccttctccattcgtaaaactgtttgttatctcacatcgggcagctgccgaaaagagcacgaattttcttgacggagatgtcaaggtttgttacggtgacgtgcgaaaaccgattcgtaaggggtgctttaggctgagacggtatgtaccgaacccttcgaacctgtgagctaacactcgcgtagggaatacgacggttgaactcctctgttcggctcggcatcccatatgcgcgttgagagagaggaagcgtatgtcaatacgcaaggagctgaccgcccagaacgtactgctgggtttccagcatgtgttcgtttccaatgtttggcttgatccggtattcgtggccggagcaatcggcttacctattgccctgtcgtcgaacatgattaacgccatcttcatcgtctccggcctggttactctgatccaggccactcggctggttcgcctgccggtggtgcaggggccgtcagccgcgtttgacgcgttgatgatcgcggcaggtacggctggcatgctgggggcggcgagttcgtccattctcatcgcttcgcttgtgttcctgttgctgtgcctgaccggtgtgatagagcggatgaggttcctgttctctccgatgatctcgggcgtggtcatctttatggtcggtgtttcgctgtccggattcacgctgagcgagtttcttggtggggctcccggcgacaaaacgtttgccgatccgcacatcctgaccgtgtcgatcctgaccacggcgattgtgcttgtcctgtcgctgctcggcaagggtctgcttaagtcgttctcattcctcatcgcgcttgtcgtcggcaccgtggtcgccgcggcgtttggcatggtggacttctctcctgtggcttccaagggatggttgggcctgccgaccttcatgccttacgggccgtttacgtttgactggaagatcttcattccgttcttcatcgcctatatggttgccgtcatggaggctctcggcgtctatcaggcggcttccgagattcaaggcacgaccctcgaacgcaagcaggtgcgctacggcctcgccggcgaggcggcaggttcggccatttcctcgttgattggtggattcaccaccaccgcatacccgcaaaatgtcggcctgctcaacctgaccggcgaaggcaagctgcgcacgcgcacgcctgtgatcatcgccgccatcctgttgctgattctgggcttcgtgccaaaggcaggcgcgctgctgtccgtcattccctcggcagtcgtcggaggcatcttcctgccggctgcggccagcctgatcgtgaccggtctgcgagccttgcgcaaggtcgctgatgacgagcgccgtcaaacggtcatcggcatgtctctgctgctcggcatcgccctgcccaaggcgctctccggcctgaccggcggcgcaagcgtgttctttggcaacaacatcatggtcggtgtattcagcgccatcattctcaatgcgctgttcatcgctcttccggatttggtggcgaagcatcgtgcgccggcgtccatggatgttccagcagccgattcggcggatgggactggcgccgcggcgcacgatgaacgataatgctggttgatattggatattgacaggagcgatgcaatgactgatgtgatggatgacgcgcgtcgtatcaagcgcgggattctggattttatccatacctatggctgtgagcaggccccggaagaggcgtttggtgcgttggcgcgcgacgtgttcatctatcagtacacgtatgatctgccgtaccgtcgttactgcgcggctaaacgcgtcacccccgcaacgctcaaggattggcgggagattccgccgatgccggtggacgggttcaagcaccttgacctttcgaccataccgaccgagcagtgcaaagccgtattcatgacgagcggaaccacgcatggcggcaagatgcgtgggcgcaacttccaccctgatcttgaggtgtgggatgaatcgatgattgtgccgttccgtcatttcatcatgccggatcgagagcgtatccgcatcgccgtgatttcgccggcgtgggacatgaaccagaattcctcactgtcgcggtatctcaccaaggccgtggaactctgtggcagcgaaggcagcggcgtgttcttcgatgaacatggactcaaattcgatggcatcatcgatttcctcaatcgtgcggtgtccgacggcaaaccggtgatgctgatgggtgtctcgtcatcctacctgtatctgctcgattacctgcatgagcatgatctgacgttcgcgctggcccccgatagccgcttgttcgacactggcggcttcaagagcaccaagcgcgacatcaccgaaggccagatgcttgacgaactggaacagacactgggggtgccgcgccaccactgcgtcaacatgtatggcatgaccgagttgagctcgcagatctatgaccaaaatattctgtcgtggtatacggatggcaccggcaactatctcaaggcgaaccccgcctgggtgcgcacggtcttccttgatccggagacgctgactcccgtcaaggatggtgagaccggtgtgatagcccattacgaccttgccaattggaattcatgcatcggtattctgaccgaggatcttggctaccggactccgggcggattcctgctgcagggccgggcgaagggagccgaggcccgtggttgctcaatcgcggtagacgaggtcatcagtgccaaccgctgacgaatctgtgagtcaggccattgatgtcttccacctgccctcgggagcggatgtttcggattacgaaatctatgatgtcgccacatcggatggggtgaagcgtttgcgctatccgcgactggatggcccaaaggtgacttcccttgccaagcagcttgccgatgttcgcaaccgcacgcttgccgcgatgagtgtcaacgatattctcgacatcgtggccgacgcggcccaactatgggccgatccggattttgagctgcggcgccaagctgaactgctgattcccgcaatcaccggatatgagcctgacatggtgcggattgagctcaaacggtatatgcgccagttcaggcgtcgtgaactgctccgtttcctggactccgaaatcggtcagccgtctatgctcgacgaattccggccgaacaaggcggggggatactctaaatatgtgggcccggcgctcacctatcaggtgttctccagcaatgtgccggggattcccgtgtggagcatggcgatgaccctgctggtcaaaggcgcgattcttggcaaatcttcattttccgagccggtgatgcctgcgttctttgctcgcagcattgcgatggtcaattccgacctcgctgatgccattgcggtggttccatggaagggcggctcgcagcagctcgaggattcagccatcgatgtggccgatgccgtgattgtttacggttcttcgcagactaccaaattgattgcgggcaaagtcgccggatccaagccctgtctaggttacggagcaaaagtcgggttggcgttcattggccgagaggctttgcgccctgatacctatgccgataccgtgcatcgtgtggctgttgacatcgccacatatgaccagcaaagctgcctggctccgcagaccgtgttcgtggagactgatggagccctcaccgctcgtgaagtggctcagctgctcggtggcgagcttgagaatcagcagcgcaaatatccgcgctccgtattgagtgacgccgagaacgtggccattcagcgggcgcgcgccgacgctgagatgagagctttgatgggcgggaaggccgcggtgttcgccagtggccatagcacggcatggtcggtgctgtatcgagaacttgacggtagcggtgccgacgaggatgttgcttcgctgatgtcgccgttgaaccgcaccgtcaacgtggtggcggtgccagatttgttggacgctgccagaggattgacttcctgccgtggctggctgcagagctgcggtgtcgctgtggattcgaccagactgtttggtcttgcagatacattggccgaggtcggtgtgaatcgcatctgtccgctcggtgagatggatcgggcgaaatccggctggcatcatgatgggggcttcaatctcatcgatctgttgcgcgcggtggatgtcgaacgcggcagcgacgcgtacggcgattcgttcgatatggatatggaataggcctgtgctgttgcgggcagcaggggctggtagcggggtgaaaggcaagggtaatgacagagcaaagcgatatggcacggcgtccaatggtgaatctggatggcagaacagcgatcatcaccggttccggcaagggcataggagcggccgtggcgaaatgcctggcatcgcacggagccgctgtcgtcgtcaattacgtacatgacgccgccagcgcgcagcgcactgttgaagacatccactcgctgggaggcttggctatagctgtacaggcggatgtttgcgatgaatcgcaatcttccaagctggtgggtgccgctgtcgactcattcggcggcgtggacatcttagtgaataatgctttcggacacttctcctttgacccgcgtcgccgttccacttttgctggaggcgattgggatgagtttagcgcacagatcgagggatgcctgcatggtgcatatctgatgtgctcacatgtggtgccgctgatgcgagcccagacctccgggcgtatcatcaacatctccagcaatctggtcgattcgcccatcgtgccctaccattcgtatatcactgccaaaggcggcttggtcggcatgacccgttctctggcccaggagctgggcggcttcggcattaccgttaatgccattgccgcaggtttgacggccggaaccgcatccagcgcagccaccaccgaggatgttcgtgaacgaatcattgccatgacgcctcttggccgccttgcccgtcccgatgacatcgccggaggggtcgcgttgttggcgtccgacatggccggcttcattaccgggcaatgtctgcacgtcgatggtggtttgaccatgcgctgaggcgcaggggcggtgtgctgacgcgctatggttgtcgcatccggttggtgcaatggaatgcagcaagagtaaaggcgacaattggcgtgcgggcatgcgaacggaggtaaccatgttgctcaaggccgtgttttgggatttggatggaacgcttatcgattcggaaccgctttggcatgacggcgaaatcgaaatcgcgcacaacaatggcggcgagtggaacgaggacctcggttgggcgtgctccggtactccggtgactcacgtggcagaggtcatgattgcgcatggctgcacattgagcgttcccgaaatcgacaagcagctcaaggattatgtgttcaaggcggaggtcgaacgtctgccgtggattcctggtgtgcaagacgtgttgcgctcgctcaatgaggccggcatcccatccatgctggtcactacttcgccgcgccgtatggcggagaacatcatgaagcagtccgagggactgttcgccggctacgtctgtggcgacgatccgtacgagcacaagccgaaccccgcgccctacctggccgcagccgacaagcttggcatcgcccgtgaagacatggccaagtgcgtggtgctcgaggattcttcggttggacttcaggccggtgcggcatcgggcgcgactctgattgcgcagaccggctggattcgcacggatacttccggcctgggccagttcgcgtccatcgaatcgtatgacggtatcgatgcggccgcgctggatggtttcgtgcgccagcgtcttggtgagtaattgattacatcaccgcgcatgcagttctcctcatgagcggtggaatgtgttgacgatataccagcgaagcacgccatatttgtaaagaagatggcagtaatggctgctatgaggttccggtggcccctcttgtatcggggcgactggtagagtggttgacggttttcagacgaatgtctggttattggacagattgttcacacatatagacgtataggactcataggaatcacatgggcttcgttaatttcatcctcgaactgctgaaggatccgcgtgccgcgattgccggttggattgccatgggcgtggcgccgaccctcggattcatcttcctcatcgtattcatcgaaacgggcgtggtgttcttcccgttcctgcccggtgattcgctgttgttcgcggccggcgtgttcgcagccccggatgctgcgaccggcaaggccgcgctgccgttgttctggttgctgccggtggtttggtgcgcgccgattatcggcgaccagtgcaactacttcatcggtcatttctttggccgccgtatcatccagtccggcaaggtgaaggccttgaccccggagcgtttggccaaaaccgagcacatgattgagaagtggggcccgctggctgtgttcctgggccgcttcttcccgttcattcgtacgttcatgccgttcatttccggtatttccggtatgcgttggagccgtttcacgccgttctcagtgctcggtggcctgtgctggtccacgctgttcacgttgctgggctacttcttcggcaacattccggccgtgcaggatcacttcgagctggtgatcgtgctgattctgctggtctcgctcgccccgaccatcatcggtctgttcaaggccaagttcggcaagaagaagccggccaaggtgaccgatgctcagctggacgtcatggaagacggcatcaagaacctcgataagtgatcaagaaatgtagattaccgcataaggaatcgtcgtgaaaaatgaaggccctgaccgtgcatatgaggtcagggccttttgcatgagatgggcgtgaaacagcaccgtggttatccacatttgtcgtggacgacatgccggggtgtggataactcggcaagctagaaccacaatggtcgattcgtgttgagcattgaactcggacacgtttcaatcggcttatgaatagcaatacctcaccccgcgtggcgcgtaggatcacctcgccagcggtagcacctccgggcattccgctgcccacggacgatgcgccgattccagcgcatcgctactacactccgccgcccaggccgttggcttcatgcgaacggcagagatcgggcgaggctccggcactcgccctaactacagacaccagctttcataacattgtgacgatgacgtcaggccatggaggcgtggggttgagtgtcatggcttccatgcttgcatggacattggcgagacgtgaacacagctgcgttctcatagacgctgatttcgtggccggatgccttgatctgctacttggtgtagaacgagagccgggcttacggttcagccaagtcgacgcgcccctcggccgtatcgagggtgaggcgatgaaccatgagctgatgacgtgggagggtgtgcgagtacttccctacgatccttggagcgcgcgccagcctgactggtgggaagttcaagcggccatccgggctttggcggaagcgaacgacgtcgtcatcgtggacgccgggcaagggggactcattgagaccgtgcccgatttacgcagtggcatgcaggtgattgccgcggaattgtcggtaatgggattggctagggccaaagcgcaccggtccagactggattcttggggctgtgaagcgccacatatcgtcggcgtggaaccacgtggcgctccacgtgggagagggcacgtgggtattggcgaggcgcaggactacttgactgccacggtattgggtcctgtcaagccaagtgtcaatctgtgcggagacgtactggaaggcctcggcatcagatcggtgaccaaaggcagtcgcaaagccatgaacttgcttgccgatctcgtagaacaggccattcgctcggtttcgggaacttctcacaaggaccagtgatgctatggctgccgtaatcactcgggctgatgagcccggcgcagtgcccagaactgtgttcttcggtctattgaatgatgtggcatccgacccgcaggttaccgatttggcggtgacctgcgatggccgcgtttgggcggaccgcggcaatggcatgcgcgaaacagtattgcatgtgccgttccgctcgccgcaagtagttcgagaatacgccgtccaactgtgcgcgcagcttgggcgcagactggatgatgcctgcccgatagcggacgccgccagtccagatggcatccgcgtgcatgcggtgattgccccattggtgccacaaggtgccgcgatttccatacgattccctgaccgaaccatggcatcgctacagcacctgagcaaattaggcgtattcccggctgcttggctgctgacgttcgtgggattggtgcgcaaacatgccacagtgctaattacgggcggaacaggcgtgggcaagaccaccttgctcaaggcgctgctggcgcaatgcgacgtgaacgagcgcatcgtcaccgtagaggaagttcgtgaactgggggaactgggacgcggcgatcatgtctcgttggtaacacgcgaggcgaatgtggagggcgtcggagccataagcctggcggacttggtcaaagcgacattgcgaatgcgccccgaccgcgtggtgctgggcgaatgccgtggtgcggaaatcgttgacctactgcgcgcgttcaattccggtcaccacggcggcatgaccaccgtgcatgcggacggcgtggaccgagtgccgtccaggttgatttcgcttggattgcttgccggagtcagtccacaggcgttggccatgctggcggcaggtgctttcgacgcggtggtgcatttggagcgagtgaacggacagcggcgtatcacgcagatcggcgaactgcgcgtagcacatggtgaactggcaggaacaccgctggcggtatggaatggccgccatcctcctcggtatgccgccgaatgggggcacttcattgaacgatggggcatcgttcccgggccgaatggtggtgggtgatgatgtggtgtgctgttctggcggcgctcgcggtgctgatatggccggggaagaagtccggaagattgcgccagctggctggtaaagagcgcacggtcgattccgcagccataaacgaacctcgatatgccgactcacctcgcgtgggcgttgcacaggtgattacgtccgccatcgcgcgattgcgaggtggcggcacattggttgaagcattcgaggaacaatccagcagacgcttcgccactcatcgcattactgtggaacggctcatagcgatgttcgaacagcggcgtctgcccgacgaatcaccagcgcaggtacttgaagctgcacgcggggtcaccgccgcagcggttttgagcgatgagctcggttgccaagtggtgccatgtctggaagcggtattgacggcttaccggcagatgaggctgatgcagaacctgcgatcgcaagcatgtgccgtgcctaaagccactgtggggctgctgagcgcgcttccggccgtcactgtggcattgggcgagcttctgggagctggaccattggcgttcttgattggatcgccgcgcggtgtggtctgcctgacattgggaggatgttgttatgctgccggcttggcatggatgcgggcattgttgaaaggcagcggattatgagtacggtgtgggtacgcgccgcggcaggctgtgcggcgattgctagttggctgtataaggttccggttcgtcatgacagccgcttgccgtgtgaggagccggctgcagcgcatgattgcgggtcgtcatggaccatactcatattgcgcatgttgcaggtgtcattgcggcaaggctcttcgattccccgggcgcttgacatggtgggcaaagccgtcggcgacgactgcggtgctcgcatgagcgaggtcgggagctccctgaccagaggggttccctgggctgatgcgtggcatgccgctatggctgttcagcatgagggtgcgccagctgatagtccatccggggaagatacgaataccacgcaacgagatcttggcctgctgcaatcggctttggaatcgtcatggacgcatggcgatatgcctggcgtgcgcctcgaatccgccattgaacagctggaccgtgacgagcgtgctgccatcgaacggaatgccgcgaagctgtcggtaaagctactgatgcctacagggctatgttttctgccggcattcgtgctggtaggagtcattccggcgattgcgtccttcatgatgtgaatgtaggcgtgaaccgagtgcgcttgggctgaattttgttgtatcgctcggtattgcacttggctgcgtttggttatccacatttgtggtggacgacacgtcggggtgtggataactcggcaagctagagccacatcccccgtttttcctggtgcatgaagcgttgatagtccacagtggtatgcaccccgcgtcaacccggcgcgggggccaaccactcacacacgcatggggaaggtgcgaagccactgcgcagctacccctccttaccgaaaggaacgccaatgaatacccctatccccgtcatcgtcgacgggcaggccggcatcttcgcacacagcaaggctcgtgtggccacgctgaacgccaaggcaaaagaacggctatgcctcatggacgcacgcttccgcaccctcatggctgagcccgaagaaggcgcagccactgcggaatacgcagtcgtgctcgttgcggctacaggctttgcggcagtgctggtcgccatcctgaaatcggacgccatcaagacgttgctgaccaacatcatcaaacaggctctgaaagtcgggtgacagccatgaagaccatgacatgccgatggcggctcgccagactgccgccagacctatgcacaggatcggccaccgccgaattcgcgatcgtattgcccagcgttatcgccatcgccgggctgatactggcaataggacgtgtggtcatcgtttccatggactgccaaagtgccgcggcagcggctgcacgcgagtttgtggttaccggtgacgaatcatccgcgcgcagcatagctgcggacgttgccgggggagatccccgcgtcagcattgcccacaacggccaatcgacgagcgtgatggtcgaatgttcggtactgcccggtccactggatgtcactccaacgcgggttaccggcaacgctacggcgataagccaataactggtcggctgctggctgggcggccgcaatagaaaggaattgcggtgcagggaatgcgttatgaggagggatcgggcacgatggccggagccatgctggttatggcggtgagcattgcgctcgcggtggcggcaagtgtgggcaacctcatgatctgccagaatcgagcgcgttccctcgccgaccttattgccgttgacgccgcgtatgcgctgtggcatgtggatatcggtgatccatgcgcgcttgccgcaaacatggctgaagcgaatggcgtcacgctgggatcctgctccgtgcgggatgaagacgtgttggtaaccatcaaggtggaaaccatggttccggtggcatcatccgtggagcggacggctcgggccggaccggtgaattgtacggaaggagacaattatcacaataatggaccgtaagcactgatgctctggcgggcttctggacctttggttaaggtgagagcatgagcgagagtgaacgcacagaacgccgtcgcgtggtggccatggtgggcaatcccacttccgataagggtcgtggtgccaaggtggatgcgcgagtattgggactgctggaggacgccggccgtgcccataacttcgacgtcatcgacatcaccggcacgagtttcgacgattccctgaaccaggcgcgtgaacgcgcgcacgagtacgactatctggtggtggtcggcggcgacggcatgatcgcactcggcgccaatgccgtgggttgcggcggtaagccgttgggcatcgtggccatgggctcgggcaatgatttcgctcggggacttaagctgccggtcaatcgcatcgaaaccgcagtggaaggtatcgtcggcgctatcgtgcgcggatcacacattgatgtggacatgggacgcgtgacctctttagacggtggctatgccgtgaacccatccaccggcgaggaatacgagtaccaggagagcaagtctgccgagcatccgattgaccggtactatgcgggcatgctgtcctgtggtctcgacgcgagcatcaacgatcgtgcgaatcattcgcatctgccgaccggcaccatgcgctacttcgtggcggtgctggtggagctgacgcatatgaagcgttatgggtaccacatcaaagccacgctggcggacggtaccacggatgagcgggacatcatcacgccgttgctgacgattgcgaattcgcgtcatatcggtggcggcatcgaggtctcgccgtactcctgcttctccgacgggctgttggacctggtgtggatgaatcacgtgccgaacttcggcgaatgtgcggtggccatctcgaacgcctataatggcaagctgctcgcctcaaaggtgttcgggtggaagcgcatacgcgagatcgaagtcacgcgggcagcggaaggagacgagccaccggtgctgatggcggacggcgaatacatcgggcatctgcccttcagggtggtggccgaggactgcgcactgcgcgtgctggtgccgccggccgtagccgcccgtgaggtggactcccgacaggaagtgcttgacgccatcgcccgagacggtcgcgaccccgtaaccggccagttcgcctgacctgattatattggctcccctcattaggctgagccgtaaagcaaacagcccagtgctgtttataggcgagggttcgacgatagtcgaaccagaagagagtcagccgtaggctgttcgcaattgcggacgagctggccgcgaagcggactgaggggagtacgggagagcggtaccagagccaatggccgtcagacttcagacgacatagttttcgatatgcagcgtctgcgccatgacctctttgatggttcggtcgctgatgttcggatgcgagcgaaccagcgagataagccccacgattagcgtgaagaatgtctcatggacgttggtgattggcagaccatgcatctgctcgaaatcacgtacggtggtctgggcaatgtagtcggcaatacggtccgccgcgcggtcaatgaacttgatatacagttcggcgttgccatcttggatcatacggttcgaaaaggggctctcgtcggcgatcagggaacggagcacgcgcacgatgtcgtctaatgccttgttcacgttgcctgtttcgcgcgcttggttccactgcttcaatgtggtgaggatttcgtcgatgacgtcgtcgagtactgcgtctgctacggcttccttgtcttcgaagtaatggtagaacagtgaacgcgtcataccgacttcgcttgcgatgtcggaaacggtgattttggagaagcctttttccagacacactttgcgcgcggcttgcacgatggcgtcgcgccgggcatcgccacgggtggggcgtttctcgtcgaggatatcgctcatgggtacctcctgactacaaccgttattgacactatgttaatacaaagaaagcggttaataacaataaaaatgcggtaaccgttgtcagatgaatgtcgttggaatataaagagttttcccgattcggcaactatgagcccggtttatcttgactttttatcggttaattctgagggcaaaggtaggttagtagctatggcacttgcattgtatcgtcgctatcgtccggacaccttcgaaggggtcatcggtcaggaccaagtcacggtcccgctgatgcgcgccttggacgagggcaagcttacgcatgcctatctgttctcagggccgcgaggatgcggtaaaaccagctccgcgcgtatcctggcccgttgcgtcaactgtgccaaagggccgacttcccacccctgcggcgaatgcgaaagctgcaaggacctggccaccggcggtccgggttccatcgacgtggtcgaaatcgatgcggcctcgcacaacggtgtggatgatgctcgagaattgcgagaacgcgctgggttcgcccctgcgcgcgaccgctataagattttcattctcgatgaggcccatatggtcacgcagcagggcttcaatgcgctgctcaaaatcgttgaagagccgcctgaacatgtgatgttcgtcttcgccaccaccgaaccagacaaggtgatcggcaccatccgttcgcgcacccaccactatccgttccgtctggtgccgcaggaagtcatgggtccctacctggagacgatctgcgacaaggaaggcatcaagcccgagcccggtgtgctgaaactggcgatgcgcgccggtggcggctccatgcgagataccctgtctgtgcttgaccagctgatggttggttcggtcgaaggcgttatcacccatgatgccgctgtagccctgctcggcttcacgccggaggcgctgatcggtgaggccgtggatgcggtaatcaatcacaacggcgaagccctgtacggcgttatccagaaagtcgtggtcggcggattcgatccgagacgattcgtcgaagacctgttggctcgtgtgcgtgatctgctggtgcttacgttggctggggaccgtgcggaatccgtgctgtctgacacggccgaggccgaggatatggacgacttgcaccgtcaggccaaggcgttgggcctgggagccctgaccgccatggcagacatcatcaacactacgttgggtgccatgaccggagccatttctccgcgtatgcgcttggaactgctggccgcacgattgttggccggcagtgaatcaggctttgcgacagccgctcccgcgccagtcgcttctggtatgccgcctgcggctgcttcttcgactacgtcagccgcttccggtgcgggtgccagtggttttgccggctcatcgcgaggcgggtttgccggagcctcacatggcggattctccggtgctgcacgcaaccagcaagtagccgcgcctcagagcaccgcttcccatgaatctgttggaggcaatggccctgtcaacggcctggtcagcgaccgacccgcgggctctccgtctgtgcaacctgctgtagcaactgctgctgccaatgccgggtggggcgctcccgccgcgtcgccggccgccccggcccaaccggtggcctcgcctgcggcatcggataatcggtccatcgacgagaagtgggatgcagccgtcgccgctttgccggaaaccattcgtgaatatgtgtcacgagacaaggtgccgaccgtaaaattcggtcccaaccgtaagggtctgccttgcctgtcgatgacgttcgacaagtcgctgagccagcacgctttcgccttggccgtggataacagcggtaagaaggcggcggccgtggtgatggatgccgtgcgcaacgagttcggtgccaatgcagttattgcaccttctgcggtcgcggcgaatggcgagcgagtcgaatccgtcaaacgtatgagcccggagcaattggccaaggtcaagcagcagattgccatggccaaggccggattggccgcgtcgagtttgggcgcgggcctgggcattcatatggggagcgagccgaaagctccgaagctggctgcaacaggccaagccgaggatacggacgacagccatcgagccgatcaatccggtgcatccacggcggcgaagagctggagtaacgatgacccttgggccaagccggctgtaagcaacgcttcgccgcaatctgcagacgggttcgcacctaacgagcccgctactacgcctgcgcccgaagaacatcacaagaagcatgttgcggttccggacatcagtgatggtgttgatccgtgggccgctccggccgctcctgttgcacccgctgcgtccgttgcgtccgctgggcccactgaacagtccacggggcagccagccgccgcatcttccgctacgacagctgccggcgcgagcgatgatccgtggaatcagatgcagtctcaggctacggcctcactggcactgcaaccggtcgaagccgacccgtggaaccagccatatcagcagtctcctcacgatgatccgtggaatcagccgcagtcccagactccggcttcttcggttcctcagacagtgtcgggcaatatgtcgggcgatgacccgtggaaccagccccaatcggttccacagccggctgccggcgatgacccgtggaatcaaccgcaacccgcacagccgaccccgaatgccgacccgtggaatagccggccccagccccagccgaaaccgcaaccgcaagtcgcggccgaggatgacgaatactcgatgagcgaccagtcgctcggcgaggcgacggccatgaatctcgacgatctgaaaaagctattcgaggtcaaaaaagtcgagcaattcgcggcagatgatccgaagaaccccaagaacatccagcctgccaagaagcactcggatgaataatgaggacgaataacgaggaatacccatggcacttgcttatgacggcgcaatacagcgactgatcgacgctttcgggcggctgcccggcatcgggccgaagggcgcgcagcgtatcgccttctacatgctgtccgcgcccgaagatgaagcgcgcgatctggccgaggccatcgaggaggtcaaggccaagatccgcttctgtgatatttgcggcaacgtgtgcgaatccagcccctgcccggtatgcgccgacccgagacgcgaccgttcggtgatctgcgtggtcgaagagcccaaggacgtgatgagcatcgagcgcacgcgcgaataccgcggcctataccatgtgctcggcggcgcaatcaacccaatggccaacgttggccctgccgacctgcgtattcccagtctgctcaaacgcttagaaggcgatgaggtcaaggaagtgattatggcgctcgacccgaatattgaaggcgaggccaccaccagctacttgacccagctattgcgacccgtaggtgtcaaggtcacccgacttgccagcggcctgccggtgggctccgacttggagtacgccgacgaaatcacgctaggcagggcactggccggtcggcgcgaggcctaggccagcgtatcattggcgctctcgcccttgcggcgcatccacggccagaatgcgccatggcggatgatgcacgcggcccttgtgtcgtctgccaaccagatgatgaacagtcctgccgccagtatgcctagaccaacaccaagggcgatattgcgcgcgtcaagcacgtcattcggctcgggggccggcatcggaatcgccactcggtgcccggagataagcagtcggtgcgtgttcacgccgtatggcgtacaggtcatcaaggtgacacggtcctcacccggcgcaatcttgagcttcgacgtgtcatccggcaaaatcactgaaatgcggtccactttgtagcccaaagtttcgcccatgacttcgatgtagaagaagtcgccctctttcacctcgtccaaacgggtgaacatcagcgcttcaaccaacccgcggtgcccggtaatgaccgaatgggtggacttacctcccaccggcagcgacgtgccgtacaagtggccggcgccagaagccagtgcttcctcggaagtgccgtgataaatcggcagattgatggactgtttgggcaccctgattgtgcccatcacgccgtttccggtactaagcagtgactggtattccttgtctttctttgagacggaatcctcgccgctggcttgggatcctccttgggcggcggagaacggatcgacggcttcacccaagatgggctggccggattcagcgagtttcttgttgtatgtgcgggcctccgtgagcttgtcttccgcctgcggataaggccagccggctacttctttggctgtggtggctgtggtggcggccaagttgcggtcggactcgaattgcaacgctagcgggaagcaggccacggcgattgcggcgatcagcaacacaatggtgatgatgcgcatcgcccacaggttgcgttgcaggcgtcggcgctcggccacgagatcgctgatatcgatgacttcgtcaaatggtgttggagcgaatgctgcgggctcgggacacgctgaggaaacgttgtcatttgcagatgtggcatccggcatggccgcgttgttttcccgcatttcctgtgaggcacgcttacttgtcgaacgtcgatgcagcaatgccatagtcgcctgttccttcgcttgatctgctcatgatttgcttatacaagacggccggcccgtcttagtcgtggttggcataggtgctgccgcaaatggcaacgccgcacgtgccacactgcgagacgttactccgcaccaagcctttcatgcaacatgccgacgagggccatagggggcaatgtagggggcataagaagtccgaaaaatgcgatatgaacaacgttgctacggctgtaagtgatgtgacttactttgggcaagccgttgagatgcaagggactgcaaaggattgcaaagtatggcaacatgataagccgcggtgccggcaatatttgacagagctttcaaatagggggtatgaatgcataaagagggaatatattgccccgataaaaatcagttcatatcattacgttctaagactgcagtgagaacgagcccaaccagacacttcagcgacccgtcgatagcttgtgcggtactgcacgcgaccccggagaaactccttaatgatttcgagacctttggcttgctgtttgagtccatgtgtattcgcgacctgcgtgtgtatgctgatgcgcttggcggagatgtgttccattatcgggataagacgggattggaatctgatgcggtcattggcctgcatgatggacgatgggctctcattgaggtcaagctcggagaaaagcaggttgatattgcggcggcccatttgaaaaagttggctgacagaattgatcaagatcacgaaggccgtccgtcattcttgatggtgctgaccgctacggctgccgcttatcgccgggatgatggggtattggtagtgccgttggccacgcttgctccgtgagctcgtatcgcgcgtttgacctatcgttctcaacccaaaaggaaaaggcccgggctgcggaaccgggccttgaaaaggagagaggaagaagaaggtattcagttatgggggttctgcggaaacctcgccggtttgctttcgtttgccggtaattgatagttaaccgctcgaatctcaaaggatggatgcggctgccttaaaaaaccaccggtgaaaacttgaatatttgctgaacaacgtaggccatgcccgtgtccacatgccggcgcggggtcgcggggtgaacgcggcaacctttataatcgttgcgtttgcgtaaaatatcgaccaaacaaatctctaagagaagaacaaaaggacagcagtggctctcatcgtgcagaagtacggcggctcgtcggtcgccgataccgaatcgatcaaacgtgtggccaagcgcgttgttgagacggaaaagaagggcaacaaggtggccgtggtggtctccgccatgggcgacaccaccgatgaccttatcgatcaggcgctgagcatcgactccaacccgcccgagcgcgagatggacatgctgatgaccgcaggcgagcgaatttccatgagcctgctggccgtggccattcacgccgaaggcagccgcgcccactccttcaccggtcagcaggccggcttcttcaccgacgcccgttacggcgcggcccacatcaaggccgtgagaccggaccgcgtgaaaaacgcgctctcattggggacatcgccatcgttgccggcttccagggcatcaacgccaagggtgacgccaccacgctcggtcgcggtggttcggacacgtccgccgtggcactcgctgtggcccttggtgccgacatctgcgagatttacaccgacgtggacggcatctttaccgctgatccgcgcatcgtgccttctgcccgccgcattccgtccatcgattatgagtcgattctggagatggcctcctgcggctccaaggtgctggcactgcgctgcgtagagtacgctcagcgtttcaacatgccgttgcacgtgcgctcttcgttctcccgtcgccccggcacgctggttgtgcctgacggcattgacccgcgcacgctgccgaacctcgactgagcgcggctacagcgaacaataatcgtaagtaatttcaaccaagacaaggcaagacatgactgaagaagaagcgaaatccatgggcgacctgttccctgacctaggccccgaggcgccggtgatttccggcattgcccacgaccgttccgaggcgctggccaccgtgcgtggcgtgccgaacgagccgggtatggccgccaaggtgttcaccgagctggccaccgccggcgtgaacgtggacatgatcgtgcaggccggcgcatccgttggcactgcggacatctccttcaccgtgcccgaatcggccgtcaagcaggtgcagaacacgctgctcgacaagcaggaagtgctgggttaccactcctttgatgtgaacaccaacgtcggcaaggtagccgtggtgggtgttggcatgaagacccacgccggtctggctgccaagttcttccaggccctgagcgatgagggcatcaacgtgctgatgatttccacttccgagattcgcatcgccgcactcgtgccgctcgatcagctcaacgatgccgtcaaggcgctgcacaccgcatacggtctcgatgccgatcagatcgaagccgtggtgtacggcggtactggccgctgagccactgagccgcgtttttgcggtatatacgacgaaagccctcctcacggagggcttttgcgattttaacgagtttcaactacttcttggtgatgtagccgagagccttaagcatttcggcgcattcaagggcaccgccggctgcaccgcgcagagtgttgtgggccagacccacgaacttccagtcaaagatggagtcctcgcgcagacggccgatggagacgcccatgccaccctcgtaatccacatcgagcttgacctgcgggcggtcatcctcggtgaggtactggatgaagtgctttggtgcgtgcggcagctccagctcggaagccttggacgtgtagttcaccagacggtcgataagctcttccttggtggccttcttgccgaagttcaggaacacggtggcggtgtggccgttgagcacgggcacgcggatgcactgggaagtgatcttgaggtcgccgtcgaacggcacgatctcgcccttctcggcgtccacatgaccgaacaccttgagcggttccttctcggacttcgcttcttcaccggagatgaacgggatgatgttgcccaccatctcaggccaatccttgaaggtcttgcctgcgccggaaatcgcctgataggtgctcacaaccacctcacgcggttcaaattccttccacgcggccagtgccggtgtgtaggcctgaatcgagcagttcggcttgacggcgatgaaaccacgagtagtgcccaggcgcttgcgctggtgctcgatcacctcgaagtgctccgggttgatctccggcaccaccatcggcacgtccggggtccagcggtgggcgctgttgttggagaccaccggggtctcggtcttggcataacgctcttcaatggcgcgaatctggtccttcggcatgttcaccgcggagaacatgaagtccacgttcgcggccacggactcggcgtcgtcgccgtccgcgaccaccatgtgcttggcgtattcgggcatcggggtttccatcttccaacggtctccgaccgcctcggcatacgtcttgccggcgctgtgcgcggaagcggcaagggtgaccacctcgaaccacgggtgattctcaagcagcgtgataaaacgctgaccgaccataccggtggcaccaaggatgccgacctttatcttttcgggcatgatgacctctatgaccttcgggtttcgatgggctgatacgttcaagcgaccgtcttgcaatggccgcaaacacacggtaattgtacgaaacatgcagaacaacagtggccgtcttcccatatggtggctcggcggcgcaccccatggcgtaccccgcgccgcgcagtccgatatcctctccataactggcaaagtgactagcgaagagacggcagtgttctacactggtagccatgtctatcgcatcagtagaggcgcaaaagcaactcgatcgtatcgtggctctcggctacccggacgtggcggatatgagtgccgccgcattccgcgcgcttgccgagccgctcatcggcgcgctcgagcattccgatctcggctcgaacatcctactggtgcctacgcgcgagctagtctcgcccgaatcgctgattgcgcgaacctccatcaaccgcatggccggctttaccaccatgcctccgcgagacatcgccagcttcctgccgcaggacggattcatgccgcccgaaggcccgttctatctggtggtcgatccgcataccggcacctgctacatcaaccgcgagcccgacgtggcccgcaagctgattgattccgacgagcgtctgccgctcaccctcgaagaaggcttggccatcgccacccagcaccctgaatggctgttggaaaagaacggtttcaacctgctcggctcacgctccacagacggccgtgtgccgagcatctggatgagccagaacgcaccgcgactgggagccgtctggcccaattcccgccatacctggctgggcaacgcgtattgcacggcccgtcgcggggtgagcctgtttaagtaggtttagcgcgcggccttgatcagcgaacggatgatggctataaagccaaggctcatcgcgccggccaccacggcgaacacctgcgggcggcgcagctcgttgcgtgcgctgaccgctccggtaacgcaatgatcctcgaaccagacgcgcagctcgttgctggagtagcggccgaccagattaccccatgtgagcatgcgggtcacatagcccgccggattgctctcatggaattcaaacaggcgaatgccgcggtaccgcgacttgggaccatagcattcgaacccgcacgtgggcgcatagcccagatcgatatcatgcacatgaccaacgaaagagttcttatggtcatgcccgcagaacagcgcgaaatagccgccagcctcgcgcaaggcatccacctcgcccacattctcgtccgcgcagccgatcgcctcgccgagccgcgagccggggcggcagacctcatggttgagcacatagcaacgcccggcgtgcgtgcgcgcgccttccacggcgttcggcgtccatgtgggcacttccttcagacaatcgtagaattcctgcggcggaatgtgctggaaggcgatggccggcacgggcttgccgtcgccattgcgctcgcccaactcggtttgtacggaccccagccattcgatggccttggggtgggggtgccgtacccgtcggcgtcggccaggtcgagtcctcgcggattgaccacatacgccgggtattgggcgtcgttttcttcgggtttgccggcataatcgcctgaattgaccatcataacggacatggccacgcggccggaaccatcggaggactcgacgggcagcgcgaacgtgccgggctcgagactgtcgtcggggttcaggcagccggggtattcgcggtagatgtcatcctgttcgtcggccagaatgccgcattggaagtcgtggttgccgtaggtggcggcaaagggcacgccggcctcgacgaccggaccaaggaaaccggagaacgtgcggcggaccttttcgcgggtctcattcatgagttcgtcgagggtcgccggcgtctcgtgtgcggggctggccttgccggattgcgttgaatatacgagggtggaaaccgtctcgggtgtggggctggtctcaacggaatcgcctacttcggaagtcgtgatcacgtcggtcgaatcggcgccggcagcggcgacggcgttcgtcacggtatcggggtcaagcagcgcggctggtacaggcttgccggcttcggtgagacgatcggccacgcgatcggatactttgcgaattacggggtgacgcttgatcccgcggattttggcctcgatctcggtgaccgcgcgcacgcgagcgcccggctcctcgccgcggcggcgcaggaacgtgtcgatgtaggcgggatcatagccgcggatctggtcgccggtgaacaccacaagatccggatcggcttcgcggatggcttcgcggatgaggcggatggtgtcgggcaacacatcggggccgtcctgtacgtcggccatttgcagcacgcggaagctgccgtcttcgcggaatcgcaagctcgtcatagctcttcagtctatgttgccgggcggcggatcgcccgcgcgttcacaggactggcacagcaagggacggggcagggcggggtgccgcagccgtgttgttgcttgatggtgccgcgattttgtcatgcagcgtcggtggaggtccagacagcgtccctatgctgacgttctgagaccattggcgtcgttactgattcatggaatggcccggcgccgacgctcaaagaggctaacgtcggcggtgggccaatatttgtcgcgttgccgatggttgtgggcctcgtagcgtcggtagtgtgccatagcctggcaatttgccgacgataagctttcccagagtcggtatttcgccataagttggtccgctgacgacgctgagcagtttggctgtcggtgcagtaccaatatttggcccgccgccgacgtatggagggccatctggtggggtatcgcaggcggggtgttgtgccggagtcaaagcgtggcccggcgccgacgctgagtgccctcatatcagccaggtgcataagcaaatgccacgatacggcatttcccgcgggtttgcccgaaccggcctgtaggatgttacgtgcgtattgacaaatccgcgtggcccggcgccgccctggcacaacgccgcagtcgcgtccgcaagagggcccgcgcaataaccagtaaaggaggaacaatgggtcaggatcaatcatccgtttttgatctcgcagcggtagccgcagcgtccaatgggggaacaacgacccgctgctgcctccggcgcgattcatcggcgatccgcagaagccgagtcgtatgccgtacaacaagtacgcctcatacagcgagcagatcccgtttgattacccggagcgcacgtggccgggcaagcgactgcagcgcgcgccgcgctggtgctccgtcgatcttcgcgacggcaatcaggccctcgtcaatccgatggattccgagcgcaagctgcggttctggaatctgcttgtctccatgggattcaaggagatcgaggtgggcttcccgtccgcttccgagaccgatttcgacttcatccgtatgctcatcgagcgtgagcttatcccggacgacgtgaccatcgtggtgctcacccaatgccgcgagcacctcatccgccgcacatacgaggcgctgaagggtgccaagcgcgccatcgtgcacttctacaactccgtgtctgtgctgcagcgcgaggtcgtgttccgcaagaacaaggaagagatcaagaagctcgccaccgacgccgccgaactgtgcaaggacctcgagaacgaggccaagggcatcgacctgtactacgagtactcgccggaatccttcaccggaaccgagccggagtacgccgtcgaggtgtgcaacgccgtgatcggtgttatcaagccgactcccgagcacccgatgatcatcaatctgcccgccaccgtggaaatgaccacgccgaacgtgttcgccgacgaagtggagtacgtctccacccacctcgacgaccgcgattccgtggtgctctccctgcacccgcacaacgacgaaggcatgggcgtggctgccaccgagctggccgtgttggccggcgccgaccgcgtggaaggctgcctgctgggcaacggcgagcgtaccggcaacgtcgacttggtcacgctgggcctcaactggctcacccaaggcatcgacccgcagcttgacctgtccaacgtgcccgagatccgcaagacggtcgaatactgcaaccagatcaagatctccgagcgtcacccgtacgccggcaacttcgtgttcaccgcgttctccggctcgcatcaggacgccatcaagaagggtctcgaggctcgtcaggtggccgccgagcgcgctggcgctgatcttgacagcttcgtgtggctcgtgccgtacctgccgatcgacccgaaggacatcggccgcacgtacgaggccatcatccgcgtcaactcgcagtccggcaagggcggcatggcctacctgctcaagaccaaccacaatcttgacctgcccaagcgtcttcagatcgaattcgacaagatcgtgcagaactacgctgacacgaccaagaaggaagtcaaggacggggatatctggcgtctgttcaaggacgagtatctgccggtcgaacagtccggcatgaccgcggccggtgtggttgtgggcgatacgcatgacgcctcgcttgagccgtggggtcggctgaagctgctcaaggtggccgtcagctccggggaggatggttccgataccgtgctcaaggcccgcctgctcgaccgcggcgtgaacgtcggggacgatgagcccgtggagcgcgaggcgtccggcataggcaacggtccgatcgccgccttcctgaacgccatttccaactttggcgtggaagcctcgattatggattacgtggagcacaccatgtccgtcggtaccgacgccatggccgcctcgtatgtggaatgccagatcggcgaggccgatgacgcgcagatcgtgtggggcgtaggcatcgactcgtcgattaccaccagcgccctgaaggcgatcatctccgccatcaaccgttctcagcgtcagcgctgagcgctaacagagcaaaacgaagctccctctgattgcgtcagagggagcttcgttgtctgtgtctacttactacttgacgccgttggtgtcggtgttcccgccggtgcctccggaattacccattatcgttaccgtttgttctcgttgtcagcgccggtattgccgggataattcgggcactcggtggaatagctcggattggcgaggcactgctgggcgaactcctgggcctgctgtcgcttcttggcttcctcttcggccgccttctgctgtgcgtcctgctcagcctgcttctgcgcatcttcggtggactgcctgttggcgttggactggttgttgacgtagggttggacgccgctctgccccctggccaggccccaagtgccatcggggccgccgatcttgccgttgtctttggccgtcgggaactgctccaccgccgtgccctgcagggcctgggccatgaattcctggaacaggtgcgccggatatccggtggaggagatgccatatcccgagaaagccggcaccacttgaggattgccgttgccatccgggttccagatggcccagacattcatcatgcttggggcgtaccccacgaacgatgatgccagttcgtcgttggcggtgccggacttgccggcgatgggacggcccagcttggccgatgtgccggccgcggtgccgtaggtggtcgtgccctgcatggctttctgcaccagggcgcaatcattggcgtcgaacaccttggtgccttcgctgggcgcgttgtacatgtccttgttgtgggagtcgagcactttggacaccatatgcaaggtgttcctcacgccattgttggcgatggtcgaatggccctgcgccagatcccacacggtcagggcgttgatgcccagcacgttgtacatggaggcctcgtcgatgtcgccctggatgccagcctcatgggcgatatcggccgtgcgtttcggcgtcagatgctcattgacgttcatgaacaccgtgttcaccgagttcgcggtggcctgatacagattgatgctgccccagttgttctccagagcgttattcacctcttgatccaagccggtgaagtgctggtgggaattgccgttgaacaacgtatcgaagctgacgccggattgcgcggcccccagcaaagcgaacggcttcatagtcgaacccggttcgaacagggcctgatcggcgttgttgagctgcttggacagataatccgaaccggcgtatacggacaatacttcgccgttcttggggttgagcgctatgccgccgatctgcagggattcgggcatgtcgttgaggcgggtgtcgccgatggactgcatgagatcctgcttgcccttgtcgatggtgctgatgatcttgtatccgccggtatccaaatcctctttggtaaaggccttggactgcaccagctcacggcacaccatatccagcagataaccgttcggccccgcgtactcgttctgctgcgccaccgcggcggtctgcgggaacttggcatcagtgtgctgcctggcggtgatgtaaccatcctcctgcatgatgttcagcacacgcttgaagcgcgatttggccatatcggcgttatcggctggatcccacgtggacggtgacggaataatgccggcgatcatcgccgcctcagacagcgtcagatccttggcgtccttattgaagtatgccttggctgcttcctggataccgtaggagttgcggcccagatagatggtgttcatgtagttgcacagcacctcgtccttggactcggtctgcgcgatcttgagggccatgatggcctcgcgcgccttgcccacataggatgtggtttcgcccatgtaataccgctcggcgtactgctgggtgatggtggaaccaccttggcgcgtgcccttggtcacattattaatgaatgcgcgggcgatgcccttcagatcaagacctttatccgtgtagaacgtacggttttcagacgccacaatcgcgttgccgatgtagtccggcagcccctcgcaagaaatgattgaacgattctgctccgcgtaggagccgatcgcggtggtgccgtccgcgtaatacacggtggttttctcggccaacgcgaacttctcgggttgcgggacctcagtggtggtgtacagatatgcgaatactgcgataccggccagcacgcccagtccaatcagggagaagaagatgcccagcacccatttcagtacacggtgcttgccttttcccgtgttcttcttcctgttcggagctcgatggctattggaagccttgtggcttgcgtggcgggaacggctctcctggggcgtataggggccctcctgtgcggagtggtcggctctgctttgcgcggtgcgcggttgcctcagagcggggccattgcctcccgaatgtgcacgacgagtataagaagccatggtgtccaccgtaactgttggccttgaacaatcgtttgacgtgagcgtaaccacacgcgttgataccggtatttttccggaattcttacaattgggaacgcttcttgatgcggcgtgaatattgcctgaatgcgctggttggcctgccgcgcgacccggcacgcacgtttcgtgtcgttgcgctggtccatacgtctccatagacttatccccagcctccacgcggcgctatgtcacccaactccccagggcaggaatgcagcaagggtaagtggcctctggcgggtgcgtggaggttttctttatgtgcggatttggctgtgagctggcactagcgtggtcccctgtccggggcgcggccgtacagtcgaacgtatgaatgacgcacagacccctagaattcgtgacccgcatgcggcggtcaatctggtcggctcaggcgcagcgcagcctgactcgtcgtcgaacgttgttgacccattggctgcgctcggcccggtctccggttcagatgcatcggcatccacatcaggctccttacgggatttcaggccgctggacatgaacgatgcggatggggcatctgatatcgaccgtggcttggcccggcttgacccgctcaccgtgcgcccgcgaatctccagccgcgtattgtgcgtggtattcggtctgctcctgatcgctgtcggcttcggcgtgtggtgggggtgcgtgtttaccgaaaacggacaatcgtatgacgaactggtttggaaaaacctgcacaacgatgtaccgtcctggaccaccggcgtgatgaacgccgtcgcacaatcctggctggttatcgctgtcagctgcacaattgccgcaatcggcattattacggcgctgattcgacgccgctggtggttggccgggcaaatcgccgtgttcgccgtggtctgcttggccgtcacccgtatcaagggtctgttgccgcgtccgttcatcatcaacactgaatcgcctgccgctaattccgcgccttccgggcatgcgatgctggccgcagcctgtgctgtgattctgctgcttgccgtgcctcgtgcggttcgagctttgtcgggcgtcatcggcgtggtttgggcggtgaccgtgggcgtttccgtgatatacggacaatggcatcgcccttcggatgtggcgatgtccatcctgctggtggcgggattggccctgctcgctctggcagttacacgcaagtccggcatggacgagccgggccaccgcgtctcctcagtgagcgtgcaaatcgtcggcagcgtgctgattaccgggggcctgctgttgctcgtctacagcggttatgtgatctggcaggtggtgccggggctcaacgtcagcgccagctgggcggttcagggagcgaatgtcagcgctgttgtaggcattatgggcgtggccatgctcgcattcggactgttgctggccctgcgtcagatcaccgcagcgcccttaagccggttggggctgatcggcgctccgccggcaccgcccaaatgatagaacatggggtgcgaacggccgaatttgcccggcacaacggcggaatttggcagttggacatgattcatgagtattatgacgccaaaaacgtcgtgtgtttcgcgcaatacataaggagtgggtatggctaccaaactggtgattgtggagtctccgaccaaggcccacaaaatcggtgactacctgggcaaggggtataccgtcatggcgtcggtcggtcatatccgcgacctcgcgcagcccagccaggtgcccgtggcagacaaggccaagttcggcaagttcggcgtggacgtcaacgacgggttcaagccctactacatcgtggacggcgataagaagcgtacggtcagcgaactcaaatcggccctgaagaacgccgacgaactctatctggcgactgatgaggatcgcgagggcgaggccatcgcgtggcacttggtgcagaccttgaaacccaaggtgccggtcaagcgcatggtgttccacgagatcaccaagaacgccatcaacgcctcgctgggcaaaacgcgcgatgtcgacagccatatggtcgacgctcaggagactcgccgtattctcgaccgtctgtacggctatgagctgtcgccggtgctgtggcgcaaggtgggaccgggcctgtccgccggccgcgtgcagtccgtggccacacgactgatcgtggaacgcgagcgcgagcgtatggcgttcaggcgcgcgccgtactgggatatcgtcgccacgctgtccgcgcctgacgcgctgggggagcgtggcgaattctccgcccgcatgatcgcgctcggcggcaagcgactcgccggctccaaggatttcggtgccgacggccagctgaccccggacgggttcgcggcgaacgttcgccagcttgatgaggctggtgccaccgccgtggcttcggcactgaagaccgccgatttcactgtgatgtcgatggaaaccaagccgtaccgccgccgcccgcagccgccgttcaccacctcgaccctgcagcagaccgccggcaatcgcctcggcatgggtgctcgcgccgtgatgcgtgcagcacagagcttgtacgagaacggctacatcacctatatgcgaaccgattcggtgacgctgtcgcaggaggccatcgccgccgcccgcaacgccgtctcctatcattttggcgacgcattcctctctgacgagcccaagcaatacgccaccaagaccgccggcgcgcaggaagcccacgagtgtattcgcccggcgggctcgcgcttccacgacccggatgagctggcttccaaacttcccggcgaccagctgcgcctatacacgctgatctggcagcgcacgcttgcctgccagatggctgacgccaccggttccaccgccaccgtgcgcctgtctgcgccggctggccccgccgagggcgaggccgtgttccaggcgtccggcaccgtcatcgaattccccggctttatgaaggccacgggggagggacgcaagcccaaggccgccgttcccggcgctggggctggctcggaccagactgctgccgccggcaagacggacgccaaggccgtcaggggtgacgcatccgaatccaacacctccctgccgccgatgagcgtcggccagcaggtcgaggcaagcgacgtcgaaccggacggccatgaaacccagccaccggcccgctacaccgaggccacgctggtcaagacgctggaggccaaggagatcggccgcccgtccacctacgcgagcatcatctccacgattatggatcgcggctatgtgtatgagcgtggccgtgcgctgatccccagctggctggcattctccgtgaccaagctgctggaaacgaacttccccaagctggtcgactaccagttcaccgcagagatggaaaacggccttgaccgcatcgcccacggcgaggaatccggccgcgactggctcacccacttctacttcggctccggcgagggcgccgcccgcaacgccgacgaggcgcacgaaggcctgcagcagcaggtcgcgcagctcggcgagatcgacgcgcgcgccatcaacaccatcgacatcggcgacggcctgcacgtgcgcgtcggccgttacggcccgtatctggaagatatggagcatctggacgccgaaggcaacccgaagcgcgcctccctgccggacaccatcgcgccggatgagctgacggtggccgtggcccgcgatttgatcgacaaccactccggtggaccgcgcgagctgggcgttgacccggtatccggcggtaccgtcgaggtgcgcaatggccggttcgggccgtatgtggcgttggtgccgccggctgagacttcggctggcgctgctggcgatactgctggtgcttctgcggccaagaagggttcgaagaaggccgcggccgccgccgcgtcgcgcccgaagatggcctcgttgttcaagacgatgagccctgaatcgctgtcgctggaagacgcgctaaagctgctgagcctgccgcgcgaagtgggcacatacgaggaaaccaacgccgaaaccggcgaggtatccgaatgcacggtagccgccaacaacggtcgctacggcccctacctgaccaagacgggtgccgacggcaagtcggagacccgctcgctggcctcggaagacgagatcttcacggtcgatatcgacaaggccaaagaactgttctcgcagcccaagtacggccgcgggcgtggccgtggtgccgccaagccgccgctgcgtgatttgggcaaggacccgaacaccggcaagaacgtgaccatcaaggacggccgtttcggcgcgtacatcaccgatggcgagaccaaccgcacggtgccgcgtcagtacacgcctgaatccatcacccctgatgacgccttccggctgctcgccgaaaagcgtgcggctggtccctccacccgtggccgtcgcggtgctgggcgtgctggtggcgccaaggccgttgccggcaagggcaagaagggcgctgcttctgtggtttcggcgcaggaggctaggcgcgccgaacgccgtgccgaggtgaagaagctggcgaacaagggctggtccaaccagcgcatcgccgaaaagctcagctccaccgccgccaccgtcaagaaggatgtcgactggctgaccgccaacgagggctacgagcgccccgccgtaattcccaagcgtggctgagcggaattattgctctacttgcgtttcaaggggctgatttctcgttttgagaatatctacttccgcttcaaggggctggtcatctgctgaaccacgagtatgaacggctccgcgccaacgtcattccgccgttttggaacgttgtctacttgggcaacagcccctcgaaacggaagtagaccttcagaaaagaccaaatcagccccttgaaacggaggtagagctggtttaactgcctgttgggcgcaactctgcgcctaacgctaaggtcaatagcatgagcggtctgtttgtttcgtttgaaggtgtcgatggcgtgggcaagaccacgcaagtcgagcgactgcgtgcgtatcttgaggctcaggggcgtaccgtggtcgttacccgtgagccgggaggcactgtgttaggcaaggccattcgccaactgctgttgcacggtgtggatgggggcgccgtcgacatcgcaccgcgcgccgaggcgttgctattcgctgcagaccgagcccagcacgttgccgaaaccatccgcccggcattggagcgcggtgaagtggtgatcaccgaccgctatctagactcttccttggcctatcaggccggtggccgcgaactcacgccagaagagattcgatccttaagcatgtgggccaccaacaacctgctgcccgaccgcacatatctgctggacatggatccggcgctttcccacaatcgtcttgagcatgccgaagatcgcatggagtcggccggcagcgacttccagtcccgcacccgtcaggcgttcctcgacttggccgcggccgagccgaatcgtttccacgtgatcgatgccagccagtccatcgaacaggtgtggtccgccatcgaagcggacattcagacactgctgcgggacaatgttgcagatgtggatacggtgatggcgcgatccggggcgtctacaggagccgtgacgatgggcggtgtccgatgagcgtatgggattcactagtcggccagcagccggtaatcgacatgttcagtcgcatcgcgcagggcgacccggggcagatcacccagtcgtggctgatttgcgggcctcccggctccggccgttccaatatggcccgagcattcgcggcggcgctggaaagccccgaccgcggcatgaacgatgagcccacgcgcgtcacgcagcaggtgctcgccggcacccacccggatgtcacggtgctggccaccaacaaagtgaccatcggcatcgaccaggtgcgcgagatcatcaccacctccgagcaaatgcctgccacggcaccatggcgcatcatcattatcgaggatgtggaccgcatgctggagcgcaccaccaatgtgctgctgaaggagatcgaggagccggccgaacactgcatctggctgctatgcgcgcccagcgcccaggacgtgctgcccaccatccgctcgcgtacgcgcattgtgaatctcgccgtgccctccgcatcggcggtggctgaattcttgacctccactaccaatgttgagccgaaaatcgcccagcgtgcggcccgtctggccgaggggcacatcggcatcgccaagttgtacgccactgacaagcaggtgatgacggatcgcgatgaattggtggtgggcgtactgaacctcgctcgcgcctcggacgcggtgctgctggccggcaacctcatcgacaacgccaaggcccaggccgaggtggacgcaagccgcaccgcggccgatcaagaggcggaattccgccgtgtcaacggtcttgagccgggggagcggattccgccgaaactgcgcggcgcgttcaatcagatcgctaagaaggacgatctcaagcggctgaccacacgtcgcgcgcgcgatgtacttgaccgcgcgctcaattccatcgcctccatttaccgtgacgtggcggtattgcagaacaacgcggaagattcggtcgggcttatcaacctggagaatcggtcggccatcaccgagctatcggtacgactgaaccgtgccggggcagtggcccgtctggacgaagtggcgcacacccgcaagcggcttgccggcaatggcaacccgttgctggtgtttgaatcgctgttctgcgcgctgattccgtaaggttcttcccgccgcccgatttattcggcgtcctgcgagtccggagcaatcaggcgcgaaggcaagttgacatgtactggggtgctggattgatcggcaagcagccgcagcagctcgtcggcaatctgttgcaggccgggctgaaccggctcggagtcaggcgtgaacgtggtgtgctgcaaccctccgatttgcacggcaggaatctcctgcgcatattgcgccagcacatcgcccaaatcaatgccgggcagtggcacgacaatcagtccatccacatggcgcgcggccatcaacacaatgcgttccttctgcacttccggcgttctgccgacgctcagcgctaattgccggccgctcctgttgaccagcggctcaagcgtatcgatgagccgtgcgctgaacggatcctgaacgctcggcacaatcaggccgatggttctcgtcacagtggaacgcagcgcactggccgcaaaattcaccgaataattgaggctgtgagccgcggctcgcacgcggcgggcgatgtcgtcgtccttggtgcgtttgccggaaagcacacgggataccgtggccgtggaaacattcgcgatggcggcaacattgacgattgaggcggatgatgattccgctggctcgttcgcggtcatgtgtgcctcctctcccagaaagcaagccggctcggtgaaattaccggcaatcactatagaacaaaagacggccgcccggacaggcggggcggccgtttggcaagtgagagaagtttcgcccgtttactcggcggcgagcagggtctcggtcagggagtcggcaacggtctcggcgttgtctccctcaacggtgatctgcacggtgtcgccctgctgaacgcccagtcccatgatggacagaatcgagcctgcggggacggccgcgccgccttccttggcgatggtgacgttgcagccggaggccgccacggcctgagcaaactgtgctgcaggacgtgcgtgaatgccgaccggatcagtgatggtgatgttgcgggtaaccataaggacactcctttgcgtctgtctgaaatggaagtcatgcggccaattgcggcagctgcttgatatcgagtataccgagacgtagaataaaatccagaaaacgattaccgttggcgtgttgcagatgatagaccaccataataggggaactaacaaggaagaacttgccggcaatggctgcggctgcatactccgaagtaggcatcgaggccactgctccaaagaactactaccctacgaacaaaggagaaccattatggaaatcaagggtgttggcattggccgcggcgtggcggtcggctcggttattcgtatggcggcccctctgccggagccttccgacgcgccccgtgccgataccgtgccggcacagaaagagatcgaccgcgtcactaagtcgctggccgtggtgaatgccgacctgagccgtcgtgctgaagaagcggccaacggcgacgaaggcgccaagcaggccgccccgattctgcaggccatctccatgttcgcgtccgacccctcgctggcggccagcatcacctcgctgatcaacggcggcaaaaccgcagagcgcgccgtactggaaggcttcgccgcagttgaggatatgttccgcgccatcggcggataccaggccgagcgtgccgccgatctgcacgatgtgggccagcgcgtgatcgctgacctgatgggcgtgcctgctcccggcattccggaaagcgagaccccgttcgtgctggtggccgaggatctttcccccgcggacaccgccgcaatcgacctgaacaaggtgctggccatcgtcacttcgcagggcggcccaacctcgcacaccgccattctggcccgcgctcgcggcatcgtggccgtggtctccgccgccgaagccgagaacctggccaatggtgagcaagtcatcgtcaacgccgccaagggcgtggtggttaccaacccgaccgctgctgagatcgaggatgccgaggccgccaaggctcacgccgccaaggccaaggagctgcgcggcaagccgggctccaccaaggacggccaccacattccgctgctcgccaacgtgggcaagcccgctgatgccgacccggccctggagtatggcgccgaaggcgtgggcctgttccgctccgagttcctgtttatcggcaactccgagccgccgagcgtggaagagcagaccaaggcctacgccgagctgctgagccgcttccccggcaagaaggtcgtgatccgtatgctggacgccggcgcagataaaccgctgccgttcctcaccccggaagacgagccgaaccccgccctcggcctgcgtggtctgcgcacgctgaaggctcacatgaacgtgctcgaaggccagctcaaggcgctcgccgccgccgatgcccagaccgaggccgacctgtgggtcatggccccgatggtcgctgacgagcatgaggccgattacttcgtcaagctcggcaagtccttcgggctgaagaaggtcggtgtgatggccgaggtgccgtccatcgcgcttatggcagacaaggtggccgaggtggccgacttcgtttcgatcggcaccaacgatctgacccagtacacgctggccgccgaccgtacgctcggctcggtcgccaactaccagaccgcatggcacccggcggtgctgcgcgccatcaagctcatcgccgacgccggcaacgcgcacggcatgccggtgggcgtgtgcggtgaggctgccgccgatccggatttggccgtggtgcttgcaggcatcggcgtcaactcgctgtccatgaccccggtggctctggacgatgtgcgcgccgagctggccagctggacgctagaagaagcgcaggagaaggccgccaaggccctcaacggcgacttctacactccggctgagtgactgtggccgagcaatcggctgaataattgggatgatgccttgttttctatctctttgagaatgggaagcaaggcattttcggtattccagggcttcccttccgtcgaggggaggccctcagtcgtgtttggctatcaccatgtattgtgatggcgttttgagttgccgcagactgaaatctgcaacatggctcgcgatacactggtgggtatgaagatttccgccgatttcaccgtcattccggacgatttcgccaaggccgcggcccctgaatatttcaatggtggcgtgcctgtggtctccttcccgttctacatcgatgatgtgagccccgaagctcgttacctgcactgggagttcgtggatccggattcgattccggtctgcggtttcgagtggattcactggtccgtggccaacctgcccatcggcgcgctgatgtacgacttcaacgactcacatgcgctggccatcccgccggacttctcccgccagctgccagccatgattccggagaccgtgcaaggccgcaattcttcggcctccaagttccttggtcgtagcactgacccggccgtgattatgcggtacaacggaccgcagccgccggacaaggatcatgagtattacctgcaggtgtgggccaccaagaagccgcttcccggattgaaccagggattctggctcaacgaactgctgcacgcgctgcgtgccagcggcgagacgcccgacaccgacggcgtcttcctgaccggcaaggcgtgagccacatgagcccccgcaggcgggggctgtcagcatcactgactgaggggcgggtcagtacagaacctccttcagtccgacttcgtcgttcagctcccgccagcgggagcgtgaccacaacaaagaaaggacaccatcacactatggcctgcaccacgattctggtaggcaaagacgcgagctatgacggctcgaccatcatcgcccgcaacgaggattccgccaacggcgagttcaatccgaagcgcttcatcgtcgtcaaaccaagcgagcagccgcgtgagtataagtcggtgatctcccacctgaccatcaccctgccggacgacccgctgcagtacaccgccgtgccgaacgcggacctcaaggaaggtatttggggcgaggccggcgtcaacgaggcgaacgtggcgatgagcgccaccgaaaccctgaccaccaacgagcgcgtgctcggcgccgacccgttcgtggaatacacgccggccaagggcgatgagcccgaggtgcccggcggcatcggcgaagaggacttcctgaccattgtgctgccgtatgtcaagaccgcgcgcgagggcgtccagcgcctcggctcactgctcgaggagttcggcacctacgagatgaacggcgtcgccttctctgactccaacgaaatctggtggctggaaaccgtgggcggccatcactggattgccaagcgagtgccggacgaggcctacgtgaccatgccgaaccagctcggtatcgacgaattcgaccttgaggacgccctgggtgaccaggaagcgcacatttgttccgaagaccttgccgaattcatcgaaaccaaccatttggacctcgcggtggagaacaccaccccgttcaacccgcgcgacgccttcggctcccactccgactccgaccacgtgtacaacaccccacgcgcctggtacatgcagcgcttcctcaacccgtacgacgaggtgtgggacggcccggacgccgaccacaagcccacctccgacgacatcccgtgggcccgccagccggagcgcaaggtgaccatcgaagacatcaagtacgtgctgagctcccactaccagggcactccgttcgatccgtacggccagctgggcgatgagcgcacccgccacatgtaccgcacgatcggcatcaaccgccagagccagcttgcggtgatgcagattcgcccgtaccgcccgcaggcttcccgagctattcagtggatggcatacgggtccaacccgttcaacacgctggtaccgttcttcccgaacgtggacgccacgcccgcctacctcgaagacaccaccacccgcgtgacttccgagaacttctactgggccaaccgcatcatcgcagccctatgcgatggtgccttccgctccacgtccaacgccgtcgagcgctaccaggagaagaccggcgcgatgggtcaccgtttggtgtctgccaccgatgagcaggtggcacgccttggcttgacggccgccgaggaagccgcgcagtctgctgccgaagaggaattcgaggcggataacgtagacggtgatgtgcagccgatgaccccggacgagaccatcgctgcgatgcgtaaccccgaagtgcgcgagattctcgccaccgccaaccagaccatggccgaccagctcaaggaggaaaccgacaagctgcttgactccgtgctgtacactcgcagcatggaaatgaagaacggcttccacatgtccgacttttagtccgtattgagctcccctccctgaggggagctgaccgcgaagcggactgaggggctaagctgttaagaaacagcccagtgggctgtttctaggcgaagaggcggcggccgccccaccaccccgctccgccatcatcaacacagaaaggcattaaatgaccaccatcgaagacttcaccagccagtacggcctggtccagaagatcgacgcattcggctacatgaagtacctgaccgagaacccggacgccccgtgcaagcacggcaaggtggtgctcgtcaccgccgatacgccgctcaaggcatcgcgcggcgaaggcaagaccaccacgaccatcgccttgatcgacgccctgaacaagcgtggcattgatgcggccgccgtgctgcgtcagccgagcatgggcatcaccgcagccggttccaagggcggtgcctccggcggcggcaaggcatccctgacccaccccgagctcatcgactggggtctgtgcggcgaaatgggcgccatcgaggcggcccagaacctgctcgtctccttcgccgagaaggccatcgatgaaggcaagcttgacacgattctcgtgccgcgtgtctccgaggtgccgagccgctccctgcgctccaccgccgtggactacggcaagggcaacgtgccggagaaggtcgtgctcacgccgacctgcgagctcatgcagatcatggtgctctcccgctcgatggacgagatttccgagcgtgtatccaagatgatcgccggcaccaaggacggcaaggccgtgaccttcggcgagttcgtggacctgtggcgcatcaccggcattctggccgacgcggtcaagccggccaagaccgagaccgtgaacggctccccggtctacgtgcacggtggcccgttcgccaacgtgtccatcggcattccgacgctggtttccgtggaaatggcctgcgctctgcatgatgtggttgtcgtcgaagccggttacggcaccgacgccggtgcccagaagtggctggacatcgcctgtcgcgagtatggcgcgcagtggccgtccgccgccatcgtggtgacccgcgcctccacctggcgcgacgatcccgagctggcctggcgctacccgttccacgtgcagcgcctggagaacctggacattccgaccttcccgctcatcaacctgtgggaaggcgaggacgatcaggtcccgtccctgcaggccaccgccgacgagctgggcttccgcacgccgatcgtcggcaatctgttccgcgacggcggcgaggcgctggtcccgcagcttgacggtttcgtcgatgcgttgcagaacggctccatgccggccgaaccgcattcgcacaagggcatggccctgaccgagaacgccaagtgggtggccgagaacgcctacggcgtaccggccgagcgcgtgatctacaagccgggcttcaccgagtctgtgtccaaggccatggaactgtgccagagcgcaggcatctcgctggacaatctgacgttcgtggcggtcaagtccccggcgaccatgaccgacaacgaccgtgcccccgaagaagagcgcaccgtgaccctgaagaaggtcgaggtgcatgccggtgccggtctggtccacgtcaacctgaccaccagcctcaccacccctatgcccaagattgtgtgatgacaggcacgaggtgaggtaactcgctttcgaggggcggatttccggttttccggaggtccatctgcgtttcgaggggctcttcgattgcgaaacccggagtatgatcattgaaactgcaatgtttatactccgggtttcttgttttaaaagccccttgaaacgctagtagagcttctgaatgttggaaatcagccccttgaaacgtagaaagcccgccaccggcgggctttctatatctgagcttccctctttgaggggagctgtcagcgaagctgactgaggggagccagaatacacaaactagaagttgccaccattccagccccagtcggtggtggcggtgtaacggatgtaggtgcggtcctcgggaatgccgagcgtggagttcagcgcggccattatgctctcggtcagcttttcccaagcagagcccggcacggagcggccgaacacgttgacctccacataggcggcgggctggtcatcgctaccaccgaagtagatcggcatattgtcttcgaacgggcacatcagccagccctcggacttgcccggcacggcggtaatcgccttgccataggcggccttcaacgcctcgcgctgctcaggggtggtggacacggacacatgagtgtgaataacgggcataattcctccttgattcggttcgcttccagtctagcctcagcggctgctgttgaacagggcatgcggacgtaggaagctgctcgcagaacggaccggggcaaggccaattggggagattattggccttttcagccaatatatgttccgcagtcagcccaatagtgttgaatacccttgtgagaaaattgattgaacagctgatgaagttcggcattgtgggcgtcatcgcctttgttatcgactggggtatcctcaacctattggttggcatattccacatgcacaacgtgctggctgccaccatctctttcatcatctcgctgattttcaactatctggcgagcatgaaattcgtattcaagcatcgtgatgacatggcgcgctggatggagattcttatcttcgtggtgggcgctgtagtcggtctgttcatgaatgacgcgattatctggatttccacctatggcatgaaccacgatgcctatgtgtcgcagcatgccgaatatctgttgcgtaccaatatcggcaagttggtggccactgccgtggtgatgatctggaacttcttgattcgcaagtggctgctcgacgatacgcacaccaatgcgatgaaccgtctgaagtccgctgaaaatcgactgaatgctgaggagcttgaagccaagtggcagaacagcttctcccacaagctcggcatctggtccctggaacacacgcccaaaggctggtcgaagtagcgttttgacgtatagctaagccccctcgtcagagggggcttagcttttgtctcacacactcacttcagtcaaggtcggctgctcggtggagcccttgatctgcttgaagccagatatgttggcatgttatcggacatgtccgataacatgtccgataacatgtccgataatgctgaaggtggcaaatattgactcctgacgaattgaaatcgaaaatcgtccaaggcgaaggtgtctctcaggaattcaagcgttgcggttcgtttccggagtcggatacttttgagacaatatgttcgttcgcgaatcggcaaggtggcagtattttcctaggtgtcagcgatgacggagagattcgcggagttaatcgtcgaatcgttcgtgatatcgaacgcaatattgcaaatgtgacgtgcaatccgaatgtatttgatccagcaccagcgttcgagtctgagcgcatagatatcggtgaggaattggttcttagaatctgggtacctgcggggccgtcagtctaccgatacaagaacgtggtgtatgatcgccgcgccgacgccgatatccgtgttcgtgatgattctcagatttcgctgatgtatttgcgtaagcagagcatctactctgagcgacgcatttatccatatgtaacagttgaggatttgcgccaggatctgattgaacgaacatacgatctcattcgtttgcgagacccgaatcatccttggctcgcattggattgcgaccacatgcttcgcgcggcaaaattatatagccgcgatcggcaaacaggcgagcagggcttaactcttgcttctgtattattgctgggaactgatgaagttattggcgacgtatgtcctgcatataagactgatgcgctagttcgccggcgcaatgttgatcgatatgatgacaggttgacggtgtccaccaatctgcttgatgcatacgatcaacttacagccttcgcccatgcgcaaatgccggatacattcatattggagaatgacattcgggtaagtgcgcgtaatattatttgccgcgaattgatttccaatctgttgattcatcgagaatacacgaatccattcatcgctcgtttggtaattgacaatgacggtattcgtactgaaaatgccagtcgtgccttgttcgaggggcgcgttactctggacgacttcaatcctatgccgaaaaatccgatcattgcggggttcttcacacaaataggtcgtgcggatgatttaggcagcggaacacggaatatataccgatattctcgtttgtattccggcaaggagcctgtgcttgaagatggtgatgtgttcaaggcattcgttcccgttcccaatggagcatctgggattggacacactgagagtgttcttagtcgcagagttcaggtagacgttgcgcagagtgtcgatactgtcgatgaaacgattgcaaggctattggcggagcatggaacagtatcaagtgctgaggttgctcaagaggcacaggtcactgtccgtactgctttgcgtcatttgaccaaactgacacaatccggactaatatgcgcagaaggagaaaaccgtaacaggagatatcgattagcgtaggtgtttttgcagtgaacatacgttgattgcgtgtgaagcctcgtgatatgggctgtcgaacgaagtgagactgggggagagatttccgtacgtaatctctccccagtctcacttcgctcgacagaccccctcgccagagggggcttagcttttgtctcacacactcacttcagtcaaggtcggctgctcggtggagcccttgatctgtttgaagccaatcagcgcaatcaccagcgaggccagtgctaaagtggtcaccaccatgaagccgccatgcgagcccatgcggtcaatgaactggccggcaatcgccgaaccggcggaggagccgatggagttcatcgcacccatccacgccatgccctcggtcaagcgagagggcggcaccagatgcaacatgagctggttgccgttgatccacgtcggggcctggcatacgccaataatcaagtagatgatcatgattacccacagatgcttggcgaacaggaacgtactgatgccgatgttcaccacggccaggcagaagtagaagcgcttccacagggcaatcgaccagttcttcgcgccatacaccaatgcgcccatcagcgagctgaaggagaagcaggcaaacacaaagcccgtgtactgcttcatattcgcttcggtggcgaacgcaataatcgagatgcccgtggccgactggaacgcgcccaaaccgaaccaggtgacgcacaccgcaatcagacccggaccccaaatggacgccttcttgcccgaacgcgcatcggcgaccgcctgcttaatggctgcgttaatcgtggcctcatcggtcacgccttcacgctcaagacggcggcgggtctcctcggcggcggtttccaccttcagcgcctcagctttggcggcctcgcgctcacggtattccttgcgggagatgccctcggcgcgcgccagcgcggtctgtgatggcggctcggtggtcagctcggtcaggaacatcagcgcaccgatcaccacgcacatgccagtgaacgagaacgccagcaaaccggagatcacggccagcgtggaggccagcggattgccgattacccacatgcattcgtcgagcacgccgcacagcgacagcgcgcggttcgtgcgctcccggtcacccttaagaatcttggtccagcgcgcgcggctcatcgcgccccacggcggaatggcggccaggaacggcgtcagacagtacagcacccattccggcgcgcggttggtaatcgccgtcaccagcgcgatggcggccacaatccaaacgatgatcgtcggaatcgagacctgtctctggccgaacttgtcggtcagcttgcctagcagcggcgtggccacggccaacgcaatcgcctgaatggcggtgagcatgccggccagcgaatagttgccgtaataatgctgtacggaaatggtgatggtcatgccgaccatcgggaatggcatgcaggcgatgaccgagccgatggaataacgggcggtatgcggaatgcgcagtagttccgcatacccaccaaagactttgtggcctacttccttgatgtcggccagaatggtgctcgagttcgagttggacgagttattggacataacagcactacgctcctttccgctcccgattggatgtcccccgctggcgtggcgttgccggcgcagccctcatcacacaatgcagggctcatggtcgcgtaaagcttactccggatccccattcgcagacttcacgccacggatactctacgggtgtccactccgcgacacgcggtagattggagatattaagacaacgttctcatgcccttcagggcgggaagcagaaaggcgactcatgagcgctaccaccatccatttcgtccggcatggcaaggtatacaaccccgaccatctgctctatgagcgactgcccgacttccatctttccgaccttggccgtcgcatggcccaagccaccgccgcgtacttggccaagaatccccaaaccaatacgattgcagccgtctactcctcgccgctcgaccgtacgcgcgagaccgccggcgcgattctcgatgcgctgaaccccgtgcgcgagtctcgtggtgaggctccgctcacgctcaccactgatgaacgggtgattgaggccggcaacgagttccgtggcaagcgcatcggccatggcgagggcgcgctgtggaagaacggcaactggaagctcgtcaccaacctgtacaagccgagctggggcgagtcctatcagcacatcgcggctcgtatggacgacttcgcccgcgagaaggtggcccagcaccccggcgagcagattgtggtggtcagccacgaatcgccgattttcagttatcgacattatctggagaccggccaccccgagcactggatgttcctgcggcacacggcgctcgcctccgtgacctcggtgacgtacgacaacgaaaccggccgtgtgatgtcaatcacgtatgtcgacccagcagccaatgtcaagtaacggcacactggtgttaggacattggctcccctcggagaggggagccaagacgcactacaatcgagtggtggacgcgaaggagcatagatgaccattgaactcaatcgtgaggcaatcgcacaggtcgcggcattgccggcggtaactgaggccgccgaagccggctcggcgctgatcagcctgtggccgttgaccgaagccatgcaaatggacaatgacgccaagtacgcggagaatctgcaggtgcgcctcacccgcgcgttcgcccgcgtgctgaccggcgaggacgtcaccgtgcccgacgccgaattcgtgtatgagggcgccgatgagattcccggccgtccgcagaacatcgttgatgcgctgcttgccgccaatgacgcctacgatacgatggccgggtattgcacatccggtgatgcgcggctggtcttcgacgccgccgcgacgctgggcgtccattggagcgactccgtcgcgcacgccgtccgcgccacgatagccgacgtggagtcgcagatcgaggccgacgccgttcagggacgactggccgcgtccggcgagcctgaggacgtcgcagaccgtttcgccaccgcgctcgccgtatgcgatgcgctgctgggcgtggtggccgaagacgccggcgccgacgcccgggctcgggcgaccgccgtgctgccgattctgctgtacgtcaatgagttgcgcgaacagtgctcgattccgcgcatctgcctgaccgatcggcagatttccgggcttctcgatgcccgtgccgggtccggggacgccgggaccctggccgccaccgccgcatacatcgcccctttggcccgcgacgaatggaccaggcatcatgacgatgtgctttgggatccgggtgaggccaagaggagggccaaggaggaggacgagaagcgcaacaaggaggctctggccgccaagttcgcccacatcaaggacgatccgggcaaggaggccgtggagctgtagccggtgccgggtgtcgcgggcggcgtcgcgcgccgccggtttgcgatcgtcttgccatcgttttcgccgcggcggtatcctatggggtgaacagtatcgtccgtgcaatggaagtggaagatttatggacaacgatgtcaatctgcgcacgcttgtcaacgatggcggtagcgcggtaatcagcgattacggagcgcatctgctgcgctgggccccgacaggacagccggatgtggtgtggacgccgagcacgtggcgcatcgaacccggcaagccgctcggcggcggggttccgatctgctttccgtggtttgggcccggattcgcgcatggccggcagctggcgatcacgccatcccacggattcgcaagggtgcgccggtggacgctggatgaggaggggttcaccgatgaccgggtgcggtatgtgatggattccgagcgtctgacggatggcgaagtgccgtggcttgacgacgagccggaggcgcgcttccgcgccacatacgacgtgcatgccgctgacacgctgacgatgagcctgaccgtcgtcaataccggtgatgttccgatgtcgtatgaggccgcgctgcattcctatctgcatgtgggagacgtatccgacgctggtctggtgggtctgcggggggcgacgtatctggacgccaccgagaccggtttcccgccgcgattgcaggagccggaggcggtgacgttcggcgaacggccggtggatcgcgtgtattattcggattcgtccgtgcagttgcgcgacgccgttctgggccgcgtggtgcatatcgtcaaatccggctcgccgcagaccgtggtatggaacccgggcaaggaaggggaccatatgcgttgcgccagaccgggcgaatggcgtggtttcgtggcggtggaggcggcggcatgccgcgaccgcggtgtgacgttggcgccgggggagtcgcatacgctttcccagacgttgtcggtggagacgcttggcgtgtgatgatgcacggcggcgcggcatgcggccgacgatgacggtgaggccccgttcgtctcgagcggggcctcaccgttgatgcacgtcgcttcagcgggtttcgccggagtccgggccggcgttctcgtgttcgggcggcacctggccgtattgcggggccggtgcgtattgtggagtctgcccgtattgctgtgggttctgcccatactgctggttctgcccatactgctggttctgcccgtattgtgggttctgcccatacgtggggacggtctggccgaagtcttgggcgggggtgccgggagccgggaatcccggggcggcggaggcgccgtacggcgtaccgtaggcgttttggggtgcgacgccgatcgccgcgtcgtcgtcgaaccgtgcgccttccggcttggagggcagggccatgaacacaatgccggtgaccgcgctggccagcatgatcaatccgccgatggccaacgcgccgaagccgccggttgccagagcctcatagccgtagccataaccgtaatcgtagttgtggccgatggcgccgatggcgccgtacaacgccgcgccgccgccgacgatcatgatgagcagtcccaaagtcatcatgccgcagaagacggcggcccaccagccgggcttgttcgtatcgtgcaggcggcggacggcgagcgccaggccggggacgacgatggccaggttccacaggctggtgaggaagtccagcctgccgtccgtgacgtcgccgagcagggacagcagggcgttgatgatgacggcggccagcgtccaccaccagaattcactgcgggaggcgcgtcccctgaacaccgtgtatttctgccagaagcggaggaaggcttcggagaaggggcatccgtagtacggcttgttcagcggcaccgcgccggtgggggccgcgtactggttgtaggtggggggagaccggccgtagacggcggctgggcatagggattggcgttcggagcggactggccgtaggactggccatactcctgctggccgtagatgggctggccgtagggttgctgctgcgccgctgacgccggggcggcgaaacgaccgtgatcctgccccgcaggcgtcgcggtgggggctccatattcgggcgtgcctgagtggtgttggatagggccgccgttaggcgtgggcgtgggtggtgcgggcgcgttgctgggatcggtcattgattcccctttcataagacgattgcgtccctccattctctcattgagcgggtgtgggacttgccgccatccggcagacccatatccgactgctccgtcatcataggcttcttttttcattcgtgtaagcgttgccgtccaacgccagcaggtacgcaaacctcgagcgcaatgcaagctccaccttcgcggttcccttgaggatgatattgcgcaactcctcatccatcatgtaggggataaggaagtcgacgtcgcgagtgcccgtcttgaacctgttgccgccgttggcgggattgatctggaaggaacggaaatagccggaaagacggtaatagttgcagtcgaagagcgccctgcgaagacgtggctcatccgtgaccgccagaccgcgcttcttcatcaggccgattatctggtcgatggttttcgcgggcttcacttccgccccagcatgagaagagccccctggtttgagcactgtgagtaggcttagggagctgctgttgtctaccatgctagtcatgtcctcgcgtcttgaaaagtctgcggcgcgtctcacgcatgctatatatccccatggtccgacagtcgaccatgcgccaacctggcagtttctacggcgaggcatcacgcggcgggctcatcgaatgacatgaataacaaggaatgcctccgccgtcgcgggccgtcgcgtccggcgcgcgcggcacaataggggactatgactgatgctgaaaacaccaaacccgaactgcccaagaacgttcgtgttcgcttctgcccgtcgccgaccggtaccccgcacgtcggcatgattcgcaccgccctgttcaactgggcggaggcccgcgccaccggcggcaagctggtcttccgcatcgaagacaccgacgccgtgcgcgacagcgaggaaagctataaccagattctcgaatccctgcgttggctgggtatcgactgggacgagggcatcgatgtgggtggccctcacggcccgtaccgccagtccgagcgtaccgccatctacaaggatgttgccgccaagctgctcgaagccggctacgcctacgagtccttctccacccccgaggagatcaaggaacgcaatctcgccgcgggtcgtccggctgagtttggctacgacggttacgatcgcaacctgaccgatgagcagaaggaggttttccgtgccgaaggccgcaagccggcgctgcgtttgcgcatgcccgatgaggatatcgccttcgacgatctgattcgtggcaccatcgagttcaaggccggctccgtgccggactatgtgatcgtgcgtccgaacggcgacccgctgtacacgctgaccaatccggtcgatgacgcgatgatggaaatcaacgtcgtgctgcgtggcgaggacctcctgagctccaccccgcgccagatcgtgctttaccgttaccttatggaacttggcatcgccaaggagatgccgctgttcggccacatgccgtacgtgatgggccagggcaacaagaagctctccaagcgcgacccggagtccaacctgttcaaccaccgcgacaacggcttcatccgcgagggcctgctcaactacctggccctgctcggctggtctatcgccccggaccgcgacgtgttctccatggacgagatgatcgagaagttcgacgtgcgcgacgtcaaggccaacccggcccgcttcgacatcgacaaggccatctccatcaacgccgagcacatccgtatgctcgagcccgaggacttcctgcgccgctcggtgccgtacctgcatcgtgacggcgtggtcggtgccgacgactgggatgccctgaccgaccgtgagcgtgaggtgctgaccgccgccgctccgctggttcagccgcgtgtgcgtctgctgggtgaggtcgccggcatggtcggctccctgctgtccaccgaggaatatctggagcctgcggatgacgccaagaagcagctcaaggattccgccggcgaagtgctggacgccgccatcgccgccctcgagggtgtggatgaggccgattggaagaccgacaacctgcatgagaccctgaacaaggctctggttgaggagggcggctacaagccgcgcctcgccttcggcccggtccgtgtggccatgtccggccgccgcgtctccccgccgctgttcgagtccatggagatcgttggcaagccgatcaccgtcgcccgtctcaagggcctgcgggcgcatctgtgatgcgtcgtccaccgcacgccggcggatgatgggagcgtgacgcatggcgggcatccgtacatacggatgcccgctttcgcgttgcatggggtgttcccgcagaacggcggaaaatggcgcgacacgccgggatttgcgtgagagcagggtagcgcgtaatatatctacctgttgcgcggttcgcctcgcagccggttgaaaaactgaatatgcccccatcgtctagcggtctaggactacgccctctcacggcgccaacaccggttcaaatccggttgggggtacgacgaacaactcttcggagttgctacgccaagccaaattggggtgtggtgtaattggcaacacagctgattctggttcagccattcttggttcgagtccaggcaccccagccaataaccctcgcggattagcgagggttttttgtttttacacgtcctgctcatgagatacggccgagagggtaatcctgaatagacaactctggggcaaagactgggctatagtcccaatccgtgactcaaaaacggcagaaatcccgcgtccgaacgtaaggggcgcgggatttctgccgtttcgggccgtgcaggaccggccgacatcgcgcgttgccgcgacttgagcgctgtccgatcctgaaaacgtgagggagaccgccctcgtcttacttcttgaccgcgttgacggcgtcaacagccttctgcagcgacgtggtgtgctcgtggtaccacgtgacctgctgttcgagtttcttggccgcggcctggtagcccttggtatcgtcggccacgcagccttcgtacgtcggcagttccacggtcagttccttggacagcgcgtcgagagcggaggcgtccgagacgtctgccttggtcagagcggcggcttctgcagcatcgccattgaccaagttgttgtagtcgttggtggcgttacgtacgtcttccgaggcggcggcgcaggcggccactgcgctatcgtactgagacgcgctgtatgcgcgggtgccgaacaccgcgaccgcggcgataatcgccaccgccacgatggcaatcactatagcgacccacttcgtcactcgcttgttgtgcggctgtgccgtcgcttctgcttggttctgggattcggactggttgccgttcgcctgctgtgcgtcagtcatatttacctctccttctcactgcccctgtttgtatcttgcggagggcctgtttcaaacaacgggtatccaacatatcgaggagagccgagattgccgggcgtttcctactggttgcgctgtggcgtggccgtttttgtctcatatggcgaaagtatgcgccagaggctattgccgaccggtgacccacggcgcatccgaatggacatgcggaatcatcatcgcgatgaccgccagcagacacccgagcatcaccatcaagatgatgttctcgtgtccgtgcgcctgcagaagcgcgccggtcagcgcgccagacgccagcgccagcattacgaccgcgcgccgcccgagcttcgactgctggtggccgtgtgccgaagcgtctgcgacgacgccggtcagcgtcatcgtgagcacggtggtgggcaggtccggcaccgacagcttgcgggcggtggagttctggatgcccattgccggggcgagcagcacgatcagcaggatgatgtgcaggtcgatgtgccgtgcggtggggaagttcaggctcggctgtgaggcctgtgaggcctgggtggtctgtgcaagccgtgcaatcgaggagacgccggacgcatcgtctgcggggccggtgatgagctggttcaaaagatagacaccgattagcgcggcgagtacgaacgacgcctgcacgcaggtagaaaccaacagatgcttggcccggttctcctcgaatcgccggatgatgcgcccgccgataagcgcgccgaccatgaaggagacgagcgtcagcgccgacgtccaccagacgaagccttgggcatgggcgatcgaaaacccaagaaacacgatgttgccggtcacgttggccacgaacacatgccccagcgacaggtagctcagcgcgtccaccagcccggcgacgaacgtcagcaccaccaaggcgggggagagcagaccgtatctgtcttccttgcggggaaccaacgtgcgtcctgcttcggcaagatgtgatgtcatggttgcgacgaggctccttttcgggattgaaattatggcgagaacatgcgtcggtcgacgccgccactctactccctactcccgtacggtgacggtgaactatcgacgctttggccaatcagatgcatcggcataccagtggtgcactggtgattacgcatttttgaacttcactaactgaatggtcactcaatccggataatatctttcgaagagttcgttgcaggtgcgatggcaatgagcaaaatgtgcatccacggtttcccagttgtgcttccatcccgtcccgccgcgcattcggccaatcgacgcgagaagggagtccatgaagaaaagtgaggcttctgctgtcaatccggtgatgcattcaagcgtcattgcggtctcagtagtgggacgcaactgcgatatggcatgatttgtatctgcgtcccactcttatgcggggttctcggtgcggctttcgctgaatgtttcactgaatacactgaattcagttattaaacattgaattcagtgtaaaattcagtgtatcaagaagaatgcgttgggttggatccctttatggcacatgaatatggcaaggaaacgttgtcgctcgagttcaaaagcgatttgaagcgtctgccagatgacgatctacttgatgccgtcgtggcgttggcgaactcggatggcggtacggtgtatatgggcgtcgaggatgacggcacgccgaccggcatcgacaaagtacatcaggatgcggtcggtttgtcggcgatgattgccaaccgtacagttcctccggtttccgctcgtgcgcagatcgtcgggacggagaagacgccggtgatgcagatcgatgtgccgaaatcccgcagcgtggtctcgaccaagtcgggcaaggtgttgcgacgccgtatgaaggtggatggtacgccggagagcgtgccgatgtacccgtacgagatcgccacgcgcctgtccgatttgggacgtttggacttttccgcacagccggtgccggatgcgacccgtgatgatttcgatccccttgaacgcgaccgtctgcgccggattatcggcacctaccaatccagtgaccgtaatttgttggaactgaccgatgaggagctggagaaatccctgcaagcggatgtcatggaactgctgcatgtcgatgcgaaccaggcgtactaccagctgtccaagctcgttaagggtgggaagctgggggtcattggccgtggcaagggggcgcgctatacgatcggtggctttaccgggcgaaagtgatgtgctggcggatgtgcctgtatggatgctttgtgctgggcatcgtccgaacttgggaagtcgtttcggtacttaggaaggtacctaggaacctaggaagtggtgtgggtaaggttcctaggttcaggtatgcgttcgtgtggcgttcatcggagggggtcagggggaaccttcgcgctgggccgaccggtattcgctgcgatgcgcttgcgatacggaggctgggattgttgcgaaccaaaacgaaaaaaactgcgcgggggcatgaggggatccgaatcggcccactgacgggacacatgggacgcggccggactccgatgacgaacacacggcgggcgaaggctcgaaggcgttttcggaatcgtcggttccgatatgtgacacgcgcggcaggtcggggccaaaggtgtcgaaacggagggaacctggagggaaccgacaatcggaaggaaccaaagcaaaaccccggaaaccgaatgatttcaacggtttccggggcttcaatacgggcggaggatacgagattcgaactcgtgaggctgttacaccaacacgctttccaagcgtgcgccatagaccactaggcgaatcctccgtgctttgcagcgcgcagtcgaactgtgttccgcaggcaactcgaataagttaccacaggtttcggataagtgcacgcttcggcgtggcgcgtgtcgcgacgcggatgcgaagaatgattactgcgagtgaaggactcactggaaagtcccgcgcaacacctgcacaaggaccgcatacttgtgcagggcccacacacccgcgcgcacctacacaaccaccggtaaagaaatcaccgtgtccaggtgaattttcgatgttcgcccggcgcgcgcccgcaatcgcgcctaggctgtggagtcatgaacgaggggacagcggccgacgtaaccgcagcacatggcggccggtcgcgccaatcgaagaaacactcaaagacgtaccgcagcatatccgcgatccttagttggctcacggcccgccgcccgaccacgttatccacatcgctgcgcgcgcgattcctcccttacctgctcacgctcgctatcgcctggctgccgtggctcatactcacctggccgggctcgatgcgcgacgatacgcttgcccaatatctgcaatcgtccggtctgcaccactactacacccagcatccgctgtttgatactctcacgttcggcttgttctggcatatcggcagcgcactcggctcccctctgatcgggcaggccctgtacaccgtgacccaagcggttctactcgccgccgggtgcgcgcttctgctgtgctacatccgcaaaatcggctcgccgcgctggctcatcggtctcggcctcgtctatcttgccaccaactatgtggtggtcggtgcaatcaccacgatgggtaaggactcgttgcacgccgtgttctatctgccgttggccgtgctgttcgtggaggcttgtctgacgcgcggctcggtactggctcgccgcccggtggcattcgcgttcgtcatcctgttgttcgccaccatcgtctccaagcggacggcgctcataatcgtgctatgcgccggctgctgtttgctcgccgtctgcacgcccaaaggcgcgcggcgtcgtgcgttcgcgtgtcttgcggttgccatcgttgtggcgcagggtgtgtggacgccattaagcgcggccgccacgcatgcgaatcgatcgcccggacgtgaggtgtggggcctggtcacccagcccgtggcccggctcgcgcacgatgatcccagtgcgatagacaaggttcagcggcggcgactgaacgcaatcatggatctcgactgggccgccgccggcatcaacccgcaccgcaccgatgagaccttccgcactctgcgcgagcaccctaggccaaccgcggcgcaacaactcgcggccctgcaggtctgggcgcagctcggcctcgcgcatccgactgaatatgccacggcctatgccggggtgactcgcggatggtgggacccgcgcgtcaatttcgcgtaccccactgattccgactacctgttcacgcctggctatctcaggcaatgggcatctttcctgactgaaggtgcttggaagcatacttccgacggcgatgccgataccgtggcagccgaacggcttgccgccatcgaacatgaccttgcgccgctgaggggtacctccgataagccgcaatggcagaaaaatatattgcgggcgattcatcggtgggcgcgttcggatggtcgcgtcggtgttcgtaaaggcaatctgctgacttcgatggccctgtacgtcacgtggattccgctggctgcgggtcttgcgctggtggtgcggcctgcgcgacgacgctacggccccgcactggccgcttacggtttgttggcattcacggtgctgtcgctgtatgcctcacccatggcactattttggtatccgattccggtattcctcgcgttgccgctttttgtggtgttaccgttcacattccgggagagccatcctctctgagcatagttatctcagatagtgaaataattgcggggttgaaaagcactaaaacgccttctattacctcgcacccgtcaaaaaatcaagactgttgttcaagaatttttttctatagagttcatagttgtttttggaccattcgagtacttgaagtgagaggaattcagcatggttcgtcgcgcctgcgcgcagtccgctgaaatgaacacgatgcgggaacgtgatacgcgcgttgccgtttctcgcgtgcgcgcgaagtcgggcagcaccggtcgtctgcagtcggccacggtctcggctcgtgcatttgcggtcatcgtttttctgtttgcgatgatcgccgcgaccttcctcccctccgccatcattccgcagtccgcgttcgccgtgacgccggcaaccactgccactgctgccaccgtcaagagcgacgacaccaccagcgtcgattacgcgacctgggccgacgttgccaaggccgtcgaagcgcagttgcaggaaggccttaaggaatacaaggacggcaacccaatgggtgccaagtccgatttcggggctgcatacaccaccgtctacgtgacgtccaacttcaacaaagtggtgagcgacaccatcggcgcagacaagcagaccgcgcagcagcaggccttccaggacctgcaaagccaggtgttcacgtcagaccaggccgatcagcttacccagaaggtcaacgacctgaccgccgacctcgacgccacggcccagcagctcgacgccaacaccagcctcgccaacccgaagcagtactccgaagacctccagaagcagatcgccaaggagcgcaaggagctcgacgccaagaagaagcgcaccgaggaaacggccaagacttggaaggaagtcgcggatgcgatgcttccgatcctggacaacgcctacaaggcctatgagggtggcgacgccgccaagggcgccacgctcgtgaacgacgcctactaccagcactacgagaagctcggcttcgagaagaccgtgctgagcgccatcagcggcaaccgcgtctcccaggtggaataccagttcaagctgtgccgctcctcgatgaacaccggcaagcctgcttccgaagtcaagaagtacatcgacgacctgaagaacatgctggccaccgatgccgccaagctcgacggcggcgcggccgatgaggagggtggcttcctcaagttcatcaccagctcggtcggtcaggcgttcctgattctgatccgcgagggtctcgaggccctgctcgtggtcgccgctgtggtggcctacctcgtcaagtccggcaacaagcgtttcaccaagtggatctacgtgggcgtgctcgctggtctggccggtgccggcatcgtggcggtcatcttcatgctcgcattcggcggctccagcccgctgcaggagatcatggaaggcgtgtgcgcgctcgtcgccatgtgcatgctgttgtggaccagcaactggatgctcaacaagtcctcggtggaagcgtggaaccgctacatcagggaaaagaccgaagccgcggtggcctctgtctcctcgcaggtcgaatccggcgagaaggtggcttcccgcacggtgatttcgctcgccatgctgagcttcctcgccgtgttccgtgagggcgctgaaaccgtgatcttctaccagtcgatctacacgatgagccaggatacgcatggcatggtggtcggcgcactcgccgccgccgtggtgctcgtgatcatcttcctggtgattcgctttacctccgtgaagattccgattggcccgttcttcctggtcacctcgatcctcatgtccgtactggtggttgtcttcgccggcggcggcgtgcacgcgctcatcgagggcgacctgctgcccgccaactacctgccgggcgttcccaccaacgactggctcggattctacccgtacgtcgaatgcatcatcgcccaggtactggcagccatcgccgtcatcgcgctgttcgtggtcggctttgccaaacagcgtaaggccaaggcccggcttgcggccggtgcaagcaagtcggacgcgaaggctgacgaggagagcgcgcaggcgtagcacaacgcccggtgcgaccatctcgcgcaacacaacttgcgacatggcaacggaagcgattccagcccacgccgccacaactaaaaacagataataaataatccattcaccacaacaaaaggaataagagaaatgatgaagaacaagaagcttgctgctctgctcggcgtgctgctcgccggctccatggctgtttcgatggctgcttgcggttccaccaacaacgcttccgataccaagtcctcgaccagctcctccgacaccgccaagaaggacgactccaagaaggccgacgccccgactgagacctccggcttcgaagaggtcccggtcggtccctccggcacagccaaggagcaggacaaggccgctggcccgctgaccgtgggcgccgtctacttccagcccatcgacatgtaccctgcgtccatgggtctgaaggctgctgatgcttccttccacctggaagccgacatccacgcctctgaggaaggcaccgactacggctacggcaagggcgacttcgtccctgacctgactgtgaactacaccatcatcgacaagtccaccggcaaggaagtcgagggcggccaggccacctccggtaccttcatgcagatgaacgcttccgacggcccgcactacggcgccaacgtcaagctcgacaaggccggcacctaccagctcaagctctccatcgagtcccctgagaagaacggctggatgctccacgttgacccggagaccggtgtcaagaaccacaagttctggaccgagcccatcgaggtcaccttcgacaactgggactacaccccgcgtcagtggtgattgactaagcagaaagccccttcgtcagaggggctttacgccgctttagggagataattcttaggacggtctaaaaactcccctcagtccgctttgcggacagctcctctcaggggtggggagcctaaggtgaatagagaaaggacgcgaatgcttgaacaattcgtggcagtgatgccgggcaccttggcccccacattgctggtgatgagcctgagcgtgatgctcacggtcggcgaggggcgagataagccgataagctcgcattggcgtctcatcggcctgaccgtcggcctgatcgccgctatcacattcgccggcctgcgcgcctcggccgtgatcaaccagcgcacgttcgtcaactatccggtgctgtggtgcgcgatcattgccgacatcctgaccatcgtcgtggtggtgttcgcacgccgcatcaccaccaattggcagcagcacaaggtgttcatgcacattgcgaacgccgtggccgccatcgacatcgcgctcaccctgttctacgcgctgccggacgtgatcctgcagctgaccatctgggtggagcccggcgacccgatcttcacgtccgacatgctgctgcgcgcgctcggcttcgcgctgggcctggccatgtcgatcatcgtggccgtgatcttccgcacgatgcgttcgaccgcggtgcgtgcctcgttcaccgccgccgttctcgcggtgctggtgattctgttcgtccggcacctgaccggtgtcatgcagatcctgcaggcacgcggtttcccgataggccacacgggattcgtggccctcgcctggttgatcaaccacaacgactggatgatcatggcccaggcgttcgtgttcctgattccggccgtcgcctccgtggtggccggcttccgcatgccgctgaccggcgcgaacgaagccatcggccgcaagcacaaggcgttccgccgccgcgccgtggcctccgctgtctggagcctcgtggccatgatcggcgtcacgctgaccctcaccgtcggcgtcgccgcgacccatcagaccatcactctttcgccgccggaagcctactcgctcaaggacggcgtggccaccattcccttcagccaggtcgaggacggccacctgcaccgtttcgaatacaaggccaaggacggcaccgtcatgcgcttcatcatcatccgaaagaacggtggcgcgtacggcatcggcctggacgcctgcgagaactgcggcgacgccggctactacgagaaggacggcaagatcatctgcaagaagtgcgaggtggccatcaacctggcgaccatcggcttcaagggtggctgcaacccgataccattcccgtacaagaccggccacggcaagatcaccattcagactacggatctggacgcgctgagcgcccacttccagtgagtcaggcaggaggcaagaatcatgttctttctgcgtatgattactcgctcgttcacccgacagctgcgccggcgcctgcttatcgcgctgaccgtatgcctgtcggcgaccgtgtccgtatcgatgctgggcgtcgtgttcgacgtgggcgacaagctcaacgccgagctgtccacctacggttcgaacatcaccgtgcagcccaaggcggacgcggtcgtttccgacctgtacaacaccgagtcgggcggcgcggcgtccaccagcgacccgaccgcctttctgaaggagtcggacgcggccaagatcaagacgatcttctggtcgttcaacatcaccaacttcgcgccgcagctcaacatccacgccatggtgaacggcaccaacgtgccggtcgtcggcacgtggttcaacaaggacctcaagatttccaccggcgagaccaccgtcgtgggcgtggaaggcatgcgctcgtggtggcagctggatggcaagtggcccaaggacgattccgatcagggcgtgatcggcaagacgctggcctccgaactcggtgtgaccaccggcgacaccatcaccctcaacaagaccaccgcctcgggcaagaagaacgagcagaaaatcaagctcaccggcgtctacgattccggcgacgaggacaacggctcgctctacatcgcctcctccacggcccaggtgctcgccgacctgcccgattcggtcgacaaaatcgaggtcaaggccctgaccacgccggagaacgacctggcccgtaaggccgccgcgaatccggccgcgctgagccaggaggaatgggagacctggtactgcaccgcctacccgagctcgatcgcctaccagatcgaagaggtgattccgggcgcggtggccaagcaggtgcgccaggtggccgcgttgcagggcaatgtgctgcagaagacgcaggccgtgatgattctgatgaccgtgctgagcctgatcgccgcagccgtggccgtggccaacctgatggtcgcctcgatcggcgaacggtctggcgagctggcgctgctcaaggcgctcggtgccaccgatgccgcggtatcccgcctgatgctggccgaaacggcggcaatctcgctgctgggcgcgattgtgggcgcgttgcttggttccggcgtggcccagctgataggccgggtggtattcggttccggcatcacgatgcggccgatggtgttcgtgctggtgttcgtgctgctggctgtcaccgtgctgctggcgtccgcctcctcgattcgttcgattctgaatctcaagcccgcggaggtgctccatggccgctgagtttatctacgtaggtgtggaaggaggaaaccgatgaccaacaccggtatgttcttcagaatgctgttcagcgccgtgttccgccggcgttcgcgcgcggtgatggccgtggtggcgtcgctggtcggcgcggccacactgttctgcctggcgatgatctgcctcgccgtgccgcagcagatgaacgaggagatgcgtgcgtacggcgcgaacctgattgtcacacccaccgaatcgaccaatgccgacggcaaggccggcatcgacaaggcgatggtgcagcacaccactgaaatggtcaaggccaagggttccgcgaaatacgccacttaccgctacgagaacgtgcgcgtcaacgcctcgccgtacgtgatggccggcgtgaatgcggcgcaggtcaagaacctcaaccatcactgggtggtcgacggctcgtggccgaccgacggcaaggtgctggtcggacgtgacatcgccgacgccatcggtctgagaatcggctccgccatcaccatcggctaccgtgcatccgataacgccagcaccaacggcacttcgtcgaactcctcgatcgaccagcaaaccaaagacggccgtgtctccagtgacatcatggacacctccggcaccgaattccgcgtggccggcatcgtggacaccggcggcagcgaagactcgatcatctacgccaccaacgccgacgtcaacaagctcaccggcatcacgcgcggcgtggacgtcatcgagtattcggccggctccagcgacctcgcaggcctggtgtccagcatcaacgacatgacctccatgcacgtcaaggcgcagcaggtcaccaagatcaccgcctccgacacccgcatcatcaccatgctgcagacgctgttctggatcgtctcgttggtggtgctggtgctgacgctcgtcggcgtcggcaccacaatcagctcgatcgtctcgcagcgacgcaacgagatcggcctgcgcaaggccctcggtgccagctcgcgtgccatcggcaccgagttctacatcgaatcatcgctctacggcctgattggcggcctcgtcggcaccgcaatcggctacggacttgccagttggctgtgcgtggcggtgttcgaacgctccatcggattcaactggtggctggcgctgatctccgtgctgttcagcgcgctggtcgccatcgtcgcctccatcccgcccgtccaccgcgccacccgcatcgaccccgccgtcgtgcttcgcgaagaataaagaaagagaaacgtcatgctacttgaactcgaccacatctcgaagatctacggcgacctgcatgccgtggacgacctcaatttgaccgtgccggaaggcgaatggctcgccatcgtcggctcctccggctcaggcaagaccacgctgatgaacatgatcggctgcatggacacgccctccaagggctccgtgaagctggaaggccgcaagctggaggacctgaacgccacgcagctggccgacgtgcgcaagaacctcatcggactggtgttccagaagttctatctggtgccgcacctgaccgccgtggaaaacgtgatggtggcccagtactaccattcggtggtcgatgagaagcaggccatggaggcgctggaaaaggtcggcctgaaggaccgcgcccaccacctgcccggccagctctccggcggcgagcagcagcgcgtgtgcgtggcccgcgcgctgatcaacgacccgaagctgattctggccgatgagcccaccggcaacctcgacgagaagaacgagaaaatcgtgctcgacctgttccgcaagctgcacgagcagggcaccacgattatcgtggtcacccacgatgcgcttgtcgccagctgcgcgcagcgcgagatcatgctcaaccatggcgtgctcgtcggtgagaagtggaatgacgaggatgcgcgcaaggcctacgaggcggccggcggcaagcccgcctccacgggtgcacaggtcgagggcgcgcagaacggcgagaccgccattggtttcgctgaccccaccaaggccgcgaaaaccggcggcgaggagtagggccgtcaggggcatcgagcagtatgtgaggaatacatggcaagctgatggtctctcccccagtcagcttcgctgacagccccctcgtcagagggggcttaaggagcgtgaatatgaccgaaaagaatacgttgaagaaatctgcgacattggcggcggccggactggtcgtggctggcgcgctgctggccgggtgcggcgaatccaaggccacgccgatggacgatgcgtacgccggcaactcgggcgagaccgagaagtcgcaggaagagcagtcgcaatcccagtcgaacggctccgatagctccgacggctccgattccggctcatcgcacaacgacccgtccaccaccacgtccgacaagaaggacaccggcaactacaaggacggcaactactcgatcaacggccagtacggcccggtcggcgaggattccatcgacgtccatctgaccatcaaggacggcaacgtcgagaccgtcaaaatcattgggcacccgttcaccacgatttccaagaaccatcaggacgacttcgccaaagccatcaacggcgtagtggacggcaagcccctgaagggactcaaagtggacaaggtcgccggcgccagctggacttccgacgccttcaacaaagccctcgaagtcgcccgccaggaggcttcgattcaggagtaagaccgctacttcagcaatgctggccacagcagatcggccatgcgcgaggcccaggcggtgtcgtcgtccatcgctttgccctcgatggcctcatacgccaccaaagatccgataatcgtggacaacagcaacttctcgtcaacgtcctcgcgaaacacgccctgcgcgactccctgcttgaggaacgcccccacatgctccagccacggggtcaccacctggtcgacgatgtgctggaagaactcggcctcgctggacaatacaatgcccacgcgcttgacgtcgatgtcgttgtcgcgcacccaatcgaccaatcgctgcaatagttgcgtgaaatgctcacgcgtggggctgggcactgggccggaatctgggatggccagatacatcgcgctgatctcgcgcagcagctcgtcggcattatggtatcgacggtaaatcgtggttttggccacaccggagcgccgggccacctcctcgatggtcacgccgctgatgccgcggtccaccgcaatctgcagcgtggctcgcatgagcttgcgatccgtcgcctcgcgcgtgcgctcaccgcgcggtgtcgccgtcgtacctgtcatctccgtcatctcttctcttcgaaatatgctcccgtacgctccagctggcgggagctggctggcaaagccagactgagggtggtaagtccatgccgtttgtaggcaactcccggataatacctactagcccagcactttagtgctctcgactttggctacataccactggttgaaccgcaccagtggcttcctgagcaacagtccaagcaacagtagcggcggcacgaatgccagcagcattccggcggcccgccagtaatccatgtcgtagatgccggcgatggccgcacgcatcatcgtcaccgcatgggtgagcggcaagaacggactgactttggcgatgaagtcgggcaacatctgcaccgggtaggcagcgttcgcacccgaaatctgcacgatgagcataagcacgccgattgccttacccacattgccgaaactcaccaccatcgtataggtgaagaacgagaacaccagcgaggccagccatccggacaacataaacagcagcggatgcacggcctgcacgcgcaggaacagcagatcgccgccgagcgacaccgtggattgcagcagcgcaatcagcgcgaacaccccgtaatgcccaaggaagagccgatgcggccgcggatcgcccaaggctttgcgcgtccggcgagacacggtggttttcagcgtcaccaccatcagcagcgcgcccacccacagcggcagcagcgtgtagaacggcgccatcgacgaaccgaaattcgccaccgggaatacggccttgcgcctgagctgcaccggcgcggccaacgtactggccagcgtttcgggatcattgcccagcacctctttgaccatgctcatatcgccactgtttagtgcgtcgctcagtgtgctgttgaacgaagccagttcggcaccggcggaacgcagtttgccggacaccttgtccaacgtggtgcgagcgtcgctgagcatatcgctggcgtcgtcggaagtccttttcaggtcgccgagcgtggagtccaactgggtggcgccggaactcagtatgccggaggcgtcagagacggtggacgacagggagtcgatctgcggtttcaccgtggccgtgaaatccgacttgatattggcgatactgttctgcgcttgatcggccagatccttgacctgcgcatgctgatcctgcgcgtcctgattaccttggcgaatattggtcgccgccgtattcagcgcttgccgcagcctgttctgccgtgcgattgaacggtcaatcgccgtgatgatggatgagtcgttgcccagtatgccggccaacgtgttgcgaatttcagtgtatttctccgtctgcttgccaatggccgtggcttgacggtccaattcgtcggcggccgtggtggcaccatcattcgcgtcggaatacagcttgtctatggaatcggacaccgcgccgaaactggaggcgctcgcgtccagtgcgctgctcatcgcgtcagcggtggtgcccagggctccgaccacgtcggtgactccctgcttggcgctggcgagatccttgcctccttgtttggcggcagaggaaacctgagtgatcagcgagttcgaggtgtcgagcaaggcgccggccgtatcggtcaatgcgctgtatgtgccaagcaaatccgccgtatcgtcaagccgtgtggcgaaatcggcgatattggcgttgaaggtattcagttgctctttggcttcgggcttggacagctgatcggccagcgaagacgcgatttccagccctgccgaagtgatggtcttggcgaacgtggtgttgatttccgccgccacctcgtccgtgccctcgttgagcagattcggtgccagcgcgttcttcttctcgttgcggtaataggtcagttcggcatgctgcacatcgtcggagaagaaggtcatcatgtctttgctgaacgacttcggaattacgatggccgcgtagtatttgccggatcgtgcgccctcgacggcatcggctttggacgtgatcgtccaatcgagctgactgttggcgcgcagcgcgttcaccacctgattgccgaccgtgactttcatcgggatcaggtcggaacgatacccctcatccacgttcgccaccgcgaatttcaggttcttcatattcgagaacgggtcccagcatgcggccacgttgaaccaggtgaacaggccgggaatcatcaccaagccgatcacgatgatgatggagaccacgttgctggtcaggcgtttgatgtcgccggtaaacagtttccacatggtgttcatcgtgcgtgcctgccttccttggtcggcggaatagtggggatgattgcggtaacggcggcgctcgggtccgcttcttcgtggcgttcggcggaggtgtcgcgacgcttggccttatgcccgtacagcatggcgcggatcgactcgtcggagaggttgccgagctcggtttggcggcggatggaatcgcgcatgaattccacgaccatcaggaagcccatgatgatgagcacccatgccagccatgtgcccatgaccacgattttctcgctggtggtcagcgcaaacacgataatgagcgcggccggcaccacaaatccggcgataagcgcacccagcagcagccggggatactggtaggcgaatttggcggcccgacgttcgatggcatgacggtattcgtcgcggtcggccagtgccgcaatggcctgagtgacacggtattcgctgccgggcaggtgcaccggctcgccgataatcatgtcgctttccttgatttcccgcgcgaacaggcggttgagattggccagtttcggccgggcgccgaggccaagcacaaaggccagaaccgcgaaaaccagcaatttgccgatataggcgaaccagaggccgtcgtagaagccgccgatggtttcacgcattgcgtcaatcgaataggtgaacggcagcagcggatagatggcgcggaagaacgcgggcatcatttcaatcgggtacaggccggaggcgcccggcacctgcagaatgaccagcgccacgcacacgcctttgcccacgtgcatgaacgtggtggagagggcgaaaatcaccgacatatacaccagtgaggtgatgacgcaggtgagcagaaacaccggggcgctcgcgcattgaatgccgatgacaagatcgccgatggctgtgaccaggccttggacggcggccagcgtggccagcaacaggaaacggccgagatagccttgagtgggcgtgagatcgtcgatgccctcgtcgtcggtttcgagtttgggaatgaccacgagcacgaacgcgcccacccacaaagacagggtggtgaacagcggtgccatgccggaaccataggaggcgactgggtagacggcccgttcgctgataacactgggggagagcatgaagtcggcgattgtggcggcatccagcttgccgtcggtgtcgatcagggagctgagtgaactggagacgctcagggttttgatgtcggtggccagcgtttcgagcttggtttgcatgccggccagcgccttatcggtgtcgcgtagcgcggtcaccgtggtggaggcggctttgtcgagttggtcgagggtgtgcttcgactgatcgatgagtgagccttgcgacgtgatgccggtcgacagagtgttggcggtcgagctgagggtgttgaggccggtgttgagctgaggaatggtgccggagatgatggtgccgcgagcggtattggcctcgcgcaccgtggtttgggtggcggtattgagatgctgcgccaatccggcggtgtctgtggaggcgttgccgatagtggtgttcaggctatcgaggttgcccagtgcgccggcaagctcgctattgcggctttccagtgcggcaatggcggattgcagcggttctcgatcggtgttcggcagccctttgagttggtcgatgatgtcggcgttcgcttggttgatgtcttccgccgtattgatcagtccgtctacctgctgattggcggcgctgatggttccggctaccgtgcccacgctttggttggcctgcgctgcggcttggctcagcaggcttgagccttggtcaagcgcttcggacgtggaggtgacgaagccgttcaggctggtctgggtagtgccgatcagggtggagacgccggccaggcctttcgcggtgtcgatgccaagtgtgcgcgcgtcgtccagcgcctgacgtgcggtgcgtgtctgctctggggtatcggtgagtttggtggtgagtttggcgatggtgctgcgtgtgtgctgcacatcgccggaggcctcggcaagggccgtgagggccttggctttggtggtgtcttcggtgctgatgactttgtcgccaaccgtattgatgacttcggtaagtactttggatacggtggagacgaatgtggaattgaccgtgcggtccacagtggacgcgccgacgtcggtgactttgggggcgatggcgctggctttttcgttgacgtaatactccagagtgggccgactcttgccgccggtcaccacgccggcgagatcgttggaaaagtctttggggatgatgatggctgcgtatgccttgccggattccacctggtccatggcctcggcttcggtgacgaaggtccagccgagctggtcgttgcttttcatctgcttgacgatttgatcgccgaggttttgcttgccgatgagtgcgttgtcggtgccgtcgtcattgttggcgatggcgacggtgatgcctttggtattgccgtacgggtcccagaagccgacgatgttgtaccacgaatacagtggtgggatgaacaccatgccgaacaggatcacccatgcggccggcaccttgaacaggcgcaggaagtcgcgtttgaggaccttgaagatattgcccactgatacctccggagcttggtgttgcttggttgctacgttttccgtagcgatacgttaatcgtagcgctacggttgccggagatcaatggggtgattgatgatgtctttggcggaataacgccgctgcccagcggcttatcgtgcgtcgctgggcattgtgcctaatttttgtggctggggtgctgtgtggctggggtgctgtgggctggggtgctgtgtgtgttggtgtgaggctgccctccatggggcggtaaaaccttcatcgggcggtaagtggcccatggggcggtgaaatccccatggggcggtggcttaaaatggctttattccgcggaatgcggttttgggctaaccgccccatggggtaattaccgcctcatgagagagctaccgccccatggataaaccgttgtatcagctttcgatggtgccggattggccgtcgatggccgactgctcgttctggctggatgactggtcggagctggagttgccggaagtgtcagaacctgtgccggccgtccatcaagttcggcaaaactgcaatcgggtgatagtgtaaggggacgctatgtggggaggaaaccatggttgaattcaaggacgatggcacggccactacccttggaaagacgcgagagaaccgtgacgccgagtccgcagtcgtggccgatctggtggccgttgaattggacgacgccggcttgaacctgaacgccaagcgattaccgattctggcgcgcatctatggcgcggtcgtactgctggacggactcgccacattgccgattatggtgatttccatcctctatgccgtgcgcgagattctggatggtcatgtgcacgtcgatgcgatgagcctgaccttcatcctgtccgcggtccgcgcggtggtgctggtggtcagcgccgtctgcctgatcgtgttcggcgtgatgctgctgcgcaaccatcgccggtatgccgcgcgctggacctacgtgctgatgccgctgacgctggcggatggcatgctgtcactggcgttgaccggcctcggccccaacctgctgatgccgctggtccagatgaccatcctcatcgtgatctcggtgaccgccgacccctccctgagcgaggaacggcgcctgcagcgcgcgctcaaacgcatggacgatcgagatgactatgagtcggcggtggcggccggcatgctgggacgcgaccagtccggcaaaggctacatcgcactggacttcttcaacatcttctggctgttcaccatcgcctcggtattcggtctgatcatggagacgatctatcacatggcgttgtacaacggcgaacttcaggaccgtgcgggcctgctgtgggggccgttctcgcctatctacggctgcggcgcggtgctggtgaccgtatgcctgaaccgcctgtggaaagcgaacccgttcctgatcttctgcgcctcggcggtgatcggcggcgcgttcgaatactgcacgagctggttcatggaggcggccttcggcatcaccgcgtgggactacaccggccgatggctgtcgatcgacgggcgcacctcgggcctgttcatgttcttctggggtctgatcggcgtggcgtgggtcaaatggctgctgccgcgactgctcgccctgattaaccgcattccctggaaggtgcggtattcgctgaccgccgtatgcgcggtgctgatggtgatcgacatcgccttcacgctgatggccttggactgctggtacgggcgcatggccggccaaccgcagaattcaccggtcgcggtgtggttcagtgaacggtatggcgatgcgtacatggccaaccgtttccagaccatgcacatcgacccttccaaggccgggcgtatgtgaatggcaagtaattacgcttcgcgggcagaaggtgcgtagagcctaagacagccctcgtgcgtgggtgataagcgggatacactttcaagcgttgaaggaatgattccctccgctgatgcgctgttttgtgacgcgcgtgatgacgatgggacaatcaaacgaaaggcaaggcacatggccgaagctacagcaaacattggtgtgatcggactggccgcgatgggctccaatctggcgcgtaatctggcgcaccatggcaatacggtggcgttgttcaaccgtcactactcgcgtaccgagaagctcatgaacgagcatggcgccgaaggcaactttgtgccggccgagacgctcgaggaattcgccgcgtccctgaagcgtccgcgtaccgccatcatcatggtcaaggccggtgctccgaccgacgcgaccatcgcgcagctagaagaggtgttcgaaccgggcgacatcatcgtcgacggtggcaactccttcttcaaggacaccatcaagcgtgagaaggaagtacgtgctaagggcttccacttcgtgggctgcggcgtgtccggcggcgaggagggcgcgctcaacggcccgtccctgatgcccggcggcaccgtggaatcctggaagaccctggggccgattctggaatccatcgccgccaaggtgaacggcgaaccgtgcgtgacccacatcggcaccgatggcgccggccactttgtcaagatggtgcacaacggcatcgagtatgcggatatgcaggtgattggtgaggcgtatgacattctgcgccgtggactcggcatggatgccgaggagatcggcgacgtgttcgaggagtggaacaagggcgatctcgactcctacctgatcgagatcaccgcccagatcctgcaccataaggatgccgagaccggcaagccgttcgtggacatggtcgtggatcatgccggcatgaagggtactggtacgtggaccgtgcagactggtctggaatttggttctcctgtggctgccatcggtgaagccgtgttcgctcgtgcactgtcttcgcacggtgagctgcgtgaagacgctcagaaggaaggtctggctggcccgaacaagaccatcgatctggccggagaagacgaggccgcgttcgtcgatgacgtgcgcaaggccctgttcgcttccaaggtcgtggcctatgctcagggcctgaacgagattcaggacggtgccaaggaatacggctgggatatcaacctgtccgaagtggcccgcatttggcgtggcggctgcattattcgcgcccagttcctgctcgaccgcatcaccgaggccttcaagggcgataacccgccggcttccctgctgttcgatccgtacttcgagaagatcatcggcgaatcgcaggacgcatggcgtcgcgtgatcgttcgcgcggtggaggccggcataccgaccccggtgttctccagctccctggcttactacgatggtctgcgctccaagcgtctgcccaccgctctgacccagtcccagcgtgacctcttcggtgcccacacctacggccgcgtcgacaagcccggcgtgttccacacgctgtgggctgaagaaggcaagcctgaaatcgaggcgtagcctcgtgatttcaggcttaggacagccctgtgggctgtccggccttcttcaggctcggcgatagccgagctgagaaaacagcaagcctgagatcgaggcgtagccatagacgaattaagccccctcatcagagggggcttaattcactcacaatgcggtgacggtttcttcggtggagaaccaggtgaactcgtccactccgttggcgtaggaggacgggtaatccgggttgttgggctgctcgaagacatgggccagcgattcggctttgccggcaccggcggcgaagaaccacgtatggcgtgaacgtgcgatgagcggcgcggtcaatgaaacacgcagcggcggcatcttgggggagtggttcacacccacggtgagcctatcggtaaccttgacctcatcatgaccagggaacagcgacgcatagtgaccgtccggtcccatgccgagaatcatcagatcgattaccggttccggaccaagctcacggatgagttcggccccataatcgcgggcggcggcgtccagcaatgcatcattcgcggcatcggcggcggcgcgaacggaatcgtcggcgctgtcggcatcggacataacatcggcgatctcgtcggcggaacgaacgtcggccgccatctcatggatatttgattccggcagcttgccgttggccacgagctggtcaagcagcaggcgacgggcctccaaagcattgcgatcggtgtcgtaagccggcacaaaacgttcgtcgctccaccagaaatgcacgcgcgaccaatcaatcgcatcagccagcggatcgctcagtaccaagcccaacggctgcgcggccgaaccgccagacagcgccacatccacgcgcgtgcggtgcgtgccatccggcagtcgctcggcgagcaaatcgagtagcgccaagacaaaacgttgcgcgccagcctgaatcatcagatctttattcggatacacaatgagttttcgagttgccatgtatggtccttatatggggtatgtgtcgtactttgcaatgtggattgtgttgtcagttgacaacgcataatacgggtggcatgccgggaatccagccatttgcagcaatgaaatgtgttgtcagttgacaacacaatgtacattgtgcgacatcgcatatgtcactttattactccgcggtcatgagcttcggcatcgcatgaggtaggaaacgatgagcaacggcgttggcatggctcgaccacaattgccgaactcatgccaacgccgctgtggcaacggttctaccgacttcagtgacgaatcagatcccagccttcgttgatgacctcggcgtagatctcatcgggatcgatgcggcgcagttcctcggtcagacagtcctcgatggtgcgcatcggcacggacacttcttgcggagtctggccgggcatcgagatcagcgcttggtcctcatacgggcgttccagcgagatcacaccgtcctcacgggtcaggtacacgccggtcacagcctcggcatcgggtacgaattcggtttcgactggcactccgagcttgaggtgcagccatgcgcacagcagttccagcggcaggaagtcggccttgccggtcaccttcacggcggtgatgggcaggtgcggtggctggtcgagcatcgaggcaagcatcgcgcgccagacggtcagtctggtccacgacaagtcgatgtcttccggcgtccaattgcggcgcagacgttcgatcgtggcctcagggttgttggaatgcaacgcatcggtgatgcggcttcgggccatcgcccccatcagatccttggctgggttcgacggcggcgtggtcggccaccacgccactacgggcgcgtccggcacgagcagcgggatgaccagcgtatccggatggttgatcaggccgccgcgcgggcgcaggatgatgatctctcccgcgccggcgtccgcgccgaaccgcacctgggcgttcaggttggagccgctcggggcgttcggcccatcggtcaggtcgacgtccggattgtcgcgatccgcgctcacctcggcggccgcttcggccgcgtccagctcgccatcggcggaccgggcgacgggatcggtgtccggcaccacggcgatcacgcggcacggatgctcgcggctggccgaattcgcgatctccagcgcatgctccagatcggcgtcctcggtggcgatcagcagcgtcagtacgcggccggtcgccgattcgccgcgctcctcatgcagttgttcgatcttgtgcgcgatttcgcgggtgcgggtattcggcatgtcgatgatcatggcatcctccaatggcgtccgtcgcgtgccagcatgtcgtcggcttgggttgggccccatgtgccggagcgataggcttgcggctggccgagcgtggaccagaatcgttcaatcgggtcgagaatctcccagctgaggttcacctcttcggtggtggggaacagcggcgggtcgccgagcagcacgtccagaatcagtcgttcgtaggcttccggcgagttctcggtgaaggagcgaccatagctgaagtccatgttcacgtctcggacctccatggtggagccgcccggcaccttggcgccgaaacgcatggtgacgccctcgtcgggctgaacgcgaatcacgatggcgttcttgccgagttcgcgcacggcggtctgttcgaacggcaggtgcggggcgcgtttgaacatcacggcgatctcggtgacacgcttacccagacgcttgccgcaacgcaggtagaacggcacgccggcccagcggcgggtgtcgatgtcaaggcggatggcggcgtacgtttcagtggtgctcttggggtcgatgcctttttcttccaagtagccgaccacttcgtgcgagccctgccagcccttggcgtactggccgcgcgcggtgttggcggcaagatccttgggtagacgcacggcggaaagcaccttggtcttctcggcggtcagatccttggcggtgaagctcaccggctcctccatggcggtcagggccatgagctgcagcaggtggttctggatcacgtcgcgcgccgcgccgatgccgtcataatatccggcgcgtcctccgatgccgatgtcctcggccatcgtgatctgcacatgatccacgtagttggcgttccagatcggctcgtacatggcgttggcgaagcgcagggccagcaggttctgcacggtctccttgccgaggtagtggtcgatgcggaacacggaactcgggtcgaacacctcggacaccacgctgtcgagttccttggcgctggccagatcatggccgaacggcttctcgatgatcacgcggcgccacgctccctcggacgagcgcgacaggccggaggcggccagctgcttggcaacctgcgggaaagcccgcggcggcaccgacatgtagaaggcatggttaccctgcgtgccacgatcgcggtcaagctcctgcacggtggcgctcagacgctcgaacgcctcctgatcgtcgaacgtaccctgaacgaagcggattccggcggccagattgcgccaagtcgactccttgaacggcgtacggcaatgcgcctggatagcggccttgacgaattcgatgaaccgttcctgtgtccagtctcggcgggcgaagccggtcagaccgaagctcggcggcagcaggccacggttcgccaggtcgtagacggccggcagcagtttcttctgcgccaagtcacccgtgacgccgaaaatgacaaggctgcacgggccggcgatgcggggcagtctgagatcgcgcgagtcgcgcagtggattgctccagttgggggattcactcatatggccaagggtagtcgttcatggccgtgcatggccagagggcgcgtgcgatgtgggcgtgatatgggccatacgcgcggacgggccgacggtcgtcgcggcaaatcgccgatttggtttgtcggatgagcgcgtgtatcctagtagagttgcccctctagctcaacggttagagcagcgtccttttaagtcgtgggttgtgggttcgaatcccacggggggcaccgaaaacccttggaaacactgagttccaagggttttgttttacccggcgatatggtttccagacgcaattagacacaatgaccgcactacctatgccctccgttgggctgtagccgtcaggcaaaaacctgtctaaccgctagtatcgaaacccttggcggattacataatcggagggatggttcgatggccacggcatggggcgacgagagcgttcgcaagtcgaacgtgcccgagtccatgtatctcatgggggcgtgcgtctgcgacctcgacgaggatttcacccgctcccggctcaataccgtcaaacccagagacgcaagcaagctccattggcgggacatgcagcccaagctgcgattcaaagccatcgacgccatctccggcctcgggctcactcacgtcatcgtcgcggcgattcccctaggcgattggaacactgccgaacgtgcgagaaggaagtgcctggaaaccctgctgccggtgctggaacgcgagtattcggttgatcgcctcgtgctggagcggcgcgacaaggcccaggacgccagggacatccgtttcatcgacgcgttgagaagccggcgcttcatcgactccatccgggtcgatctcgtggcaggtgccgccgacgccaggctgtggctgcccgaccagctgctcggctcctacggcgactggcgggccggcgagcaccaatatgatggattccttgcctccgtgcgcgccatcgttatcagcgccgggtgaacgtctttgaaaggcgttacactgtaaccaagccaaccccgctggggaaatggaagtgagagccggacgccccgagtatcttgggggccggctcttgcgttacttgccgccgttcgttgcctgtctcccgattcagcccacgggcgcggcgagcttgcggcgcatgtattcgctgcggctgatgtggtagcatctggccgtttcggtcagctcgtcgacttgggcacgcggatgctgacgctgatcatctcctcgtccggctggtcaagatgcagcccatagtggacgcgcccggtcaggccgtcgggctcggtctccgactcggccatcctctcgtcacgctccacctgctcctcggtcatgccgaacttcgccagcagttccctgtcgcgttcgacgccacgcggatctcgcggacctcaaggaggtcatacacctggtgctcgcggatacgtgcaccgcaagggaaatgctgcggcgtcggcatcgggctcatatgctgaccggcgacctggcgggcgttatggaatgccacatcggcaacgccggtgactggctcgcgatctggatgcgcgacgacggaattgccgtgttcatgcgcacgggcggccacgacgagctcttcggaagaagataaccaggccttctgagcggacatcagactcgaatgagttgatcaggccttcacacagccggaacgattcgatgacttcattccttgatcccgtcctcgccataccggtttggacaaatcgacattgcaagtcatgacgtccggaacgacatttctgccaccgaacaagggattctttcaacaatatgtttggattcgcacgtaattcatcaacgagatgaatgacgggttaacggacagcgccaaaaccatataagtgacaacggcgagttacagccggtggatttcgtcgtagcagacagttcacaattccttctgccggcaacactgctgacagaaggaattcaacgaagacagatgaaatgtctttcatcactgggaatacggttgaggtcatgtcttggagcagagaagaaggtgtccgatgagcatggacgaatgcggtgagacacccctgatgcgtcaacgggaataccggtattggttcctgtgcgacacctcgtcgcaaatcggcgtcgtggtcggcggcttcgcattcacacttctcggctacacggtcacccataattatgtgctgagcggcctggcaggcacgctcaattcgctggtgacggcattcatggtcatccccggcggcatcatctccgactatcacgaccgtaggcgcctgatcattctatccggggcattcgccgccgcgcttgacgccgcgctggcactgacgctgttggcgggacgcatgtcagctcccctgcttttcgtgttcgtgacggccaacggcgcgctgtcggggttgttctccaacacgaccaacgtcgcactcccgcaggtcgtggagaaaaaccagctggccgacgcgaccgcggcgaaccagtcgcgcgatgcggtattgcaactcgccgcttcaccgttggccggtctgctgtacggcgtgagcgccgcgcttcccctcgccgtggcctgcgcgtctcgcgccctgcaatccgtattcggcatggcattgcgctgcgacctgcgtccccaccctcggaaccatggagaggacggtgggccggccgtcctccgggacggtctcgagggggcgcgctggtacgcgcgcaacgggcgggcccgtctcatactgctgctgatcgtcgtccaggttatggtactaagcatgtgcgggacggtcgtggtcctgtaccagcagtcgctcggcacgacgtctctgatgctgggcgtgatacagacgttccagggagtcggcatgcttctaggcggcgtcatcggcatgaggctcgtccgcgagctcgccggacggacggtgttcgtattgacgtcgcttgcattcgtcaccagcttctcgctgatgtcgctcaccgcgtcaccatggatacttgcgctgctgggtttttgcgcctcggtgcccctcatcccgctcaattccatgattgagacctacctcatgctactgattccgatcagcctgcgagggcgtgtcggagcagtcaacgtgctgttcatgtccgtcgcgcagagcgtgtcctcagtcgctgccggtactctgctgcatattgtgggataccggggcgccctgctgctcccgctggcgataatgttcgtggtgagcatgatggcatgctcgacgcctgcgatcggtggcatgcccggactgtcgcgtatggacagcctcgagacgctgtcgtgatcccggcgcatcccgcgaatcgagaggagatgtggaatgccttcatccgagcatgccgacgggccggccgccgtggtggtcctcgacaacgacccattcgcggcccgcgcccttgcggccgtcctgtcccacgatccccgtcatttccgtgtgatgtggtggtgctcgtccgctcctgaggccatccagcgttgcctccatgcccgtgagcttccccaggtgctggtctgcgacatcgcactgtccgggatgacggggatggatgtctgcgccacgatccggaaggcggggtcccgcatcggggtcgtgttggtgacggcctacgaccctaaagaatacgtggcggacgccgtttccgtcggagcgcaggccgtgctgggcaaagacgaggccatgcacggtttgatggaggccgttcagaaggcggccgccggtaggggcgtgtgcggatgccccgacgtgtccgccgcggcgggtccaggacggaatgaaggcggtccgagggtcgttccgcgtctgtcggaaagagagagggccgtcatgaggttcttcgcaaagggcatgaaggcggacgacatcgcggaacgtctggacctgagccgcaacaccgtgatgacgtacagccaccgcgcgctgcgcaagctgcatgcggagaatcgggaggaggcgatggagaaatgcggccggtacgatctgttcaagtgaggcagacgactcgctccctccggtccgaacccacgtccgcagggagtcgcggagggacgatcgatcccgtgcgcgtcggcctgacggcgctgtacatggtgttgatgttcgtgaccgtatacgcggagacgtcgatagcgtgcgatgaccgtttcctggtctggcacgcggcgttcatcgcatacgagacgctggcactgtgcgccgccgcgctgtggccggattccggttcctggatggtggtcggcatttggacggtcagcacgctgacgagcatgcccacgacgttcccggtctccgcgcccttcgccgtggcggtcctcggcggatgcgggctcggacggggcctgctcgcggcgagcgtgtgcgtgctgtcccgcatgctcagcttcgcgctgcgcatcgaaccctggccgggtatgcccggagcggccgttctgtgtctcgtgttcttcttggcggcgttcctcggggcgctggccaacgcgcaatacatacggatgcgggaacgggaacgggaacggatgcgggaacgcgaccaggcggtcatcgacagactgcatgaccgcgtctgcaattcgctgtccttcctgattaacgccttggaagaccgggcggcgtccgggctgtcaggcggggacggattgcccgacgacgagatgcggcggattctgcaagaagcgctgcgtgactcgcgcgcggccatcacactggtcaggacccgggaggacgctccatcgggcagccccggacacagcgaatcgttcacctcacttgccgagacgcatgcgagacgactgcgcatggcaggaatcagaggggacgtcttcgtcgacccgtccgtcgacctgctactcgacgaggagacgatgcgagacgcggtctccttcctaacggagcttttcggcaacatcggcaaatacgccgacccggacgccggctatgtgatgagcgtgggcgtgcacgcggacggattgcatatcgatgaaagcaacctcgtacggactgcgggcccggacgatgacgggctgctttccaacggcgacgggctgcgccggtaccggaggatcatcgaggcccgcgggggacaactggcggcgggcgcggacgacggcatatggtccgtgcagagcctatggccgctacgacggtccacgtcatgaacgatacggtgccgggacccgcgacgacggacaagcgccgacgcacgaccggcggacggtgacgagaccggacgccccgagtatcttgggggccggctcttgcgttacttgccgccgttcgttgcctgtctcccgattcagcccacgggtgcggcgagcttgcggcgcatgtattcgctgcggctgatgtggtagcgcctggccgtttcggtcagctcgtcgagcgtggacttgggcacgcggatgctgacgctgatcatctcctcgtccgtctggtcaagatgcagcccatagtggacgcgcccggtcagcccgtcgggctcggtctccgactcggccatcttctcgtcacgctccacctgctcctcggtcatgccgaacttcgccagcagcgccttgtcgcgttcgttcaaatcgctcattgccgcctcctcaagtggtcgatttcgttcatgaacttcttggtcggcggccaatgggagccggcagaccaagctccaagggcatcgtcatgagagcggggcgcgtcggccgcgtcgcctgccgaccagtccggctcctaccatggtgttccatgtcatgcaccacgatccttgtcggcaaaaacgcaagctacgacggctccaccatcatcgcccgcgacgatgattccggttccggtcgttacgatcccaaacgattcatcgcagtcgcccccgccgatcagccgcgccactaccgcagcgtgctgagccatgtcgaaatcgacctgccggacgatccttgccggtacaccatcgcccccaacgttctgaacaatcgcggcattctggccgaagccggcgccaacgaacacaacgtggcgatgagcgcgaccgaaaccatcgccgtcaacgagcgcgtgctcggcgcggatccgatggtcgagctcaagccggcccacggcgagcccggcgacgtcgaccatcgcgacgaacggccgggcggcatcggcgaggaagacatcatcaccctcgtgctgccatacgtcgccaccgcgcgcgagggcgtcatccgcctgggcgaactgctcgaaacctacggcacgtacgagtcgaacggcgtgatcatctccgacgtggacgaaatctggtacgtcgagaccatcggcgggcatcattggatcgcccgccgggttcccgacgactgctacgccacgatccccaaccagctcggcatcgacgatttcgatctcgccgacgcgttcggcgaacggcgcgaatatctgtgcagcgccgatctgcgcgagttcatggccgcgcatcatctcgaccgcaccatggacgccgcgccgggccatttcaacccgcgcaaggcgttcggcacggcgacgccgaaggatcacatctacaacacgccccgcgcctggtacatgcagcgccacctcaaccccagcgaggattgggattcgccggccgcccgccacacgccggagtccgacgacattccctggtgccgcgtgccggaagccaagataagcctcgaagacgtcgatttcctgctgtcctcgcatttcgaaggcacgccatatgatccgtacggcacggcaggcacggcggaaagccgtcatcgttaccgtccgatcggcatcaaccgcaccgggcatatggtggcgattcaggtgcgcccgtatgcgccggccgtcaaccgcacggtgatgtgggtgtcgttcggttccggcccgttcaccgccgcggcgccgttctacgcgaacgtcaacgatacgcccgcctacctgcgcgacaccacgccggaagtctcgaccggcaacctgtactgggcgaaccgtctgatcgccgcgctcgccgacgcgcatttctacgaaaccagcaatgcgatcgaaggatttgcggaatcggcccgcgcgtacggccatcgtctggtggaacgtaccgatgccgaattgcgtgagatgaccgcgcaaacgagcgcgtctgaatcgcaagagagtgcaggagccgcggagattacggaaaacgccagtattgcaaccatcgccagactgcagcagtccaacgaggaaatggcggaatacttgcgcactcacgttacgaaactgctcaacgacgtgctctacacgtccagcaacctcatgcacaacagtttcgccatgtccgaccgctggaactgagcataaagccccgaaatccggcaaaacccgtcccaatgagccaggtttccgcgctcggggaggttccgcatgaacgtaggctgttggaagcgtcagtgctgcttccaacagcctcacgactgcatcctcacccccgtacgtcagttctgccatatataaggcagatagtgccattcagaccgtcgattgaccatcaaatcgtcggaaatcgcgatcagttgaacccgacgacgtgttccgccacgaaatatcccttgcgaatcacgaaacgaccgatcgacccgcgcaagttcagcgcgcgagacatggctttcttgcgcacatccttgtaaatagtgggggagtgcgccttgatgtcgtcccacatatcctttttcttctcataattttccggatcgcgagacaaaatcatgaacacacttgccacggaactttcaatcgccaggaagtggatcatataacggtacaggccgtccggcaccgtgtcgcgttccggggtggcacgcaccatgcactggttgacgaggcgtagctggtcgacgcggcggatcatcacatcggtctgcacgctttgcccgtcgcgcccgatgaaatagtggtagaacggcgtatccaaatacttcatggtcttcacccacgggaacggctggtacgcgtaaatgaagtccacgtagaacgtgtgctccggcagctgcatgccggactctcgcaccacggcggtgcggtacgtcagcgcgtgcatgagaatgtattcagccaagccgaaatgcccaagatcgttccaggtcaggcgcgcgccggccttcatggcatggcggaagttcaccacatgcttgttgcgtttgccaaccttgtcatacacataattggtgacgagcatgtcgatcggctcggtggaatcggcctcttcgcgcagcacggccatgacctgttcgagcgattcggggtccacccaatcatccgcgtccacaaccttcacatacatgccgttcgccgccgcgatgccggtgttgaccgcgccgccgtggcccttgttctcctggtggatggcgcgcacgatgcctggatagcgggcctcgaatttctgtgccatttccagcgtgccgtctttcgatccgtcgtcgacgaccagcacttcgatgtcgtcggtgttcgtcgccgaaagcagcgagcttacgcagcgatcgagataggattccatattgtatgcggggatcacaaaggtgagcgtctttgccgtgcgggccatgaaagtctttcgtcctcacatattcagtcgttgcgttcagtttcctgttcaaaccgtagcacttcgtctcccggcccggcggggcggtgtgcggtctgcgccgccgaacccgtgccccgagattccggatcctcgccggtaccctgaccgggatccgtccggacttcattcgaccggccctggtcggcgccgtcggaatcggccaggtgtttggcccggcgcctggcctccttgcgtgccttgtcaccttcgaagagcagttggggtttggagtcgagccggctcagcccatgccatgccagatccacgatatatgcggccaactgctccttgttcaccttcgggcggtccgcccagtattggccggtgaacacggtcatgcccaccagcatctgcgcatagtacggcacgcctttggtggagagtttctgccgtttgaacgtttcggaaaggatgtcttcgacgcgcacggcgatgtctcccagcagtgagctgaacgagccggacggttcggtgctgggcgagtcgcgcgccagtacctggaatccctcggcgtcctcttcgatataggtgagcagtgcgagtgcggtgcgttccacgatctggcgtgggtgcacggtcggatcatccaacgcgctggtgagcgtgccggtcaacgcgcgcatttcgcggtccaccaccacggcgtacaggccctccttgcctccgaaatgctcgtagacgatgggtttcgacacttttgcggtggcggcgatctcctccacgctcactgcttcaaaacccttcgacgcgaacagcgaacgaccgatttcgatgagctgctcgcgccgctgatacgacgtcattctggatgtattggccatgctgtccagtttttcacgccccgtggatagctccttgaccgtccgcctccacgtatcgtccgattctggtgaatcgggcatgtgtgtcatattgacaatgcttcattgcagctttaatatattcaataaataataaattttattaaaggggtgatgtggaccgtctaccagaatggttggccaaccttgcggaggaggatttggccttcatcaagaacttcgtgctatcgtcaggatctctgaagcaaatgtcccagctgtatcaagtctcctacccgaccatgaggatccggcttgacaggcttatcgaaaaaatacggttgaacgacaacgagacggaggatccattcatcctcttggtgaagagtctcgccattgacgatagatacgacgtcgacacggctcgaatactcatagacgagtacagaaagagaaaggatgaatcatgagctggacatggatcgcagtattgatcgtatcattgattaagatcctaggcgtaatcgccgtattcgttctggtcttcctcatcgcgaggagtctgattcgctacgcaaattccctaaagaaaggaagcggtccttcaaagcagacagcggaagacaaaagaatcactcttcatgatctataaaaacgtcaccagatgtatcgaagtcaagatcgcattatcgatgccttgcatggcagagcaccttatccccctggcgaatcggacattcgtggtgcgtccgcggggcggagccggtgtgtccgttgcgcttcttaggctggagccatggatacgaatgtgattattgcgattgtcgccgtcgccgtcatcgcggcaattctggtgatcggcggatggtggttcggcaagagccgcaaggctgccgtggccaagtccaccgaagccgcgaaagccaaggccgacgcccgtcttgctgcggaagcggagtcggccgcatctgattcttccacggtgaagccgtccgttgattccaatgttgatgcagctgaaaaagctccggctgaaagtcagcagaagtcctcagctcaagcttcctcttccgaaacggcggctcctgcaccagccaccgaagccaagcccgaaccggttcatgacacccccgaatccgccggcacacgcatgcagcgtcttaaggcgcggctgtcgaaatccggcaatccgttcggcaaggccctgttcaacattcttgcgaaggatcagctctccgaagccgattgggaagacgtcgaagacacccttctgctcgccgatgttggcgcggaagccagcgaacagctcgtcgaggaactacgcaacgacgcccgaatcgcaggccagtccgatccggccgaagtgcgcgcggcgctgaaagacaaactgctcaagctcgtcggtactgacatcgaccgccggctcaacgccgacaaggacggcgcgaacaagccgagcgttgtcatcatggtcggtgtgaacggcaccggcaaaaccaccaccgcgggcaagctttcccgcctgcttgtttccgaaggcaagcaggtcatgatgggcgcggccgacaccttccgcgctgccgccgccgaccagctcgaaacctggggcgcacgcgtcaacgtgcccgtcgtccgctccgacaaggacggtgccgacccggcatccgtcgccttcgaggcatccgccaaggccaaggaagcgaacgcggacgtgctcatcatcgacaccgccggccgactgcagaacaagtcgaacctgatggacgagctcggcaagatccgccgcgtcaccgaaaagaacctgccggtggacgaggtgctgctcgtgctcgacgccaccaccggccaaaacggcatggcccaggccaaggtgttcgccgaagccatcggcattaccggtgtggtgctctccaagcttgacggttccgccaagggcggcatcgtgatcagcgtgcagaaggagctcggcgtgccggtcaagctcgtcggtcttggcgaaggtccggacgatttggcaccgttcgatcccgaaggtttcgtggacggcattctcgcgtaagccaacgtccacgttgtgagagcgcaaaacgcacgacttacctataaaccaagccccgaatcatgctcgaaacatggtcggggcttcgtcatatccgttggaatcgcgccaaaatttcctcgagcggtcgcacgtacgcttccagccacgcttaacaatcgcgtaacttggcgtaacgaaaccaaaacgagaccggttttaactgacaaactgttagcccccataaggggacggtattgtagagacaaataagacgccggccgcacaaagcccccggtgccatgaacgaaagagagggaggtagacatgggagcgattgattccggtaacaccgcatggattctgacatccgcgtccttggttttcctcatgacgcctggtgtggcgttcttctacggtggtatggttcgcgccaaggccgtactgaacatgctgatgcttgaggcggccgcgctgtcggtcactatgattatctggactttgtggggttggtccatcgcatacgccggttccgacatcggaggcatcttcggcgacccggccagcggcttcctgctgaaggactccatggtcgcgcaggacggcgtgttcaccgccaccggtctgaacggcaacaactacccggtttctgtggacgtcgccttccaggtcgccttcgcgatgattaccgtaggcctgatctgtggcgccatcgccgagcgtgtgaagtacagcacctggatgatcttcgtggcgctgtgggttaccttcgactacgctcctatggcccacatggtctggaacggtggtctgctgtctgctgacggcgccatctccaaggccatcggcgcggccgcccacgatttcgcaggtggtaccgtggtgcacatcaacgccgcagtcgccgccctgattatcgtgctcatcatcggcaagcgtaagggcttcggcactcagccgttccgcccgcacaacgtgccgttcgtgatgctcggcgccttcctgctgtggttcggctggttcggcttcaacgctggttccgccttcgccgccaacggtaccgctggttatgcttgggtttccacttccgccgctaccgccgccgcaatgctttcgtggggcttcaccgagaagattcgctccggccactacaccgcaatgggtgccgcttcgggtatggtcgccggcctggtcgccatcaccccggccgccgatgtggtttccccgctgtgggccatcgtgatgggtgccatcgcgggtgttctgacctgcctggcttgcggtctcaagttcaagttcggttacgatgactccctcgacgtcgtcggcgtacatggcgtgggtggtttcaccggcaccattctcgttggcttcttcggcgaaggcgccggtctgctggctggtggcgactggcgtcagctcgttgtccagctggtcatcgctctcgtcgccatcctctactccgcggtgatcaccgcgatcatcgccttcgctctggagaagaccattggttggcgcgtcaccgaggcccaggaagtcggcggcatcgaccttgccgaccagggcgaacgtgcttacgattttgctggtactgccagctccgtcctcaaggaggtgaagtgaaatgaagctgatcaccgctatcattcagcctcataagctcgacgatgtcaaggaggccctcgcggccgccggcgtgcacggtctgaccgtgtccgaggccaacggctacggccgccagcgcggccacaccgaggtctaccgtggcgctgagtacaccgtggacctgattccgaagattcgcgttgaagtgctgtccgatgacgcggatgccgagacgctggtcggtgtgatcatcaagtccgccggcaccggcaccatcggtgacggcaaggtgtgggtcgctccgctggactccgtggcccgcgtgcgtaccggtgagaccggttccgccgcgatctgataacacagacgtccatgcctagaaggggatggactgcataggaaaggtccccgctcgccgcgaattgacgccgtgcggggacctttttggcaatgaaagatgaagcaatgacttcagcagtcgatggcttgaaacaacgattcatggatatgagccagccggatgacgacggcgtctaccggaatggtgcgaccaagcgcaaagctcgcacggaactggccatgcaatgcctcacggagctgtggaatgcggcctgcaaggatgtctctttccctgtgcccgactccggcatcggcttcgccgcggtaggctcgctggcacgtggccaactgggccccagctccgacctcgacctggtcatcatctacgagcctcgcacgttgaacgaccagcagctcaacgagttggccaacaaactctggtacccgctatgggacagcggtctggacctcgaccactccatccgcacgcgcgcccaatgcgaggaagtcaccgaccatgaccttcccgccgccatgggctggctggacgtgaagcccatcgccggcgacaccgctctgatcaccaccaccgccacatccatcctcgaacgctggcgcaaggccgcccgcaagcgcctgcccgaactgctcgactccgccaaagcccgactcgacgaattcggccggctccaatacgtcaatcagcccgacatcaaggaggcccgtgggggtttgcgcgatgcggtgctcgtctccgcgctcgccgcctcatggctggccgaccgcccgcacggcatctacgacgaagccgtggaacgtctgctcgacgtacgcgactgcatccatctggtggccggcaaggacaccaacctgatgctgacgccctatcaggccaaagtagctgtcatgcttggcctcgccgatccgacttggcccgaaaacgagcgtgccgcctactcgatcgacgatttgcagacactgcttgcccgtatcggccggcgcatctccttctcgcttgattccaccgcatcccgcgccgaacattcgctgacccacgaaaagccgcgattcgcgttcttccagatgttctctcagcgttctggcggcaagcgcgaagccccgcaattcgacgtggtggctcccggcgtggccaagcacgaaggcgaattggtgttggcgcccggtgccgagcctgccaaggatgccaagctggcatcgcgtatggccgtggcggccggcgaattcggtttgcccatcaacccgtctaccttggttaatctgaagcgttgcccgattcacgacaaccagtgggatgacgaatcgcgcgagctgtttattcgtctgcttgcatgcgggccgaatcttatggaagtgtgggagagcatcgacttcgtggacattccgggtcgatggatgccggaatggctcggcgtccgcaaccgtccgtccgcctcggccgcccaccgatacaccatcgatcggcatatggtggaggtcacgtcgcgtctggggcgcgagacaccgtccggtggacggtacgatgacgatcatttcaaggcgttgctgttggccggtattacccatgacatcggcaagcgcgcgttcgtggccgatcacgccgccgagggtgcccgccatgtgccggtgattctcaagcgtatgggctacgcgccggacatcgtcgactgggccaccgtgctggtgcgtgagcatttgacgctatccgaatttgccacgggtaaggacccttatgatccggccgtggcggaggagttggccgaccgtttgcaccacgacaagatgctgttggatatgctgttcgacctgacccgggccgacggctcctcgctcggtgccaccgccggtgagaccatcaccaagcaatacggctggtccaagtggcgcgaacaaatcgtgcgcggcatgtattccgccgcccgcgccgcgatgtaaacggaatcgcccagcgctttgcgcggccgatacctacttcatccatgcgtccgaacgcatgcgcagcccgttggacaggccgcgcccgcccatgagcaccacgttgaacgcggcccagagtacggcggtacgcatcaggtcgctcgtcagcgccggcgtcaccatattggccagtatgagtatgagcgtcacatacaccacggcggtcagcgtgcatgtgacggccagatagcggtagtcgcgcgcgccgataagaatgccgtcgattgccatcatccagccttgcagcgggaagaagatgcccatcgtcaccatgccgatggcaatcagcgtctgaatatgtggcgtaggggagaagaagtgcccggcgaacaggccgactaccgcaaaagccgtgccgattaccgcgccggtgaccagtcccgcacgcccggtcgcccgcgtcagccgccgcgcctgctgcacgctgccagcgcccagcgttgtggccaccagcgtctggccggcgatgcccacggaatccagcatgttcatcgcaaaattccaagaggagttcacagcctgaaacccggccaacacggcagtacccatgcgcgcggcacaggcgaccgtagtcaccatggccgcacgaatcgccaatgtgcgaatgaacaatggcagtccgtcgcccccggctgccgcaataccggccaaacgaggccgcagactcgcaccatccgcccgggaccacagaatggcggggattaccaggaacagccccatgaaccactgagccaccagcgtcgccactccggagccggcaatgccccaattcagcacaataacgaacaacacatcaagcaccgtgttcaccaccgcgccgcccaccgcagcgatcagcgtgatacgaaccttctgcaaacctcggaaaatgccgttcgccgcatataccatcagcatgcctggcgcgcccagcacgattgcgcgcgtataggtcacggcttgttccaatacttcgccctgaccgcccagtgcccggcataatggctcggcagccgcgaacaatcccaatcccagcacggtgccgatactcaaggccagccacaggccgtcaatgcctgcctgcagtccctcgcgacgacgaccagctcccagcaggtgcgccacctgcgcagtggtcgagtaggccaggaatatgcatagtccgactgccgtgaggatgatggtggagccgattgacaggccggccaacgccgcatccccgatatggccgacgatggctgtgtcgataaggacgaaggtcggttcggcgatgagctggccgaaggtcggcagggccagcgccacgatccggcggttggtggagcgggcgtcggtcgggccgttgctggtgtttgtgtttgcgccggcatgcggggttccgaagccatcgcggcgtgtggtatcgccggaactggtggctttggcgtcggaagagtctatatgcacgctcacacgcatatcacgcctgactacattgcgcaagcacctgttgtggacgcggaatgttatccccagactatccactaagttatccccagtatgtggataacttagtggattatccccagaattatccccaaaatgtggataacttatttttctatccacattttgctttctgcgtgtcgcggcgctgactcataggtgaatgagaaatgaaccgatgcgggcagccgtttcgtttccacgcgatatcgttcacccgccacgccacatcctatacttgaaagctatggcagaaggaagtgaacactcgtatcagaatgggttcggcggtggcttggatcgtggcgatcgtggcgaccgcgcgggccggggcggcgcacagacgtcggcggcggccggcgacccgattttcgaccgtgtgcccccgcatgatgacgacgcggaaatggccgtgctcggcggcatgctgatgagtaaggatgccatcggcgaggtctcgcagaccattgacgtcaccgatttctaccagcccaagcatcagacgatctataacgcgatcatcgatctgttttccgccagtcagccggtggacgtggtgctcgtggccaaccagctgttggcggatggcaacctcgacaaggtcggcggcgcggactatctgcacagcctcgtcgcatccgtaccgaccgccgccaatgccatgtactacgcggaaatcgtccatcagcgggccattttgcgcaatgtgatcgccgccggcaccaaaatcgcccagctcggttattccgccgaggggtcgcaggccgaggacgtggttaacctcgcccagtccgagatctacgagatgtcgatgggcaaggtgcgtcaggactatgccgccatcggcccggtggtccacgacgcgctcgaccagctggacaaactgcagcagggtctcgtcaacaagggcgtgccgaccggattccgcgacatcgacgacgtgacccagggcctgcagcccggacagatggtcgtcgtcgcaggacgtccggccatgggtaagtccacactcggcatcgacttcgcccgagccgccgcgttgcaccacaacatgacttccgtggtcttcagcttggagatgagcaaggtggaactcgcccagcgcatcatttccgccgaaaccaatattccgatggccgccctgcgccgcgccgacgacatcacccccgaacgctggaacaccctgaaccagttctggaccaagatgcagaacgcgccgctgttcattgacgacagcccgaacatgagcctcatggagatccgcgcgaaatgccgtcgcctgaagcagaccaacgatctgaagctcgtggtcatcgactacctgcagctcatgacctcgggcaaggccgtggaatcccgccagcaagaggtatccgaattctcccgtgccctgaagctcttggccaaggaactcgaagtgccggttgtggccttgtcccagctgaaccgtggcccggaaatgcgtaacgacaagaagccgcagctctccgatttgcgtgaatccggctcaatcgaacaggacgccgacgtggtgttcctggtccaccgccctgacttctacgacaaggaagaccgccccggcgaggccgatatcatcatggccaagcaccgtaacggcccgaccgaaaccttccacctcgccttcctcggtgccacgtccaaattcaaggacatgccgcaggactacaacagcaatcaggggtgtgatgatggcaagcaacgtttcacgcgatgtttcgcaagaccaatcgtccgtggcacaggcccgcaaaccgtggtatgcgttcgccaccgtggccgcaggccgcttcgtgcggtttgcatcccgcgtcaccaaacatggcggttcggctttgcccggcaaagtcgtagaaaagattgaccctggcttcctgacccgtacgctcgggcagttgccgcttggcgtggtattggtgtccggcacgaacggcaagaccaccaccacccgcatggtcgcctcgatgctctccgatctgggattgaaggtgttcaccaatccgaccggctcgaacttcgtgcgcggcgtggtttccgcactgcttaccgaggtcacgctcggcggcaaattggacgcggacatcgccgtacttgagctcgatgaggcgtacgccgtccacttcgtcaagcaggtcaagccccgttatgcgttgctgctgaacgtgatgcgcgatcagcttgaccgattcggtgaaatcgacaccacggccaaactgctcagccatgtggctgcggcgactaccggcactgtggtactgaaccgcgaggacccgcgtatcgccgcgctcgccgcgaaggccccggctggcaccacagtgcgatacttcggcctcgccgacgatttgcgccactatttcccgtccgatgacgacatggccacgaccgtgtcggtggaaggtgtggccgggccgctcccttcagtcagtactcccctcagtccgcttcgcggacagctcccctcggagagggaagctgccgcaggcatggcagaactccccgctgacgtgacacttaccgccgtgggcgaccacaaggccaccttccagatggacggccaggactacgccaccgacgtcaaacttgaaggcgtctacaacttgtacaacgcggccgccgcgctcgccgtggtacgtgcggtgatgcaagacaatgccgccgcatccaaggccaccgccgcagccaacgcctgcgccgtgtccgccgacgagctcatcgccgccgtttcccgcgtcacgccggctttcggccgtggcgaggtcatcgacatcaacggttccccggtcgaactgctgctggtcaagaacccgatgggcttccgcctctcgctcgccagcttcgacccggccaacgcggacaccatgatcgccatcaacgacgaatatgccgacggccgcgacatgagctggctatgggacgtggacttcacctctttgcgcgcgtccggtgtcgccatggtctccggcgtgcgcgcctgggacatggcactgcgcttggggtatgaccaagtgccagtcgccgatacgaacaccgacctcgaacaggccgtcaccgcattcgtcaacgccaatcccggcacacgcaagcacatctactgcacctacaccgccatgctcaaaacccgcgccgtactgggccgcatcaccgaagtacgggacgctggcgtgggcaagtaaccaccctctagcgcccgcgcgccacctctcgcctgcgggaggacatggtgaggaataagacttccccttagcgggaagacatcgacaaggagaacgcgacatggccagaacaattgatgtagtgtccctgtatcccaaagacatgaacatctacggcgattccggcaacgtgctgactatccgccgccgtctggaactgtacggttacgaaccggtcgttcaccagtacaatcaaggcgacgactggcccgaccaggtggaccttattctgggaggcggcggccaagacaccggccagaagaaaatcatcgacgacttctaccatcgcgccgacctgctgcgttcgcttgccgcagacggtacgccgatgctgatgatctgcggcctgtaccagctgttcggcgagtatttcgagaccgtggacggcacccgtctggatggcatcggcgttatcggtgcttataccgtgggccagaacgtgcgtatgatcggcaatcttgttgagcattccgaccagttcggcgatgtgattggctacgagaaccactccggccagaccttcctgcgcgaaggcgttcagccactcggcaccgtcgatcaggacagccgaggcaacaatggcgaagatcataccgagggcgcgcgcgtgcacaacgtgatcggcacctacatgcacggctcgttgctgcctaaaaaccccgccatcagcgatttccttatcgaaaccgccgtgactcgtcgttacggtacgttcgatacgtccgatcaggcccccgaacaagccaaggagctcgcccggctcgatcaagtagccaccaacgcgcgcaaggctgccgccgaacgtcctcggtgaattctcggtgagtcctcggtaagtaccaatcagcgaaaaatcagtcgaaatcagtctgagggtctagtacattgccctgttgtttgcgctaggcttggtggtacgagacatggcaccaggccatgtcggacctcgaaggaggggtatcatggctgattttaatcttttgggtgatggcctgcgcaaggtcctgctggcgggcatcggagcccttgccaccggatatgagaagagcagcgagctcgtcgacgaactcgtcaagaagggtgagattacggtcgagcagggcaaggcgctgaacaccgagctcaagcgcaaggtgagcgagacggtggatgacgccaagaaggccgccgccgaagccggcgacaaagctgctgccgcagccgacaccagtgccgccgacaagcccgctgacgagggcaaggccgagtgaccaagcccacacgcactacgccggaatcagagtcgaccccgctttccagcagggtcgaccctattctgacgcctgcgaaagccgaacgtgaggcggcggcgaaccggtccgtcgacacgtcggacacgctcaagcagaccgttaccaaggcgactccgagcgtatccgacgaaacgctggcactgttcggacgcaggaacgatttcgccacgcgctaccatctgacgcaccgtggcaagatcaaacgactggggcagatcaccagaatcgtcaagcaattcgacgtgctgcacggcctgactccggtcaagatgcgcctcatgttcgaggcgctcggtcccacgttcgtcaaagtgggccagattctgtcgatgcgctccgagattctgccgcaaagcttctgcgacgaactcgccaaactgcgcgccgacgccgacccaatgccgtattccacggtgttggatgtgcttgccgccgaatacgggcgtcccgccgacgaggtgttcgcgcatatcgaccccaagccgttgggctctgcttcactggcgcaagtgcatcgcgccacgctgaaaaccggcgaagatgtggccattaaagtgcagcgcccgggtgtacgcgaaatcatggcccaggacgtctccatcatgcgctccatagccaaggccgccactaaggtgattcgcacctcacagatcgtggacctgaagggcgtggtcgaggagctgtgggacaccttcgaatcggagactgactttctgatcgaggcccgcaatctcgccgaattcaagcgtttcgccgcccgattcaaatacatggactgcccgacggtgtacgccgaactgtgcaccgagcatgtggtggtcatggagtacatcgacggcatctccgtctcccacccaggccagctcatcgacgccggttatgacttgaaggagatcggcaccaagctcgtcgacaattacgccacacagattctcgacgacggcttcttccacgccgacccacatcccggcaatatcctcatccggggcggccagatcgtacttatcgacctcggtatgaccggtcggctcgaccagcgcacccgtgcagtcctcaaagaaatgattttcgccgtcgccaaacaggattcgcccgctctggccgaggggctgctgcgatttgccggcaccgaggccgatccggaggactatcccgcgctattggccgatctggacgtgatcgtcaaggaattcggcaccgtggatctggccgaactggacattgccgctttcctgaccgcactgacgcagatggccggccgccacaacatcgaggtgcccagtacggtgaccaccgtcggccgcgcgttggttacgctcgaaggcttactggacgagttcattcctgatgtgaatatgatcgaaatcatttccgaccatatcgccacgtcgaaatcgctgaagaacgccaccaaagacgagatcaagtcgctgggcgttgaggggcatcaggctttgcatgccacgctcggcaccatgaccgaactcaagaccgtggcccgtatgctgacccgtggtcagttgcgcgtcaacatggaactggtcggctccgaagagccgttccagctgctttcggatatggcgaaccgcctgaccatggcgttgatcgtggtgggactgttcatcggctcgtcgattgtctactacgccggcatgaagccgattatcttcggcattccggtcatcggcttcatgggctacgtcgtggccttcgccctcggcgtatggatcgtcatcgacatctacttaaagggccgcaagaccaggaagcgatgaggcgccggcgcaacgccttcccgtatgggtatgatggaatgtcgattcaccggggagaacagcaatgacggcatacatggagcataaggacctgacgaacgaggtcatcgagcgcgggcgcacgaatgagatcgccgatggcgtgcatcgggtgctcgaccgtatcgccgaggctgaggccgtcgccggtcgcaggagcgggtcggtgcggctgctggccgccaccaagacccgtgacgtgggtgagatcctggccgcgatcgacgccggtgtgcgctgcatcggcgagaaccgtccccaggaggtcaccgtcaaggccccgggcctggcgaagcgcctggccgaacgagggtatgcgctgggcgtggtccgcgacgccgcttcgggcgatgatgccttggccggggccggacggcatgtcccgttccatctcatcggccagttgcaagccaataaaatcggcaaggtgttgccggcggtggacaccatcgaatccgtggattccatcgaactggcggagaagatcgcccgccgcgccaccatgcgcggcatcacggtcggcgtgttgctggaggtgaacgaatccggcgaggaatcgaagtccggctgcgcacccagccacgccatcgacttggctcagcgcatcggtgcgatgggcggactgcgcttgcagggtctgatgactattggtgcccatgtggatgatgagcgcacgattcgtgcgggcttcgcgcatctgcgccgcactcgtgaccagattcttgcctccggtgccgaaggcacggccgactgcaccgaactgtcaatgggcatgacccatgacatggcctacgccatcgaagaaggctccaccatcgtgcgcgtcggcaccgccatcttcggcgagcgcgctttcatctgattggagctatacggaaaaacgccgcttgatcaatagccaagcggcgtcttttcgtaaggattttcggcgtatcaatcacgcatagatattgcgcggacgcatgtcttcgggcaggccgtcgagcagaatcgccacagaaccttcctcgaacacggagcgaatacccgcggccagcagcggtgcgcaagacagcacggtcatattcggcaggcgcttctcttcaggaatcggcacggtgtccataaacacgatttcatgcgcgccgcagttggccagtcgctccacggccgggccggaaagcaagccatgagtggcgaccaaggtcaccgacttggcgccggattcgttcagtgtgcgcacggcttcgcagatagtaccggcggtatcgaccatgtcgtcgatgaccacgcagttgcggccgtcgacatcgccgataatgccatgtgcctcggcatggttcgggcgggtgatatcacgctgtttgtggatgaacgccagcggcagattgcctagcttggcggcccactgttcggacaccttgatacggccggcatccggggacacgatggtggtgttgcccagatcaagggtggaacgcacgtaatcgagcagcaccggcatggcggttagatgatcgaccggaccatcgaagaaaccctgctcctgagcggcgtgcagatcgaccgtcataatgcggtcggcaccggcggcgtggaacagatcgaaaatcagacgggcggtgatgggctcacgaccgcggtgcttcttatcctggcgcgagtagccgaggaagggcgccaccacggtaatcgacttggcggaggcgcgcttcaaagcgtcgatcatgatgagctgttccatgatccacttgttgatatcgcccgaatgacactgcagcacgaacacgtccgcaccacgcaccggttcggtgaaacgcacgtacatctcgccattggcaaagtcataggacgtggtttcgaggatttcggttcccaagcattcggccaccttctcagctagctcggggtaggcgcggcccgtgaccaatacgagtcgtttatccggagtgccttcaagaatcgccgacatgctttcgcatccttttgtgttgcagtgtttttagccttaaccagtgtactagcaccccaccgcagcgcgtgccgtgaagtggggctgtgttgtaagagtgctgcaatcgttgatgaacatgcggcactgtcccgccctgaccataagatgggtaagttgctcacagggtgaagtgcatctgcatcgccctatgattaacacgcatacacactcctgccacggaacgtccgtggccgaatagtccgaaggaggtgggtgatgtctgcgcacaagtacgaactgatgttcatcgccgatcctgagctggatgagcgcggtctgaagaagctgaccgagcagtatctggaactcgtcaccaaggaaggcggctctttcgatgagcccgattactggggccgtcgcaagctcgcctatgagattgccggtaagaccgaaggcaactacgtcgtggtgaagtacaccgccgagcccgctaccagcgatgagctcgaccgtgttctgaacctcaacgaatccgtgatccgtacgaagatccttcgtaagggctgaatcaagcgtttagtcagctgaacagctggtattcaaggtaagtaagaaggaccgttatggcaggcgaaaccgtcatcaccatcgtgggcaacctcactgctgaccccgagctgcgcactatcggcagcggcgcgaccgtggcgagcttcacgattgcttctaccccgcgaacctggaatcgtcagaccaaccagttcgaggatggtcaggcgctgttcatgaggtgcgccgcttggcgtgatctggccgaccactgcgtccagtccctgaagaagggcatgcgcgtgattgccaccggtcgcctccagcagcgttcctatcaggcacaggatggttcccagcgaaccgtcgtggagatgcagctcgatgaaatcgggccctccctgcgttacgccaccgcacaggtgacccgccagtcgtccggtcagggcggcttccagggtcgttccggtggtctccagggtggtcagcagcccaatcagggctatggcaaccagggtggccaaggtggttatgccggtggccagggcggttacaacggtggctatcagggtggtggcgctggatactcccagcagcctgccgctcccgccaacccgtccgctcctgcggccgacccgtggagcaatgccggtgcatctgatgccggtagcttctccacgttcggcgcttcctccgatttcggcggcggcgacgattccgacccggagttctgatcagtacttacctccccgctgccagcagcaatcaatatcaagatttataaggagaacatcatgtcacgtaagaggccgcaaccgccggtcaagccgttcaagaagaagccgaacccgctgaaggccgccaaggtcaccgagatcgattacaaggacgtcgcgctgctgcgcaagttcatttccgatcgcggcaagattcgttcccgtcgtatcaccggcgtgaccgtgcaggaacagcgcgagctctccaaggcgatcaagaacgcccgcgagatggccctgctgccgtacgccacctcgggtcgctgagttagggaggctttgaacaatggctgaaaccaaggttattctcaccaagaccgtgtccaacctgggccactccggtgacgttgtcgacgtgaaggccggctacgcccgcaactacctgttcccgcagggcctcgctttcgcgtggaccaagggtgctgaggctcagatcaccgctatgaagcgcgctcgtctggccaaggccgtcgctacccgcgaggacgccgtcgccgctaaggccgccatcgagggcaccaccgtcgagatcgccgccaaggtgtccgagtccggcaagctgttcggtggtatctccaacgaggccatcgccatcgctctgtccgacaaggccgcggtgaacccgaaggccatcgaggtcgagaccatcaagaccaccggcgatttccccgccaaggtggccctccacccggagatcaccgcttccttcttcgtgaaggtcgtggccgagtgagtcattccggcctagtgctggaatcacacagaccaagagtctgagcttaagcatcatcccccgtgcggttcgcgccgcatgggggatttttgtattggtgtttaaaaacgctggaaataggcgcgacacgccgagagttgcatccgcttcaaatctgagtatatttaacacctgttgcaaggaacacttcaacatctaaccaagcccctgtagctcagttggttagagcagctgactcttaatcagcgtgtccagggttcgaatccctgcgggggcacagttcggaaggctccggtcgattatcggccggggtctttttgttttccggcttaattctgctgatgaaatcctcatcctggcgatagtaggtatcgtcggtcagatcgctaatggttacgccgagttctttagcggcgagatacatcttcttcggtcgaatttctgatcccccgttgggccgttggcggcaccgggatctcggctgctggagggtggggccggccgccatgatgccgcgcgtcgactgccccatgtgcggcgtggtcgtcgcatcggcgccgggggcggagcccggcggccggttcacccgggctgttcgaacgcggggctcgaggcgttcaacaacgggatcaaggtcgccatccgcatggcctacggcttccaccacgtcaccaacctcatcggcctggtcatgctcagatgcggcggactcgacatccgactgccacaacccgcaatctaacccacgaaaacagcataagccttactttttctggggatgtgcattggtcaaattacgtcttctttcgtgatatgtcgagctttgttgattgttgcgcagagcgccgtaatcgcaaaaacgaggcaggttccgatttcgatgacaaccgtccagcctttggcgtcgctgttggcaaagccgttggcggctatggagccgaggatgattgccgctacgattgcggtgacgcccgagcctcgcagcagtccaatcagcccgctgatgacgcttacgctggcggatagtatggcaacgccgagagcttcgaccatcatgcttgccaatgcggggagacgggaaccgtctccggtcaatagtgcgtagggaatcaggggcgccgacatgcctgcccatgtggcgaggaacgtgccggaccagatcatcgcgtttttcaccaagaacaatggggctctgccacagggccatgcataggtgattacgcggcccgtgccggagtaggccggaatgatgatacgggcgtagtgggcggttgaggcgatggagcagccggcggtggcgaccgcgcaggtcacggccaccgttaagtcggaaaccaggaaaccgagatgatcgactcgggcgatacccacgatcctgaagaacagcagcgacagcgagctgccgataagagtggcggccagtagaaacaggtagaacctatacgaggtgtattgtcgttcgatgcggtagacatccagcatgggacatgctccttggttgtttgtgttagtcctgagtgtggcggaaatagtaggattccagatcgctgatgtcgctcatggcatgttgcgctttgacggaaccgtgattgatgacgatgacctggtctccgatggtttcgagttgggcgagcatgtgcgcactgatgatggccgtgactcctcgtttgttctcttcccggatgatgcggcaaaacagcttcatacccgtggggtctaacccgttcatcggctcatccaggagcaggagcgtgggatgatgcgccagggccgttgccagtgcaaggcgcatgcggttgcccatggacaaggtatcggccggtaaatcccccatggaggccaagccgacccgttccattgtttcgtcgggggaccagtcgcatcgcatgaacgctagatgcttgtggaggatggcccgtacgctcatgcctcgctcgaagacgggaatgccgatcagcatgccgacctgtctcaatagcatgtcgcggttctcggggttcatgatacggccgcggatattagtttcaccttggtcgggggcgatcaggccacccaaggttttgagcagcgtggtcttaccggccccgttcgggccgatcagggcgatggtttctccgggatacgcgctgaatgatatgtcgttcaggaccggtttcccgccgatagttttcgacaccctgttgcagtagagagttgccgacagtgatttcatttcatctccttttggataatcccgcaaggcaaccggccacgccggtaagacaccatgcgaagactacgaataaatcaatcgaatggcttatgttgctaccggggaatgcggcatcggtgagcattcggtgcatcggtacgaagggcatccaatcatgaatggtaagaactattgatggtaatttgtcggacgggtatagaatcggtgcgaacagcattgttgctagcatgattagctgaccgacaaccgttactccaccgcaaggtagccctatagccaacatgtaccccaatgacaggttccccaatgcacagagaagtaacatcatgactaaatatgaggtcgccatctgtatgagtccaaatttcattgttgaggcaacgaatccggcaacgacacccggaatggacaccgcaatccagataatgaagtcagctatcaggagacaaatcctcggtaccggcaaattacgctgatattcaagtaatccttcggaaatggattccgataatagctgcggagcaatagtgcaccccaccgccaccagaccaagctgccatacacctgcagagagttgctcagcctgactggtggtgagacttcccatcatcagagtaagaccgtatacgattgctagcgcaaatactgtctgtaccatggtgaaagcgataaatagatatctatgccgtacaaagctccattttaatagagatgtgagcattcgcgcaccgcatataagccgcgatttattcagtccactctcacttatcatcggacgtcgattatcctttcatatgcttcgcgcaacgtgccgtgttgcaccgagaacgacagttctggctcatcgcccatcagcatgttcagccggctcagtagcattttggcttgttccgacgagcagacatagcgtagccgaccgtcctcagccagtaccggagttgcagctaattccgtcaaaaccaaagagggatccgcagtgttgacttcgatccgtataagttcgtcaatagaagtgagttggcgtggtgacgcattacatacgaggcgaccgcagtcgaagatcaacaaattgtcggccaccgaacctatctcatctagattgtgagtcactacaagtattgttttgccttggtcggcttcctgccggagtattttccatactctgcttcgacgaatcggatccacatcgttggtcggttcgtccagcagtattacggaagcctcctgaacgagagccatccccaaagagactaggcgtctgcagccaccagatagattctctcctgcgacatgcgaatattgctcaatgtccagacgacccaagaagtcattcgttaggcgaaccgcacgacgacgagatatgccacgcatgccggctgcgcagcataaagcctcgacaggagtgaccccgcgcaaagggacatgtggctgcggcatatacgcgcatagacgtctcagctcggctgcatgggatatttctcttccggaaaaaagtatggttccagaagtcggtttcactgatccgcaaagcgacccgagtaacgtggtcttacctgcaccattatgtccgagaactcctgtaagtgtccctttgggcaatgaaaaactgacatcccgcagcgcccatacgtcggaagagaatctcccgaaccgcttatttaaatctcgcacggataaactacagtattgctccatttccaccttcctatcgtttacacttcaagtaagccaatagtcaaagcaatgggcctttgctctgctccccggactgttgttcccgtccatttgagcgggtattcgttaggttacggagagtctcgccatgagccaaggtctcatcctcgaaaatgaggattatccgctgctgacaggccgtcgatgtaccttgcaggccttggcagatgatgggatggcaggcgtggccttgctatctgcatcgatgtcaacagccatctgtggtgtttctagggggcatatcgggcgtcaacgtgttttgagcctgcgtccttctcgctttagcacatgtgccgattcccggatggggaaccgcactacgaaatttggcctacacatcaagaggcgccgtgaaatcggccgccggcttagaccgaactcgtgtagctgtcgaggcggccattggagagaacatgtatcatatgcgtgtcagacttccgatgacccttggatgtccgttcctgtttcgccacattttaggggattcatgagatcttcaccgacactcttgatcatggataacgaccggctggcattgcgattgctttcagccagtctcaaacgcctacttcccggctgtacggttcttgcaccagtcgatactggcgctgaggccatagccgtctgtacttcgcatcactgtccggatctgttgttggcggatgtctccatgtctgatatcaacggattggtggtgtgccggacgattagaaaagagaattggaagacatccgtactcatgatgacatcattcagcgtcgccgaatatgctgcagaagcggtggcttcgggagcccagggaatcatacataaggacaatccgaaaacaatcgccgaggctttgctgcagataaaggaaacaggaatctgttctgatcgttttctgaatgcccacgattcgtttttgcggctgaagtcagagaagaacaaggatctgtcccctcgtgaaatggaaatcgttgatcgatgggcgcgagggagatcgatgtccgacatagcggaggaattatcgatcggtcagaccacggtgcggacccatcttgaacatgccgcgtccaagctgggggtagcgaacaaccgtgcattgatttccgcctggatgcatctcaatcgctgatgaggatttccatgaatacggcgtttacgtttccgtcaaaaataattcggcgctatgtggcacatccctgcttgtcccttctgtcgctgctggggctgtctcttgccctgatggagataatccagattggtcccatgcctcttctgccggcaatgctctatggagtgcttgcggtttcctttgtccttcttcctgccattggaggccaagcatgttgggccatcattgttgcaggttccgtgatctccatctccctcactcaggacagtcccttcgttatcagcggcatgctcatcgctctcggcattcttgcgttctccggaaccgtgcctgaatggctgatcgcaatgctgatttgttcctgtacgtatatagcgcgaagcgttatggtggagaacttcaatgttttcgtttccgtgtcggtcacggtcatgttcttggccagcttgcttgccggcagattggtagcgcttcgccaacaggcttttatcagagaagagcaaaggctgaaattgcagattgagcttcagcagcttgattatatgaggcaaaagaatcgtcttgcgatacagatacatgattccttgaccaataatctttcggatatctcattaatggcccgggttcatatcgatgaaaacatacctgacagcgatgattgggcaatcgttcttgaacatagtcaagaggcgttcacgcaagtgcacgacatcatagacatcctttcctcggaagacaaggacgcgaaatcagaaacgacgttcatggttgaactgcgtaatctgctggatgaaagatgcagccatcttcatgcgctggggtatgacggaaatacggccatcgacggatgctgcatcaaagcttcgccggaagaaaaggaagaagcgttatccctgataagagaactctgcaacaacatacagcgtcacggttccccacgcaatggctcgttcgagttgctggtcaagctatcaccatcgtcaatggaaattagcgagatgaatgatattgcagccggatcggcgctgactgcattcgaacaatcgggaaggggcctttcactgcactcaaaacgaatacaggaaatgggaggcgaacttaactatagaagcgatgatggattgtgggtgctctacgccaaaattccgctgagtcatatggagacaacaaaaacttgaaaccaagtacagcgagaacttttaaaaaacaacaaataatccatcacagattaatactccagtatgacgaatacaacaatcaaaacgcggaaatatcattttattttgtattactcggaggaggagccaggtaatgattcagcgctatagtcaagggacgtcagcaagaagaatcttccccatattgctgattgcggaaggattatgcctatcgggcatgagcgtggatctgacaatcacctcactgaccggttcgtccctcgcgccagcaccatggatggcaacattcccgatagcgtgcatattcatcggtacggtgatcggcacaccggcaatgggacgcttggtggggcgattcggctatcggcaagtattcgtcttcggcgcccttctagccgtcttgggtggaatatcctcagccacggctttgcgattccaccagttcccattgctctgtatagggacgttctgtgtgggcatataccagtcggggacgaactactaccggtatgccgcagccgattccatgcccggcaaagaaagcaaggcaatcaacggaatcctatcggcaggagccatagcaagcatcatcggcccggttctggcgacattcttcggcactgcgaccaacatcgaatacgagggatcatattacgtcgtcagcgtgctcgccgcctgcgcggtaatcgtgctgctggcgctcccgaaaattcagtcgccaactcccgcgcatatgcgcgacaaagctaccgcgagcacaacccccaattatccggcattgctgacccgaccccggttcgtgctgggcgcgaccatcagcttcgtcgcatcattcgtcatggtgctcgtgatgagcggcgcacccatagtcttggagagcacgttctcccaaaacgcgcaaaccagaatggtcgccatgcaactgcacatggtcggcatgtacctgccaaccctgttcgccatcttcattttccacaagaaaaacagcgaaatggcgcaggcgttgacggggttgatcatcggcatgctcggcacagtcgtcgcactcgccgcgtcggcttcgtatgccgtcactctggatctgctgctgatcggaatatcctggtcgctgtgctacgccgcaggcagcgccctgttgacaaaatcctatacggagtcggaacgttcgtgggcgcgaggcgtcggcgaactcgctcccgtattgggacaggtgctgggaagtgtgctcgctggcgtgctgctggccgcggggtggaaaaccgtattcgtcaccgtgctggcgatgatcgtatgcgcgctcatcgccatggcaggatatcgcaataaaatcaagtcatgagcgcaaatgacatgtccttagacgacatagcctaaggacgtatattgtataccgttgcaaactagaacaaactagcttgcaacggcgagcgaggaaccaaccctagtcccaggtcagcgagttcctcgggagcttgagcaggtattgcattttccggatgacggcctgctggacgtgttcggcgtcgtgcccgtcggacgggtgcaggaggatcgtgaatcgtgtcgagcgttccacgagcgtgccgatcgcgcttttgttggccgcgccgcgcacatctcgccacgcgtcgcgtactccacaccctcgaacacccacctgttcacttggccctcccgtcagtcagccaggcgttgcgacgatcactggaacccgccacgaaagttttttgtcggggggggtagcttttcctagtgacggcagccggatggcgtgcagtcggcaagatacagagaagtatgtgcaatatacggagaagtatatgaatgcgataagtattgcgcttccattcagacagtggaattacttgcgttgtatggcgaaagacgacgccgtcttccgccgaatggaaaatagaaagaaacgagtctgacaatggcattagatgttggcaaagcgttgaaatccaagaccttggtggtcggcgtcttgtcgatgtcgttgctgatgtccgccagcaatgcagtcagcggcaccataccggcgatgaaggaggcgttctccgactattccgcggcgaacgtcgaactgctgaccacggtgccgacgatcggctcgatggtcggcacggcattgaccggcctattcgccaatgccatcggcaggaagaaaatcgcgatggcgggattcctcatatccgccgtcacaggcgtgattccggcgttcttcccgtactattggccgattctcatatcgcgtatgttcttcggcttcgggtcggcgctgttcgtcaccttgagtgtgtcgtacatcaccgacctgtatgacggcgatatgcaacgcaagctgcttgggtggagacaggcggtcggcaatcttggcgacgtcgtgctgctgttcgtcgccagtctgctgatcaccatcaactggcaatccacgtacctcatcttcttcctgttgttcgtccccatggtgctcgtgggcatgttcattccgaaggagttcgataacttcagcattcgcagcgcgctcgtcgacgatgagggccacgtcgtcgacaagagcgcctcgcagaagcagacgacgaactggcaggtgctgtggctggcgttcatcttcctggtggtctccatgctttacaacgtcatgtccatcaagctcgccagctatgtggtcgatgaaggcatcggttccgcatcgctcgccacattgatcttcagcttcctcgtcgtcgccaccatcctctccggcgtgttgttcgacaaggtcgccaaggtcaccaagcgcctgacggtgaccatctccgaagtggtcatcggcatctgtttcatcgccactgcgctgacgaagaacgtgccgctgatgttcgccctggtgctgattgccggcttcgcatggggcatcatcaaccccgcgctgaccgcacgattcgtggactactcgcccgcgcactcgatgaacctgaccacgtccatcgtgattatcggcatcaacatcggctgtctgatctccccgtacttcttcgcgctgacggcaagcatcttcggcaattcctcggccggattcgccatcatcgtcggtggtgcgctctacctcgtgatggtggtcatcgagctgatcaccctcaaggtggacaagaagctcacggtgtgattcccgcggcgacggagccgtaccggaaccggacgacggcaatcaacgaccagcaaccaacaaccagcaaccaatcagacacacagacaacgaacaaaggagtttcaacatggtgttgttcatggccaatccacagcgtcccaagatgtatgagaagttcgtgcacgatacacccgaatggttcaagggcgccggtctcggcatcttcgcccactggggttcgtattcggtgccggcatgggcggagccgatcggtgcgcttggcacctttgacgatccggtgtactggaacacccactgcccgtatgcggaatggtattggaacacgatgagcatcaagggctcgccggcggccgagcatcagaaggaagtctacggtgacatgccgtatgaggacttcatcgacatgtggaaggccgaggcgttcgaccccgcggacatggccgacctgttcgcacgcgccggtgcccggtacttcgtgccgaccacgaagcatcacgaaggcatcacgctgtggaaggcccccgacaacgatgggtggaataccgtggaccgtggtccgcatcgcgatctggtcaaggaattcgccgacgccatgcgcgacaagggactgaagttcggcgtgtactactcctcgggcctcgactggcacaaggagcccaacatgccgattctcggcgacggggaatacgggccgcagagcgaggactacgcccgctatatgtactcgcatgtgatggacctcatcgacgaataccagccgtccatcctgtggggagatatcgacgtgccgaagatctcggaggaggacaacgatttcagcgtggcccgactgttcgagcattactacgacgtggtgccggatggtgtggtcaacgaccgctggggcctgacccattgggacttccgcaccgtcgaatacgaacagggcaaggagctcatgggcaagggcatgtgggagatgacccgaggcatcggctactccttcggctacaaccagatggaggacgccgactcctacatgaccggtccggaggcggtgaagttgctcgccgacgtggtctccatgggcggcaacctgctgctcgacatcggccccgacgccgccggacgcatccccgaactgcagcgtcagtgcctcgagggcatggccgactggatggacgtgaactcgccgagtatccatgatgtcgaaccggtgccggaagcctcgccttccggagagggggacggcgagccatgggtccgttggaccggagacggcaagagcgtctatgccgtcgtcgatgctgcgggcagggttccgctgcgcatcgccgccgatgctgtggacgcggattccgccgtgacgcttggcggatccgcagtcgccgtggacgccgacggcgacgtgctgaccgccgatgttccggcctcggaagtggcggggccgcaggtcgtgcacttcgtccgtcgctgacggattgcgctgaaggtgccgtattcgatatacagctatattatcggatgcggcaccttgtcatatgcgcgcgtacagggtagaaaatgggcatcgttcctccttggaaaggtatcgaggatttcccctcccgaaaacataattagacaatatgtctaataaaaaattatccgtccggacgcaagttttcaagtcgtcgtcgggcgtgcgattccgtttcctgggacatgaaaaaacattcacggagatcccggttcaaacacttccttccctgatcgcggtccatcatggaagccgtcatgcgcggcgaccacggaaggaagaatcatgacggcaagcaaaccaacgaacgtcctcgaaggcaatctcgcgtcggaaccgaaataccggcaggccaatagcgagaaacaggcgcgactcggaatacgatccgccgaagaacaataaaagaggtgaagcccgtatctcgcaaccactgagattcgaggtcgcttcggctgattccggtggctttctgggcattgcattcggctggacattcgacatcgcatcctgccggcatttcgtcgtggggcaaagtgtacaatcgccacgtttgctttcgcgcccagcgtaaatcgcgtcgccggctccgcgaacggatttccaatcacacagaatgccgtgaacagtcagccatgcctgttgcgcggcgaagagaaaagaagaagcagtggattatcctctctttaccaagctggccgccgagttcttcggcaccgccattctgatgatcttcggcaacggctccgtggccaacgtcgagctcaagaacaccaagggccaccacgccggctggctgaacatcgccatgggctatggcttcggcgtcatgttcccggtgctcatgttcggtggcgtatccggcgctcatatcaacccggccatgacccttgctcaggccatcaacggcctgttcccctggaatgaagtgctgccgtacatcgtcgcccagctgctcggcgccctgcttggccagctcatcgtctacatcacttactacccgcactaccaggagaccgaggacgccgaggcgattctgggcaccttctgcaccactgacgcggacaacaagaaggtcaactacttcctcaacgagatgttcggcacgctcgtgctggtgttcggcgcactgtgctgcctgacgctgccgtggggcaaggccgacgacgccgcatcctccatcgtggtcggcttcattgtgtggggcctcgtgacctccatgggtggcccgaccggccctggcctgaacccggcccgtgatctcatgccgcgactgctgcacgccatcctgccgattccgaacaagggtacgtcccgctggggcgaagcctggatcccggttgtggccccgattgtcggtgccattatcggtgtctggctgtacgtgttcttcttcgccagctgattcgttgattgattcatgcatgcaaatggcctccgctcgttttgggcggaggccattgtcgttgaatcaggtaaacgcagagactactgctccaggaacacctgcggggccttcatgaagttcgtggcgcagtgttcgccgcagaagtaatagggcttgccctcatactcgcgcgtgatcgcgtcggcattcaccgccacggtcatgccgcacaccgggtcggtggcggtttcgccgtcggtcggggtgacgtggtgcatgtgcattcccatatccatagtgttctccttgttggttggattattggattggtcggatacgtgattggttggattcagcgtggtgcgatcgtcgatgatgatggtcggctcgtgaggcgcgttggatgtggtggagccggtgatgttggcggcgttggctgattcggccgatccggctgattcgatatccgccgtgctgttgcccgagccagcggtgctatcggcagcacccacgttgatattcgccccatgcagcctgttcgcgttcagcaccaggcacaccgagctcaacgccatcgccagaccagcgatcatcgggctcaacagccagccggtgaacgggcagagtgcgccggcggccaccggaatgccgatgacgttgtagccgaacgcccaccccagattctcgcggatgttgcgcatcgtggcgttggacaggttgatggtcttgatgacgccgcgcaagtcgccgctcatcaaggtcacgtccgccgactgcatcgccacgtccgtgccggtgccgatggcgatgccgagatccgcctgggccagcgcgggggcgtcgttgatgccgtcgcccaccatcgcaatcagagtgcgggattgcgcggccgtgcgggaggcgccatccgcggacttggcggcggcctcgtcgcgttcgcgctgcagtttggcgatccagtaggccttgccgtccggcttgacctcgcagatcaccgtatcgatgccgacttcgcgggcgatgcgcccggctacctcggccttgtcgcccgatagcatcaccgtgcggatgccgcgtgcgcgcaacgccgcgatggcctcgcgcgagccttccttgactgtgtcctgctcgtagctcggcttgtcccagtcggcggccgcgtccaccacgccgcgcgtgatggtgccggtcttgtcgaacaccacggtgccgatgcgacgcgcctgttccagcgccttggcgctggtgaccagcacgccgttggtggcgcccaagcccagtgagaccgtcaccgacagcggcgtggccagtcccagcgcgcacgggcaggcgatgatcagcacgctgaccgcggtgaccagcgcatgcgccagttgcggcaccgggcccagtgacacccagatggcgaacgtccagatggcgatgatcatcaccgccggcacgaaataccgggcgatcttatcggccagctgctgcaccggcgccttggtcgcctgggcgcgggccaccatcgccgcgatctgcgagagtaccgtgtccgcgccgacctgggtggcgcgcatcacgcagtcgcccttgagcagcacggtggccccggtcaccggatcgccgacggttttggagaccggcttggattcgccggtgatcatcgattcgtcgatatgcgcctcgccggccacgatgatgccgtctgtgggcacgcgctcgccgttcttgacgaccagcaggtcgccggtggcgatggcgtcgatgtcggtgtccgtgaaatacgccggattgcgccattcgatgccgtccacattgtctgcggaagtggcgttgagtttgtgcgcggtgcgcgggcgcagtttgatgagcgactgcaccgccttgccggtgccttcgcgggccttggtttccagaaggcggccgaccagcaccaaggtgatgaccacgccaaccgattcgaaatacggttcgcgcgagccttccgggaacacccacggggcgatgcaggtcaccagcgaatacaggtaggcggccaaagtgcccagtgagaccagcgagttcatgtcgggggagtgatgcgccaacgcggggaagccgaccgtgtggatcggacgcccgcagtagaacatcaccggcgtgatcaggatggcctgcaaccacgggttcaccatccaatgcggcaccagcgtgggattggccatatgcagcatggtgacggcgaataccggcaacgtcagtaccgcgcccacaatcaccagcttcgtcagcgccttgatctcattggcacgttcagtcgcctctcgtcgatcggcctccgccgcatccacggcggtaggtgccgtatacgaagcatcaggatgaggaaggggcgtgttctcatccgagccgtcctctccctcaaccttcaacatcccatgcaccatattcatgccgcacgcaaacggatactcgcccggcggcaacgccggcagttccacgtcggtggtggcgttgcccggcagcatggcgtcaagtcccagatcagcaaacaccacatgcgaggtgcattcgccggtctcctgccggtcgaaggctagtgtgatcggcgtacccgcacgcatgctcaccacggcgggggagtacccgcccttgacggtgattgttgcggattggcgttcgccggaagcgtccatggccccggccgttgccttctgcgttccgaagaagaatcgcaggaccagccatgtcaatgcggccgccactatcagcgccgcgacggtcgagaaaatgctgaactccataactgttccttcccactcctgatgtactgaacaacagtgtataccctatacccctagagggtatataatggggtgtgttcagctgacggataagtatcagggggtttgcgatgcatggttatgacgaagacaaggccaaggtcatcgcacgattacgccgtatcgaagggcaggtgcgcgccatcacgcagatggtggaggatgacaaatactgcatcgatattctgacgcagatttcggcgtcgaattcggcgctgaaatccgtggcgttattgctgctggacgatcatctcaaccattgcgtgcggcaggcgtcggtccagggcggcgaggtggccgatgaaaaacttgcggaggcttccgcggccattgcgcgtctcgtcaaatcgtgacgagttctgccgcatgatgacgcgcgctggcaaatcatgaaaggccgtctgacgctcggatacgacacggcataataacggttgatgctcgactgtgataaggccaagcgtccaatgtgggctgctgagcgtccgtttaacggcttgaaatcgtcgagttcggtaaaaatttaccgtcattcaccatcgatgacatactgggtaccatgtttgagcaaataggaaacgtgattatcgtcatcgtcgtgctagtggttggtgcagggcttggcctcttcgccggcttcgtgctggggcgccataagggtcaggagatggctcgaggcgtcaaaagcgaggagctggaggaggccaagacctcgctggagaatgcgcgattcgagaatgctgagctcagtgctcgcaatgctgccgcacaggctcagattgaaggcgtgaaccagcaattggctttcgccaagtcacaacttgcccaggcgcagcaggctgagcaggttcgcattcagcaggaacgtgagcgtgcggctgcggaggcggaacggaagcgtcaggcggatgctcgggacgccgaggccaagcgtgctgaacaggaagcgcgtttgaaagaacagagcaaggtgctcgaggcgcttgcgccagtggccaaaaatcttgataccttgcagaacaaggtcacgcagatcgaagagggccgcaagagggaaatgggcgcattgggagcccaactcaaggggctcaacgaccagcaggcccgtttggacaaggagaccagctccctgtccgccgcattgcgcaataacaaggtgcgtggcgcgtggggcgaggcccagctcaagaacattgtcgaatccgccggattgctggaacatgtcgatttcgatacccaggtggtggtcacggatgccgatgggcgtacgttgcgcccggatatgatcgtgcatctgccgggaggcaagaccattccgattgatgccaaagtgccttatgccgattaccagcgtgcctgcgaaatcccggacaccgccagtcccgaggatattgcccgccgcgatgatttgctgcggtcccatgccaaggcgttgcgcgagcatgtacgtgctctcggcgaaaaggcctattggaatgcctttgatgtggcacccgattttgtggtggccttcatccccaatgaggcactattgcaggccgcgctcgaagccgatcccacactgatggatgatgcgttctctcgcaaagtggcgctcacctcgccggtcacgctgtgggccgtgctgaaatccgtcgcctatgcctggcagcagcagtcgctcaccgatgacgccaagcagctgttcgatctgtcccgagaactgtacgaacggttctccacgttgggtgattatgccatcaaattgggcacccagattactaagacggtcagcgcctacaacaagttcgcgtccagcttggaacgccgtgtgttgcccaccgctcgcaagctgcaaaaaatcgaaccgaccaagatcatcgaggaagtaccgatcatcgaatcagataaaggcaatgtgagcgaactgtccgcccctgaagtggtgccggccgatgagggtgatactcatctgactgcctcaggcgatagtctggagtcatgactgaatctggattccgccccactggtaccccggacctcgccgtcgcgaagagccataatgactttgccatgctggagccgcgtgagcagctagccaccttgctgagggagcatgtggtgggccgtccgttctccgaacttgccgcggtgactttcgaccaccatgccgccaccgtcatgggccatgtgctgattgacgctttggaagatgcgggctattcggttgatgacttcgatgctgttggtgccttgaccgcagcatctgtgcccatggtgtccgccatgatccaggccgcctcctctcgtggcgaggacctagatggattcgtgatggacttcgtctacccgtccatcaagggcccctccatcgaaggccgccgtgtggtgctgttggatgcttggctgtccgaaaagtcgtacgtgcagaccagctcgctggtcaccctgcgcaacggcaatgagctgagcctcgactttggcatagtggagcagttgggtgccaaggtcgtggccatcgcctcgctggtcggtggcggtgccaaagacatcaatgtggtcaacccctccaccggcgacgagcaaacgctccccttcatccaggtcttcgacgaatccgaactgcggtaaatccacctttgacttccctcgcataaagtcagccgggctgagcagcgaagctgactaagaggaaccggtgaatagcgttatcgaggagaaagattgcacgcacccaaccagatttctttggctgccaaggcttcaggtgaaccggaattccgtgaaatcggccttgggccgtggtctgagacccatcccggcgagcctcgtcctgacgatccgacttctccgaattatgacggtcgtttcgactcggtgctgttgaacgacggcgaccgccgcaacgtattggaccgttaccgctactggaccgtcgctgccattaaggccgatcttgacgctcgagggcgtcacgacttcgaagttgcggtggaaaactggacccacgatttcaacatcggttccatggtccgcaccgccaacgccttccaggccaagcgcgtacacattgtcggtccacataagtggaatcgcaagggagcgttgatgaccgaactgtaccagcacgtcgaacaccacccctccatcgccgaactggtggaaagctggcatcatcgcatcgccggtgaaatcgcctatgaacgagccaaggccggtgccgccgccatccatgcgcatgatgtggctgtggatggaaacaacaagcaccttcatgagctgctggccgaaatcgatgcttgtgatgcgcgcatcaaggagcttcaagccgcccgcgtcatcgccctcgacattattcccggcgcagtgccgatggaagcctataccttccccaagcggtgcctgctgctcttcggtgcagaaggccccggattgagcgacaagtctctcgcattggccgacgatgtggtctacatctctcaattcggttccgtgcgctccattaatgcaggcgctgcggcggccgtggccatgcacgcatggattgcccaacacgccgtatcaggcgtgtagccatgcgccgacaatcccgccgcatctgcccaatatgggccacattagaggcatgatctacgccaccaaatccatcgccgcggcattaattcgcatttgccgccggcatcgtcggcatcctgctcgccgcaggcatcagcagctccgcgcagtccacactggccgaagccgttaaaccggactactggattcccgaatggtggcagtccggcctgattctcatcgcctgggctgccgccgcatggatcggcggtctcatcatcaccggaaaagcggatatcagatatcaaataacgcgggttactgctttggcagttctgccggttcggccatgatcctggcagtttgtcatggctatggctttggcggttctgcagtgaccatggttctggtgactctgaccccatggatttgaccaccgtggttcactgcgcttaaccagctcccatcactgttccagcatgaggtatgccggctgcccgcagcttattgagtaaaggatgttgttgcatcacctcctcataggtgaatcggacaatggtgtcgactttggcccggtacagtgccgtctcccgttctttctccgcctgaactgcaccacgaacacccttgcggtcattcatatccgggttcacatatttttcatagccatcgaattcgcccacgataagccgattctcaggtagccgccagaggaaatccacgcgatacagagcaccggtttgcgggtcggtgatgttttgttgcagttctggggctaataggccgcctgcgatgatggtgcctcgtccaagtgactcgccaccattctcactcgccggattggcgtaatgcagtaggcggaatatcggcgtgcaatcacgtcgcatagtgctgcacacattcagaatgtccgtgatggcgacgccgttgcgcagcgccgaatcgataatgggcagtgcaaatcggaagtcgacggacagcccgcaatccaccaccgttctggctttgctggtcaccgggagtccattggcatattctggcgtgctgcttgacgtgaagatgcgtttgacctttgcactgctggcgttggggcctcgtgatgttgtggcgagagtgatggtgccagcatgaagatgccattggtgttcaaaatcgtggatggccgctgccgtgaccccggcgaacacccaatccggatgtctgttatgaagagttcgtgcaatatgtctgatacgttcgtcgggttgcagcgaatcccagtattccgaagcggcgtacatgttggggaatacacgtttgagttcgcgcgcctgcacgcgccgagccagtgccgagcggtgtgccttggttgttccataagcgcactgttgcgttgcttcagccttcgtgatgagtatgtccactgctttgtgatgtttcatgattcgacggtatgccaatggtgaacacggtgtctatctgtctggggttatgtggttctagcttcggtgcctagatgtgtgtttttgcctgattatcaggcatctgaccgtattggactgattatgtggattcttttgggtgggtatgcaaaatgtggataactggcgaggtgcgcagggcgattgtcgttcatatgttcgatgtaggtgtgtttgggctcattgtgagcttattagggtggccatgcagatacttcagtggggcacatttgcggttgggccgtggcgttgcctcgctgcggggcgtctcagcggggcgttttattggttggaccgcggttttgttttgctgggatggctgagcggggcgtttcatcggtcagctcgcggttttgctctgctgcgagtcgtctcagtaaggtgaacttgcggtccggcaacggttttgccccgccgaagaagccagcagcggggcaaatgctcgaccggcttgagcttctgattcgctgaagggctccagtaggcgggaaaatgaggcttcccgacaactgcgtgtcacatacggctcatatagttatggccatgccaacattttcacgcgaagaaatcgtgcatttgggcgatctggcccgaatcgcgctcaccgatgaggaaatcacccgtctgcagggcgaactgaacgtcatcgcagactccatcaacaaggtccaggaagtcgcctccgacgatgtgccgccgaccgccaacccggttccgctggaagcctacctgcgcccggacgtcgccgaaaccccgctcacgcaggaagaggcgctcgccggtggcccgaagaccgaggccggcatgttcgtggcaccgcgaatcctgggaagcgaggagtaatcgatgagcaacgaaaccgcaactcttgtcaaactgtctgctgccgagcaggccgctgccatcaagaagggcgacgtcacctcccgtgagctcgtcgaagcccacctcaaggtgatcgaagccgctgagccgtctatcaaggccttcctgaaggtttccggcgatgtggctctcgagcaggccgacgccttcgacgccaagtccgccgaagacaaggccgccctgcctgagctggctggtgtgccgatcgccatcaaggacatgatcgtcaccaagggcatcgaaaccaccgccgcctccaagatcctcgagggctgggtgccgccgtacgacgccaccgtcatcgaaaagctcaaggccgccggcatgccgattctcggcaagaccaacctcgacgaattcgcccaaggctcctccaccgagcactccgcctaccagaccacccacaacccgtgggataccgagcgcgtgcccggcggttccggtggcggctccgcctccgcagtcgccgcattcgaagcaccgatcgccctcggcaccgacaccggtggctcgattcgccagcccggcgccctgaccggcaccgtgggcgtcaaacccacctacggcggcgtctcccgtttcggagccatcgccatggcctcctcgctcgaccagatcggcccggtctcccgcaccgtgctcgactccgcactgctgcaggagatcatcggtggccacgacaagcgtgactccacctccatccccgaaggcccgcgcccgatggtcgccgccgcccgcgaaggcgccaagcgcgatctgaagggcatgaaggtcggcctcatcaaggaactcggcggcgagggcttccagcccggcgtcgaggcccgtttcggcgaggccgtcgacaagctcaaggacatgggcgccgaagtcgttgaggtctcctgcccgcacatcggatactcgctgggcgcctactacatcatcatgccgtccgaggtcagctccaacctggcccgttacgatggcatgcgctacggtctgcgcgtcatgccgccggccggcgtgccccagaccgccgccaacatgatggcctacacccgtgaggccggcttcggcgacgaggtcaagcgccgcatcatcctcggcacctacgccctgtccgccggctactatgacgcctggtacggctcggctcaaaaggtccgcacgctcatcatcgaggacttcaagaaggccttcgaacaggtcgatgtgctgatctcgcccaccagcccgtccaccgccttcaagttcggcgagaagatggacgatccgctggccatgtacgtcaacgacatcgccacgattccggccaacctcgccggcatgcccgccatgtccatcccggccggcctgtccgacgacggcctgcccgtcggcttccagttcatcgccccgcagcagcgcgacgaagtcatgtacaagccggctgcggccctcgaagcagcgctggaggacggctggaacggcccgatctggaacgacctcaagaccccatggcttgacggtctgggcaagtgagcatcggaaggaaagaaacaacatcatggctgaaaaactgatgaagtacgccgatgccaccaagaagtacgatgtggtcttcggtctggaaacccacgtggagctgtccacgaacaccaagctgttctgcccggcccacatcgagttcggcggcgagccgaacaccgaactgactccggtgagcctcggcctgccgggcagtctgccggtgatcaacaagaccgcggtcgattacgccatcaaactgggtctcgccctgcactgcgaaatcgccgagtggagccagttcgcccgcaagaactacttctacccggacatgccgcgcgactatcagatctcgcagtacgacaagcccaccaacggcaatggctacctggacgtcgagctggaagacggcactgtgttccgtgtgccgatcgagcgcgcccacatcgaagacgacgccggcaagaacacccacgtgggtggtgccgacggccgtatcgaaggcgccgaccactcgctggtcgactacaaccgcgccggtgtgccgctgatcgagatcgtcaccaagccgatcgagggtgcgggcgaccgcgctcccgaaatcgccggtgcctatgtgcgcgccatccgcgacatcgtgcgtgcgctgaacatctcccacgctcgtatggagcagggcaacatgcgcgccgacgtgaacgtctcgctgcgtccaagcccggatgccccctacggcacccgttccgagaccaagaacgtgaactcgttccgcggcatcgagaagaccatccagtacgagattcgccgtcaggccgctcgtctggacgacggcaaggagattctgcaggagacccgccactgggatgaggctacgcagaccaccgctggcggccgtctgaagtccgatgccgacgactaccgctacttcccggaccccgacctcgtcatgctccacatcaccaaggagcacatcgaggagatgaaggcccagatgccggaaatgccgcgcgagcgccgcaaccgcctcaagtccgagtggggcctgagtgatctgcagatgcgcgacatcctcaacgccgacgccctcgacctgattgaggaaaccgtcaaggccggtgccaaggcggccggtgcgcgcaagtggtggctgggcgagctttcccgcgaagccaacgccaagggtgtgtccctcgaagagctgccgatcaccccggccgacgtggccgaagtcgagaagctcatcgcctccggcaagctcaacgacaagctcgccaagcagaccgtcgaaggcgtgctgaagggcgaaggcaccccggatgaggtcgtcaagaagcacgactacaagatcgtcgaagacaacggtgccatcgaggcggccgtcgacgcggcgttcgaggcgaacccggatgtcgtcgagaagctcaagagcggcaacatgaagccgatgggcgtgatcatcggcgccgtgatgaaggccacacgcggccaagccgacgccaaggccgtcaccaaggtcgtcatgggcaagatcaagggctgattagattcactggctcccgctggcgggagctgtcgaacggagtaagactgagggtagtcgccatggtcggatgaccaccctcagtccgcttcgcggacagctcccgccagtgggagcacttatttgtagggaaatcctccagttcaaattcgtttgacagctcccgccagcgggagcctttattgattctgtaagaaagtcgactcagagcatttccagcgttcacccagtcgagtaagatatgctcggcactggaccgtgagccgaaacaagccgaaccgggggatgtataccgatgaccacaaccaacgagacgctgagcatggctaccgaagtgcaactgaagcgcgatctgccacagagcatcgtcattccgccaattcgtggcgaaatggtgcacctgcgccccgccaccgccgaggacctgcctcgtttggatgaactagatgccttctatggcgcatccaagatcaccggcaaggatgcggtcaccgaacgcgccattgtacacacgtgggtccgccgctcccaagcctgggaagccggtcaggcgcccgccgaatccggcgtgggcgacccggaatctcgccgcaccatcgcatgggctgtattgactgacgccgaccatgacgatgacggtcagctcgatgcggccagcaccgataacgtcatcggcatgattttccttatcgacatcgacggctggtccaagtccgcccgcatccagatcatcttgggccgtgaataccgtggccgcggctactcccgtgacgccatgccgcgtgtgatgacttacggctttgcgcccgaaccggccggcctgggcatgcaccgcatctgggtgagcgtgccggaaaagaacagccgttcgatttcggtctaccagtcgctcggattcgtgccgtccggcacctcgcgcgacgcgttgtgggatgtcgaaaacaacaaatatcaggaccttatcgtcatggacacgttggtcgacgagtacgatccgattcgttcgcttgacgcttttggcatgcacttgattgaggacaatccgggtgtcaaggaggcgctgtccgcgcgcgagcattccatcgccatccagcagaacaagccggaacccgagccggcacagcgtggtgaggcagccgccgtcacgacgagtgacgtgcagtctcaggcccagacgccggcggccgcacagccagtcgagccacaggccgggcaccacgacgatacgcagaagaacgcgcgccacagtctcgaagaggaaagcaactggccgtacgatcaggcagaacgcaagccctcaaaggaagcatggtggcgtacgctgggccgcggccgcaaacgcgatacggaaagtgagtgagtaaacaagcatgagtgccgaggatctcgacaattacgaaaccgacgccgaactcgcgctgtatagggaataccgtgacgtcatcaagctgttcacctatgtggtggagactgagcgtcgcttctacttggcgaataaggtcgatttcaacgtgcgttccgctggccaggacgtgtatttcgatgtgcagctgactgacgcatgggtatgggatgtctaccgttccagccgtttcgtcaagtccgtgcgcatcgtgacgttcaaggacgtgaacgtcgaagaagtccagaaaaccgatatcgacattcccgacgacatccactgatccggtgtcgcgccacgacagtcgcctattcaccgattatgcgaccacggtttgccgggacgtcacttgatacgtgtgtcgtgttcgattcatgctcataccatactcatggcgcgctcgggtcacgggcccgtcttttttcgttgatgagatgagagtgaataatcgatgtcaacacgagtgatgaagaggatagtcggttccgtcgcatgcctcgccgcgtctgccatgttgttgccgggaacaatccggccggctcaggctatggaggccgacggccggtactacagcagcaaacagccgtatgtggccccgaatgacgcgaccgcgtcgtcctatagcaaggctccgaaaggatacggaccgatttataccgaaagcatggcccgtcacggatcacgtggcctgtccagctacaagtacgatgcgttgctgatgaggatggccgagaccgccgctcgggatggcgggttcaagtcggaggccatcaaagccgagttcgtgaaaaacctgagcggcatcaccgcggccaatgtcgagaacggctatggcatgctgaccggtcagggcgcacagcagcattacggtatcggagaacgtgcgtaccagcgtaatcggtcgctgttcgatcaggccgcagcggatggcgggacgattgcctaccagtcctccggcgaagcgcgcgccactgagtccggcgagaacttcgagaaaggtttcaacgaggcttcgggaggcaggctcatcggcaatgtcagcgcgccgacgaatcccgccgattccggcaatggcaaggatttccagaagaatcccgacaccctgtacttccacaaggtgcagaatcccgatggcacaagcaaggtgccgggtaccaaggcatacgacatcgcgaacaactaccagaatttcgttgccaatgatgcgaccatcgccggtgctgagaagaccataggtgacaacgtcgacgtcaaacgggcctcacatgacctgttgtcccagattttcaccgaagaattcctcgccaaactcgagaatggcgaatataagtggtacaacaccacggacggcaccaagaaaggcggcaagaactgcgcgccaggtgccgatgcgtccaaagatcccgacgcatgcggcgaagtctccaagaagatcaagagtgagtatgacgccgcgatggatttgtacaacctgtacatcatcgccgccgacatgcacaatgagaacaccggtgaccacaccttcgccttcgaccagtatttccagggagcatatgcggatgatgccagaatgttcgcatgggcgcttgatgccgaggacttttatgagaaggggccgagctacgccggtcagaacgagacctattccatcgcgcagcctctgttggatgatttcctcaataccattgatgcgcgggtgaacggaggatccactgtggcgacgttccggttcgcccatgcggaaaccatgatgccgtttgccgcattgctgggattgccgggctccacgcagcaggcaccggcctccaccacggacgtgtacacttacggcaacaatgagtggcgtggcgaatcggtgacgccgatggccgcgaatgtgcaatgggatgtgtacgccaggaagggtgaggaccccgccaccggacaacggtacacgcccatcgtgcgcatgttgtacaacgagaacgaggttccgttccgttccgaatgcacgccggtcgccgatggttcgacatggtacaagctgaccgaactgaaaagctgcctggccgccgatcataagacgctcggtcaggatgcccgcatcgcggaacaggccgatgcgaccccgtcgccgcagccatccggcaagcccgcgactgattccgatgcggcgacgcatgccgccggcaagggaaccgctgccggtcaggcatcatccaccacgaatgcccgtccgacgtcactggcacgtaccggaagttcggtcacggtgtttgtcgtgctgacggtcggattgatgctgatcggcgtctcgctgaatgtgtggcgtatgcgtcgctgatgccgactgtccgctcataatcatccggcgccgtcttccacatgaagtgaaggacggcgccgcctattcggcgcgaatgaaagccgcatgtagggcacgggtcgaaccttcgcgcgacaaagccgcacgccgggaccatgcacgattgcaagcatcgtcttccctaccttcgggtagactgcttgagatcttgttttataaggagacctcaaagtgacgcaaaagcaatccgtggtgattatcggcggcggtccggctggactgaccgccgcatgggaactcgtcaaggacggcggcgcggaaaactatgacgtgaccgtgctggaagcgacccgcgaattcggcggtatctcgcgcaccgtgaagcacaacggcaaccgcatggatatcggcggccaccgtttcttctccaaagacgaacgcatcatggattggtggaagaccgttctgccgttgcagggcgcaccctcctatgatgacaagaagctcggccgcgaccacgacatggagccgggaggccccgatccggagacggaggacaaggtgatgctcaagcgccaccgcgtgtcccgtatcttctggaaccgccacttcttcgattacccgatttcgctgagccccaacacgttgaaggccatgggcttcaagctcaccatggtggccggtttcagctacctgaagtccatgttccacaagctgccggaagacaacctggagaacttctacatcaaccgtttcggccgcaagctgtattcgatgttcttcgagggctacacggagaagctgtggggccgccacccctcccagatctccgccgactggggtgcccagcgcgtcaagggcctgtccatcatgggcgtgctcaagaacgccttccagaagcttagccctaggaagcgctccaacgcggaggtcgagacctcgctgatcgaggagttctggtatccgaagtacggtcccggccagctgtgggagaccgtcgagtccaattgcgaggccgccggcgtcaaggtgctgaccgacgccagggtggtcgaggtccgccagaccgatggtgccgtgtcttccgtggtgtacgaggattccgagggcaaccgcaccgagctttccggcgaccagttcatctcctcgatgccggtcaaggacctggtcaacgccatcgacgcggccggcgacgatcccgaggccgctgattccaagcccgccccggccgatatgaccgaggtggccaacggcctgccgtaccgcgacttcgtgaccgtgggcctgctggtcaagcacctgaagctcaagaacaccaccaacatccccaccctcggcaatccgccgatcgtgccggactgctggatctacgtgcaggacccgggctacaaggtcggccgtctgcagatcttcaacaactggagcccgtatctggtcaaggacgtggacgacaccgtctgggtcggcctcgagtacttctgcgaggagggcgactcgttctggaacatgagcgaggaggacgtcaccaagttcgcgatctccgagctcacccgcatgcgtgtgatcaacggtccggacgaggtcatcgactcccatcgtgagcgcgtcaggaaggcgtaccccgcctacttcgacacctatgagcacatggacgagctcatcgagtacctcgacggcttcggcaacctgtactgcgtgggccgtaacggccagcaccgctacaacaacatggaccactccatggccaccgccatggaggccgtcggcaacatcaagaccggcaagacgtccaagaagaacgtgtggtccgtcaacaccgaaaagtcctaccacgaaaaaaagtgagtaaaccttgttgagctccctcgtcacagagggagttttttttggttttcggcgggccgttttgcgttggtcgagttggcgttgtacagtaaacgaagttcgcgaagactcagagacgcagcgaacattcatgagcggtgcgaccgcaataatcactcttaacgcctggataggcatgggcctgttcggtatggaaagggcaaccagtggcaaatagccagaatcttgaggatatgaagctgcctgagctcaaagagctcgctaaacagatgggcctgcgcggcacgtcgaccatgcgcaagcccgagctgcgcgccaccctgcaggcggcgcgcaatggtggagagccgccggccggtgtgaccgtgcgcgcccccaaggccgccaaaaccgccaaggtcgtcaaggctccgcagcccgatgccgctgaggccagcaccacagacaatgctgacgcggccacccagtcgctggctccagctccggctgccacggaaccgcagctcgatttgccgcttcccgtggccgacgatgccaagaaggacgagaccgaaccgcgacgcacccgtcgtaaggccgccgatgatgccgcattcgaaccgcgtgcggcccgtcgtcgtcgcgatgacgaccagtccgatttcgctcgccgcaagccgcgcaagaaggccgatgaggccggcgatctgctggccacgctcgatttgggagatgcagcgcctaccgagcgtcgccgcgagcgccatgaggacgtggaagttcctctgattcgccgagtccgtgatgatgaggacgagcagcctcgccgccgccgtcgcactgcggaaaacagcgaagaaaccgtgcgtgacctcgacgatatcctggccacgctgcccacgcagaagcacgaggaaacggccgaagacggcgagcaaaacgacgatcacgagtttgtgcgtcgtaaccgccgcgaccgtagcgatcgtaacgatcgcgataaccgtaatgatcgcaacgattgccgtaaccgccgcatgcgtggccgtgatcgcgacaacgccgatgatgatcgtcgctatgatgatcgcgataatcgtagcgatcgcaatgaccgtgatagccgccgcgaagagccgcaggaggatctggtgccggtggccggcatcgtcgacgtgctcgactcctacgcttttgtgcgcacttccggctacctgccaggcccgaacgacgtgtacgtttccatgggccaggtcaagaagtacggtctgcgcaagggcgatgccgtccatggttcgattcgcgccccgcgcgaaggcgaccgtcgcaaccagcgccagaagttcgtgccgctgcaggccatcgattccatcaacggccaaagcgttgaagaagcgctcaaccgtccgcagttctccaagctcacgccgctgtacccgcaggagcgtttgaagcaggagaccgccccgaacaagctcaccggccgtatcatggacatcgtttccccgatcggcaagggccagcgtggtctgattgtctccccgccgaaggccggtaagaccatcaccctgcagaacatcgccaactccatcgccgccaacaaccccgaggtccaccttatggtggtgctcgtggacgagcgccccgaagaggtcaccgatatggagcgcacggtccagggcgaggtcatttcctccaccttcgaccgtccggcctccgatcacaccacggttgccgaactggccatcgaacgcgccaagcgtcttgtggagctcggccaggacgtggtcgtactgctcgattccatgacccgactggctcgcgcttacaacatcgcagcccctgcctccggccgcatcctgtccggtggtgtggacgcgcaggccctctacccgccgaagaagttcttcggcgccgcccgcaacatcgagaacggcggttccctgaccatcatctcctccgcgctggtcgagaccggctccaagatggatgaggtgattttcgaggagttcaagggcaccggcaacatggagctgcgcctgtcccgcgagctggcggacaaacgactgttcccggccatcgacatcaacgcttccggcacccgccgcgaggagctcatcaccaatccgcaggaactgccggtcatctaccgtctgcgtcgtctgctgggaggcatggagcccgagcaggcctaccagacgctggtgccgcgcctcaagaagaccgccaccaatcgggacttcctcgccgccatcgtgcagcagcagagcggagccgtgaacggcaactgaggttgccgttcaggcaaacccggtgggcttgccgacggcgacgcctgagtgaggcggcagccgaacgaaggttggatcgagtccgcgcgtagcgtggtccgttcttgctggtggagccgtgaacggcaactgaggttgccgctcggaagtccgatgccttaccgataatgatgcgatgatggggaccgcggagattattccgcgggccccatcggcgtttccggtgcgtcgatcacgccaccgccggcgagctctcccggtagtggatcgagaaatcgacgtaacgctgctcggctgcgccgcgcccgccgccggccacttgctccagaatggcgtcgaccgcgcattgcgcgatctgctccttgccaagctcgacggaggtcagcgagggaatcgtgtattgcgcctcctcgaggttgtccatgctgaccacgcgcaggtcgtccgggatgcgcacgcccatctcgcgcagttgtcgcaacgcaccgaaggcgagcaggtcgttgtagcacagaagggcgtcggccttgatgccttcctcgaacatgcgacgcacgatttccgaaccgttgcgtctggtggcgatgccccgtcccacatagcctgcgccgccgctggcatcgtccttggcctcctcgtcggtctcccaggcggggatgggcctgatgagcttggcatccactggcacgtcggcctgtgccaatgcttcgagatatccctgcgtacgcagcgtttcggttgaggtccgtcgtcggtcgagcgcgccgccgatcagcgcgatgcgccggcaacccgcgtcgagcagatgctgggtcagcgccttgaccgcgtcgatgttatgcacgaggatatggggcgcgggcacgtcaaacaggcactcgccgagcacgacgagcggatagtcgccggccaggcgggcgatgtcgcggcgttccatgagcagggggctcagaatcaacccgtcactcatcttgcgcgccatggcggcgacgctttccaactcatgtcgccgactgaaggccgtggattccacggttacgccgtatccgcgtcgccgtgccgcggcaatcacgcgttcggcgagctcggcgaaatatatctgggtgagactgggaatggccagggatatcagcccggttctccctgagcgcaggctgcgtgcccgttcgtcggttacatatcccagcatctcgatggcctgccggatgcgttcgcgggtagtctgcttcatatacgggtaatcggaaagatagttggacaccgaggtcaccgacaccccggcgagctgcgcgacgtcgcgcatggtgggggtgggtttgtcggcgacggccgatgtcgttctttcactcacaggtggctcttttctcgggtgggcgcccaccgtccggcggtgcgtttcctcccatcataacgacggccgtcccgttctcccgaaacgtcgaagggctccgtgtccgatgccggaacgcatcggacacggagccctctcagtcattgtgtggagcggatatccttactttgtcgccgagccagacgcggcggtctcggacaccagatcggcgggtgcggtctggtatccctccgcgccgcgttcgaccaggatgcgctggtattccttgaactcggtctcggtgtagtcgtacttcgtcagaatcagcagcttgagcagcgcgcccagcgccggcaggatcgagatcacgatgaacaggccgttcagcgtgcccgacgtctgcgcgacgttcggctgatagccgaggaaagtgagcgtcagaccggtcgtggcgccggcgagggcgatggccagcttgctggagaaggtctggccgccgaagaccacggcctccgcacggtgcccggtcttgacctggctgtattcgatagtctcggccagcatggcggacaggatcgggttgctcatcgagtacatgcaccaggtgatgccgatgaacacgaaggtcaatgtcgtgttcgagtatccgacgaagtagaagaccacgcggaaggcgatctcggcgatgagcagcacgcggacgaggttcaccttcttgtagcggcgggtcagcaccgggatgagcaggaaggtcagcgcgctgaaggtgccgatcaggccgaagccactcatcagcccggcgttcgacatgttgtaggtgaagaagtagatcatcatgttgttgaccatttccatgaagaacttcaggaagaagatcaccaggatcatcatcatgtacttgttcgccttgacggcctcgaacacctgcttgtaggagagcttctccgccttgtcggaggcggcgatgcgctccttggtgaacaggtagccgaactccatgatcacgaagcccgcgatcatgaggatcgacacggagatcagatagctcatcgacggagtgttgttctgcttgaactgcgcgagcatcaccggcatgatgatgccggccatggcgatgccggcggacacgccgatgttggcgacggtcactaggtcggtgcgggtctggcggtcatgcgacatcacggtggacagcgaccagaacgggatgtcggagaaggcgtagcaggtgccccacaggatgtaggtggtgccgcagaagacgatcttgccggccaccgggatgtccgggtcgatgaagcaggcgatcgtcgcgacgaccacgaagatcggggcgatcttcatccacttgcggaacttgccttgcttgctgggcttgcgggagtccatgaacccggagaccagcgggtcgaagacggcgtcccacaggcgggcgaccaggaagatcgcgctggcgaccaccgaggagatgccgaccacatccgtgtagtagatcaggatgaagctgccgatgatgccgtagctgaagcactgtccgaatccgtagcagaaatacgccacgtattccttgaggctcactttgtccgcattgctggatttgaccggtgcggctgccgttgccgatgtcatattgttccctttctctatttattggttcgattgtgaagggtggccatatccgcacccatgtcggcgctcgttctcacacctgcacgtagccgtaggtgtgcttgctcagcaacacctctcgtatgcgcttggggtcgaatttgtattcgtggtcgtggtcgagcaggccgttgacctcctgttccacgtcggaggtctgcgtgtagcagaagccaacgcaatagtcgatgtccatcacggcccgcgtcagggccgcgatctgatcaacgaccttgtcggggtcggtgatacgctcaccgtagccccacgaatcctcggtgtgaccgcccggctcataggccacgccgccgtattcggtgaccatcaccggcacgcgctgctgttcgtacccctggcagaacacgcggcggccgcccatcggggagggtgctccagccaacacttcgtcgcgacggccctgataggtctccagcagttcgtcggcatcggcgttgtagtcgtggatcgtggcgatgtcggtgcgcgtctgctcgtagccatcgttgccgatgaccaggcgcgagggatcgaaggccttcgcctgataatagagcgagttgacgaaggtgcgctcctgctcgctgtgggcgatgtcgaagacgccccacgactcgttcatcagcacataggcgaacaccgaggggtggttgacgtgcttgcgcaggtaggcgggcagctcgcgctccacattggcgatgagctccgggccgaattcgtaggcgctgggcatctcggcccagacgatgaaaccgagcttgtcgcacaggtagagcatgcggttggactcgagcttctgatggatgcggttgccgttgaagcccatggccttcatcttctcgatgtcggcgcggaactcgtcggcggtgcccgtcaatcctccgcccgggtaatagccctggttgagcagcagcttcatgtagtacttctggtcgttgaggaagatcatcttcccgtcgctggttacatcacgcagaccgaagtagctggacacctcgtcggtggtctcgccgccggagcgcacggtgaagtcgatgtcgtagaggtccggcgtcgagggcgtccatggatgcggttcgggggacgggtcgtagttgcggatctcgacggagaaccgggcgcgcgcgttggtgaaggagacggtgccgtgcgtgaccggcttgccttcgaaggtcacgttgtagtcgagctccgcgtcgacgttgacattgagcgaggcatccacgtcgaggcgcgcttggttggcgtgcggggtcatcgtgaagtcggtcagatgcacgtcgccggtctcttcgagccacacgctctgccagatgccgatggtgcgcgtgtaccagcaggcgaagttgccgtccttccatgcctgcttgccgagcggttggtcggtgcggttgaaatcgacgaccttgacgaccagttcgttttccttggccgcgtaaggcgtcacatcgaagcggaagggcgtgtgtccgccttggtgcgagccgacgtgtcggccgttgagccacacgtcgcaggcatagtcgacggcctcgaagttgagcaggtatcgtttgcccgggcgcatgtcgaggtcgaaggagcggcggtaccacacgacggggtgatactgcggttcgtccacgccggacttggggaaggtgtagctgtagggcacctcgatggtgcggtcgaattcggggaaggccatcgaggccgcggcttggagggtctcgggtgtggactccatcgcgttgttgccttggttgccgttcttggtcccggccggtgcgccggggatcgcgaagtcccaggtgccgttgagatcgacccagttgcgtcggacgcattgggggtcggggtattggattcgctccattgctttcctttctctgtatcgtttcacaaaaacaatgtcgttgtctttgtgattgaaagtactgttatcgcactactttgtcgcagtcacttccttgttgacgcttctattctgtaacgtttcagaattgctgtcaagtgcgggacgccgttattgttggaatttgttcccatttatgctgaaatgtgtcagcggtagcatatttaaccctatagccgatggatttatcaaaaaatcgatgaatgcggcaaggtatgaccgtcttggctgacgtaagctgaagccacaacagaagaacgaaccaagataaacaggccgcacgaaaagaaaaaggcctttcgctgtttggtgtgggtgggagccggtcaggtggtgacggttcgtaggtcgagtctgccgcaggtcaggtagatcatcgtggagaagtactccatgttgcggaagccccgggcacgggtcttgacgtgccggatgacgctgttcaggccctcgaggaccgcgttggtgcgccggtggtcgaaataggccaggatgtagtcccaatggcggcgcagctgtcgggccagggccttcatgggctccagccgtgaatgcatcatccacgagcacagggccctgaacccggcctcggcctccgcgcggctggcgctgtcggcgtagatgtcctgcagggtctcgcgcatccggcaggcccgggcggtcttgagccgctgtttttgcaggccgcgcttggtctccaattggagttcggtcaggctggactcgttcccgggccacaggtatttcgtgcgtttgagcagcgcgttgtgcccgccctcggcctttctgaccctgtcgacggagcttgtcaagttatttgtgtttggggtgtgttttataaataaggttccattcgttcggggtatgcggccgcgagttgggcgagggcctgtttccagttggtcgtcatgcgcccctcgatgagccttccctcgcttttgcgcctggttttgttgccgtctttggcgcgtttgaggctgcgtttgtcctcgatgtcgcagattgccagccagaacagcttgaccacggcctggtcgttggggaactggctgcggttgcggctgaccttgcgcgactggtagtcgggcgattcgatgctgttggtggtgtacgccacccggcggagcatgggcgggaaccgcgggaacgggacgaaccggtcccacgagcgtttccacgtggcggccaccgacgggtatctccggccgagctcgctttccgcgaactcgccgagcgccttttccgcggcctgcccgttgggcgcgcggtacacgctcctgagcgccgcgcacaccctcttcctgtcgtggtcggcgacgaacctgttggccgcgcgtatcgggtgcgccacgcaggtccgcgcgatcgccttgggccacgtggcctccacggcctcgggcaggcccttgagcccgtcgcagcacacgatcagcgcgtcggccatgccccggttggccatctcggcgcacacgtgcgcccggaaggaggcgccctcgttgtcctggacccacatgccaggcacatgcttgaacccgtccatgtcgacgccgatggcgatgtgcgccgccttgggcagcactctgccgttgtcgcgcaccttgaccctgacggcgtccaggtacacgaccggataggactcgtccagcggccgctcctgccattcgagcacggcgtcgctcaccgcgtcggtgatgttggatatcgtctcggggctcaggtccgtgccgatcgtcttggcgaggtggtgctggatgtcgcgcaccgtcatgccgcccgcgtacagggatatgatcatctcgtccagtccgcccagcctcctggaatgcttgggcgccaacctcggggtgaacgagccgtccctgtcgcggggaacctgcacggccgcctctcccaccggcgtggacggcgtcttgggatacgagccgttgcgcgagttcgcatgcccgccgcccgccttcgactccctgtcgccgggcgcgtagcccaggtgcgacgtcatctccgtctgcaggccgcgttccagggcggccctcgtgagctcgcccggtagtccgccgtcgccggtgagctcgatctgcccgccgtctatccgttcgaacagggggtccagcgctcccgacgcgaccagcgagtccaccagggaccgcgaatccgtcacggcaccattgtcgttcccggccacatcgccggccataggcttcactgcctcggtcaccatgatcgtttcctttccatcagatgatcccatacacaaacaattagacaccctctcagaatgaccggccggcgtttttcgtcgcctccaccggcagcccggtctgcccgagcatgcccggcgtggtgttctgccgcgtctggacgcaggctgggcttgcgtggccgaaagccggcaaacggcccagaccctatgatttccggcatcggctcgcgttcgcgaacatcgagcgatgggctcgcgacggcatggacgtgatggcgatgctgccctacctggcggcctacatgggacacgccggcatcggcagcaccccctactacgtgcacgccggccccgatttcatggacgggtacgcggatatcgtcgccgacgccgaacgagtggtccccggaaacggggggaccatgaacacggcaagaccgatgaacaccaggccggacgaaccggatttctggcgtgtcgcgcgcggctggctgcaccaccggctttcccgcgtgcgcggcaactcgccgaagaccgtcgaggcatgccgcatcggcctggaatcctacatccgatggctcgagaccatggaaggcgtggaacgcgacgacatcgggttcgggcatttcgaccgggcgcacctgggccggtgggtcgaatggatgcgggccggacgcggatactcggaccgcaccatcatgctgaggatgacgacgatgcgcgcattcctcggccacgcgagcctcgagcatccgacgttgaccgcattggccaacgacgcggccggcatacgtgtcagaccacccgcgcgaaaacccgtcgaccacctcggggaggagcacaccaaagcgttgctgaccgcatggggcaccggcgacgccaaatcgcgcaggaaccgcatgctcccgatcctcatgtacgacaccgccgccaggatcggcgaactcgccgccctgacactcgaggacgtgaggatggacgagccggccaggatcacgatcacaggcaaacgcggcaagacacggatcgtgcccatgggagaaaggacgcgacgtcacctgacgtcctacctcgacgaattccatcccgacacggacgggagcgacggagccagaccgttgttccactcgacgaggaacggcaccatccgcccgctctccgtggaccggatcgacgagatcctcaaaaccgcggcgtcaaaggcacgcgggacgtgcccctccatgcccggacgtatccactgccgcctgatacgacggacccgtgccatggacctctaccaacagggcgtgccactgccgaccgtcatgcaactgctcggccacgaaagcatgagcaccaccagcgcgttctacgcgttcgcgaccctcgacatgatgcgcaaggccgtcgacgcggccgaccccggccccgacccgccaaggagacatggctcagcgaacaacggctccgacagctccgcaccctcaaatagccagaaaacgttaaaccgggaaacaacacggaatgcggcactcccaccacaatcccgaaccgtttcccggcttaacaacaaacccggcttaatcactgttaaaccgatatcggtttaacagcgacatgggatggcagtaccagcacccatggtggcgcgaggaactcgaacgactgaacatccgccagtcgatgagccgcaagggcaactgcctggacaacgccgccaccgaacgggtgttcggccacttgaaggacgagttctacaggggacgggagttcgactcgtacgagcaattcaaggccgagctcgacgcgtacatcgtgcactggaacaccaaacgacgccagatacgactcgagggacacactccggaggaattccggaacatgtccctcacagcttaaaccctgtatcctgatatacaacgtccaacaaacgtcgagtatcgcacaaggactcgaacgggagtattctcgatatcatgagcgaaacgagcagcgactggcaaaagaccaccattgattccgcccaagcggcggctcacccggaaaccgcgcaggcggtggcgcgcatcaaagcgctgcgccaaaccatcgataacatcgattcggcggccatcgcattactggccgagcggttcaagaccacctcgcaggtcggcgtgctcaaagccaacgccggattcgcgcccgaagacaccaagcgtgaggactatcagatcgagcgcctccaccgcatcgccatcgatgccgggcttgatccggaaattgccgaaatgtaccgtgaattcgtggttaccgaagccaagaagcgccaccagcgcatagccgatgccggtggcgacccgggcgtactcgacgtattcgcctgattcgcccgcagcgaatgggcacctttcggatattcgtctatagggcaagttgcctgcagcgactacattaatacgggaatggaatgcccatagtggccgactgtatgaatgggatacgtagatgagatgtggcaccgcactggtcagttgcgcattgtgcgtggcttcgattctcggcggtgcttggatgtctcgtccgactccggttgattacggtccggtgctcgctacggcaagtgatatgtacgccgtcaccgatgccgaaggggagccggtccgttggtatgtggtagggaagggcggcgccggcaatggcgccagtgccgattccggcaatagcggttccactgataccgattccgccaatagtgattccggcacgtccaaggtttctcgtgtccccgcttccgccgccaccctgccatggaaagtcagcgtcacctactcgcttgacggtccgaacgtcgaggcaaacgaggttgccggcgcgtctggactgatcggcgtgtatatcgatattaagccgcaaaccaaggaggccaaccgtacgatcccggttgtcgcctttaccgtgcctacgcaggtagccgatgatgtttccgctgacaactccattacggtgaccatgcaaggttccaataccgtagtcgctgcagctggaaaagccgcaaccggcttggaattcagctgctatatgaacgccaaagacttctccatgagttccgtggcgctcgccgtattgccttccaattccagcagtccggcagttggtgctaatcccgatgccgcgaatgctgccgcacagcctgctgccgatacggatgtcgcccaactcaccgcctctgccgccacactggtcgatgcgctgaccgacgccggttccggtgaacagcaacagctcatcgagcagcttcaaaccctgcgcgataacgagcgtgcgctgaacaagtctgtagtggccgaacgcgaaaccgcccataagcggacgtttgaagactatatggccgcgtatgtgggctcatataccacgcacctgtctggatcgattggtacctccacccagttgccggcgttgatgggcacggccggcgaactatccggggacacgcctttggctcaagccgtactcgacttggccaacgcggtgaacaacgtcagtgccgcacatcagcatgccggtgcggtcgatgcgttggacgaggtgattcgccgcatccagcagcaaggcaccagcggactggtggatgatctgaccgccgaggcttcggaggaagccactcgaggctccaaacaatacgccgatggacagagccagctctccgccgcaatgattccgtattcgatgaaatacacggacttctatacggccaatttgagcgccctgaccggtggcacgtcctcgggcgccaccgcttacgagagccaagccatcgccgaaaccaacggtagcgatgaactcgccgacgctcaatccaaggtcgatgccgcgatgagcacgcttgccaccgcctccgagcatacgggcaaagccacggccttgcgccagattgtattgcgattctccgatcagttcgaaggcggcacgtcctcggcttccggcagtgatggtgatggctcgtccggtgatgtctcttccggtccggtgaccgaggctcaggcactgactagcctggtcgattcgcaatcgcaatcgttctacggtaagacccgggccacccaagccaagcgtaaggccgatgccgcccgtaagcaggccaaagccgtgcaacagcagcagtcgcagcattccaaggcctcactggtcgatgacaccatgtccatgtctgctggcgatgtgatgaactatgcgggtggtcttacttcggccatcggtggtggtgataagtccgactcgtctaagagcgctggttcgggaacgaacgactcagccaagtcgagcgatactgacgattccggcaacaatcttgacaccgctccagtactgttcggttttggcactggcggcacgctgctcaagcacgatatgaacgcgctgattaatgagaccgtgaaaatcagtgatgctggcacgctcttggcgcaggccgtcgcgcagctcgacagccccaatacgcaacagaaaaccgccgaaacccgatatctcatcgtgattccgacggtgtgatggtgtatgcgggaaaatccgcatgggacaggtgcccaatacgcgtaaagtgcgttatcggtgtgggacgccgcgtcaaaaactggctttttcgatgcggcgtcccacaccctcttgtaagtcagagctaactatagtttgaagaatggctaaattccaaggatctgttgatttggtctgtgggacgccgtgtatataaaacgtttgacacgcgtggtggcccacgctattgtgggccgccagcttacaatgcgggatatttgcgtgccgtcccacagtcgtgtcatccgaacgtcaaaaaacaaaagaggggaacctcaataggaggttcccctcttttgctgctgcgcgcaacgctcagtgctttggcttcttgactggtggctcaccgagctcgctggcttcgacggcgacctcggtttcgggcgcgtcttcggcggcggattcctcggcgtgcttggccaccaagtcgaacttgccgaccacgcgaccggcctgcgcgatatcgcccaaggcggcgtgaatcgcgtccacaccttccgaagcagcggacagcgccacggacaggatcggggtcttcatggagaccttggcctcggacttgatcttgcgcaactgctcgacggccttgcccgcccaagtcagcagctcgggggaagcaccggtggcggcctcgacatacgggtccacgaccggccaggcggcgcgatgcacggaaccggaaccggcgtgcatccagctccacacttcctcggtggcgtacggcaggtacggggccagcagacgtgcgaaagcgtccaggcccagacccagagcggtgcgggcggacttcacagccttctcggacggcacattgccgtgctcgtccggagtgccataggcacggttcttgaccagttcgatgtagtcgtcgcagaactgccagaagtaggactcgatgacttccagcgccttggaatgctcgtaggattccagcgcctcggtggcctgacgcaccaccacggccagcttggccatagcggcgcgatccagcggttcggtcacatcggccgggttccacgcggcctcggcggcggcacccacatgatggttctcgtcctcgcggccgatggccagcgcgaacttggtggcgttcagcagtttgatggccagtcgacggccgatcttcatctggccgatgtcatacgtggcgtccaggcctaggcgggcggcggcggcccagtaacgcacggcgtccgcaccgaacttctcgatcggctcgttcggcaccacgacgttgcccttggacttcgacatcttcttatggtcggggtccaggatccagccggacagcgtggcatgggcccacggcaggcacttgttctccagatgcgcgcgatcgacggtcgagaacagccaggtgcggatgatgtcctgaccctgtgggcgcagatccatcgggaaggtggacttgaacagggcctgagaagcctcatccggctcagcccagtgggtcacgatctgcggggtcagcgaggaggtggcccacgtgtccatgatatccttctcggcggtgaagccgccgggcacatcacgctgggactcgtcgtagccctccggcacgtcgatggtcggatcgatcggcaggcgatcctcggacggagtgatcgggtgatcgtaatccggctcgccggaagcgttcaccgggtaccacagcgggaacgggacgccgaagaagcgctgacgggagatcagccagtcgccgttgaggccgtgcacccagttctcataacgcacgcgcatgaagtcggggtggaactcgagttccttgccgcgctcgataagctcggcgttcagcttggcgtcggtaccgccgttcttcaaataccactggcgggaagtgacgatctcgagcggcttgtcgcccttctcgtagaagttcgtcatacgcttggtcggggtcggctcgccgtccagatctccggactcgcgcagcttgtcgacgatgatcttgcgggcggagaacgtggtcttacccgcggtttcggcaaagacctcgcggccggccgggtcctcgatccagtccggggtatccatcacgatacggccgttgcgctggatgatcgggcgggtgggcagcttcaggtcgcgccaccactcgacgtcggtcacatcaccgaacgtacagcacatggcgatgccggcacccttgtccatttcggcggccgggtgcgccagaatcggcaccttgaccttgaacagaggggagtagacgtactggccgaagtactgcttgtagcgttcgtcgttcgggttggcgatcagcgaggtgcaggccgccagcagttcggggcgggtggtctcgatgtagatcggggtgccgtcctcaaagcggaaggccaccttgtgatagaagccggggtattcgcgggactcgagttcggcctgggccacggcggtctggaaggtcacgtcccacagaccgggggcgtcctgctggtaggcctcgccacgggcgaggttgcgcaggaaggccttctgggccacacgctgcgggtgctggccgatggtgtggtaggtctgcgaccagtcaatggacagacccagcttgcgccacagggcctcaaacagcttctcatcctgagcagtcagacgctcgcacagctcgatgaagttcttgcgggaaatcggcacctgatccttggcgtcgatcttcttgccatcagtgccctcgaacggcggcttgaagtcggggtcgtagggcaacgacacgtccacgcgcacgccgtagtagttctgcacgcggcgttcggtgggcaggccgttgtcgtcccagcccatcgggtagaacacgtcgtagccgcgcatgcgcttgtagcgtgcgatcacgtcggtgtgcgtgtaggagaacacgtggcccacatgcaacgaaccggagacggtgggcggcggggtgtcgatggagtagacggccttgcggtcgcgggtattgcggaatttgtaggtgccgtcttcatcccagacggctcgccacttgtcctcaagtccgtccacaccgaccttgtcgggcagcggggtgaggttggcgttgatgatggatttgccttcagtcataaagccaaagtttatgcacgttgcatgacaagccgaactgtacagtaaacagcccagtaggctgttcgcaggcgaggtacgaacgatcgaacgatagtgagccaaggactatcgggcgtagcccgtccgtgactgaaggttgcctattccaccgtcaacccggccagcggcatgcggcgattgatcatcgaggtcgggtagccggagaccttggtggacgccacagtgaagcatttgcgggtatacagccaatcactggccgcatcctcgctgatcagccgggcgtacgccttcattcgtgcctcataatcggcgtcattagtggcggcgcgagcatccgcataggcctgttgcgcttcggtatggtcgtaatggaacatggaatcaggatcggcgaatatgccggcatcatccgtgccgtccatgctcatcacggtcagttcccatttgccgtccttgattcgtttggcataatcctcatcggagagcacttcaaggttcaccatggggcgcggctgccgctcgatctgctgcttgatggtttcggccaacgaccggtattcttcgggaaccaccagattcaccgtagtcagatattgcgcgccgaagtaggagaacatctgcccggcttggttttcgtcatgcgggtacagtccggtcagatcttcgtatccgggttccagcgggctgatggggccgcccaatgttccggctgcgtcgggttgggcggaggcgatgccggctgcgtcgatttgatagcggaaggctttacgcgcctgttcgtcggagagcagcgaatcggtaccgttgttgtaggccagcagcaccttatccgtagtggccccctccttgacggtcaggccatccttgccgttcaaaccggtggccgtcgaagccgaaaccggtgccgccatatcgagactgccgtcggtcagggccttgctgagcgcatcggcgtcggagtattgcataaattcaatggcctggctgaccgttttggtgccatggtaggtatcgctgcgcgccagcttcagggaatggccaggctggaaatcggccacgatgaatggtccggaacctatggccttgcgttgataatcggcactggacgactcggaatcgtagacaatgccgagtctgccggacagcgctcgcaacagcgtcggattgggtttggcaagcgtgatgaccaccgtggcggcgttcggattggtgaccgacgccagatcgcccaattcgtcgacgtccgccaccttgttggtcacgttctgttgcaacgaccacacggcgtccgaggcgtccaacgtatgaccgttcgagaaggtgacgcccgattgcagtgtcagggtgacggtcagtccgtcatcggaagtcttccagcttgtcgccagtcccggctgaagcttgttgtcttgatcgacggtcactaatgtctcatacacattgtcgatgagcagacgttcggctgccgcagaggaatcggaccgaatatccaaggattgcggcatatcgccgatgccaatggtcacatcggcatcgagaggcgatcccggctggaaccggttttgcatgaacgtccatcccacaaccacgagtgtgccgagtgccacggcgactccgagaaaaatcccccacttggaccatgtattgttccgcttgctgtgctgcatggtcttcagtctagcggtggactcagcctagaatccgcaattcaccatgatgggcatgagctagtgcttggacgtgctcttgccggcgggcggcgcatagctagggcaggtgtcggacagcgggcagttggcgcagtcaggggtacgtgcatggcatgtggcccggccgaacagaatcagtcggtggctgagattcgtccactcttcgggcggaaaacaggcggtgatttccttctcgattttcacgggatcagggtgcgcggaccgccaatccgaccgccaacgcagtcgtccggttacgcgcatcacatgcgtatcgaccgggaatccggggatatcgaatgcgttgccgagcacgacgttcgcggttttgcggccgacccccggcaagctggtcagtccatccatcgtgcgcggcaccacgccgccgaaccgttcgtccagtgccgtggccagtccgatgagatgctgggttttcgaacgatagaaccccagtggatgaatgatgtcttcgacttgggccggattcgcggccgccaagtcacgagcggtggggaaggtggcgaagagttcgggggtgaccgtgttgacgcgcttgtcggtagtctgggcgctgagcacggtggcgatcagcaattcgagcggattcgagaaatgcagtgcacaagctggtgccggaatcacttggcgcagaatgtcgtattcgtcatgcatgcgcgtgagacgcgcggatttggtttctctcatcgtatggatctaagcggcgtagtgtcgatgattgatagtttgcagcgctgctggtctgtcaggcggcggtgttgagatcgggagtatcgtcatcgatgtcgatggcggcagaggatgctttggcggcctgctgtgcggcggcagtttccttatccgtctccggcgggtcgaatcggtagcccacgttgcgcacggtgccgatgaggtgttcgtattcaccgccgagcttggcgcgcagacgacggatatgcacgtcgaccgtacgagtgccaccgtagtagtcgtagccccatacttcctgcagcaactgggcgcgcgtgaacacgcggccggggtgctggaccaagtacttgaggagttcgaactccttgtatgccaaatcgatggggcgtccatgcagggaggcggtatagccgttggtgtccacgatgaggtcgccggagcgaatctggccatcttccaccgtggtggtggattcggcgggagaaccggctgctgcggctgtgggagcgttgccgcgctcggagaccaatcgcaatcggccctcgacttcagccggggaagcggtggtgaccaccacatccgcaatgccccactgggagttgaccacggtgaagccgccttcagtcagcaccagtacgatcggcgtggataggccggaagcgtggatgaggcggcacaaggttttggcggtcgccagatcatcgcgtgcatccagaaacagaatggtgttctccggcatcttcaccaagctggctgcatccatcggcagtacacggacgcgatgagaaagcagggcgagtgatggcaaaacggtggcggggtcgctggcgaaagtcatcaacgtaagatccgtcacgctaatccccctttatcctgcaatgtgttacgcaattgcttggtgtggccgtacgagtcgtcagcggcgttatgccgctttcgcaaagttttcattattctacgcgcttgtagtggacacataggttacaagtttgcggaatatggaacggcggacgtccatcaaccgatgatacggccgagcaccagtgcggttgcggcgatggtcacgcccatcagcatcaccggcatcaggccggtgccgatccacggatagcggatatccgggtccggatcggcgtcgcgcacccacaacgtggaggccacggccaaggccagtcccaaaacgatgaggatgatcagggcaacggttcccgcaacggtgcccttggcaagcattgcgcccaaatcaggcaggaagcaccagccggccacggcgagagccgccacgccggaagtcacggcgtgggacagggcacggatgagatggtcccgcttctcgcgggccatctgacgtccgaacgagaagaccaccagcatgaccagcagcaggcccatggccaacgcccacgaataccacggaagcgtcgaaccatccgcggcggtctggtccggcggcaccttgccggcggggaacggcacggtgacgaacatcagggaggccgcgccgaacagcaaggtgacgacgcgatccagcatcgtgccgcgcaacggccagaagacaaggaacacgaccagcgtcaggcatgcgacgacccggggggcggtggggtcggcgccgggcagggtgacggccgcggccgcgatgagcaatgcgtaggccgacagctggaccagcagcatgcgcagaaccttgttcttgcattccttccaggtgatttctgtcatggtacgcctctcagataatcgaatcgctacgtcaatcctacgtcgggcgttggaacggtgccgtcgagcattgatggccatccgtggcgacgagatgcgtgacggcaagtcagaacgcgatgacgcccagatgctccaacagcactttgacgccgatcagaatcaacaccacaccgcctgcgatctgcgcgggtttctgccagtgagcgccgaaggcgcgcccgatgtacaagcccgccgcggagaagaggccggtcaccacgctgatgcagaggatggcgaacggcacgctggttgccatgaacgccagactcacgcccacggcgaaggcgtcgatgctgcacgccacggcgagcggcagcatgtgcttccagtcgaattgcgcggtctccttggcgttctccgcgtcctcctcgtatgcctcatgcaccatgttgccgccgatgaacgccagcaaaccgaagatgatccaatgatcgaatgcggttacatacgcgctgaatgcggaggccgcgtaatgccccagtatgaggaagagggcctgggagccgccgaaccagagcgccgatctgacggcatccccgggtcttacgcgggagacggtgagccccttgccgatggagacggcgaacgcatccatggcgacggagacggaaatgagcagggtctgaacgattatcgcaatcatgatgtgatggaaggttcatcgcccgaactccagacgatgggcctcgaccagcgttcccacacgccgcctacgcctagctgaaaaatacaccagcactatatcacgcgatgcacgtcgaaccaaaaaggcgggagacctccggagaggtctcccgccgacgattcggaatcgaatcacttgccttcgttcgcgagacgctcacgcgcggcaatgatttccttttcggcggcgtcagcaccggtccagtagtcgcccggcaggacttccttgcccggctccagagccttgtactgctcgaagaagtgcttgatttcggccttgtggtactcgttgacgtcgtcgatgtccttgatgtcatcgaaacgaacgtcggcgggcacgcacagcaccttgtcgtcgccgccggcctcgtcgaccatgtggtacaggcccacggcgcggcactcgaccacgcagcccgggaacacggagttcggaatcatcacgagagcgtccagcggatcgccgtcctcgcccagggtgccgtcgatgtagccgtagtcatccgggtaacccattgcggtgaacagggtacggtccaggaagacgcgaccggtctcgtgatcgacttcgtacttgttcttggagccgcgcggaatttccacaacgacgttgaaggtttctgccatgtcatttctccttgaaaatcgacagttacgttatcgtctcaccacaataccctgtttgcgcctgcaaaacaggtgcggaactcaagaaaccgtgctgagattatgccgacactatgtctaaacagacgaaatcctcccgttgaggggaggatttctagcggtttacacgcacgatatacccgtgcgcgtaaaccgcatcactgttgcattaccgttgcactaccgcatcactgcacggacaggatgtgagccacatccgcccaaggcgccagagacacgtagttgtcccaaccccactggaattcgcggccggtcagctcgtcgcgcacgttgagcgggcggtcggtgggcagacccagctcgccgagttccaggtgaatcatcgactggtgtgcgttgtgtccatcgaggttcacgaccacaatcagcgtgtccgcttggccggtgccggtcagttcggccggcgtgtggcgtgcgaaagccagaatattcgggtcggacgtaggcagcacggtgaggttgtggtagctcaacgcggccgggtgggcgcgacgaatcttgttgagcgcggtgagcatctcggccacgccgtactgcttggccttgctccaatcgcgaaccttgacctcgtacttctcgttgtcgatctgctcttcgaagccggggcgctgcttgttctcgatgagttcgtaaccgttgtagataccccaggacggcgagcccatggctgccagcaccgcacgcacgcagtggccggctacgccgttgtctcgcatgtaagcggtgagaatatccggcgtggtgggccagaaggtgttgtgctggtagtagccgtcgtcgccattggtgaccggcagatactcttccagttcgtccttggtgttgcgccacgggaagtagcagtgggactgggtgaagcccacgtagctcagggcgcgcatcatgcctgggcgggtgaatgcctcggccaggaacaacacctcggggtgcttcttcgtgaccgcggcgatcacatcctgccagaaacgcaccggcttggtgtgcggattatcgacccggaagatcgtcacgcccgccttgatccacaggtccatgacgcgctcgacttccttttcgatgcccgccatgtcggcgttgaagtcgatcggatatatatcctgatacttcttcggcgggttttcggcgaacgcgatggagccgtccggcttgtgccggaaccagttcggatgagccttgacccacgggtgatcgggcgagcactgcagggcgaaatcgagcgctacctccagtccgagttcgtgcgcacgccggcatagggccttgaaatcgtccatggtgccgagcagcgggtccacggtgtcgtggccgcccagctcggagccgatgccgaacggtgagcccgggtcatcggggccggcgaccagcgtgttgttgcggcccttgcggttggtcacgccaatcgggaagaccggcggcaggtagacgatgtcgaagccctcggcagcggcgcgttcgagaccagccatcgaggtcttcagcgtaccctgaatgatcttgccggtgttcggatcgatggtggcgccttcggaacgcgggaagaactggtaccaagccgcgaagctggacttcgggcgttccaccttgaaacgctggggctgactgggggagataccgtcgcgcagcgggtgagtctcgtgcagggcggcgatggtcgggttgtcgccggcggcgagacgatcctcggcgctcagcgtctgatcggccatggtctcagcggccttctccaaggtcttgcgatcgcgtgcggtcaggccggcgtccggggttgcggaccaacgggccagcagctcggcaccggaattgagtgcgttgtccacgtcgtccatcacacgcaccttgatacgggcgtcatgcagccaagaaacgtacgtgtcttcccaaccttcgatggtcacggtccattcgccgagctgacgcttgacggccgcgtagccatcctcccaaggcttcagatcgctgtgctcgccgcacttgaccatcacggtccaacgatcgaggccgggatttatacaggtcatggcctggcgcatggtttccttgccgcgcgggttgcgcacgatggcggtggcacccaccttggtgcggccttcgatgaacacttgggcggtcatctcaaacggttcgccgagttccacgcgggcggggaagatgccacgctcctcggcgggagtgatgtccatgacattgatgcggccgaactggccgggctcgtttgcttcgatggacggtgcgggggcttcgacagccaggcctttcagcactgctgcggcgcgtgccgtttcggcgctgactctcttgcgcttggttgcggggctctttcgggcagaagtcgcctttgacttcgtcttcgtggtgttgttatcggtattactagtgcgcgtggtcgcgcgatgttgtactgctgccataaggccctattctagaggcttttgaacatatgttgcacattgtggataacttgcaggtaaacgttcggtcaaccgcatgaggtggataactcggcggaagagttatccacaactcgccggcaaacggcaagctcggaccacataggccgaaaaaccggctgtagcgaatgaaaatctgccatgatcgtggcctacccgcacacagtgcagtatgcggggaacgtaccaggaaaggacgaatgatgataacgacatggcggcaacggggcatggccatcgtagcgatgctgaccggtctgataataatggtgggagtggtgttcggctcggcgaatacggcgtatgccgcgacgttgacgcccgccgacgaaagatatcacgtgacgtttccatacaacgatatggaatattacgtcggtgtcgcggggctggacgcttcgggcaacaaatactactgcatcgaagcggggaaactgagcgactatgtgataggccccaccacggtgcttgcctccgatgagaacgcccggcgtatggcatggatccttgaccggtaccgcgacacggatgccgccacccatgcggcgatcggcatcatcgtgcaggatcacttcgggcgcgatcgggacgagtgggcgagacagatggcggtcattcaaggccggtatcccgagatcgtggcgaaggcggcccagatatgggatcaatcggccggcatgacgcctgcgggcacgacggtggaacgcaccgatgccgaggctttgcgcagcggttccatcttggtgaaagtggtgaaccgcgtcggtgacgcgatcgcgggagtgccgttcaccgtcaccttgcaggggccggcgcggttcgtccaaggcggcaacacgttctcgggggtgtcgacgagcgccggatcctcgatcgcgtgggaggcgaccggtgccggcgaggtgacggcgaacaccacatacgagtatgggcggatgcacgtcatggacagcactcaggacatgctggccttcgattcgatggcttccgtcggcggttcgtcgtcgacgttccaggtgcgcaaggatttcgttccgtcggtgtccacgcaagtgtccgataaggtgcttgatgcggcttcgccggtgttcgatgatgtgaccagcggcgtgggggacgagggcagtcattgggtgcccggtctgaagctgcaggcgcgtggatactatttcgacgggctcggcaaggacgatctgggcaaggtcatcgcgccgaacgcacgggagagcgcggacgcttttctcgcccggttggcgtcctcgggtcataagccgagtgcttatggcgaggcgtccttcaccggtgtggggcaacgggttcgtgtgcaggccatgaccaagccggacggtgacgccgcctatctgactccgaagaccggcggctttggcacctgggtgtgggtgttccggcggagcgagcaaagcaaacgggcgcaggaataccttaccggcgactgggtgagcccgttcatggaggcttcggaaagcaacgtggggcgcgggaaggtcgaagtcatgtcgacggttaccgaacattcagcggatatcggcgccgaactcagcgacaccatcaccgtatcggggttcccggcggaccacggccagttcatgggcgatgaaacctatggtttcacggcggatcagccgtatgcgacggtgagtgtatggtggtccggcgatcccgacaatccctccaacgatgaggcgtacaagccgtccgggggagaggttcccacggaagacgacaaccaccggttgctggccacctgggagattcccgcgatgaacggcacgttcaaaatcggcgccggggcgttggacgcgcatggcgctcccatgcatctgaccgccgaacggcatgggtggtacgtgttcgtctggcggttcgagggggatgaccgtgtttccccggcgtccagccggtatgacgatgcctgggagcgtgtgcgggtgcttcccccatgcgagccggagaaaccgtgcgaaccggagaaacccgagacgccgccggcgccggcggagacaaccacgcccaaccctcgcccgtcactgcccgtcacgggtggcgatgtgtcgcttgcctcggttctggccgtgtcggtcctggcgataggcgccatactgtccatcgtcgttcggtggcgtcgtcgctatgaccgattcaactgattttgccgaggattcccccgcctcttagcggaagcgtgggcgggggatgaatcggctttccttttatgctataccggcattcagtcgtacctatcggaagcgaggtgtttgctgtgaaactcgaatcgaatcatcattcggtgttcctcatgcattatcatctcatactcgtcgtgaaataccggcgcgaagtgttcgacgacaccataaataacattatattgtagtgcttacttttgcaataatactatttccaaggagatgctatatggaaagaaatttaattttgattgattctataccaactgtcgtttggggcaaagaatcagaaaaaatatatatttatgttcatggaaaaaacgggaacaaagaagaagctctttttttcgccaatattgctgaaagaaaaggttatcaaactattagttttgatttaccatctcatggtgagagaaaaaataaagatattgaatgtaatatatggaatggaatacatgacttagaatgtatctggaaatatgttcaacgtaactgggataaaatttatttatatgcttgcagcataggcgcatatttcagtctgcacgcttataagagcagaaatattgaaaaatgtctttttctttcgccgatactagatatggattatttaatacataatatgttttcatggtttgatgtaagcgagaatgaattaaaggaaagacaaaaaatcgaaacaccgattgaaactttatcatggaaatactaccaatatgtaaaagagaatcctgttcaacactggggtataccaacagctattatgtatggcagcaaagatatattgcaatcaatagaaattgttcgtcatttttcaatgaaatttaattgccaattatacatatcaaaagaaagcgagcattcatttatgagtgattctgatagaaaaattgtaactgattggatagagggaagtatttgaatctcttattttgtataaatctaaaccaatctaatgcagtctaaggtaaatatggagctatcatcatctatcaagacaacgctcaccgatggtctttgccgttcatgcggtcagcgcggtggcttgcacggcggccctgagccggtcctcgggcatggcttcggccgcgccgcccaaggggaactgtgcggccccatgggatcgcgacagggaggcgtgcaagggtcggaaacatggtcgaacgcgtcttcaaccgcatgaagcactacagcaaggccgccacccgccacgacgggctcgacgaggcctttctcgccgacccccggtccatcctcagccccatcccacctgaaaaaacgcggccaaaaacccaactagtgtaaacataggggagaagcccgtcatttctcataggcaattccctccatttcccgttgtagctgccgcagggtacgccggatatggtagcctgctgtggttctgaatcgtccgtaatgtctgccgatttcttcctgtgtgtacttcttaaaaaatccaggtaaatcatttcccgtttcttctctggcaaccggaacatggcagcaacaagggaagcgttacaaaaggttactgtctgcccgcagattgtgacgggatattccgtgtccggttccggggagggaaaatattcatcatctgtgcttaaaggatagtgcttttcatcaaagaaatattcaaggaatatttcttttcccgtcttttgcacctttgccgtcctgcgtcaattgctgcatggcgtatgacaatcttacagtaggcgttgaacgtatactcgatatattcccggtatgcttctgtatcggtcgtggaaattccctccccttcctcctaaaagggtggtacttggtttaaaagtttttgtatgatagagaggggcggcagcactttttgctgtcgccccttgactgcccataagcgaaaacaggcgagattgtcaacggcggctcgcagagccgtttatcttgaccgttgactggctcgactggttttgctaaccgttcgacaaactggaaattatcaaacaggggctgtcaattcaatatgattcccctctgaatcaataaactctactacccaattagtgtttatttgcgtcaacggaaaacatagttctaaatcttcaattttatttctaagaatttctaaatctgcaacatcaatactgggtaagcaattactaccaaaactgtgattctcattcatcttttcaaaagcaaataaaccgaaacgaaatccgtttatatcaaaaacactataaatttcgttttttatagtcacttctttttcaaagaaactctcataaaaacggattgctctctccatgttcttaacgcatagatatagtgacttaatatgacagtccaatatttcctcctctcagaaccctgatttgtcttttggtttctggttttattttatcgcataaatattaacttctctatgaattttcccttatatttttcggaatagagggatagctgcctatcagattttagtgtgttactttaccgcacatgagcattggaacctgggttgtccgatccatagccctccagcagattgacaacgccccacacgccaagtccagcgccgagggctacaacaagagcctgcgaagtatcaatagcggaagtgaaaaactacatagagcctccttttctccgggatattcccggccatgaaaaaagccgccatttctggcggcaggttacatacttcgggtgtgatgtcttggggcatagttgacgggtctcctgaggcatgcttcacatctgtcgtggggcatcgttgacatcgttcgccggcttgcggtattggtgttcgcgggtggcgtcgagcgtctggccggcgaggatctcgccggtctccgggtcggcgaagctgctggactacgtgcatggcggcggcaaggtcatcggcacgtacatgtcgatggacaacggctgcgacgagaccaatccgctgtacggcaacaggatgctgggcgattcctattgggatcgggatttcatcatgccgaacgacgaggtcggggcgcgtctgcccaaagaggagttcgtcatgtacgagcgtggcgcgcgggtgaggacggcgggatcgcgggtgctgctggattcggtcgaaccctacttcaatcgtgaggggaggtatttctgctcccacctgcatgccccctcgaccgggagggtcgggttccccgcggcgacgcggtacggcgacgtcgtctatttctcccacccgttgttccgcatctacaaggatttcgccccgtcgtgggtcaaggcgatattcgccgacgtcctcgatctgctgatgccgaggcagctggtgcgcaaggaggacgggcatacggtcagcgggctggaggtgcagctgcgccgttcgggttcgcgcaattcgttgatgctgcattgcctgtactacccctgcaagaagtcggccgccaacctgtacacgatcgacgagaaggttccgctgttcgaccagcgcgtgcgcgtgtatgtgggcgacgccgagatcgagtcggtccgcgcgatccgtcagggcgaggtgatctccgaacgggactacaccgtggccgacgggtatgtcgatctgaacattcccaagatcgacgggtacgagatcatcgagttgtcgctgaaatgacgcaccgactcagaatcccggtctaacggccgacatgggggtctggaatcgtctctaagcctttgccgaaggctcagagacattgaatgtggctgcagggtgcgggagttcccttgattcctttgtaccatggaacgcaagaggccaccagccttgttggctggcggcctcttgcatgattagtagcggggcatggatttgaaccatggacctctgggttatgagcccacgttttcttatattgttctagtttgttattgtctattgtatagtgcgacaatggttcgaaatacggcgttttgtttgtttcatattggttgtgattggcgagtttgtccaacttttgtccagattatttgtgtccagatttgtccaaatctggtagcatataaccaactgttgaaggagtagctgatatgacgaagcgggaaacgtccggacagatcaccgaactggagcgaggacggaagtattcgattcgcgtccgtctcgctccagacaatgaacataagtcttggcattggtcaaagtcgcgtaaggtctacgggaacaaagccgaggccacggcagcgatggttgcctacaaacaagaactcgaggatgagcgttccggcaagaacgtgacggtggcggaatacgctgacatgttccaatccaaccgcaaggctctcggcacggtttccgtgctcaccattgagcgggaccaacatgagattgaccacatcaagaaatatcttggagagacaagagtaatcgaccttacctcgcagcagatcgagaacgcctatttacgcatgtcggaacaggatggagcttcgccagatgccattcacaaggtccatatgaaattatcccagatcatgcgcaaggctttcttggatgagctgattaaccgcaacccatgtgatgcggtggaaggcgtcaggcgcccaaaggtgagccaacagaagcgcagggaaacacgaatcacaaaggaacaggcactcgcattcgttcacaagatacggcaggaacctcaagacgggcgaattgtagcggtctggttgggcgtggccacgggtcttcgccgtggcgaagcactggcgctggtgtgggaagacgtggacctagacaacgcgcgattgcgcattcgtaagcagctcggcaaggagaagattctgaaggatcccaagaccgccaagtctcgacgcaccatttccatcgacaggcagacagttgaatttctgaagcagtggaaaactcgccaacataatctattccgcgccgcaggtgttgaacagcaagatgattcaccagtatgcagcaacgaattatgcggattcttggaccccgacaacttcagccgttggcgtcgaaagttttacgtcaaagaaggtctggcgcactataccaatgagactcggtacgttgataagcgcggagtcgaaagggtgaaacagactggctacgtcggtcctaatttccatgcgcttcgtcgtgctcaggccacactactcgttgctggaggcgtggatcctaaaacggttcaggctcgtcttggacacgagagcctgaacacgacgttgaatatctatgctgaggaggtaggagaaaacgaccgcaaggcagctgactttatgggagagctgcttcgcagctaatgttagtggcctattctccgtatggtcccatgaaacgggatccgttgaagtgcatcatatgatctggtgtgtcggcgcaccatgcttcggtttcccatgctagtagggcgaggtatttttgcatggtcttgcgatcaggaaagcatgagaccaatacgattttgtcccactgctcggagaacagttcgtgcagttcattctttctggtcacgtcaaccgggccgtgagtacttgcagcttccatgagaaatagccagccacgttttgcatcccaagcgatgacgtctggcgccttctcgcgagccttaagactgattccaagttcatccaacaatgcggggtctacggcaccatgcttatggtcagtatcgtcgatataagcgacttggcatccgggagcaaagcgtggcagcatatttcctccaccattgctttaatcagaagagactgaccacttggagatagactcagggcagcacctgaaggaagaatcacaggtgtttttggcatattcttccgttcctctgcaagagattgataggattcatgctgctcgaggaatctcttgagaatcaattcgaactcggactcgccgcgatgcagcagcatattcaacgtgtcatttgttatacggtagttccattttggagaattgattgggcgatcgggtcgatcggcattctcctccactaattcggcgattacgaattgatggagcgtaaacctgcggatggtttcacgggtatttggtttgtagtccacttcatagtagtctctaatccaatccatgatggcgcgggttcccaacatgggattggtagcctgctgccagttgtctccgggcttgagctgaagtaaggcgagcaatgtcattgcgctacgctcattttgttggtccttgccaactccaagttcgcgcaatgtgtcaatggcatcagcaatcagctggcttttgtccatgaaaaacagatactaaattgagaaaagccgcgtaaatacagtatctatcagcaaaaaaccaaaaagaaaataaggaaaattacaacgaaattacaacaaatgaaagagcctgatgtaacgacttatgcaaagaaatacagagttatgaaaaaataacatttgaaaaagagtgtctttttctatgcagtgtaacagcaactatttcatttctgcttgattactctaaaacttattagtctatggtttgtcaagggcttgttgcgtaagcaatgctgaacagcaccctttacaaaatataggctaataagtagtttttcaaaagcagaaaagaaatgacaacgcttataacagcatgatttaatgcagataaaggcaaaattgaaagttatggaggtaacggaaatgaaaatgaaaaatcctatgctggtggtaacagatatagagaaatcagttgagttttataaaaaggtttttgggcttcatgtgattatggatttcggagcaaataaaactttaactggcggtttggctttgcagacagttgaaacatataaagactttattgggaaaagcgatatttcttttggtggcaataactttggaatttattttgaagaagataattttgatgaatttgcggataagctgaaagaatgtgatgttgaatatgtccaccctattgtagaacattcatggggacagcgtgttgttcgtttttatgacccagataaacatattatcgaagttggagagaatatgaaaatagtatgcaagcgtttcttaaacagtggaatgacgccggaacaagtagcggaacgcatggacgtacctatgaaatttgtcaatgctcgtatgcgataaattagaatttgtggagatgatagaatggaatttaacaaactaataccagaattaacagttaaagatataaaaagaacgagggaattttaccttaatatattacaatttaaaattgaatatgaacgagtagaagataagttcatgtttctatcatttgaagattcacagtttatgtttgaagaattacgagatgatggctggaatgttgctgaaatggcatatccttttggtagaggagttaatttttctattgaagtaaatgatattgataaagtatatcaacagcttattcgctctcaatatccgttgtttagagaaatgatgttgaataaatacgaatctaatggagaacttattgaacaaaaagagtttttagtgcaagatccagatggttatttattaagatttacacacgaataatacaaatcccagtttgtgtgggagatacgctccaaatctcgcaaaccgacggagtgatccgccagcggtggcggtcgtaagacatagcgccacgccagcttgctggcgagcgggcggttcacttcggcggtttggcgagcgcagcgagccttagaaagcccccgttatctaacaagggggcacaaaaaacaagaaacaatatacactactaagcggaaaacgctgtatttataaggtaaaaccgcttatgacaagatgttaactaaaaaagcactcatttaacacataaaaattgaataaggcataggaaagacagttgatttcaaataaggaattgattgtctttttcttttaggaaaaatttaagtagaggtaattatcagtaaatggtagttgtttttttgattggaggaattaaagaatgaatgataaaaattttattgaagaattaaaacataaacggaatgaatatggggtatctcaaagaagatttgccgttgcctgtggtatcagtcgtacatattttaatcaaatagagaacggtagtgttgttccctctgatgaactaaaacaaacaatgcaaaaacagattgagcgttttaatccgcaagaaccattattcttattgattgattactttcgtgtccgctttcctactacggacgcattaaagattattcgtgatgtgttgcaattaaaatctgattatatgctttatgaagattttggcaagtacggatatgaaagcaaatatgttttaggcgacatcaacatcatgtgttccatgcaagagcatttaggtgttttattagaactaaaaggcagagggtgtcggcaaatggaaagttatctattggcacaggaacgctcatggtatgactttatgcttgattgtttaacggcaggtggtaagatgaaacggcttgacttggcaatcaatgataaagcaggaatattagatattccaaattaatggatgacctttgtcctatcgcaaacttgggcgagagagagctcggaagcagaagcgagcttgtcgtcctgttcaatggctaagacgctgctgccgggggctgcttgacgtgcagtcaccgctcctaagatgccggtgccggaaccaagatcgagtatgtgaacgggcttatcagagtgagtgaagagactcgtggcttgttcggcaactggcatgggagtaagaaactgttcccattgctgctgctgttctggagaaagcagagtggcggctttgttgcgtatttcggcgatggtttcactcatgtggttaagaataaccggtcccgtcgtcgtgcgcagaaaggcccggcctccttctggctatttgcctaagaagaaaaccgggccgaagttttatcggcggcgcttgggccagctgatgggaatgccgccattggcggtgaggtagtcgttcagggccttctgactgatgtagtccttgtttcccactcggattgatggcagcgcgtccatcattagacgagctttggaacggccaactttgaacatgctttggagagctgcgacatcgaggaactggagctgagtgtctggttcaggcttttccatgacgttcctccttcggcaaagcgaaatacgaattccagtagctccaaatgacttctcgacagaaagtgacttgtttagtcgcgaattcgagaaggtcggggtggtcagcctcacaggccttcagaagatcgaaatatccgtgaatgcgctcttcctccaccagtttgacaatggacatggcgtcggattgattgccttcaaccagtgcgattttttttccagtccgcaccgttgaactcgagcacgtcttcgggactgtatggagccttatccggatcatccatgtggatcaggtatcgagccatgccacggggattctccaatcgcaggatcatctttgggccgccgaattgctcaaagaaacgctcggcgttctggcgtgtggtcgtgttggcccacattgcgattacatggcggtgtggcttcttcagttcgccagtggcgatgtcggcaatgtcctgatcgtgtacgggagaaacaaggatttccagaccgctgatcttcattcggtctttccaatcgtcgggacaactatcgggatagattaggccagcccagtacctgcctttttcgttcgtagcttttctctgatgagtcatgtccctcatctctcatcccttgcgggggcgtcgtagtagcccccacaacttgtttgtcgggtgtgaacgggctcccgctgtcgcttcgcccgcttcgtcgtcagtgccggggcgtcgcagtgagtggatgtcctgatccgtcatgaacggcacatggatataccgcacggtattggactcgctatcccacaaatagccatcaccgggacggttgaaactgatctgccatgggcgggcaccacgctgcacggcgtcctcgccaagggccatcacagcctcgctcttggaattcagacgcaacgctaacgtggtaagcagcagactgcgataggggagactggtgctcacgcgcgggttctgcgtggacacgaccacggtacagttcaatgctctagaccgagacagtgccgatctaatggactccacgcacgcgtccgaagtcttcttatcagaaccggaacggatgagatcggcggcctcatcaatgacgagcaggcggtgccgctcatgctgatcatcgacggtgcggacttgcccacgccaacgttcggctcgtgtgtccacgtccatgttgaaagcggagagaagatctttcgcttcttgcaaggagtaagccttgttatcgagcacggcggcgtagttttcggcctccatgccggacttcaaatcaatgaaccagacttccccgccagcctccacttcttgcctgatgatgtttgcgatgacgctgcccttgccggaattggattcaccgatgatggcgaggtgggcggtgcggggtatcgaggccatttgctttggcctcgatacctctgcacctagctcataccgttgaacggcattttgtttcttaagaagcattatcggagctccttcagttttgcgaaggtgaccttgtattgcgctgatcggaagagcctgcgtggaatgatccggacctcggtaggctggaatctcattcccaatcgtggagctacttcgtccgcccacttgttgattccctcgtcgctcgtgtaagcggctggaattgtgaaagtgattcgtgaggggttccagcgccattccacggagcagcatttgatctgttctttcgtgagggacatcggcttagcagatagtgcggatgccatgagactattgcgtagagcgaataccacgtatgctgcgaccccgataactgcaatagcgcaagcgattgcaagaatggcagccggatgttgatgtactaaggtgatgagtgcgtccatttgtcctccttgtggacttaagggtttggattgtggatgtggctggagggcgtccgacaacgtcctccagcgctatatgtcagatgccgagggtctgcttgatcatggccatttcgagcttgctggggaagattctgccgatcgacattccgtcgagcaggacttcgatgcactcgtagcggttaccggctttgctgataccctgcacgatttccgcgtgcagccgtggtgtctgttcgtctgccatgttgcccacctcctttctgggtttcgtcgatggttccatccaatcgcgtatccgaaaacttgtttttattgaggtgtaaaatttacactaaacagtattgaagaggattgtttttcgttggaatcccggcgtttctaaggatctgataaaaatatgaaaattgactgcgataatctgattcgtgccttgaaaacgttggctatgtcggagggcttgagtcagaaagagctgggtgcgagtctaggttttagccttaatcgaacgaagaaccttttctccggacggtcaaaactcagcggtgaggaagtgctccggattcttaccagtcgagagcatccattaccgaaattgaagcgttacctaccgctctgccaactgcaacaagatctatgggctatcgagtccgaaaaccgtggcgcgtctgaagagagcgaactggctgttgcggatgcacaagcaatacagggttccctcatgacggtgaatgtcaataaaccactttcggagatggctcgtgatgtcatgcatgacaagaaatggcgagtgcttccgaccggttggatctgttcggtgacaatcgtgggtgaccaatgtacgtatgatccgattgctccggactttgttacggcagtatcggcgatgaagaagatggggtggatttggaagcgaggaagtggcgtattcgcaaattggaacaagataaacggcggcatgtcgggggaagaagcagctggatattgtgagaacgccttacggtcgttcattcttgatcctgaaaatgatgtaagtatgagtgactcgtttcgccgggccgtacagaaatattgggtgggggcgtccgataccgaagaaatcgacaggcttcggaatgttgtggaaaatgttcggcggatggctgagcattgggtagattgggaattgtctgacgagcccaatgaatatggtgtgtcaccaaaacagatttatgcgaacaagttcgactacttcgagcaagaggttctcggaatgcggcagcttcattttgatttgctcaatgatggaactgaaattccgtccgacttagaaactagatatcgtgagaccttctcggaagacggcaagccttacaaatattcctaccgtattgaccctatcctcaaagtcaacgatggtccgggaccccttgtagacgcctctccagaggactggaagcggtaccatgcaatccgtgatggttcgtgaatttgttgattcatgttggtactgcttggcggatttgtccagaatttgtccagattcacggtgtgtagacggatgttggaatacgagaaaaggctaggaatcaaataattcctagccttttcactggtagcggggcatggatttgaaccatggacctctgggttatgagcccagcgagctaccgagctgctccaccccgcgtcggcacgtcctgtatttggacagctcgctcaacaatacccgattaatcaggagtgtcaagattctcgggcgtgtcggccatgggatggggcacggctcaggcggccggctggccgggcactgacctgacggtgaccgtgctcaacgcgctcggcctgttggtcggcgcgttcatcggcgcgtccacgtccacggccaagctcacggcctgatatgcgaaatatttcgcccggtggattcggtggaatatttcgcgccccggacaaacaacccccgcccaagatcgcggaccatgcgcatggcgtggatgccgcgacttgggcgggggtttcgtcgtttcagaccgtcagaagccgttgttccttcctgcgttcggcgatcttctcggcgagccatgtgttgaccacggcgttgcggctgaccgccagctcgtccgcttcggcgtcgaggctttcgaccatccagtcgggcagggtgagattgaccttgcgggtcttggtcttcgcggggcggatgacgcggggcttcgtcatgtcgaagtaccggcgcatgtcgtcgccgcgttcgaaggcctcgtcgatgtccgaggccttgacttcctcaatcgtccttgtgctgctcataggtgtcctcctcgtagtcgcgtgagcgccgcaccgagatgatgcggacgatgtccttgtgttctccccggtaggtgacgatggccgtccagtgcttgccgtcgatgacgccgagctcaaggtagcgggcgtcgtcgctgcgcgggtcggcgtcgaattcaagcacgacgtcgtcccacatgcgttgggcttgctcgaagtcgatgccgtgcttggcgaggttcttcgcgcttttggccgggtcatactcgaattccacgtcctacctcctactgaatacctatcatacacttaacgaataccattgcaatacctgtggtgttcatgaggtgagtatgctcgctgacaccgtcttcccgggccttgaatcgggcatgggtgcggatgcggctgagggacgtcaactggcagcgcctcgtgctgattgtgttgcgaaagaacccccgaccggatggtcaggggctatgcaaagtatggaattgacgaggtgaaaacctctgggtcatgagcccagcgagctaccgagctgctccaccccgtgtcgcgccggtgtcccgtgaaccgcccgccggacggatgccttgaaccgttatcccgaacgttgacataatgggagcatgcctatcaagatccccagtggcctgccggccagagatatcctcgattcggagcgcatcttcgctctggagaagcccgaggcggagcgtcagcgcgtccgtcctctcaaactggtgatcctgaacttgatgcccaagaagatcgaaaccgaaacgcagctgctgagactgatctccaaatcgccgctgcaggtcgagatcgacttcatgaagacctccacacatgaggccacgcacgtttccgccgatcatctcgtcaagttctacgaaaacctcgatgcgctcaaagacaactattacgacggttttgtggtcaccggcgcgcctgtagagcatatgccgttcgaagatgtggactactgggacgagttcaagacgattctcgactgggcctccacccatgtgttctccaccatgtacctgtgctggggcgcgatgggcgcactgtactaccgctacggcatccacaaggtggattaccccgagaagattttcggcgtattcccgcagtacctgcaggacgaatactgcttcctgaccaatggtttcgacgagattgatctgcagccgcactcccgcctcgccggcgtgaacgaaaacgaggtacgtgccaaccatgaccttcagatcttgacttgggggccacagtccggcccgggcctgatcgccacacgtgacttctccgaagtgttcgcgctcggccattgggagtacggcaagtacacgctcgccgaggaatacgagcgcgatatggccaagggcatgaccaacgtgcccttcccgaagaactacttcccgcatgacgattcgaaactggaaccgttgttcgcctggcgcgcccacgccaatctgctgtggcgcaactggctcaactgggtgtaccagaccacgccgtatgacctgaccgaggtgccgcagctcagggctgagaagaagctcggtactgatcgttcgattcggcatgagccgggcgggccgcgccaggatgatttcgagccgttcgcccacgacggatacggagtgatcagagggtagcgcaaatgccgcacatcctcgtattgtgactaatagcgcacaatgcttgcgcaacatccgaaaaaccttgcgccgccgccgattccagaagacgcgccggtgtagtattgacattgtctagacgcaggcaaataatcactcttcagtcattcggagccgaatgcccagcgcagactccgtgtccgcgcccggcagactccacaccgaggagacgaaagtaacgagcacgtcacatttgcctgcccggtgggtttaaactgacacctgacattgaagaagcaggaggcgtgatatggtcggttcgctcagcgcaggattgctgttggctgacgaggcaggcgctcatctgccctcggttgatgacttccttcccccggagattctgttccagggaactccgtttgccatcaaccgcattattctgattcgtatcgtggcaaccattgtgctgctggtggtgctcggcgtgactgcgaaacgcgccaagctcatccccggccgttggcagggcgtagtcgagtacggtctcgacttcgtgcgcgacaaggtcgtgtatgacgtgatgggcgagacccgcggcaaacgttacgtgccgatgatcaccaccctgttcttcacgatcttcgtgttcaacctgtgcggcatcatccccggcatgaacatggcggccaacgccacggtggtcatgccgctcgtgttcgccgtctggacactgatccagtactggatcgccgccatccgctcgcagggcctcggccactatctgcgccacgagctgttcacccccggtgtgccgtggccggtctacatcctgctggctccgatcaacctgcttgagttgttgatcatccgcccggcctctctgaccatccgtctgttcgccaacatggtttccggccaccttatggtcgccacctgcctggcgttcgcacagttctggatggttgacgcggccaacaagttgcagggcatcccggtgggtgcgctgtggttcgccggtggtttcgccatgacctgcttcgaggcgttcgtcgccttcctgcaagcctacgtcttcgcgattctttccaccgtgtacatcaacctgagcttcccggaagagtgacgggcgactaacccgccgcttccggtccccggtctgggaaaatcgcagaccgaccaaaccccaagatttataacgtcgccaagtacgttagaaaggaaacacaatggatatcatcaccctcgcagaggtcgccggcaacctgtccgtcatcggttacggtatcggtactcttggccctggcattggtctgggcatcctcttcggcaaggccatggaatccaccgctcgtcagcctgagatgtccggcaagatccagaccatcatgttcatcggcctggctctggtcgaggtgctggcactgatcggcttcgtcgccgccctgatcatccgctgatcaacagacgaaaaccgattatgtccatcactgaaaggagggcttgatggcacaagcagcaagcgggattgacctgttcattcccgaggtctatgacatcgtatggtcggcgatcatcctcgtcatcgttgcagtgttcttctacaagttcttcatgccgaagttcaacgcgatcttcgacgagcgtgccgccaagattcaaggcaacatcgccaaggcggagcaggctaagaaggacgccgacgaggccaaggccaagtatgaggcccagctgagcactgcccgtgtggacgccgccaagatccgcgacgacgcccgtgccgaagcgtctcacatcatcgccgacgcccgttcgcgcgccgagtccgatgcggcccagatcgccgcatccgcacagcgctcgatcgaatcccagcaccagcaggccatcgtctcgctcaagggcgaggtcggtgcgcttgccaccgctctggccggcaagatccttggcgccaagctggaagacaacgacgtgcagtcctcgatgatcgattcgatgatcgacgatctggccgtcaagaagtgaccgtgaccatccgtaaccagaaagggaggtgaccatgcgaggagaggcatcacgtattgcagaccgcgagtcgcgtgattcgctggccccgaaactgcgcgacacccgtgaggacgcgtggcggatcggcaacgaactgttcacgatcaccaaggtgctcgacgacagcatccagctcgaacgcgcgttgaccgacccgtcccgcccggttgccgacaaggtggccgtgctgacggaactgctcggcgacaatgtgcatccgatgaccatggagatcatgaccgatttggtctcccgtcactggagccgtgcgcgggacatcgccaacgcggtggaggatttcggcgtggacgccatgatgtactacgcggacgccaccggcgccacgctgcaggtctccgtcgagctgtccgaactgcattccgcgttgctgaacctgccggtcgtgcgcgccaagctgtacgactaccaggccaccagcgaggcccgtgtgaagctgttccgtgaggtgttctctggcaagaccctgaacaaggtcaccatgaggctcgccgaacacgccacttgcaacctgcgccgccgccgctacttggagaccatccagtggatgatcaacaagttctcccgtcacatgggcgagtcgatggtcaccgtgaccaccgccaccccgctgaagaaggagcagatcaagcgactggtcgaggtctactccgccaaggtgggccgccaggtgcacatcaactcggtggtcgatccgaccgtgctgggtggtatgcgcattcaggtgggcgacgaagtcacggacaacaccgtggtcgcacagctgcagaaccttcatcgcaaggtgcagacggaggcgactccggcctgaccggccgagccaatccgtccaacaccacacacaagcaaagacttgactgaacaataaccaatagaaggagtgatcatggcagaactgaccatcgatcccgcctcgattcgcaaggccctcgacgacttcgtgtcgtcgtacaagccgagcgacacccccacccaagaggtgggatatgtcgccacggccggtgacggcattgcgcacgtgacgggattgcctggttgcatggccaatgagctgctgacgttcgaagacggcacgctcggcctggcgttcaaccttgacgcccgtgagatcggcgtggtgatcctcggcgatttcgctggaatcgaggaaggccaggaagtgcgccgcaccggcgaagtgctctccgtgcccgtcggcgacggctacctcggtcgcgtcgtggacccgctgggcaagccgatcgacggcctcggtgagattcagaacatcgaaggccggcgtatcctcgaagcccaggcccccgacgtgatgcaccgccacccggtcgacgagccgctgtccaccggcctcaaggccatcgacgcgatgaccccgatcggccgcggccagcgccagctcatcatcggcgaccgccagaccggtaagaccgccattgcgatcgataccatcatcaaccagaaggccaactgggaatccggcgacccgaagaagcaggtccgctgcatctacgtggccatcggccagaagggctccaccatcgcctcggtgaagcagagcctggaagacgccggcgccatggagtacaccaccatcgtggcctccccggcagccgattccgctggcttcaagtacatcgccccgtacaccggctcggccatcggccagcactggatgtacaacggcaagcatgtgctcatcgtcttcgatgacttgtccaagcaggcagaggcctatcgttcgatttccctgctgctgcgccgcccgccggggcgtgaggcatacccgggtgatgtgttctacctgcactcccgcctgctcgaacgttgcgccaaggtctccgatgacctgggcggcggttcgatgacgggtctgccgatcgtcgagaccaaggcgaacgatgtgtccgcctatatcccgaccaacgtgatctccatcaccgacggccagatcttcctgcagtccgatctgttcaacgccaaccagcgccccgccgtggacgtcggtatctccgtctcccgagtcggtggcgccgcacagaccaaggctctgaagaaggtctccggtacgctgaagatctccctggcacagtaccgttcgctggaatccttcgccatgttcgcctccgatctggatgcggcatccaaggcccagctgacccgtggtgcccacttgaccgagctgttgaagcagccgcagttccacccgtactcgccggaacaggaagtcgtgtccgtatggaccggcacccacggcaagctcgacgacctcgacctgaaggacgtccttccgttcgagcagggactgctggactacatcgaccacaacaccgatatcctcaagaccattcgcgagaccgaggaattcaccgccgacaccgaggctgccctcgataaggccgtggatgagttccgctcgacgttcgtctccggcagcggcaagccgttggaagagaagaaggtcgaaagcgtcaaggccgcgccggtcgatcaggaaaagatcgtggcgggagaaaagtaagccatgggctcgcaactcgcattgaaatcacgcatccactccaccgagtcgttggcgaagatcttcaacgctcaggagatgatcgcgtcttcgcatatcgccaaggcccgtgatgtggccctgaacgcgaagccgtactccgatgcgattttcgatgccgtgcaagcgttggtggcccacacccatatcacgcatccgattgcggtgaaggacgagaacaacccgcgtgtggccgttctcgccctcacctcggatcgtggcatggccggcccgtacacctcttcgattatccgtgaaacggagtcgctgctgtcccgccttgatgcggcaggcaagcagccggagctgttcgtgtacgggcgtcgcggttcgacgtactacaagtaccgcaatcgtgacatcgcggcgacgtgggaaggaaacaccgaccagcccggcgtggaaatcgctgaaacgatctccgacaccctgatggacgcctacatgaaaccggccgagaagggtggagtctccgaactctacatcgtctacaccgagttcatcaacatggtggtgcagaaggtgcgcgtgctgcgcatgctgccggtcgagatcgtgcagaacgagaccaaggtgccgtcgcccgatgaagcggccccgtccactgcggacatcgccccgctgtacacgttcgagcccagtctcgaaaaggtgttggacgcgattctgccgaagtacatccagtcccgaatccacgagtgcctgctgaccgcagccgcgtcggaaaccgcaagccgccagaacgccatgcacacggcgaccgacaacgcgcgaaacctgatcgatgaccttacccgcaagctcaacgcttcccgtcaggcctcgatcacccaggaacttaccgaaatcatcggcagcgccgacgcgctgaccaagaaggaagagtaggaacgcatatggctgacaaccagaccactgcggccgagcctaccaacggtcgcgtcacccgcgtccagggctcggttatcgacgttgaattcccggtgggtcatctgcccgacatctacaacgccctgaaagtaacgatcgtcaacaccggcgccaaggaagaaggcgaggcgaaggagaccgagatcaccctcgaggtcgaacagcacctcggtgattccacagtccgttgcgtcgctctgaagcccaccgacggcctggtccgtggtgcctccgtctccgacaccggcgtcccgatctccgtgcctgtcggcgacgtgaccaagggccacgtcttcgatgtgtccggtaacatcctcaacaagaagccggatgagaccatcaccgtctccgagcgttggccaatccaccgcaacccgccggccttcgatcagctggagtccaagacccagatgttcgagacgggcatcaaggtcatcgacctgctgaccccgtacgtgcagggcggcaagatcggtctgttcggtggtgcaggtgtgggcaagaccgtgctgattcaggaaatgattcagcgcgtggcccagaaccacggtggtgtgtccgtgttcgctggcgtcggcgagcgtacccgtgagggtaacgatctgatcggcgaaatggccgaggccggcgtgcttgagaagaccgcactggtctttggccagatggatgagcagccgggcacccgtctgcgcgtcccgctgaccgcactgaccatggcagagtacttccgtgacgtgcagaaccaggacgtgctgctgttcatcgacaacatcttccgcttcacccaggccggttccgaggtgtccaccctgctgggtcgtatgccttccgccgtgggttaccagccgaacctggccgatgagatgggttcccttcaggagcgcatcacctcgacccgtggtcactcgatcacctcgttgcaggccatttacgtgccggccgatgattacaccgacccggccccggccacgaccttcgcccacctggatgcgaccaccgagctttcccgtgacatcgcctccaagggcatctacccggccgtggatccgctgagctccacttcgcgaatcctcgatccgcgttacgtgggccaggcccactacgactgcgccaaccgcgtcaaggcgattctgcagcgcaacaaggaactgcaggacatcatcgccctgatcggtatcgacgagctcagcgaggaagacaagaccaccgtgaaccgtgcccgcaagatcgagcagttcctcggccagaacttctacgtggccgagaagttcaccggtcgccccggctcctacgtgccggccgacgagaccatcgaagccttcacccgcatctgcgacggcgtgtacgacgacgtcccggagcaggcgttctccggcatcggcggcatcgacgacctcgaagagaagtggcacaacatgcagaaggaactgggtgcgtgatggctgcggaaaaaaccacgatgaaggtcaacatcgtcgccgctgaccaccctgtgtggcacggcgaggcgacgagtgtgaccattcccgcctctgagggcggcatgggcatcctgcccgaccatgagcctgtgctcacagtgatcaagcagggtacgctcaccgtggttgagcccgatggcgatcgtcacatgttcgaggtgaccgacggattcatttccttcgactcgaacaaactcaccgtggcggtcgagcgcggccacgacgtccagtactccggcatcgccgagtgatctgaaccaactccttaagggactctctggttttccagagagccccttttgctatgtatgccatgtgttgcgctacagtggtggcctatgcgagttattgttgccgactgttcggccgagtattcgggccgcctcaacgcctcactgcccctggccaaacgtgtattgctgatcaaggccgattccagcctgttgattttctccgaattgggctcctacaagccgctgaactggatgaccgcgccctgcacgattcgtgagatcgacccagccgccaaatctgcgcaacattcccgggaaagtgtcgctggtggggctgtggatggtgattccgcgacgcattccccggaaagtgtcgccgctggtgagccggaaaaggtgttacgtgtcagcgccgacaagggctcggacattcttgaagtgacgctgcaacacatctattccgaccaaacctatgatctgggcgaagatccgggtctcatcaaggatggcgtggaagaccatctgcagcgctatctggccgagcagatcgagcgtatcggcaagggagccaagctggtgcgtcgcgaatacccgaccgccattggcccagtggatattatggccgtgaatgccgaaggcgagcatgtggctgtggaaatcaaacgtcacggcggcattgatggcgtcgagcagctgactcgctactgcgaactgctcaatcgtgatccgctgctggccccggtgcacggcatcttcgccgcacaaaccatcacgccgcaagcccaggtcttggccaaggaccgtggcttcacctgcctcattctcgattacgacgatatgaaaggcaccgaggacgacagtctcaggctgttctagatatagcaggggctccctcatcagagggagcccctgctatatctttatcttttagtacgcggcgagaatatcgattacgaagaccaacgtggagttggcgggaatcgaaccttgctccttatctccataggcctgatccggcggaatcaccagcagaacctgagagccgacggtctggccgaccagacccttctgccagccctcgataacctgatgctggccgctggaatcgctgaacagatcggcgtcgattgtggaatcgcgatcccaggacgaatcgaactgcttgccattcgtaagccaaccggtgtacttgaccaccacggtgttcttgtcggtcagcttggcgccgttacccttgatcagcgtctgcgagatcagcgaatcaaccgaaccctgaccgttcatgtcaatggacggcttgccattcttggctcgcgtcaccttcggcagattggccggcacattcttgacttcctcgccagtggccttcttcaggtccttggacttggagacaaacgtcatcgccagaatgtaagagtatccggacgaatcctgagcgttgacgccaaagccgatcgtggtgttgatcttggcgcccttgatctggttgtagtaggtcgaggagagggtcttggaatccaccttcagcgagcaatccggcgtgttcttggtccaggtgtccatgagctcggtgccgtctttaacgttgagcgcgatgccttgggcacagacgcggtcgccctcctcgatcacgtcgccatcgcccttttgcagcaccacataggagccgtcggacacggtcatcggcgtattaaaggagatggtcggcttctcgccgagcttgcccttggcggtcacgccggcaatttggcccttcttgtcagaagagtcggaagatgaagaggaatcggaagaagaggatttcgagtccgagctcgaactggagcaggcagccagcgacacgcacatcgccagtgaacaggcaagagcaacggccttgccgagggggataacatagacttaacagacttacgcatggcacaccaccctactggtaaaccttgattttctgcgctcctaggtaataaacaggtgaagattgtagaatggttgagttatgagtgctgaagaacagactacaagaccggataagggcgccaagcgtccatcccgtcatgccaagatcatgcgtggagtggtgacgcctatcttcggcctattggccgtggcggctgtggtgttggggtacatgaatgccacgatatggaagccctccactgaaatcaccgcttccgcaaccatgagcggctcccggtatgccgtcactgatccgaatgtgctgaccttgttggatcagaacgccacgataaccgtggactcgggatcctctcaggacgaggcgtgcgtggcgttggggccggccaaggatgttgccggatgggtcgcgtccgagaagtcctatacccgcatcaccggattggcgtcatggagcgagctgagcacccggaagggaagcagcacgagtcagggagcgcctaccagtgccgatggcgcggtgtcgttcaaggattccgatatgtggactgacgtgagatgcggcactgggtccgtttcgctggagagcaagaagaccggcgcctcgacggtagccattgtggatctgggcgaaaatgtcaccaacgccaaggtgcagctgcactgggtgcgctccgcagtgccggactttgcgatgccgttctatctgtccggcggattgctggccgtgctggccgtactgtgcgcctccgtgttcgccatgccgccgcataagcgccgcaagcgcatggtggaaggcacggcaagcgccgtaattgaggaagaggcgcccgccagcatcgcagtgtccgggaagccggatggggcaagtcgacgtaatcgtcgccgccacgccacgcatcagcgttcgggccgtgcgtcctcgcaatctgaagccaccgaaacaccggttatcatcgacccaagttcgcgtaacctggtcgccgaccagcagaccggtgccgagagcggcgctgagaccggcttcagcgccggcgataacgaagcgacttcggtaatcacccctgacgaactgcaggcctacttctcccgcttggcccaagaggtcaataccggagacgactcggccgatgccggacaggaggaaagctgatgaacaagcgatggaacaaactgtgtgtggccgccctcgcctgcgtggcgttggtcgtgccgttgaccgcctgtgaaggccggctgccgacgccggctgctgatacctccaccaaggttgcgccggatttgaccgagacgcaggagaagaagattcgcctgaagattctcaagacgatcgatgaagccgatcaggccaagaatcccgatggatatgcggccgttatgggcgggccccagctggacattcgcatcagccagaccacgatcaatcagcgtggcggcggtatgtcccaatatgcgaccattcccaaggacatcgcccagacggtgattcctacggacgacggatggcctcgctcggtgttcaccatcacgaccaccaccgaagatcagcagtccaagcgtttgctggtcttcgatcaggaatccgcccagcagaattacaagctgatggccatggctcgactgtttgagggagccaagctgccaaagttcgagattccgactcttggctcgcagatgggcaccgcaaaggatgagaagctggtggccactcccgccgatgccttgacccaatacgccgatgtgctgcagaacggctccaagagccaatacgcttccaagttcgcagacgatctgctgcgccaggaactggccaataccacggccaaggtgcaggaaggtatgcaacgcaacaatggtacgcaagagcaaaaattcaccgctgtgcctgaacagatgtgggtgatgcgtgctgcagacggtgccggtgatttggtggttggccgtattaacggcgaatggactcgcaaggcaggggatggccgcgaatcgcagccggcttccgacgacgagaaggcgctgttcaatagcgacaagtacaccagcaccatgaaggtcacgtatgtgaacgtggtggccttgtacattccgttggcaagctccggtgcgcaaatcaccgcagtgggcgccgaccgtcagccggtaaaggtcgaagcgctgtaattgttgccgccacccaccgcgcggttaacgtcccaccacgatgtgattcgtccaccacgatgtcgataaaatcttacctttcgcataatggtgccgtttggggtcacatcgtggtgggcgttttgctacgtggtgggaatttcaccgcgtagtggaagaatcactacgtggtgggaatcggcattacaatcaatgtcagcaaatgtgattgttgttgtacgcgaatcgcgtggaatcgggaggcattatggcagagcagcagttcaatccgggagtctcattggcgggtgccgtcgatttggaggcgctgaagcatcaggtcaaggccgagcccggccaagcgggcggcgcgcctgccgctggtgggtacgtgatcgacaccaccgaaaacaccttccaggcaatggtgcagacttctgcgaccttcccgatcctgttgctcctgtgggtgccgaccgatgaccgcctgttcccgatggcccgtgtactgggcgacgcggtgaatgccctgaacggccagattcagctctcccgtatcgatatctcgtccaatccctcgattgcccaagcgctgcaagtgcagggcgcgcccgcactgtttgcgttgattgccggccgtccgatgccgctgttgcagggccttccgggtgacgacgagctcaagcaacttaccgacgaggtgattccgaagatcattcaggccgccgcacagtctggtgtgaacggtaccgcgccgtactcgggtgatcctgattccgatgccgccaagagcgctggtgccaccggtgccggcgcgggtgctgagcaggtgccgccggagcatgccgaagcccatcgtttggccgaggagggcgattacgccggtgccgccgccgaatacgagcgcgtgctcgaatccgacccgtccgatgcactggccgcccgcgaacgtgcgaaggcgctgttgctggcccgctccagggccgctgatgtacgtgacgtacgtgccgctgccgccgcagcgccggacgatgtggaatcgcagttggccgtggctgatatcgacatgattggtggccagattcaagacgctttcgaccgtttgctggactttttggccgccgggcacaaggccgatatcgagcaggttcgcaagcgtctgctcgaatacttcgccatccccgaacccaccgacccgcgtctggcccgcgcccgccgtcgcctagccaccctcatgtactaagtggttttggctcccctctttgagaggagctgtcaggcgtagatgactgagaggagcgcgcgagcgtacttgactgcttcccctaaaccatccgattcttcccgaaatactgctggaatcttggcccctccagcgccagctcctcctcgaaatcgtccgcccacttacagaacggacggttggcgagaccatcgttattgaatcgcgcctgatcggtgatttcggtgatgcagaatttcggaatcgtcagattggtaaccggcccggatcgttcggcctcggctacgatgagcggcgcgttcggcccgccgaacacgtccacgctccagccgtcttccgcaatccacacggaataccggttcttgatgattaccgagccgccgcgcttgatgagttcggcggcgatgcgcgtgtcgatctcgcgctcgacctcgtagcgcgtgccacccacggacggacctttgacggtgatatacgcttccgagaaccggtcgcggtactcgtccagcacggccaccggatttacgtcgggcgtcatgtcgacgtgaaccttgtgcgagaccagccgcacgcgcaaggcgtaattgtcggcatgcacgtagtagctctgaataatgagggtcggggcgtcgccgtcgtcgtattccgccggcagctcgcggcagaagaagcggcgttcgtattcgaagtcatctgtaggttccgacataacctcattgtagagccgatgatggcgattttctcgttattttggcgacgtatgtgcctcatgcagcgtgatgtggtgtacagtaaagaagttactcgggtttgtagctcagtggatagagcgtctgtctccggaacagaaggtcgtgggttcgatccccatcaagcccaccagcatggctttcggctagccgccggaagccttttgcatattcggcgcgtgctggtgctggtgctggtgtcggcaatggcaaggctggtgatgccggctcgcttgggttgtggaaaaaccgcccggtttggcgagaaaggtagccgaatcgtctggaatagcaaggaatagtctgttgatggccgtatgccgggcatcatgcgcgctaaacgcgacttcgctcagtagactgctacgtaatcggcattgccaatcgttgccgatcgtgcgattggtcgtagccggtggtgatgtgtaccggcgccggccgcagcaggtgggcgccccaagatgagaaggagcacaatatgagcgaaaagatggaagccgtagccacttccgaggcgccggccgcgctgggcgcatacagccaggcggtgaaggccaatggcttcgtgttcgtatccggccagctgggcatcgatccggccaccggcgaactggcgggcgagaccgctggagagcaggccgcgcaggcgttgaagaacatcaagcacattctcgacactgccggcaccggcatcgagcatgtgtgccgtgccaccatctacctgaagaacgtcgaggacttcaaggaagtggacgcacgttacgctgaggcgttcatcggctccgtcaagcccgcccgcgtggcctttggcaacaacatgattcccaagggcgcgctcgtggagattgacgccatcgcggtggagtgattcgaacgtttccccggcggcccgtctgcgcgcatggtgtgtgcagacgggccgccgcgtattgtgcgacgcattcccgggaatgtcgcgctaggcgggggtgtgaggtgtggttccgcggcacattcccgggaatgttgcgctggaatcgttgggcggtggtccgtgccacaatagagaccatggcatccaaaggaaaaccgtcgccgcgttcggccgtcagcccgctgagcgacgcccaggtcgagcgtctggccgcccgtcatacgcttgtggacccgacgcagtattacccgaccggccctcgcacgcccaatcagccggagatcgacgcgcagaaccccaaggccacgaaacggttgctggccggcgtgtctggggtgttccgcgccagctgcaagaccaaggcctggggcttggaacaggtgccggaaaccggaccgttcatcaccgccgccagtcatatcaccatgtttgatgtgttcgtgccgatgatgagcctgttccacatgggccgccgcccccggtacatggccaaggccgagatggcgaagtggccattgatcggcaagtggttccagttggtcggcatgcagccggtgcagcgtcattcgggcaaggccaagcagatcgaagagacctcgattgatattctgacgtccggccgcccgctgacggtctggccggaaggcaccgtgacccgcgacccgaaaaagtgggtgatgagcattaaggagggcgtgggatatatcgcccttgaatcctcgcgcagactggggcatcaggtgccgctgtacccggcggtgacgtggggtgccgcctccatcaaccactggtggccatggccgcgcaaaaacgtggtgatgtgctatgaccatgcgctcgattactccgatctgcttgccgacatggactcatggggtgaagaaccgcctgccgaggccgtgaacgagctgatgtggcgcgtgctcaaacgcatgaacacagtactggaggaaattcgtggcgaacagttccccgctgaaggctactgggactaccgcagcatgagtcgcaagccttggcctgaagccggcggcccgttcccggctgagaagtagccgcaccggttcccgtacggggagcctaggcgagtagcatggcacaagattgtaccgatgaagttgcgcgacaagcgaaggtaggaatttgatatgggtaaaaatataacggttctcggtgcaggagcatggggtaccgctttcggccaagtgctggcggacgccggcaacacggtgaccatgtgggccaaggagcagcggattgtcgaggacattcgcgatcgccaccacaacgccgtgcgcctgccgtccgtcgaaaagttgccggacaacatgaccgccaccggggatcgcgccgaagccgtcaagaacgcggacatcgtggttgtggccatcgccgcgcagttcgcgcgagtggcactcgtcgaattcaagggactgattcctgatcacgccatcgtcgtcagcctgatgaagggcatcgagcgtggcaccaacaagcgtatggacgaagtcgtccgcgaatcccttgacctgccggccgaccggttcgccgccatttccggaccgaacctgtccaaggaaatcgccgatcgtcatcctgccgctaccgtggtggcttgtacgaacctcgataatgccacgaaggtggctgaggcatgtaccacctcctatttcaagccgttcgtgaccaccgacgtcatcggcctggaaatgtgcggcagcctgaagaacgtgaccgcgctggccgtgggcatggcccgtggtgccggctatggtgagaacaccgcagccatgatcgaaactcgtggactggccgaactgaccgcgctgggcgcagctgctggcgccgatcccaagaccttcttcggcttggccggtgtgggtgatctcatcgccacctgtggctctccgctgtctcgtaactatacgttcggcgcgaatctcggcaagggattgacggtcgaggaggccaccaaggtcagcaacggtgtggccgaaggcgtgcccaccacggatgcggtggtggctcttggcgagcagcttgatgtgccgaccccattggcgtatcagatgagccgcgtgctgaacgaaggcatttcctgctcggagatgcttgccggactgttcgggcacgaggttaccggcgaataacgagagaagcgacgtatacgtggcgtatacgttgtacgtgcaaagtcgtgtggcgtatacgtcgttgacgtgcgcgagtagactggtgtgtgtctcttgtgcgcggcggtccgagcgcggttcggtccggttggcggtgcaaagcataggcttgaaaacggttgtagtttcaataaaaggatggttatggccaagaagcgtgttgtggtgctctatggtgggcgtgcagacgagcattcgatttcctgcatctccactgccggtgtgctgggggccatggacactgaacggttcgagccgattccggtcggcatcaccaaggacggcaagtggatcatcaacggcgaagatcctcgtggctggaacttggacggcggcgagctgccgaccgtaaagatcaccccggaatcgcgcccggtgatgcttgacccctctcgcggccaggacggtttcttcatcggcgagcccagccacatcaattccgccgattccggcttcggcaccagcttcgtcagcatgcccgacccggaaatgcaccatgcgctgacctcccttggccatgtggacgcggtactgccggtgctgcacggcccctatggcgaggacggcacggttcaaggcctgctggaaatgatgggtgtgccgtacgtggggtgcggagtgtttgcttccgccgcctgcatggataagcattacaccaaggtggtgctgggtgccgccggcattcccaccgcgccgggtgtgacggtcgatgcgcgcaacttcaccgccgccgatgtgcttgccaagatcgaggacgccggtcttacctatccgctgttcatcaagccttcgcgcgcaggctccagcttcggtgtgaccaaggtcgagaaagccgatgaccgcgagacccagcaggatcgtctggccgccgccatcgccaccgccggcgagcacgattggaaggtgctcgtcgaacaggggattgatggccgcgaaatcgaatgtgccgtgctgtgtccgaaggccggtgacgagcctgaagccagctggcccggcgaaatcgtgctcgatcatcagaacgacgaccagttctacgatttcgactccaagtacatggatgcctccgccagccacgtggaagtgcctgccaatctgccagtcagcgtgcttgaggacgtgcgtgacgtggcccggcgtgcgttcaaggccgtggatggtgccggcttgagccgtgtggacaccttcgtgacgcctgatggcacggtgatggtcaacgaaatcaacaccatgcccggcttcacgccgatttctatgtatcccaaggcttgggatgccaccggagtgagctacaccgaactcatcacgcgattgattgagggtgtgctgaggtagatcgagggcgtgccgcggtaggcgctgcgcggcgggcggatgacgtgggtcggccggtggtcggcccacggacgacacgtcgtccgttgtcgttgccgtgcccgttcccgtcgttcgttcatgccgggtttccctaagttcagcggacggacaccaaatggcgaacgcagttcatcgtcgcgccaccgtcaggacaggttggacgcttagtttcttctcttggatttgcaggccgtgcggatgccgcgcatcacgggcctgattccccagaccatcgtctggatgatgttgagaaaaggaacagtatgaacaacctgtgtaagatcgcggccggctcccttgccgccgtactcgcgttctcgatggccgcctgcggttcgagcaacgcctcctccgatggcaccggcgaaagcaccggcaaggccgtcaccgtgaatgaaaagtccgccaaagccatctccctcgccgacttcggcaccatggaagacctcgagaaggccgccaaggaagaaggcgcgctgaacgtcatcgccttgccgcatgattggtccaactacggcgaggtcatcgagggcttcaagaagaagtacccggagatcaagatcaccgagctcgatccgaacacttcttccaaggaagagctcaatgtagccaagaccaacaagggcaccgacgccgcccccgatgtcttcgacgtcggccaggccatcgccgccacctccaccgactatttcgccccgtacaaggtgcaggcctgggacaagattccggacgagcagaaggacgccaatggtgcctactacgccgactacaccggtatcatgtccgtgggttggaacgccgacaagtacggcgatgtcacctccctgaacgacctgctcgatccgaagttcgccggcaccgtggccatgaacggcaagcccaccgaggccggcgcggccttcaacggctatctgatggtcaaccagctcgccggcggcgacatcaacaacctgcagcccggtctcgacttcttcaagaagctcaaggaagccggcaacctgaccaccatcgatgtgaccaacggcaccatcgactccggccaggtcggtgtggtcttcgactggacctacaaccaggcctcctacaagaaggaactcaagtccaagggcgtgaactggaagtacaagaccttccccaaagctcaggttgtcagctactacaaccaggccatcaacaaggacgcgccgcaccccgccgccgcacgcctgtgggaggaatacctgtacaccgccgaaacccagaacctgtggttcaagggcggcgccaacccggtgctgctcgactccatgaaggcggacggcaccgtcgaccaggtcaccctgaaagacgccatcaccatcgaaggccagccggtcacctacagcaacgatgactccacccgcatcaccgagtggcttcaaaacaactgggacaagacgatcggcaactgagagtccacgatgaccgccgcaatcgcacccatcgcaccgaacggacccgtcgcctccaaggccgcgggtccgtccgccgcatcgtcccccgcttcgtccgcactggcgaagcatcgtcaggagcttggcacgctcgccaccacgctcccgttcttcgcctacaccgcctgcttcctgctcgcacccaccgtcatcgtgattgtcggtgcattccaggaccgcagtggcaacttcacgctcgcgaacttcaataagatgttcgaggccaacaccatcgccgcattcggcacctcgatcctggtgtctttagcatcctctctgatcggcgcagtggtgggcgcactcgcctcctacgcgctggtcatcggtgccaagccgaacggcctgctgcgtcgtatggtctccgccatctcctccgtgcttgctcagttcggcggcgtgatgctcgcgttcgcattcatcgccaccatcggcatcaacggcatcggcaccatgcttatcgaaaccctgaccggctataccgtgaacccgaactggctcagctccctgccggggctggtgaccgtctactgctacttccagattccgctgatgatcatcatcttcctgcccgcggtcgattccattcgtccacagtggcgcgaagcctgcgagtcgctcggcggcaatacgttccagtactggacgcgtgtggcctgtccgattctggcaccccgcttcatctcggcgttcctgctgttgttcgcctccgcgttctccgcctatgcgaccgccgccgccctgttctcccagcgttcgatcctggtgccgctcatgatccagggtgccatgcgcaacgagatggaccccaaccagcagggcttcgcgcaggtgctggcattcgcaatgatcatcgtcgtggccatcgtcatgctgctgagccacgccgtggaaaagagggccggacgttggcaatgacttcccgaaccatacgcaccgtcgaaaccgtcggcaccgagaccggcaccgtcggcaccgtcgaaaccgtcggcaccggcgtcaagccgccgcaattgcgcgccgcccgcgcgcgcaaacagagcatcatcaaattcgtgatcctgttcgtcaccctggcgttcctgttcgtgccgctgctggccatgctcatcttcacgctgcggcacccgttgtccggtcgctggtcggccgcgccgtggacggcgattttcaccggcaacggcgaatcgttgggcgccgacctgagcgtgctatggcagggcgtcggcatctcgctgtcgttgagcgccgtcaccgtcgcgatcatgctcatcctgctggtgcccaccatggtcatcgtgcatattcggtccaaagccttggagcgtgcgatcgaatgggtggctacattgccgctgaccattccggccatcgtgctggtggtgggtcttgggccgatctaccgctggctgtccgccgacgtgctgagcaccaacccaatctggctgtgcttcgcctacgtgattctcgtgatgccgttcgccttccgcgcgatcgccgtgggcctcaactccatcgacgtcaagacgttggtcgaagcctcccgatcgctcggcgcctcctggcccaaagtgttcttcaaggtgatcatcccgaacctatggcagtcgattctctcggcatcctttatctccatcgccgtggtgctgggcgaatacaccgtcgcctcgctgctcggccgtatgaacctgcaggtcgcgctctaccagctcggccagtccaattctcaaatctccactgccatgtcgctgctggctctgctcttcggcgtggtgctcctcgttgcgctcgacctgatctccgacgcaatgcgtaagtcaagggaaggtaagtgacccgatgaacaacgattcaactcccacccgtcaggaaaccggtaccgcagtggacgctgccccggtgtccccggccatcccggcagccgtgtcctccaccgccgaggacgccttcaagaacgatcccaccgctaccctcgagggcgtgcgcggcaaggacgtgaccaaggccgccaaggccctgctcaaagacaccgtcaagcgcggcggtggttccattcagatgcagaacgtcgtcaagatctatcccggctccaccgttcacgcgctcgacgacttcaacctggacatcaagcccggcgaaatggtcgtgctgctcggtggatccggttgcggcaagtccaccgcgctgcgatcgcttgccggtctcgaagatatccaaggcggacgcatcatggtcggcggacaggacgtcaccggtgtgccggtgaacaagcgcgagatggccatggtgttccaggcgtactcgctgttcccgcacatgaccgcccttgagaacgtggaattcggccttgaagtgcgcggcatgggcaagaccgaacgccgcaagatcgccatggaacagctggagctcgtggggcttgccgatcaggccaagaaatacacgcagcagatgtccggcggccagcaacagcgcgtggccctggcccgcgcgctggccgtcaagccgcgcgtgctcctgctcgacgagcctctttccgccctcgacgccaaggtgcgtgtgcagctgcgcgaccagattcgccgcatccaactcaccaccggcaccacaaccgtcttcgtgacccacgatcaggaagaggcgctggccgtggccgaccgcatcggcgtgatgaacaagggcaagatcgagcagatcgccgccccgcaggacctgtaccagcgccccgccaccgagtacgtggccacgttcattggactcaccaaccgcctgcccggcgcatccaatggcgacgaggccgtggtcttcggccagcgcgtgccgctgctcgccggctccgccaagggcgattccgtggccgtgctcgtgcgcccggagaacctgatgctggccttggctggcagcagcgattcgcacgtcggcgaacgcgcccgcgtggaggtcattcacttccttggctctttggttcgtgtggacacggtcatcacctccggcgaataccagcgctggaacaagggtgaacagctcaaggccaccgtgcagctgcccgccagcgagctgccggccggtctggcggtgggcgatgacgtgattgtcgccccgcgtccggtcgccgcgctcgcctgctgaatggcgctgcgatgatcgtgcggttctgttctgttttttgtgactgtacgatcgtcgaatggcttatcggcaatgatgtgtgtgggacggcggcgatttttgggcgattatcgcgtgccgtcccacgccggtgcgggatggcatgaacgtcaaacgatgtacattcgtgccgtcccacagaatgtattggggaatcgttgcaatgacgccatttcttcgtgcggcgtcaccagtcatatgtggagtggtgtgggccgccgcgaaaaaattgggtaaaatcgcgtggcgtcccacagtaatcttgcagagtaggggactttctcgtcattgggaatgattgacgttgatcattccttgcccattgatgatttcctccccattcccaatgcaatcgaaacgccgtgccgtattcttgaagagtattgcacgtgtgatcggtccgtttgcggccagtaactatgggggataagtatgagcaaaccaatgccgccggcgcagcagccgcaggtacctgagcgaccacagcagccgcaacaaaccccgcgcgattggtggttcacggcccatcgccggttttcgacaatcggctcggcgctcgccattatgatggtgttctggatcggactgaatattctggccactgaagcactacgaacgctgcttggcgccgatgtgcccgcttgggctgtgttgctcgcctcctccgggccgctgtatgtggtggccatgccgctgagtatgttggctttcactcgcgtaccggttattcgcacccggcagtaccccatgaaggcgggggagttcattcagattttcgtcatgtgcattccggtaatgctcttgggcaatatgattggcaatatattgtctgccggagccactgatggtcaggccaccaatcgcatcaacgacgtgattcttggcagcgactggcgggtgaacgcattgttcataggcctgttggcaccggtttgcgaagaatggatttttcgcaaggagattatctcccgcctgcgccggtacggagaaaagaccgcaatcatgttctccgcattggcattcgcgctattccatatgaacgtgttccagttcttctacgcctttggcctaggactgatgttcggatatgtatacacacgcacctcccgactgcggtattcagtggctatgcacatgctgatcaacctgaacgggtcagtactcgccccattggtgatacaacagatcgatccccgcatcctcgacggcacaatcagcgaggccgaaatcatgcgtatggctgaaaccggcaacatgggcggcatgggcatcatgatgttgtacggcacagtgatgttgggcctctgcattgccggtatcgtgctgcttatcaccaagcgcaagatctgggagttctatcttgcgccagaggagttgcctgctgggcttaaaatacgcaccgcctatgccaatcccggcgttatctcgtacctactgttgactgtgattctcaccggttggatgctgttcgcatgactgtcatagccggacccagagaggcgagccgggagatatcacagattgtctgacgagccgccatcttcaacaaggtatttggtgcccgagccggcgatggctcgcgccgccatatctttgatggtggaaggcagtacaccctcgcgcgcgaacacaagcacttggccggtcatgccgtaaggggagaagccggtgaacttgaccagcggtggctggccctccagtgccacgtcggcggtggctttggttacgcggtcgagaatatcctgactgatagcggacgggtcgccggaggccttggccgtgaattcaagcgtggccatgccttcgctgaccggcgtgagcttggtcagggcggcggtattgagtaccgaattggggatgaccatcatgtccccggagcgggtgcgcactacggtctgacgccaggtgatgtcgtgcacggtacctgtgacgccttgaatggtcaccagatcgccgggttggattacgcggcccagcatcaggccgaagccgccgatgatgttggcgattgtatccttcagacccagcgagatcgccacacctccaacaccaagggcggtgaccagggtggtcggattgatgccgaacaccggttgcagcaccatcgccgtaccggtgacccagatggtcacgcgcgtgagattcacgaaaatcgaggcgctgggaatctgcgaactatccagaaccctgcgcagcacgcggctgatcacgcgatcggccgcgaacacgacggccagcacgacggccagccagatgagcttgcccgcattgacctggaaccagtgtgcgatgtcttgtgcatattcggtcatatgccctactgtatcgaccatttctggtgaagtcgtaaacatgcgggcccacgtcgggttttggccgttgcggtggtgctggtggtgcgataccggtggtgccgtcggtggcgtgccgccggtggcaccaccggtatcgcggtgcagcatcgtcgtggtgatgacgtcgccgtgacgcctagtcccgatgctcgcggcaggtctgtccgaggcccctggccaaacgaatcgggtcgagaatctcatccagttgctcggcgggcagatcggtgcgttcgccggccacctcgcgcacggtgcgaccggtgcgcacggcttcggcggcgatgtcggccgcatgctcatagccgatgtagtggttgagtgcggcggcgatcgacggcgaggattgggcatacgagcgtcccagaccgacgtggatctcgatgccctccacgcaattgacgcggaatgtctccatggcccgcgtcaacagggccatgccggtcaacagctcgtgcaccatcaccgggtcgaaggcgttcagttgcaactgtccctcggccacggcccaattcacggtcacgtccatgccgaagatcgtgaagcagcactggttgacgcattcggggatcaccgggttcactttggccggcataatcgacgatccggcctggcgagccggcacgttgagatcgttgaaaccgcagcgcggcccggaattgagcagtcgcaaatcgtcggcggccttcttcaggtgcacggcgaggctcttgatggcagccgacgtggccacgtacgcgcccatatccgtcatggcggccaccggatcgggcgcggcggtgactggcagcccggtgatgtgcgccagatgcttgatggcggacttgcggaaccgcagatccgcgcaaatgccggtaccgatggcggtggcaccgaggttgagctgggccagcaacggcaccacgcggtcgaacgcggccaaatcggatttcagcagcgtggcgaacgaatgaaactcctgaccataggtcatcggcacggcgtcctgcagttgcgtacggccgatcgtcacgtcattgatatgtttgtcggccagatcgtggaaggccttggcgagtttcttggtggactcggcgagcggcccgatcgcgtcgataagcgcgagtttgcaggcggccgggtaggtgtcgttcgtggactgcgactcgttgacgtcgtcgttcggatggatgtatgtgtaatcgccgcgctggtggccggcgatttccagcgcacggttggcgatcacctcgttcatgttcatgttcgacgaggtgccggcaccgccctgcatcacatcgaccgggaactgatcggccagtttgccggcctcgatttccaggcaggcggagcgaatggcctcggccttggccgggtcgatcaggcctaattcctcattggcgatggcgcaggcgcgcttgaccgtggcataggcgcgaatcagctcgggatgttggctatcggtgatgccggagaccgggaagttgccgatagcgcgctgggtgtgaatgccccagtagacgttcgccggcacctccatctggccgatgcagtcatgttccagacgggttttgttcgatgtttcgctcatgcttccatcttcctgtgtgagggctggaaacgccagcatgagaggctgattgcgccttgtgagaaacctcacgcagggttcattcgacggaagcaatccagactcactggttttcggtcaagcggtgtacccggggaatcctgcggggccgttcgacggtgagatgggggatggcgcggcatgcatgccgggggcggccgaatcctgcgcattgtgcacgaagatgcgattccagtaattaagcatgtccttttggctcatggccaggtatatgcccatggccagcacggccacatcttctttaagcaggtctttgatttcgatggcgtcgctcaattcgggccaacgttgcagcacggcgagcatgccgcccacggtgaactcgaccatgagatcggttttcaggtcaaggttcttggggtcgcgttgcaatgtgctgagcatttgcagacggcagaagtcgcgcagcgattcggtcagttcaagcgtgctgtgcgggcctgccaacagggccaggcggtcgaggcgttgccgttgctctggatctgagagcgtggcggtgacgcggtctcgccattgttcctcgggattgccatttgggtcgggggtgcggttgatcggaatcgattcgacctgatgcaggatggctgaatcggccaattcgggcaggctggagaagtgataatagaacgaattacggttcacgccagcctcacgcaccacatcggtgacggtgatcttgcggtagtcgcggtcggcgagcaattcccagaaagcgttctctaggcgttctttggcgggcagcacctcggaatcatggcgtggacgtggcatctcttcctcctgatgcaccagcgtgatatggtcacgctgtctaataacttattgggcagtataactattatttgtggacatgtctatgagctaatcggcgatttcagttgcgtcctccgctgagggcgaagctgcggtgccggcatcggtatcggctctggccggggccgctctatctgttcctgtcgcggttcctgtcgcggttcctgctggggtctcggctgttcctttggcggtcgcagaacttggtgcggaagctggggcgggcgtcggcctgcgtttggccgtggacgccttgaacagtatcgccagggcctcaaccaaatgacgccggtctgcgggggtcagccctacatacgcgccaagcatcgccggaatcgaagcggggaagttgctcatcacctcgctgaaactggtggcgccgttggcgtgcagcacggtgaacagcgcgtccaccgcacgcttgcgctgttcgggcgtaagcgtggcgatccaatggttcagctcctcgttaaacaactgcgagctggaactcaaatccggctcggtgatgaactggtcaccatccaatagccaggtgaaggcggaatgctgcatgatgccatccgaatcggaagagaccacgcggcaaggctccggggtctcgaaaatcatgcccacaatcgacgaacttggcacgattttcgtcaccttcggctggatggtgcggtaggcggggctggtcacaatctccggcgggaaaccggggccgtccagtgaatagacatgctgaatgcgcttgcgcaccttggggtcggcgttcatggccgcgtaaatcgccaggttgcctcccttggaatggccgaccagaataatcggaccttcccacagtcgcgccaccgtatccagataggcgctggctgaacgttgcgccggcaccggatactggaaagccatattgaaatcttccttccatccgatgagcgaatcatcggtaccgcggaaggaaataaccaacgtgcctttgtaggtcggcttccggcgcttgtggccgtcgggcagttggaaggtggcggcggcgaattgggtttgctcgccctgattgatgcgctcgaccaccgcgcccaggcgaacgttggcgtagcgggggttctcgcctgcggcctggaacaggtcgtgggtcaggtccggattgaccactgaaaccatttgggcttcgtgcggcttgtcgtcggcatgcgttttcggcgaacgatgcagctcgcggttggcctcgtcaaggcttaccgattcaagctcgggatgccagatacccttcaaccagatcagtggatgcttgggctcgaaagcgcgaatgcgtgcggcgaacgagcctgaccgcgtctcatccagcatcaacgtcgggcagatactggccacatcctcatagatgagcgtggagatgatcaaggcgtcgatttcgttgaacggcaagtcggcgaaggagcgcgtttcggtgtgcgcgtaatcgataatgccggtcatacgcacctcctgcttccgttgatattgcatatccccttgggtcatgtggtcttgcgatcgcgtgcggccgtgcggctgcgcgcagcaattaaccatatgcattccattgtagggattgtacggttttggccggcgcgatcgagcaagactgcaccgacggcgaacaattcgtggaaggattcccgtcagcttgtcgaaaattgtcgggtggcagggttgcgatgccagccagccgaccaccctacgacgcacgcgccatctcccgccggcgggagggttaaccactcaatccttttgacgaggcggaccgctgggcccgtcaagggttcggcagatcgaagcgcgccagatccacgccctcgagttcaagcaactcggccttgatgtcgagtcggccgccgtagccgccaaacgcgcggcccgagccgactacgcggtgacagggcacgatgatggtaaccggattgcgcttcactgcgcctccgaccgcctgcgcggccatgcggccgccaccgcgtcgttcggccaattcggcggcgagttcgccgtaacttaccgtcatgccatagggaatttcggccaccagattccacacttcatgttggaatggcgtgccggcgggatgcaacggcggcgtctgatctaggccggggcgctcgccggcgaaataggcggtcagccatacgcgggtcatacggaacacatcgggttcacgatcggattcgcgattcgaatcgagaacggcttggtgatcggtggcccaccaccagtcttcaagacagagttcggtaagtccctcgccgtccgaggccatcatcatcctgccgatgggcgtttcgactgtggcccgcatcagttgtcgttgcgtcataccgccattatcgcgcgttgagggatgaagcccatactgtgcctgatttcatgaaggacgggtcgtgctgtacagtcagtattgcgtgctgggcagcgatatctgacatagtgggggttcttgggccggcgtgagtgttctttccgacatcccaaccgtctaactccgcttcgaggggctgatttgggttattccggaggtctatctccgtttcgaggggctcttcatccgggaaaccgcaagtataaacggctccgggctaacgtcattacgccgtttttggcccgtgtctactcagccaccagccccttgaaacgggagtagacctccggagaaggccaaatcagccccttgaaacgcagcgacccctctgattggagtcaatcagaggggttcggcacattgctgatgcagctggtccgccttgaggtggaacgtaaccaagattcaggcgggattactccgcaacgagcgccaggaaggcggcggccacggcggctgtcgggttcgggaattcctcgtcctggttgaagaacggcacgtcggcgtagttcaggaacttcacttcggcacggtcgccgatcaaggccttggcctcttcggccagctgatcggttatcgtcatgcgttcctgatttccacggccatggccgtgcaatgtgcccatcgcttggttctacccgctgtttatgctggccatgcccatcgcttggctgctgtatacggtcaccgcgagttatgtgcacggcggcacccgataatcgttggaaaaccggtgggacacgcgggggcttggctttttcctgagattggcgtatctttgtcacctgttgcccgtgaaggtaacacatgcggacatagcttagttggtaaagcgcaaccttgccaaggttgagaccgcgggttcgagtcccgttgtccgctctcggatggctggttcaggatgattgattcagcctgaggatgacccgggcggttggcgcagtggtagcgcacttccctgacacggaaggggtcacaagttcgaatcttgtatcgcccactcgatgaatcgccggcagaatgttgccggttttttcatcacaagctcgggcgattggcgcagcggctagcgcacttcgttcacaccgaaggggtcgtaggttcgattcctacatcgcccacccgatatcacgctcgtcagcctatgatggcgggcattttctatatctgctgtgccacggctccttatatggcgtccggcttcgggtggcatctggctgtgagcggtttcgatcatgagtggcgtccggccgtcgtgcaatcccgctgcgcgcggtgccgtttgggctgtaatacgggtgctttgaaccggccataacttcttcatatgtcccggggcttgtgtcgtgtgccgcggcgtgcttccatagtggatatggcggtgcggaaggggagccgccatacttgcttacacaaggacgtcttggtcagccagggcaacggcatggaaaggggtttgcgatggtgtgcaccacgctgaatttcgcggagaaatacctgctgaaaaccgaagtcaggtccgttgccggtatgtccggcggtacttccgatgctggtactgatttcgatgtcgatctcggtggcgagggcgacctcagaagcgatcatgccaccggtttcaatcgctcgctatcggccgacgattattgggctgcagccggatatgccgatgagtcattgtattgatggacgtgatgacgcggtaagggcgcgtcgataagtgcggctggtgtcgtggctgatgccgcatttggtgctcgttcggtggtcgcggctgatgttccgtacggaccgcctgcaatggttttgcatcggtggtgcgtcaaaatccggaccgtcgccgacgctgttgacgtctggcggcgttggagggacagataatggattgtcaacgccgctgagaacgattggcgacggtggtgggacagcggatgccctaccaccgtcgccaagagtggtacttgtgtcggtggcgtccaagacatggcccggcaccgacatcagatactctgaacgtcggcggattcccgttctgtgtcccagcgccgacgtttgattcctgcttatgcgagctggcgtcggtaaaaaggcagaacttggttcaccggcgatgtctcagcacgtttgcgcgcgtcggatccttctggagcagcgggaaaacgagcgccacaacgagcaggacggcgatggacagcacgccgaacgaggcgttgccggtcagggacgtggtggtggctaccaggaaggtgccgatgattgaggctgttttagggaagaaacaatagtgagaccggggaacccttgaaatcattggggaatcatggtggcgatgcatgcgattaacgcatgttgttaacacagatgtggaatgaggaggcgcgtgaggctcgtggtctgcgacgcatgagtgtgaccgtgagctccccagctgatgagcgcaaaggcagagattggtttcacgcgggattgtcccgatgtcaaggtcatgatgcaaaagcgttaagcatcctacggattatattgagaagagaagtcattagtaatacaattggctttggaaaggattcattatgagcactactactgttcgcatggatgatgatctcaaagctgaagtgaacgccattcttgattccatgggattgaatttcaatacgttcgtgaatatggccagcgtgcagttggtgtcgcagcgtcgtattccgttcgaggtgaaggcgcctgaacccgtgctgcctcgcgcgggacgtgttgccgccaatggagttacgtaccgtggggtcgacgaacagggatatccggtgatcgaagtgccgaacgccatggtgttgaatccaagccggggcgccgatggtgttgccgtactgcccaaggcgtggcgcgatggcgaataatcatgatattccggaattgatgccggttccggagcaattgcatgtcttcgacgtgtatcgcatgcaggtgcggttcctccggtcggatctacagggattcaccggtagattgagccgaaatgatgccatacgtgtggccaatgcggtcggcgaggtaaagcctgaagaacaggtgtggctgtaattctgttctgccgtctaactggttcggggtactcactgtgaaccagtgcacaattgcgatggtcggatgtctttctacagtccgcttatatgtgaaggttttgtggtcgacgttgcgtcatatgttgcttgtgacgttgcgtaatgcggcatattgcttggtgaaaggaggttaggccatgtcgatggacgatgaaacggacagccgatacaccacaggggacatcgccaaactcactggtgtgagtgtgcgaaccgtgcagtactacgacgccaaaggtctgttgattcccaatgagatcagcgacggcggccgaaggctgtatggggctgcagaggtcgagcggatgcgggtcatcctttttctcaaaggactcggcttcaagctggagcagattcgctcgattctgtcggacgagcggccggaacgggtgctggttgatttgctggatcagcagacggcatccttgcagtcgggtatcgccgagcagaagcaacgtcttgatgactgcttgcagctgcgcaaagcactgacggtctcggcgtcggacttcgtatcgtcaacattaaccgacatggcaaccgttatgaacaccacaaccactcattccctgcgcaccacatatttggtcatgctggcaatcgcattgcccgcgactttgttgcaaattgcatgcctcgtcatcggtgtgatgacagatgtatggtggccgctgccggtcgccgttctgctggcgattgcgctcactgttgcggcgatgaagtactatcgctcccgcgtgcagtacctatgtccggcttgccatgagaccttccagccgggtatgcgagagttcgtattcgccgcacacacgcccaagacacgcaagcttacctgcccgcattgcggtcacaggggtactgcatggaactcagcatctgaaagtttctgattatagcgttcgatttaccaacggtagttgtcgcagaatttgcgacaactaccgccctgtcaaaatatgtgcgttgtgcagggctaaattgtttcaggtcgcggctcgggcggtagggtctgccgttttatcgctgcttcggcgttcctgttgctgattgatggatgatattacgcttgcgtcgggtctttctgcagcagcaggaagaccagcgccgcgacgagcaggattgcgatggacagcacgccgaacgaggcgttgccggtcagggacgtggtggtggccaccaggaaggtgccgatgattgaggcggtcttgccgaagatatcgtagaagccgtagtactcgttggcgtgatccttggggatgatcttgccgtagtacgagcgggagagcgcctggatgccgccttggaacatgccgaccagaatcgccagaatccagaactccacggccgatttcatgaagaacgcggcgaagagcacgatgcacatgtatgctacgaccgccgccgtgatcatcgccttgcaaccgaatcgcgccgccaggcggccgtagagaatcgcgcaggggaaggccacgaactgcgtgacgagcagtgccaccaccagctgggtggagtcgatgccaagctcggcaccgtaggaggtactcatcgaaatcaccgtgttcacggcatcgatgtagaagaagaacgcgatcatgaacatccacaacggcttgttcttcacgattttgccgaacgtgcccgccagttcgctgaacgtgccgcgcatggccgagcccagctggtcacgggtggcgcgatagtgcacttggcggtagctggtaagcagcgggatggtgaatgccacccaccagatggcggtgatgatgaatgaggcgcgcgtgcaagccaccgtggaccagccgaagagcgacgggccgccgaagatcagcacgatgcagaagatgaacggcacggtggagccgatgtagccccagccgtagccgtgcgaggagaccttgtccatgcgctcgttcgaggtggtgtcgataagcatcgaatcatagaacgtcagcgagccgttaaggccgatggtcgccagaatgtagacgaccaggaacggcagccaggtcaggggcaaggccattgcgcagcaggtgaccacgccggtgccgaagaagcccaggaagaacttgattttcatgccttgcacgtcggcgatggagccgagcaacggcatgagcagcgctatgaccaaggaggcaatggtttgcgcgtagccccaggcggacacgatgttgccgtccgccggcatcagcgatttggcgtaaatggggatgacggcggtggacagcagcacgaatgccgagttgccgacgtcgtagatgatccacttcttttcgcgggcggtcagtttggcgctttgcggcaccggttcgtggacattcgtgggatcagtcatatgcactcctcgacggtattcaactcaatctatcgtagaagcgcggactagggtgggggccattccggttgaacggcgggtgaataatgccggggcccctttctaaggggagccagggcagaaaaatagctcccctcgctgaggggagctggccgcgaagcggactgaagggagccgatcgtggactgaagggagccgatcgtggattcccccagatgaggaaatccactcaatcgtccggaaactattcgccgatcagcgcgatggcctcgtcgtaatcggggcattgcggcacgccgttgaggctgcgctggatggcgatggatgccgccgcgttggcgatctttaccgattcggccagactatggccctttgccagcatcgcgcacatcacgccggtgtggcaaccgcccgccgaacgggtgtgtacggccttggtcgggtatccctcgatatgaatcgtctcgccacctggctcacgaatccaagcgccgcgggcgccgacacgcaccaccagcggcgcgcgcagtgtagtgcccaagccgtcacacaactggtgcatgaagtcgtcgagtccaccgccgatggtgaccttgctgtcgtcgatcggcgcgcccaggcgctcggccagcgtcatggcctcctgacggttgcaggaccagaccgggcgtgcgagcaccaggtcctcaagcatatggtcgttgaccagacgcaacgtattggtgggattgatcaccagcgtgtagtcgcgtgcagccgggtcggtaccggccttgagtaggaatccgtccacgccggtggccgtatggtccatcagtgtgttgccgctgatgtgcaccacgtctttgggctgcggctccagcgtgttgaacgtgtccgcgtcgccatgagcctcggcgccataggaagcgatgaacgtcttcttcggcgcgccggagctcagcaccacgcggaaaccggaatcctcatcaagacgatcctggccgatatgcgtaatgccgttgtcttggaatgactggcggatgaaatgcgcccacaggccgttgcccagaatgccggcgtgctcggtcggcacgcccatgcggctggccgcctgcagcacgcgatagctgccgccaatggaaggcttcggatgatcggccacggcgaatccgccctgtgccggcacctcgtccacattgagcataatgtccacccagacttgccccagtgaaatcacgctgggctcgtgagtgccgatacctcgcctgagattcaacatgacagcctccttcgtcgtaagttgcacgaggaccccttcgtcccttgccatctcttataccgagattatatgagagtttgctggatgcggaataggcaagccggcgtgttttatcaggtaaacgctacgatttgcggcgtaattcgccgatggcgaaccaatgccgagccgctcgcgaaccgctgatggcccactcgcaagttacgctcgaaccgcgcgtgaaccgccgaagttcacccatgatacacgcaagagttgcggttgtcggtattgggctatatatttgtgaagttgtgtgttcggcatgtcgggtgaaaccggcggtcgaatgcgcgaaagacttgacacatcaaggttaagggagtccatcatggcagctcgttgcgcagtgtgcggcaagggaccgcagaccggtttcaccgtttcccattcgcaccgtcgtaccaagcgtagcttccgcccgaacctgcagtctgtgcgcaccacgattgatggcgagaacactcgcctgcgcgtgtgcgtcaagtgcctcaaggccggcaaggttcagcgcgtggccgcgtgaatcgcgtactaacgtggagcaaaacccgtttgagcttcggctcagcgggttttgttgtttctgcggcctaaaggggccgtgcgaatagaataggccaatatgagcatcactatggacaccactctcgcttcgctggtcaccaacaagcgtcgcgtgtccgcgctcaaatcgctgggaatcgtcactgtcggcgacgccctgacctactatcccttccgcgtcaccgaaccggtgccgcttcgcgccatccgcgaggccgcacccggccagcagatggcatttgccgccgtgatacgagacatgcgcgtggtgccgatgaacgctcgccgcggctaccgactcgaggcggcggttgacgacgccgactttgcccggtctcgtcgcgtacccggcagcacggctcggctcacgttcttttcgtatcgtaaatcgtatgtggattgggtcagcatgcggctgcgcgccggcacgtctgtggtggtctccggtatgcccagcgaatacatgggtcagctgcaattcacgcaccccgaaatcctcactgtcgcgcccgggtcggccggaacaggagcggggcttgagggttacgctcggggcgcggcatccggcaatggcgcgtttgcgggaagtaccgatccgtatgccagtgcgcagtccgcgtatccgccggccgcggctgccccttccggggccgcgctgaaatacgacgccgataccgtgcaagaggcgcttacccgcgtctgccggccccgcccggtatatcacgccagttcgcgtatttcatccgaacatattcatgagacgattctgggattgctgtggatgatgggggcccgcacgtcatccacgcctgacgggcaactcgctggcgctgggtcagtcgacatcgtggctcccacgaccgacaccatcgccgtccaaaacggggaagagaagtccggcacgaccgccgaatccggtgctgaggcgctctcccgatccatcccagatgtgctgcccgaatcggtgcgcaaggccaagaacctcatgcatcgggctgaggcgttcctggccattcatgatccggcctccacggcccggttcaaggaagccatcgaaaccctgcgctatgaggaggctttcgtttcgcagacctcgctgctgaaggctcgacagcacgcgcacaagtcatcggcgcatccttgcccgctgaacgaggcgctggaaacagctcgagcgtcggtgggcgaagcggccgcggagccaagcgcacaaccgggagcatcggagcgcggtgctgcgaccaatctgcctgatctgcccaatttgcgtgaccgtttcatcgcctcgctgccgttcacactgacagccgggcagagtcaggtggtggacgacatcgcggccgatcttgaacgtgactggcccatgcaacgtctgttgcagggcgaagtcggctccggcaaaaccgtggtggcgctcgcggccatgctgcaggcggtcggcgccggctatcaggcggtgctggtggctcccactcaggtgcttgccgaacagcattacgagaccatcagcaagatggtgtcggggctggcccttgcacagccgggtgccaaggagaccgatgccgcggccgacgttgagggcgcgatgggcgcgtccagtgcttcgacagtctcttcttccaaggtgtctgcggaaattcccgtcaccctgctgaccggtggcatgaagcttgctgcgcgacgtaaagcacttgctgcggccgccagtggcgagccgggcattatcgtggccacgcacgcggcattttccaagaccttccaagccccgcacttggccttggtggtaatcgacgagcagcaccggttcggtgtggaacagcgcgaaagtctcaacgccaaaaccgacgacggcaccacgccgcatctactggtgatgaccgccacgcccatcccgcgcactgccgccatgacttggttcggtgatctcgatatttcctggctcaccgaattgcccggcggccgcaaaccgattcgcaccgtggtggtcaatgaggccgacgccgccaccatggggcgtatgttcgcgcacattcgcgcgcgagtcgacgcgggggagcgggcctatatcgtgtgcccgcgcattgatgcggatgatgaggagaacgaaggcggttccggcgtttcgtcagcagccggttctgccagcggacgcgccgcagcatctggttccagcgcccgcacagctgcgggcggccgtgcgacgcgcgcggcggccgacgccatcggcatcgacgatccctacgaaaccttcgacgagaacggcgaaaccgtggctcgcccgccattgcatgcggtggccgaaatcgccgaccggttgcagaaactcccgcaattccaaggcattcggtttgcgactctgaccggccgcgacaaggatgacgtcaaaacccaggtcatggccgattttgtcggcggcgagactccgatcctggtgtccaccacggtgatcgaagtcggcgtggacgtcaagcaggccagctgcatcgtcatctttgatgccgaccgatacggcctctctcagttgcatcagctgcgcggccgcgtgggacgtggcggcaccaactcgtgggcgttccttatttcccgtgcggaacccggctccccggccgagcaacggctcgaagtgattcaccactcgctcgacggtgccgaaatcgcccaagccgacttggaattccgcggtgccggcgatgtgctcggcgacgcccaatccggcggcaagtccagcctgaagctcctgcgcgtggtcaaggacgccgacatgatcgccgacgcccgcacccgtgccgagcagcttctggccgccgaccccgaactggcagacgaggtccaactcgccggtgccgtcctcgacttcacccgaggcaacgaaaccttcctgacctccagctgaggctagggctgcgccccccccgtaatcgcacgatattgtattttcatctggtaaacagaagtaaatgcttgtgccagagacggattgcatatgcatgggtgcttcgtggaagctgattctgtgttccgttgctgagttacggacgtgctggcgatacgcagctttcgcgttcgacaagctgcgtgggaaaaatgaagtaattctgttccacctttccttcccgcgcttcgagaatcaggttgatgcattgtctggcgatgaggtcgaatggctgcctgatggtcgtcagggatggacacatgcttgccgcaggatagacatcgtcgaaaccgatgatcgataattgttcgggcagactgatgccgtgctgtcgggcggcgcgatagacgttgatcgcgacgagatcgttgaacgcgaagatggcggtcggtcggtcctgctccctcatttccaggagattgcatgccgccttgtatgccttgtcggatacgtagtcgccgaccttgatgagatgcggatccgcgctgatgccgcttttctgcagcgtcgccatgtatccgctcagccgcgcttgtgaggattgtgaattagtagggccagtgatgacggcgattcgtcgatgccccaatgatatgagatattgtgtggcgatcattcccccggtccagttatcaatgcctacccccggctcttctcttttcgtatgcgacgctgcaaaaagcgttacatatagagtagagaaattttcgctactctagaacagcttttctatcggcgtgttgctgcctatatagcggagacggatgctgcagccatggattggctgctgtttcttcgatgggtgcgatttgtgcatatcgttgcaataaagcccttctaaggcgggaaaacaagataacgaaaatttcgccacgcgcgatgaagttttatttgctttttttttttaaagccttgtacattgaaggacgtaccgatggatgaaacggcaatggcgacgatgttgttgacaggctcattcagacgggttaggagaaaaactatgacaaatgcaacggcgcaaccggatacttccgtgatgcgcaagccgaagcgccaatacataggcatattgtattgtcttccatacgtggtggtcttcctgttcggcatgatcgtcccgatgttctacgcgctttatctcagcttcttcaagcagtcccttctcggtggcaccacattcgcgggcttcgacaacttcatccgagcgttcaaggatgaggctttgtggggcggctttaggaacgtgctgatttacgcggcgatccagattccgatgaatctgattctgtccctcgtggcggcgctcgtcttggactcccagaggatccgccatatcgcggtgccgcgaatcctgctgttcctgccttatgccgtcccaggcgtcatcgcggcgctgatgtggggatacatttacggcgataagtatggtctttttggacaaatcgccggtatgtttggcgtagcggctcctaatatgttgtcgaagcagctcatgttgttcgccatcgcgaacatctgcacttggtgcttccttggctataacatgctgatttattattctgcactgatcggcattccgaacgacctgtacgaatctgcccgtattgacggcgcttcggagctgcgcatcgcttggtccgtgaagatcccccagattaagagcaccatcgtgatgacggtcctcttctctgtgatcggcacgctccagctgttcaacgaaccgaacatcttgcgtacttccgccccggacgtgatcaacagcagctatacgccgaacatctacacctacaacctcgcattcaatggccagaacgtcaactatgccgctgccgtctctctggtcatcggcatcatcgtcatggccttggtcgccgtcgttaagatcatcggcaacaagtgggagaacaagtgatgagtgaagcaatcgcaagaccgcgttccaagtcgctgcagcgcagagacgccaaactggcgctcaaggcaagcaagcattacaagcgcatgcagcagcgtgagccggctccgaagctgaccggcaagcagcgtgtgctcaactggctgctgcacatcattatggctgtgatggtcatctactgcctcgtgccgctgctgtgggtcgtcttctcttccacaaagaccagtgagggcatcttcagctctttcggcctgtggttcgatgacaagaatgtgttctggcagaacgtgcaggatacgtttgcttatcagcatggtgtctacactcgttggctgttcaatacgatcatgtacgcagtggtagcaggtgttggtgcaaccatcattgccactttcgctgggtatgccatcgccaccatgcgattccctggacgtaacgccctgctggccgtcactctggcattcatgtcaattccttctacggtgatcaccgtgccgctgttcctcatgtattcgaagatcgggctggtcggcactccgtgggccgtgattattccgcagcttgccacgccgttcggcctgtatctgatgatcatctatgcgcagacctcgattccggtctcgctgatcgaagccgcgaaactggacggtgcaaacacttggaccatcttctggaaggtcggtttcccgctgctgtctccaggtttcgtcaccgtactgctgttcacgctggtcggtgtttggaacaactacttcctgccgctgatcatgcttacgaataccaacgactacccgttgacggtcggtctgaacatgtggctgaagatgggtgcccagggaacttcagacggtcaggttccgaacaacctcatcatcacgggctcgcttatcgcagttgttccgttgatcatcgcattcatgttcctgcaaaagtactggcagtctggcctcgcggccggctctgtcaagcagtgaacccttggccgcacggtccctacgatcacacattcgttgccttggcgaccgtgcggcatccatctgtttgaaaaaacaacaagatagtaattcatgacacacaaaggagtaatcatgaagaagagtattcgccttatagctgctgtagcagcattggccatgactgctggagcggctgcctgcggctctggtacttcgcagaaaaacaataaggctgatgtatctttgaatgatattaattccgctttaaccgatacctcaaaaacaacggatttgacggtatgggcatattcggctaagcaaatcgaaggtccggtcaaggctttccaggagagatatcctcatatcaaaattaacttcgtcaatacaggcgctgcatctgatcatttcacgaaattccaaaacgttgtttctgccaataaaggcgttccggatgtagtacaaatgtcgatcagcgaatatgagcagtatgcggttagcggagcgctcctaaactttgaatcagatgaaattgaaaaggcttggggaacgcagtatgcacaagcagcgtggaaaaatgtgcactttggtggtggactgtatggcaccccgcaggatgctgcacctttggccctatatgttcgaaaggacattctcgatgagcatgggctgaaagttcccactacttggcaagaattctatgatgaaggagtcaagcttcataagcaggatccaagtaagtacatggggttcatttcctctagcgatacttctttgttcggtgtattacgtaccgttggcgcaaagccttggacggtaaaggatacaacgaatattgatttctcgctaaccacaggtcgggtggcggagttcattaaattcattcagaagtgcctggatgatggagttcttcgtgctgctgctaccggtacagatgaatttaatcgtgaagtcaatgatggcgtatatgcaaccagattggaagggtgctggcaaggcaatatctacaaggatcagaatccttctttgaagggtaagatggtcgtcgcccatcctttggcatggggtaatgatggagaatcgtatcagtctgagtctactggctccatgttctctgtttcatcagctacaccaaaggataagcaagcagcggcattggctttcattcagtgggtcaatggcagcaaggatggagtttctgagttcttgacggcaaataaaggtaattactttatggcctctaactattatcagaaggataagagcaagcgagatcagcaagaaacagacggatatttcgcaaatactaatgtgaatgagatctattttgagtctatggataaagtgaacatggactgggattatattccattccctgcgcagctcacagttgcgtttggtgataccgtagctcctgctctgacaggtaagggagacttgttgactgcatttaccaagttgcaggataaccttaagtcttacgccgaggataacggttttaaagtcaccactgacgcagactgataaccgcccataatatgttgttgcggggaggatggctggtctgccgtcctccctttttgagattaaacatctttccaaggaagcgcactgtgagcgttatcaccaaagtcaccacgtatgatttccggttcccgacatcggccacgttctcgggttccgatgccatgaaccctgatccggattactcctccgcctacgtcgtcgtctccacggatgccggtgactccggcaatggattcgtcttcaccatcggccgtggcaacgatgtcgtcgtccgggccatcgactccatgtccgagacccttatcggtcgtaacgtcgaggaactgctcgacaacatgcgtctcgcatgggatctgttcgtgcgcgattcgcagctgcgctggctcggccctgagaagggcgtcgagcacatggccatcggcgccgtgctttcggccctgtgggacctcaaggccaagcgcgccggcaagccgctctggctgctcctttccgagatggagcctgaagagctcgtcgcgacgcttgacttccgttacctgaccgacgccctcactgcgcaggaggccatcgatatcctgcgcgccgcccaggaaggcaaggcggagcgtatcgcccacctcaaggaagtcggttacccgggatattcgaccgccgccggatggcgtgcggtcggcaagatacagagaagtatgtgcaagatacggagaagtatatgaatgcgataagtattgcgcttccattccgacagtggaattatttgcgttgtctgtctaatgtgattcgaccagatgggacgtcgatagtcggtcctattccgtgtgctggtgatgtggagttgatcatccattagtgcctcatatgcatatcggctatcaatgtgggtaggtgaaggagatatacgcaagaatatctaagatataagttcaaattcttaatcttttcaatgttgatttatatgtgtctggagtgataatgtcaaaaataattaattatagtgaagtactggaatccaaacgtctgatggttggcgtcttgtcggtgtctttcttattgtccgctggtaatgctattagcggaacgattcccgcgatggaagaagcgttctcgaatatttcgaaagccaatattgagacactaacgaccataccgacagcgggaattatgctcggaaccgtcctctcgggtgttttctcgaattatctaggaaaaaagaaatccgtgctcgcgggtttgattatcgctttggttggcggtgttatccccgcgttcctgcctcaatactggccaatctttatttcgcgtttcctctttggcgtgggcatgggtatctttaatccgctttctgtgtcctatatcaccgatctgtatgtgggggatcgtcagcgtagtcttcttggataccgcaatgcggttagcaatctgggtgataccatcatgcttttcgttgctggtatcttgattacctttggttggaatatcacctatctggtcttcttcgccttgctgataccgattgttttaataattttgttcgttccaaaggaattcgataatttcgatatcaggaacagtgctctggatgagaatggtcagattagtgacagtgtgtctgatgtcaaaccatctacgaatctcaaggtgatcgaggttggcgttgtatttatggttatcactatgctatataacgcgatcccgctgaaatttgcgagctatattgtcacggagcatatcggcactgcctcgaccgccacatggatcttcagcttcctggtcttggcgggcattttctccggcgtgctgttcgagaagatttccaaggttttcaagcgtttgacggtgttcgtattcgagattgttattggcgtcgcctatatcacgattgcgttcacctacaacattccgttgctgacggctttggtgttgatctctggctttggttggggtattatcaacccggcattgacagcgcgactcgtagatgtgtcgccgattaactctatgaatctgagtacttcaataattgttatctttatcagtgttggttctcttatttccccgtacttcttcgcaatgttcgcgggcttgttcggtaacgattcggctgcgttcgctattgttgtcggtggtgccctgtatgtggtcatggccgtgcttgatttcatcaaaataaagaagaacaaggagctgagcatctgattgattcgtggttggaatcgttgacgacgattccaacccggcaatcggaagccgttccatcgcaacaaaggagttcaatgatgtccaccgcaactggtttcccaaatcgccagattaatctggattttcataccagtccttacgttgagcatgtcgccgacgatttcgacgccgaggaattcgcggaacgtctgcatcgttctcacgtaaactcgataacctgtttcgcccgtgaccatcacggctacctgttctatccctcgaagcgccatcccgagctcgtgcatccgcacctgtcggacaggaatctcctgcttgagcagatagacgcctgccacaagcgcggcatccgcgtccccgtctacacgagcgtgggctgggacgggtacagcgcgctcaaccatcccgagtggcttgcccgggacccccaagacaatgtaataaacggatgcccgtcggttccaaagccgaacttctacgattcgctgtgtctgaacagcaattacagggcctatctcatcgatcacctcaacgacatcatcgacagcctcggcccggaccgcgtcgacgggctcttcctggatatcttctccttggtgccgtgcgactgcccgcgttgccgggagcagatggagcgtcatggctttgaccacaccgatatccgccagcgggaacggtattcggccatcctgcttgacgagttccgtcgtgaggtccacgacctcgtggatgatcgggtgcctggcgcgactctgttcttcaacggtgggcatatcggcccctcgaacaagacctcgttggacacgttcacccatctggaggtcgagagcctgccaagtggtttttggggctacgacaacttcccaatcgtgatgaggtacgtgcgcaatctcggcaaacccgtggtcggcatgacgggcaagttccacacggcttggggtgatttccattcgctgaagaacgaggacgcgatggaatacgagtgcttccagatgctgacgatgggcgccggctgctccatcggggaccagctccatccgagaggcgggttgtccgacgccacctatgatctgatcggacgggtctactcccaggtggaggccctcgaaccgtacacgctggataccgacacgatggcggacatagcggtcatgacgccggaacgcgaatggaacatggacagcgcgctgtccgattcgttgatcggcgccaaccggatgctcacggaactgggatgccagttcgacatcatcgatccggacatggacttcacgcggtacgggctcatcgtccttcccgacgagatcgtgtcctcccccgaactccaacggaagctgctggactacgtgcatggcggcggcaaggtcgtcggcacgtacatgtcgatggacaacggctgcgacgagaccaatccgctgtacggcaacaggatgctgggcgattcctattgggatcgggatttcatcatgccgaacgacgaggtcggggcgcgtctgcccaaagaggagttcgtcatgtacgagcgtggcgcgcgggtgaggacggcgggatcgcgggtgctgctggattcggtcgaaccctacttcaatcgtgaggggaggtatttctgctcccacctgcatgccccctcgaccgggagggtcgggttccccgcggcgacgcggtacggcgacgtcgtctatttctcccacccgttgttccgcatctacaaggatttcgccccgtcgtgggtcaaggcgatattcgccgacgtcctcgatctgctgatgccgaggcagctggtgcgcaaggaggacgggcatacggtcagcgggctggaggtgcagctgcgccgttcgggttcgcgcaattcgttgatgctgcattgcctgtactacccctgcaagaagtcggccgccaacctgtacacgatcgacgagaaggttccgctgttcgaccagcgcgtgcgcgtgtatgtgggcgacgccgagatcgagtcggtccgcgcgatccgtcagggcgaggtgatctccgaacgggactacaccgtggccgacgggtatgtcgatctgaacattcccaagatcgacgggtacgagatcatcgagttgtcgctgaaatgacgcaccgactcagaatcccggtctaacggccgacatgggggtctggaatcgtctctaagcctttgccgaaggctcagagacgttgcatgcggctgcctgaggagtggaagacccttgtgttccgcacccttgggtcacagccgcttcgggcgcggagttttcgttgtttcaggactggattccgtgtgccccgtcttgtcggcgcgtggcatcaggcattggtcagagcgctgactcgctggggtgactccaatgatgtcggccgtattcgacgaatacggctcgtacacgtcctcatggtcggcggtctgcgcgaaatccatcgccgaagacgaggactggtggaacgaactttcgtccgcctatcagtgggtgatgtctgaaatggggcacaagggaatgccgcgtccggacccggatgcggccccgttgtgggcgtgggtgcgctgggtcgattcgaaaagccgggcgcgcacccgtcccgaccgccggtatccgggtttccgcaaccagtacgacgggttggagctcctgcatctgcaggtcgatgagaatcgtgtattgtgcacggatttcgaccagtaccattgtgtgatcaaccggtggccgtgcgccccgttggatgccgacaggtggcctcccgccgaatgcgaccggtggctggacgagcattgggacgacccggccgacatgaaagcggtccagtatcggaagaacacgatcgtggatccgaaacgtctgccggaccggtggatacaggcctgcctgtggacggtcacgcccgaagatgtgtttgatgtgcgccgtgcgtgcgggaaaccggataccattgggaatctggatgatctgaggagcagggcggccaggtttgccgaatcatgggctggacgcggcgacgagaaatccgagacccaacagtattggcgggacctgttggacaaggtgctgctcattccggacacgagcgacgggcagacgctctggttcgaacgtcgcaccgcattgggcggtttcatcgacgcgctcatgattcaggcccgcgtgctcgtggagcagaagagcctcggcgtggatttggacaagccggagccgcgccgggggagcatggtcacgcccgtccgacaggcgaaacggtatgcggacgccctgatcgctgatcccggtttttcaggacgcatgccttctcctggaaaggagcggagagcaatggattacagcgaattcgacgccctgccattggagaccgatatggtttccatcagcaaggacccgtcgcacgacggcattcgcgacatgtcctcattggaaaaggctggtgaaatcgtctccgcacgaatcgggagattgggcggactccgttgggaatcgcggataggagcggggtgtcaactggtaactagggtgtgtttacactatctaggttttgtgtgatgattggcgtatgtgtacgccggggtatggcatcacgcttgaccggttcatgagggtcgcgcacctgttgccgcgccagaggggcaacgtggcggtcgacaactacaggttcgtcaacgccctgctgtggatgtgcaggacgggagccccgtggagggacctgccggagtgctacggcaagtggatcaccgtctgccggcggttcgaccgctggtacgggaacggcgcgatggaacgcctgttcacggcattgcaggaggagcggatcatcggggtggagatccgggtgctcgccatggactccacgagcgtgaaggtccaccagcacgcgcccggcgcgttcatgggagccagcctgctcatggaccgcgcctacgagggggattccacccgcctgctggcggagtcgttcggcctgacgccggtcgtgccgcccaagaagaaccgcacggacccatgggactacgacagggaggcatacaaggggcggagcatggtcgaacgcgtcttcaaccgcatgaagcaccaccgcaaggccgccacccgctacgacaggctcgacgagaccttcctcgccgcgcccggctcatcctcatcgccatctacctgaaaacacagccaaaaactcaaagtgtaaatacaccctaattcatgattggtatgcgtagatgagcctgtacagtgaaagctatgcgtgtaatttctggacgattcaagggtatggcgcttgctacgccgaaaacgggtacccggcctaccacggatcgcaccaaagaggcgattttctcgcacctcgactcatggggagtgctggatgacgcccgtgtactggacctgttcgccggtactggtgcgttgggcatcgaagcactgagccgtggcgcgcgagaactcgtggccgtggaaagttcccggcctgcggcggcgctgattaccaagaccttgtcgcagttacagaagaaccgttcgtgggatgcttcgctcaaggcccgtgtactggtcaaaaaaaccgagcaagtggctggcggctttggtgaatcctttgacgtgatattcatcgatccgccctacgcctatgagaccgctgaatgcaatcagttgttggccaatctggcggtgggcagcgccaccaacgagaacaccgtgattatgctcgaacgctcggtacgctccgacacccccaccgcccccgaaggctggcaaatcactgaaagccgcaactacggcgaaaccgccgtcttctacatcgaatccgcggatgacgactcggatatagagcgttccgacgattccgccgcgtagtgaatctcccaccgtgtggtgaattaatcggcgagccggcgcggatgggcggcggagacctcccagcccaaggccatcagggtcttgcggtcggccttatccagcgccttgcaatccagtgccgcgataaggtctggccgaatctcggcggtgcgggccagcgcttcgtcgcggcgaaaacggtccaccttgccgtggtcgccggacaacagcacgtccggcaccgcaataccacgccacacggcgggcttggtgtactggcgatgttcaagcagtgcgccctcgccggtataggactcctccacgatcgaatcgggattgcccatgaacccgggcatcaggcgggtgatggcctcaagcatcaccgataccgctacttcgccaccgttcagcacatagtcgccaatcgaatattcgcgtacatcgacgccctgggagcggtagtagtccgggatgcgcgcatcgtagccctcataccggccgcagccgaacagcagatggtcggcatggctgagctcggtggcgtcgcgctgggtaaacaacggggccgatgggttcgggaagatgagcaccggtgtgccggatggggcggaggagtcagacggccgcgagaatcccagcagttcgtccaggcattcgctccacacctcgggcttcatcaccatgccggcaccgccgccgactggcgtgtcatccaccgaatgatgcacatcgtgggtccagtcgcgcaggttatgcgccttgatctccaacaatcccttggcctgggctttgcccatcaggctgaggttcatcacctcaaagtattcggggaacacgctcacgatatcgatcttcatgttatccagcctaacggtagccccgcccgcattacacggccaccactacactattgcggtgatgaatacgacgatgagaatccccacccgcaaaaagcccgaagtgttgtccccggccggcaacctgaggggtctgaaaaccgcggtcgattatggtgccgacgccgtctactgcggcggcaaagccttcggcatgcgatcggcccccaaaaacctaagtcttgaggactttgaggaaggctcgcgctacgcccatgaacgcggcgcccgcgtgtacgtgacctgcaacgtgctgccgcgcaacaacgagatcgaagccatgcgcgagtacgtcggccagctcaaggacaccggcgtggacgcgctgatcgtctctgacatcggcgtgatgatgatggcccgccaagtggctccgaacctggaattgcatgtctccacgcaggccggcgtcaccaattaccaagctgcgaacgccttctatgagcttggcgctcgccgtgtggtgttggcccgcgagatggacttgcaggccgtgcgtgatattcgcgccaacattcccggtgacctcgacatcgaatgcttcgtgcatggcgcgatgtgcatggccttctccggccgctgcctgttctccaactatctgaccggccgtgatggcaatcacggcgaatgcgcccagccatgccgctggaaatattcgatcgtggaagagaaacgccccggccagtacttcccgatcgaacagaccgagaacggcgcctatctgttcaattcgcaggacatgaatatgctggggcacttggatgatttgattgactccggtgccaccagcctcaaaatcgaaggccgcgcgaaaagcgcctactatatcgccgccatgaccaacgcctacaaaaccgcggttaatgaatacatgattcaacgcggttttgaagacgctgatggcaatgttctgaagcctttccgtgaccgtgtgattcgccagggcgaccccgattttggccaaggaaccgaagatcaagtgatgcgcaatgccgatgccgcgttcgccggtgtggccgatgagggatatgaccgtggctctgatactgcggttgccgattcggtcgccagctcggttgccgcagaacgtgaccgcgtgacggttgctgatgccgccgactcaactgcctctggtacgccggccggcaccgccgtcgaacccgacggcatgagctctcacgcccgttccacgcgccgcaagtccaacaccgcggtcgaacagatcgagaccgattggaagcatgcggccgttcgcccggccccacacgtcgaactgcccgaatggctgctcgaggaaaccgacaaggtggcccaccgcgactactccaccggcttctactacccggagcacaaggtcacacagaacaccgaccgctccgcctacttccgctcatggctggtagtgggcgaagtgctgagctggagcgcggacgaagacggacgtgtcacgctgatgagccgtaacaagatcgagccaggtcaacaggtcgaattcctgctgcctggcgagagaccattggtctttaccgtgccggaaaccggcctgcgcgatgccgatggcgcgccagtacccgccatcaataatccggcgcacgtgttctcgatgccctgcccacaccaggtgcccatcaacgccgccatccgctcgcgcaccaaaaagcccaccctcaaagccgaataacctaccactccgccccctctggcggagggctgtcagccgtaggctgactggggtggtcatgggaatcatgaacaccgcccgcacccaagaaagaatgccttatgcctgaatacagcgaagaaatcctcgattccaacagcatcagctctaccgataaagccggtcgccctattccggtgaccatccccatcgcactggcccccggcatcaaggtggtgtacaccacgcgactgggcggcctgagcgccggcgattacggcaacctgaacctcggcggcaagtccggcgacgaacctgaggccgtactgtcgaaccgcatcgcactcgccgaagcggtgcaagcccgcctatcgctggtctcccaagtacattccggcgtggctgtggacgtggacgactcgttcgtcatcaacacccccttcggcttcgacgtgtccggcacacatggtgagactgacactccgcacgtcatcgaggcggacggccaggtcaccgcacaatccggcatagccctaggcatgttcgcggccgactgcctgccggtgctgctgggcgacccggtcaccggtatcattggtgcggcccactgcggccgtcgtggtttggagcgtggtgtgatcggcaccacggtagacctgatgaagagcaagggtgccgatccggcgaacatcgtggccacactcggcccgcgcatctgcggcgactgctatgaagtgggcgacgagatcgccgaccagttcatcaagcgcttcccgctgaccaagacgaagacccgtttcggtggtgccggcattgacatcgccgaggcggcaatgatcgacctcgctttcgccggcgtacatcaggtggtcgattctatgccgcgcgtgcacgccgccacccagtaccttgaggaagacccggaactcgccgaactgtgccgcacggacggcgaaggcccggccgagctcgcggagcgcatcgacaacatcagccacagcatgtgcacgctcgaaaacccactgtggtactcgcaccgccgcgccgcgctcgccaacaaaacacacgaaggccgcctcctcgccctcatcgtgcgtgactgaacggagaatgcgagcacattccgtggagaagatgtgatgcagttcacggacggccagccctcaccctacggtggtgcctatgactgagagagatttcgatacccccgtcgagacgcctaccgtccagccggcccccgctcagggcaccaaaccggcacaaaccgtgccggtggtagccgtagtgctggccgccggcttcggtacgcgcttcgaccccgataatcccaagcagcttgtctccgtgggcggcaagcccatcgtgtgctggagcattgatgcctttgaacattgcgatcgcgtcagcgacatcgtggtggtggtcaatcccaaggtgcgcggtgaagtggaaacgttggttggcgagatgggctacaccaaggtccgcgtcatcattgacggcggtgacgaacgtgtggacagtaccgccaccgcgctcgacatgctggctacggctggcattccggacgatgccaagattctgatccatgacgccgtccgtccgttcgtggaacagtccgccatcgacggttcgattgatgcgctcgaccagttcacggccgcgaccgtggcctacgcctcaaccgacaccgtgctgttgaccgaggatctgggcgatttgaaagtggtcaagtcggtgccggaccgcccgaacaccttccgcgcgcagaccccgcaatccttccgcttcgcgacgattcgtcacgcttacgatttggctgccgccgacccggacttccatcccaccgacgacacgcgcgtagtggtcgattatctgcctgatgaacccgtcgccattgtctccggtgcggaaaccaacctgaagatcaccacgttggaagatattcccacagctgagcgtatcgccgaggagattctcggtcgtgatcccaaggaagaggcccgcgcccgcatgcatgccctgctggcccaagcagccggccagatgcatcgctagactggcattatgcgtgaactcaatgttgtgatctccggcttcgaccactatgacggcgtggaggtcaatcccgccgtcgaagtgcccaaggccatcgccgagcagggactgggcgtctcctctgctccggacgatccgttggagcaggtcgccgtcaccgttcatgccgtcagcatcccggtgagcttcgccaaagcctggcccacgctgaaagagaccattgaggccaccaagcccaatatcgtcatcgccaccgggctcaagcacgcagcccgaggcgtgatgcttgaacgatgcgccaccaacctgatggacgcgatcaggccggacgcggacaacgtgaccccacgccgcgaacccatcgaccccaatggcccggccgcctattggacccgcctgccgttgcgctcgatcctgaatgatttcacggatgattctattccggccaccctgagttcggacgcaggtacgttcgtatgtaattcgctgttctacaacttgctcaactggaccgccacccaggagcgggtgctgggcggattcgtcagcttccctccggtcgttccggcgcattccagccagcatggtctaccactcgaccagcagatcgccgctggccgtgatgtggtgcgcgaagccgtacgctactatctcaagccctccagctccgacatcctcatcgcctagcacgctgtgcgccacgccggaatagaacatggttcgcacgcattgtaacgattgcgcgtcgctcaacgctcagcgctagtgcgatgcgctacagtgcttcaaggatgtgccaagagctttatgcgtgtgcgaaaggaataaacagcgatggtggatcgtttcccggtggtgctgcgaggatatgacaaggagaaggtcgatgctgccttcgacgctactcaggagagtgtgaagcgtgcgcagcagacgttggccagcatgcgtgagcagattgcggcggatgacgaccgtattctgcaactgcaggcccaacttcaggaagagaagaacaagaagccggaaggcaacagcttcgcttccttgggagcgaacgcccagcagatgcttgcctccgccgaacagacgagtaccgaactgctggaacgcgccaagcaggacgcgtcctccatccgtaccacggctcaggcgcaggccgaaacactgatcaacaatgccaagctggatgcccagcatattgttgacgacgccaatgccaaggccgcctcgattctgacgaacgccaacaatcaggccgaatcagtgaccacctccgccaacgaggacgccgcacaactgcgctccgaaaccgccaagaccatcaccgaacagcgtcagaccgtcgagcttgagctcagcaacgcgcgcgaagagcacaccaagaagatggcttccgaacgctccacccaagagcgcgaaatcgccgatatgaaggcggaagctacccagcaggttgccgcaatgcgcaaaagcgccaatgaggagatcaccaagcttaagtccgattccaacgatcagattgaggcggcgctcgccgaggccaacaagaagctcgccgacgtgcgcgagcaagtgtccaagatgatgaccgaagcccagcgcaaggccagcgaaatcattgatgcggccaagaccaagggtcaggaaatcactgatgaggccgaggtcaagcgcaccagcacgatgagccaggtcaacgccgaagtcgagcagatccgtcacgacatcgccgctcagcaggatgaggccacgaagaaggtcaacgaactgctgcagcacctcgaagagcgtcgtgtggcggccaagcgggaagccgatgagttggtcggccaggccaagaacactcgcgaccaagccgattcatatgccgcgtccaagcgcgaggaggcggacatccaggccgccgcaatcgtgcataaggcgggcgaggaagccgatgcgcagatcgaggagcgtcgtgccgccgcccaaagcgagcttgacggtctgtccaagcgcatcgccgatctgcaggaacgcgagtccgtcatcacccagcgtgtttcggaactgcgttctatgttctcgcaggcgttctccggattcgctttcggtggtaatgcggcggcctctggtcagagtcaggaagccgctgccgtggcgtcattgccggtggtcgcgcccgtcccggaagtcaagcctgtgcacaacgaggccgatgatcagccgggtgagttgagcggaaacgagtcggctgccgacgatcacaatgagacagatgcggcaccggctgattcggctgcgcagaatgagcagtccgaatcgtctgagccgtccgagcaccagacacagggcgaaccggaggccccgactcaggagaatacagccgtatctgagcagaacggcgaatgacaggccttcgattagactactagcggtaagaattacggcacctgcgctttcgagccaggtgccgtattcgtttggatctgcgccgcaagcgcaccatcacagaaggagtatgacatgagtgaattgacgcctctgaccggcgaagcattgaataccctgcgcggcgatttcgcacagagtggcaccaaccgtctggccatgaacgcggtgaccgccgccggcatcgacaaggtggctcgcaattatgaccgcgctcgtctgatgcagcgccgtttctccaccatcgttgacaatggcgaagccacccatcaggatcgctccggccgctgctggctgttcagctccctgaacgtggcccgtttcgtggccaagaagaacatgaacttgaaggagttcgagttctcccagaactacgcgatgtactacgacaagctggagcgcgtcaactacttccttaaggatgtggccgctctggtggctgccggggagccgtccgactcccgcctgatgcagcacctgctcgccgacgtgatgggcgatggcggccagtggaccatggccatgaacgtgtacaagaagtacggcgctgtgcccaaggacctgttcccggagaccgaatcctccaagaacaccggtgagatgaacacccagctgcgccacatgctgcacaccgccgtggcgcacatgtacgccgctgacggcgatgcctccaaggtcgaggcgattattgccgacgccactgctgccggccaccgtattctgaccatccacctgggcgagccgccggtctccttcgactgggaatggaccgacaaggatggcgaattccaccgcgacggcgagatcacgccggtcgaattctggaagaagtacgtgggaccggccggtctcgaggactacgtgtgcctggtggatgatccgcgcaccgagcacgccaagggcaagaagatcggcatcgagcacctcggcaatgtggctggcggcgacgccaccgagtacctcaacgtgccaaaccagttcatgaaggactgtgtcaagcagattctcgttgagcagggcatcccggtatggttcggtgccgactgccacccgttcatggaccgtgagaacggcgcttgggccaccgacctgttcgagtacggccgcgtgtacgacgtggacttcgatttggacaaggaagcccgcgtgcgcttcggtgactccgccatgaaccacgccatggccttcgccggcgtggacgtcgccgatgacggctccacgcggcgctggcgtgtggagaactcctggggtgccaagatcgccgacaagggctacttcaccatgtccgacgactggttcaccgaatacgtctacgaggtcgccgtccccaaggccatgcttcccgaagagtaccgcaaggccttggaatccccggccaccatgctccccgcatgggatccgatgggcgcgctcgcataagagggcgtatgggcttgacgggtgggcgccgcccgtcaagcccggcgccgccgcagacggtccataatcgccggccccgccagcggtgccggcggcgaactgctatagtggggccttcgcatccacggcggcatgcccgcggtgcgcggattacgggaaaggagtcgagcattggcagcgttacgtggcccggatagttccgaggatgaacgtcggttgggggagcaggccgtctttcccgagaccgtcgatgtcaacattcgtcagcttgaccccattcccgcgccgcgtgccttcctcagggagcagccgctcaccgatgagatgagcgagctcgtgctccactcgcggcaggaaatccgcgatgtgctcaacggccgcgacgaccgactgctcgtcatcgtgggcccctgctcaatccacgacccgaaggccgcgcacgagtacgcagaaaagctggctgccgtcaagcgcgagctggaagaccgactcgtgatcgtgatgcgcgtgtacttcgagaagccacgcaccaccatcggctggaaaggcctcatcaacgaccccgatctggacggtcgcttcaatattcgtaagggcatgtggctggcccgcaaggtgctcaccgacgtgctgagcctcggtctgcccgccgccaccgaatggcttgaccccatcaccccgcagtacatctgcgacgcgatcagctggggtgccatcggcgcgcgtaacaccgaatcccaagtccaccgcgaactggccagtggcctgtccatgccggtgggcttcaagaactccaccgacggctccatcaaggccgccgccgattcctgcttcgcggccggcttcgagcatcacttcctgtccattaacttggacggtcgcgtgatttccgccgaaaccaaaggtaacccggattgccatctggttctgcgcggttccagccacggcccgaactacgatgccgaatccgtgcgccgggctttgggagatctcaaggcctcgcaggcgacggggccgagccggcacgggctcgtcatcgacgccgcccacggcaattgcggcaaggacgaacgccgcgaagccgaagtcatcgaagagatagccgagcgtctggcgcatggcgagcagggcatcaccggcgtgatgatggagagcttcctggtgggcggccatcagaagccggccccgctcgaccagctggtctacggccagtccgtcaccgatgcctgcgtgccgtgggatcgcactaacgagctgctacacaccctggccgacgccgtcaccgctcgcagctcggctaaatagctttgtctttgtagaaatgctcactgagacccgctcagtgagcattctttgccaataacggtggtcatgtcagtttgttcccgtgacaccttatccttgggaaagatactgacccaaggagagatgttatgcagcagcaggaggaagcagcgcattcgctgcgtccgttgcaagtcggtccgcagccgttgaacaccccggaagagcttcgcgccattcgtcaggcgatgggggaggggaagaatccgctcgtcgtcaccgatgtgcctcgttgggaggatcaggtgggtgtcagtcgcatcatcaaccgccgcgtattggagttggagccgctgcccacacccgcgcaagtgctcgctgagctcccgctgaccgatcaggctcaggaaatcgtcgcctactcgcgtgatgagattcgcgcgtgcctgtacggccaagatgacaggttgttggtcatcgtcggcccctgttcggttcatgacccgaaggccgcgctggactacgcgcatcgattggccaagctgaaagacgagctcggcgagcagctgctcatcgtcatgcgcgtgtacttcgagaagccgcgcaccaccatcggctggaagggcctgatcaacgacccggatattgatggcagccacaatatccgcaagggcctgttgcttgcccgcaaaaccttgcttggtgtgctgaaggaaggattggcggccgccacggaattcctggagcccaccagtccgcagttcatctcggatgcggtgagttggggcgccattggtgcgcgcaacacggaaagccagattcaccgccaattggccagcgggctttccatgccggtcggctttaagaacgccaccgacggttcggtgaaggcggcggtcaacggttgcttcgccgctgcccagcagcacacgttcttcggcattgaccatctggggcgtgcctgcgcagtcgagacccttggcaacccggactgccatgtggtgttgcgcggctcgattcacggcccgaactacgatgccgaatccgtggccaaagccatggaagacgtacgcgccgaaatgcccgctgaatccgccgcttcgcatggtctgattgttgattgctcgcacggtaactccggcaaggacgaacatcgtcaggccgaagtcgtgcgcaatattgccagcagaattgcagctggcgagcggggcatcaccggcatcatgatggaaagctttattgaaggaggcaatcagaaggccgcgccgcttgatcagctggtctatggcaagtcgattactgacaagtgcatcagctgggaagagaccgaggccttgctgcgcgagcttgcggaagccgtggccacgcggcgttggcactgagttgcgtcatcggctctctcgcaggagcaatgcaacgaaacgtctctacccctcagcctgccattcggcggccacctcccctgacatgggagtcgaaagcgttgtgaaaggaacttacgtatgggtatgaaaactgtagctattattggcgcattggatgaggaagtggcgctgatcgccaaatcgctcacgcatgtgacgcacaccgccaagggcagccttgacatcgtgtccggcacggtcgactcctttggttctgacgtcatcaaggttgccgcaacggtaggcggcatgggactggtcaatgcggccgccaccacgcagctgctgattgacgagttcgccccggacgccgtgattttcagcggcatcgccggcaacctcaacacccacctgcacatcaacgacgtggtgctcggcggcaccctgcgctacctcgacactgacatgcggctcgtaggccagtggaagcccggcactgcggacgctccggtggaggaattccactctgatgaccgtctgctggaagttgccgacgaggcgcttgccaatgcgggcattacccacatcaccggcatcatcgcctccggcaactacttcgtggacacgccccaaaaggccgaggaggtcatccgactcaccggggctgacgccgtggagatggaaggagccgccgtggcacaggtcgccgcccgcaatgacgtgccggcactggtgattcgtgccctttccgacaacgccgacactgattacgaggtattcaaggagttcgacatctccgaatacgccgacaccgccgcccgtctggccgtcgatatcgtcaagcgcctgtaatcggcgggctggcccatctcaccatccacgctttggatatgatgaccactatatgagcgctttcaaactattgcttataacctgagtcatactcggtgttcggcacggcgatgtgcgggagctcatcgctggggccacaagccgtgccagtccttctcccgtatcccggtcgctgtgcttgattcgtccgtcatcgcgaacacgtgatgcgcacgccgcaccggggtttatccgcaagaggagaaagaagaaggacaatgtctgcaagcgcatccgcgactgtggccaaaccggtgaagaaggattccgttcccgagatcatcgccgcctcgatggtgggcaccgccatcgaattctacgacaactactgctattccatcgcagccgccagctatttcggcgcgattttcttcacggacgtcgccaagtccaaccaggccctggccacgctgatggctttcgtgaccttcgccgtatcgttcctcgcccgcccgttcggttccatgttgttcggccacttcggcgacaagctcggccgcaagaagacgctggtcatcgccctgatgaccatgggcatcgccaccttcctggtcggatgcctgcccggctatgagcagatcggcgcatggtccatcgtgatcctgtgcatctgccgcgcctgccagggcgtggggctcgccggtgaatggtccggcgcggccttggtcgccaccgagaacgccccggccgacaagcgcgccctgtatggctccttcccgaacctgggcgccccgatcggcttcttctgcgcctatggtctgaacctggtgcttgaggccaacctgagccaggagcagatgctcgccttcggctggcgcatccccttcctgtgctccgccgtgctggtggccatcggcctgtacgtgcgtgcccgcatgtccgagaccccggtgttcaagaaggcctccgaggagaagcgcacctccaagcacccgctgcgtgacctgctgccgtactggaaggaggtcctgctcggcaccgtggccatgggcatcacctacaccctgttctacgtgctcggcacctggtcgttggcctacggcgtcaagggcctgaagttcacccaaagcgagtacctgcttatgcagatgtgctccgtggtgttcttcgccatcttcatcgtggtctcgtgcgtgtatgccgacaaggtgggtcgcaagaaggtcatgatcaccgtgaccgccgccgccttggtgttcagcttcttcgtgccgatactgctggtgcactccgtctcccacatcatgatcttcctgtgcgtcggcttcgtgatcatgggcggcctgttcggcccctgcggcgcgtacctgcccgagctgttcccggtgcacgtgcgctactccggcgccggcctgagctacaacctcgccgccatcttcggcggcgcgttcgccccgaccatcgcccaggcgctggtctcctccgagttcggcgtggccggcgtgggctggtacatggccatcatggccgcgctcgccctgctcgccctgttcctgatcaaggaaagcaaggacaaggactacgagctctgatccccgcccgtccgcggcggtccgcgacagggggcatcgcccggcaagggcggtgcccctttcgtatgccggccgataagatgaacagtaggcgaacttacgtagtctatgcggggcactacgcctcgggcgttttactctgggagtcatggatatctcgcagatcgtcgtggccgtggtgctcgccgtgctggcggtggcatgggtcgccgtcatcgcctacaacaagggccgggtttcgggtcgccttgccgccgaacaggacctgtccggcgatgaggacgcgcgttccctgttcggcgtcgacgtgcccgtgcgccccaccgagcggcgtctgatcgaagcgctgcccgaagccctgatcgtcaccgatcgcaatggtctggtccaatacgcaagccccggttcggtgccgttcgccctggtgtccggggggcggctcaactcgcgtgagatcgaggacattctcacccaggtcgccaacgatggcggtgtgcgcgagcgcgaggtccggctgccggtcaaccacggcgcctatccatcctcgaacggccgcgggcttgaggccggtcagtcgcgcccgtccaacacgatgtacctgcgtgtgcgcatcggcgacatcggcgacgacctgtatgccatcttcatcaatgacatgtccgaacagcgtcgtttcgaggccgtccgccgcgacttcgtgaccaacgtctcgcatgaactcaagaccccggccggcgcgatctcgctgctcgccgaaaccgtgaccgacgcggccgacgatccggacgccgtgcggtacttctccggccgcatctccaaggaatccgcgcgcctgaccgagctggtgcatcatctcatcgacctgcagagggcccagagcccgcagggcatgatcaacgcgcggcgcatctgcgcgctggatgtggcccgtgccgccatcgccgacaatcaggtccaagccgactcgcgccatgtggacatctgcctgagcgtcaacggcaagccggtgccgaccaggcttgcggacgatgccgtggccccgcaggtggcggcgcccatgatcaaggccgatcgggaggcgatgcagaccgcggtcaagaacctcgtcgaaaacgccatccactattcgcccgagcacaccacggtggccgtcggcgtggcggagcgcgacggcaaggtcaccatccgtgtggtcgatcagggcatcggcatccccgccaagtcgctggaccgtattttcgagcggttctaccgggtcgatccggcccgttcccgtgaaaccggagggtcgggacttggtctggccatcaccaagcactgcgttcaggagaacggcggacgcatttcggtatggtcgcgcaaggggagggctccacgttcaccatcgaactgccggccgccgcggatgaggatgatgaatcaacgcaggacggggacggtgcggacacgccgagcgcggcggtgacggacggtgcgccggatggcggccatggcggcacgccgaacggctcggcggcgcgggagtagcgccggcggcgccgatgcggcgtcggccgatcgcatggcgggctggtttcgcccgtggcgtgtagcctcattgagcaattacgtactttcgggaaacggcaggctaacggagaacaaatggttacgatggtgtcggaaaattttgcgccgatgcgcacgggaacatatccaagaaaggctactatggcacgcattcttatcgtcgaagacgaggaatcctatcgcgagccgctggtgtatcagctcacgcgcgaggggtacgacgtgtccgccgccgccaccggcgaggaaggcctggaactgttcaccaagggcggcatcgacttggtgctgctcgatctgatgctgccgggcattgacggcaccgcgctgtgccggcgcatccgcgagcagagccgtgtgccgatcatcatgctcaccgccaagagcgccgagatcgataaggtcgtcggccttgagatcggcgcggacgattatgtgaccaagccgtactccttccgtgagcttctggcgcgcatccgggccgtgatgcgccgcaaccaggccaccgcccaggcctccggcaccgtggacgacgacattccgctggtgtgcggcgacatcgccatgcaggtgggccagcatcaggtcaccgtgcgcggcgagaccgtgttcttcccgctcaaggaattcgagctgctcgaatatctcatgcagaacaagggccgcgtgatgacccgtcatcagttgatcgaccgcatctggggctcggattacgtgggcgacaccaagacgctcgatgtgcatgtcaagcgcgtgcgctccaagattgaggaggatccggcgcaccccaagtatctgactaccgtgcgcggtctcggatacaagatcgatactcccgcggagtaaatgggaggcggccttcgggtcgccttttttgttgtggattgggggctcgccgcaggtgagtccgctccaaaaactacgtagcctcaacgtagcccataaacatccaagtgttcatcttctgtttactgatttcggttccgccttttcgaaaccgctaatagtcttgtagttgtcaagaattgaccgggcggtttcgctccgcccgcgaatagttgatagagggattaggtaataatcatgcagaagaacatcctcgttcgctccattgccgcgctgtccggcattgtgatgcttgcttccgtggctgcctgcggcgacaacagcgccgcgaagaccgacaacaacgcttcctccgactccaccgccaaggccgctccggtctccggcgacttccagggcgccggcgcctcctcccagcaggccgccgtcgaagcttggatcgccggcttccagggctccaacccggacgccaagatcgcctacaacccgtccggttccggcgccggcgtgcagaccttcctgaccggcgccaccgcatgggccggctccgacaaggccctcgccgataacgaggtcgagcagtccaagtccgtgtgcgcctccggctccgccttcgacgttccggtctacatctccccgatcgccgtggtcttcaacctcaagggcgtttccgatgccggcaagcacatcaacatggacgccgccaccatcgccaagatcttcgacggcaagatcaccaagtggaacgacccggccatcgccgagcagaacaaggacctgaagctgcccgacaccgacatcaccgtcgtgcaccgctccgataagtccggcaccacccagaacttcgtctcctacttcaaggacgtcaccccggacaactggaactacgacctctccgagaactggccgaacgaggtcggccagggcgccaagggcacttccggcgtgatctccaccgtcaagcaggccgacggcaccatcggctacgccgacttctcccaggtcggcgatctgggcaccgtggccgtcaaggtcggcgagaagtacaacgtgatctccgccaaggccggctccaaggtcatcgaggactccaagcaggacaccaccgtcaccggtgacaaccgcgtcgtcatcaagatcaaccacgccaccaaggccgacggcgcctacccgatcgtcctggtctcctacgatgtcgtctgcccggcctacaaggacgccaagcaggccgagttcgccaaggcatggctgacctacgtgacctccgacgaaggccagaaggccgctcaggatgccgccggcaccgctccgctgcccgcctccctgaagaccaaggtcgccaagtccatcgaggccatcaagaccaagtgatgccgtcggcccacagggtcgcatggactgggcctgacctctgaacgccgaactgtgaacgcacagtcgccagcatgaagccgcagtcgtaaaccatacggctgcggcttcagtcgggtcaggaccccaacggtttgacaacgtcgccgacgggcaaccgcaccactcgaatacttgataaccaccctatataaggagaatccgtgagttcgcaagacaaaacggttgtacagccggttggcggcaagaccgccgacaaggtgttccgcggtgtggcatacgcctgcggcatcctgatcctggttgtgctcgccgctgtgttcctgttcctgttcttccgcgcatggccgttgatcggcggcgatcaggccgccaacagcaaaaccgtgtccagcttcaccggcggcaaggccgacaacttctggagctatgtgctcccgctgctgttcggcaccgtgctggtatcgctgctggcgctgctgatcgccttcttcgtgtccatcggcatcgcgctgttcatctcgcattacgcacccaagaagctcgccaccgcgctgagctatgtggtcgatctgctcgccgccatcccctccgtcatctacggcctgtggggcggcctgattctggtgcccgccatctacccgttctggaactgggtggccaaccatctgggctggattccgctgttcgagggcccggcggccaacccgtcgcgtaccgtggccaccgtggccgtggtgctcgccgtcatgatcctgccgatcatcacctccatgtcgcgcgatatcttcatgcagaccccgcgcctgcatgaggaggccgcgctggcgcttggcgccaccaagtgggagatgattcgtcttgccgtgctgcccttcggcaagtcgggtatcgtgtccgcctccatgctggctctcggccgcgcgcttggcgaaacgatggccgtgttgatgatcctgtccccgggcctcaactactccatcaaactgctgcaggcctcgcagaaccagaccatcgccgcgaacatcgccgcacagtaccctgaagccaacgatctgggcgtctccacgctgatcggaaccggtctgattctgttcctgatcaccttcgtggtcaacttcatcgcccgtaagcttaccgagaaagcgactgcgtgatgactgctgccgagaacactgaaaagaccccgatgtccggtgcgcccaagatcgatttcgatcgtttccgcccgacccgttccgccatccagcgccgtaacgtcatggaccgcttcatgtgggtcctgatcgcggtggcgttcgtgatcgcctgcatcccgctggtctccctgctgtggaccaccatcgtcaacggcgccaagcggctgaacctgaacttcctgagctacaacatgaccggcgtggtcggcggcagccagaccccgtccggaggctacggcggcgtgctccacgccatcatcggcacgctcgagatcaccgccggcgccatgatcatctccatcccgatcggtctgatgtgcgccgtgtacctggtcgaatactcgaaccgcggaaagctcgccaccacgatctccctgctcgtcgacgtgatgagcggcatcccgtccatcgtggccggcctgttcgccttctcgatgttcacgattctgctgggccccggcaccatcaacggtttcgaaggctctgtggccctctccctgctgatgctgcccaccgtggtcaaatcctgcgaggagatgctgaagatcgtgccgaacgaccttcgtgaggcttccctggcgttgggcgtcaccaagcagcgcaccatcaccaagatcgtgctgcgcaccgccctgcccggcatcgtctccggcgccatcctggccatcgcccgcgtgatcggcgagaccgccccgctgctcatgaccgccggcttcatcgccagcaccaatgtgaacctgttctccggccagatgaccaccctgccggtgtacgtctaccaggagtactcgaagctcaacgcgaactgcccgcccaacgccgacgccacctgcgtgaccacgatcccgatggagcgcgcctgggccgccgccctcgtgctgatcgtcatcgtgctgctgctgaacctcatcggacgaatcgtggcgaaggtcttcgccgtcaagaccgaacgctaagcccagccgctcagcctaagccttaagaacacaaggaaacataaggaaacatcatgggacaacgtattgacgtcaaccacgagaacatctactacggcgacttcctggccgtcgaggatgtgaacatcaacatcgagccgaacaaggtcaccgccttcatcggcccgtccggctgcggcaagtccaccgtgctgcgcaccctggaccgcatgcacgagatcatccccggcgcgcacgtcgagggcgaggtgctgctcgaaggcaagaacctgtacgacaaggacgtggatccggtggccgtgcgccgcgatgtcggcatggtcttccagcgcccgaacccgttcccgaccatgtccatccgcgagaacgtgctggccggcgtgcgcctgaacaaccaccatctggccaagtccgacgccgacgatctggtcgaatgggccctgcgcggcgccaacctctgggaagaggtcaaggatcgtctcgacaaccccggcatcggcctgtccggtggccagcagcagcgtctgtgcatcgcccgcgccgtggccgtccacccgcaggtgctgctcatggatgagccctgctccgctttggacccgatttcgaccctggctgtcgaggatctgatcaacgagctcaagagcgactacaccatcgtgatcgtgacccacaacatgcagcaggccgcccgtatcgccgactacaccgccttcttcaacctgaaggccgtgggccagcccggtcacctcgagtacttcgcggacaccatcacgatgttcaacaacccgcaaaacgaagaagccgagcgctacatctccggtcgcttcggctgatcgtttcctgcgcgcagcgtaatgatttgtgcgtaggagaaacggcaaagcccgccgcaaggcgggctttcgcatattgagggcgagtattgccgagtattaccgttctcgcaacggagcgagctggaatacttcgtcggactgggcggcgacttcccgcttcggtcgatcgacgggagaacggcgggcaaagcggtacaagacaagtccgcacgatgaatactctgtgatgaatcttctgtttacggtgcgagtgtggaagaatggtcacagcaaggtccagcaaaggagcataggtgagtactggtctgatcgtcggcattgtcgttgtcgttattatcgttgtcttgattggttggggcgtcagcgcctataacaacctggtgacgctgaagaaccgtgtgaagaacggttgggcgcaaatcgacgtgcagttgaagcagcgcgccgacctcatcccgaacctggtgaataccgtcaaggggtacgcatcccacgagtctgaagtcttcactcaggtgaccgccgcccgcgccggcgtagtggctgcggccagcaacccgagcacgaccactgctcagcgcgccgccgccgaaaaccagctgtcccgcgccctgttcaacctgcaagccacggctgaggcatatccgcagctgcaagccaaccagaacttcatggatctgcagaaccagctcaaggaactggagaacaagatcgcctacgcccgtcagttctacaacgacgtggtcctgaagctcaacaccgccatcgaaaccgtgccgacgaacatcatcgccggtctgttccactttgagcaggcgcaatacttcgaggccgatgacgcttcccgtcaggtgccacaggtccagttctgacccgcttcaggcccgtccggtaagccgccggccgggcccgtattgtcttaagagagggaagatatgcggatacgattcattcgcgccggaatcatcagcattgttgccacggtggtgttggcagttatcaccttggcgataatcgggacttccgcgttcggcgattcggccgacctcagctaccgcacgctggactatgacgtgaccgccaccgcgaacggtgatttgaaggtcacgcagcatatcgacgtcaagatgcgtgagcgtaccgacagtgacgacaacaccaagccgtggaagcagctgttccagcaatacacgctgaactccggcaccttgactgatatcagcgatatcagcgtgcgcaacgtcaccgacggcatcgactacgcacaacagagcgagcccaagctgcccagtgacgtctcttccgacaaggaatggaacagcgactacgccaaccattggtatgtcgccgatgtgagcgatggcagcgaccatccaaaggcatacacgcccggtaccgatggcctcaagcccagcgcctctgccaccgaagatgacacaaccgtggagatcggctggaatattccggtcaccaccgaggccgacagcatgaagttcgatgtaagcttcaccatgcacgatgtggccaccaaatggaaagacgtggcctccttccaatgggagccgttcggcaagaagaaccaagtgcctatcggcacggtcaccggcaccgtccatttccccaacggcatcaccggcaaaacctcatggacatggctgcacaccgagcgcacctcggaaaccaagcgcaacagcgacggcagctacacgttcacggcctacaacatccacaatggcgactacctcgatgtggtcgcggcgttcgatgccgccaaagccaagggcatcgcccgcaaaggaaccggcaatcatctcaaggacctgaaacaggacgaatataagcaacagcagcgctggctcgacaagcaacgattcgctgccagagctcgtctcgtgttctggattgtcagcatcgtgctcggcatcgcgttgtgcgcgtggggtatctgggctgtgatctccagcaaccggcgtgcgcaatacagtggcagcgtcgaatactggcgcgaccagcccggcatcagtccggcttccgcagcccgtctgattcgcgtggtcgatccgtcgacgcgccaatccgatgaagaccgccagctgaccgccaccatgctgtcgctcgccgtcaagaaggccatcgccatttatccggggccatcggacatgtatcgcggcatcgacatgagccaggccacgccggtgggcttgagccaaatgattgccgccgaccaaggcaagcagtatgcggcaggcatcaccagcaccatcgtgattctgccgctcgccattgatgaggcacccaacgcgcaacagttgggattgagcgaatcggaagatgcgctgctgaacctgctcatcgtcatttctcagcgcgtgggcagcccggtattcgacctgaaccagatgaaggcgacctgccagaactggcaagacggctatattgagctcggcaaattcaccggtgcatgcagcatggaataccagcggctgggtgccacgcgctctgtggactggcaatggatcctacccggcgtattggccgccgtgctgggatttggttcgctgctggccaacagctttatcggatacccggtggctggtcttatcgggctgccgatattcctggtcggactgttctgctcgatggccggcgcgatgaccgtgctcactgatcaagggcaggatatcgccggccggactctgggccttaagcgttatatggaagacttctccaacttcaccgaccggggtaccgccgatttggccttgtgggattggtatatggtctacgccgccgcgtttggcatttccgatcgcgtgatgcgtgaactggccaaagcatatcctcaggtcaacgacccggcttggctggatgccaatgcctccaactcgttgttctactggaactaccgcccgtatggctggtacagccaccgtcataatggtccattcgaccacgatgctgccgggcagatggacctaggcgttggcggcccagctccggcttacggaggcacgtcgtttgccggcggattctccgacctcggctcgcagctgaactccggtctggcggacatcagttcgaccatcagcgcggcagcaccatccgccgattccggtggcgatttctccagcttcggttcgggcggcggctccggtttcggcggctcgttcggtggctcaggtggcggctcgttcggcgggcggtagcgcatgcctatgccgaaacgcattgttcgtgccctgggcttaagccttgtcggtgcgctgattcttgccgcactctgtgccggtgccttgattctcggcacagatggtgccgacctgagctaccgcacgcttgattacgatgtgaccgccaccgccgacggcgatcttaaagtcacggagcatatcgatatcaagttgcgcaaacgcaaggatgacgatggcaagaccaaaccgtggagatcggctggaatattcccaccaccgtaaaaccaacagcatcaagttcacggtgagcttcaccatgcatgacgtggccaccaagtggaaggacgtggcgaccttccaatgggagccattcggtgagaacaatcaggtgccgattggtacggtcaccggcacggtgcatttcccccaaggtgtgaccgcgagcaactcgtggacttggctgcacactgaacaaacctcggaaaccggccgaaccaaggatgacagcttcaccttcaccgtaaatgatgtgaaaagcggcgagtacctagacgtggtggccgctttcgacgcggccaaggcgggagatatggctcgtgtcgagaccgacgatcatctgcaggagttgaaggaagacgaagccgacgacgaacggttctggcgcaatctggaacgccaacgctccacaaggcgcctgaacaactggatgaccaccatatcggccggcctgatattcgggattattggtgttgttgcagccttacgctcctccggacgttcacgttaccgtggctccatcgaatattggcgcgatcgccccgagctgagccccgcatcggcggccaaactcatcgatatcgtgacttccggcgacaaacccgacatttccgagcgccaactcgtcgcgaccttgctttctctggccgtgaagaaagtcattgctgtgttccccggttcggcggacctgtatatcggcgtggatctgaaacaagtttctccggtggagctcagtcagcgaatcgggtccgatccatacaagcgcaataatgcgcgtaccaatagcacgattgtgatgctgtggcagtccgattacggcgtatctgagggatttgatgaatcagtattcgtcgaatccgtatttgatggatctggatctggcggatctggatctgccgcatctagcgtgttcgatgcacaccagcccgatctcagtgcttctgagcgggcattgctctatctgctcaccgtgatttccgagcgcgtaggtcgtacggcatttgacatggatgacatcaaagacgcctgcaaggattggaaagacggctacaaggaactcgaaaagttcaccaatgcgtgcaagaccgaattcgcggcggcggatatcacgccgaaaaccgagaacggatggctcattcccggggcaatcaccgtgctgatcggtggcgccagcatattcatcaacggtttggccggatatctggtggccggggcctcatcggcattcccctgatgacggtcggcatattctgcttcctgatggggaattcctacgtgctgaccgatcatggtcagcagatggccgggcaatgcttgggtctcaaacgatatatgcaaggcttctcgaacttcaagtaccgtggagtcgcggatttgacgctgtgggattggtatatggtctacgctgccgcatttggcatatccgaccgggtgatgcgggagctggccatggcctatccgcaagtatccgatccggaatggcttgatgccaatgcctccgacacggtgttctattggaattatcgtccgtacgactggtatgggttgcgtttctacaatggctcggcgttcgcggattccgcggctgacagcggattggccggagcggtgccagcgttcgggggcacgtcgttcgcggctgggttctctgacctcggcacgcaattgtcgtacggatttgcggatatcaccgcgacaatcaatgcggcctcgccatccggtggctcaggcggctttggcggtagcagcggcggttccggcggcggttcgttcggtgggcggtaagcgatgtgcttctgaaagtccctatagctttgaaagtaaaaggcccggtgtcataagacatcgggcctttctctcaaaatcgaggtgaggagacctcaacagtcaggtccaacggggcgaaagtctgtggcgccgccgagaagattgcctcgaagctagcgtgacctttctgctacaacacagcataccagcctccaccgaagctcaccagtacactggactgaccaaaccaaggtctactagcgtgccactttggcgcggtgtcgttgtgtcaaccggcataatgacgtctcaaaattcaagaggaggttctcatggtaggcaacaaccatgacaaccgtccgagacaagaccggcaataccgggaaggtctgatgaccggcctgttgatcgccctggccaatcaagttggacaggggcggtcgacggccatcatcattgccgcactggtattgctgggaatgagtctcagacgagaccactgatctatcagcggaacagccggaatccatggggttccggcccctcgttttcactgaactggatatgagtaagttgcgttttctattccgtgaagttgcggaaatttcatagattgattgtgcgggcaggccgagagtgtgaaatccaacgggatgcttaggcttgatcgtggatatcgagtttccataagtttcacgaagggaatcaccatggcattgttccgtaacctcggaccgttctccaccaccgccatcggccacggcgaaatgccgctgaccatcgaaaacaaccgcggccacgaggtcggcatcgaaaccctgcatgcctcgctggacgccggttgccgccacatcgacaccgcttgggcctactactgctccggcggcgaggagcagaccggtgaaaagctggtgcgcgaggcccttgagacctggaaggggccgaaggacgaggtgctggtggccaccaaggtgggccacttccgcaacttcaccgacggccgccccacgtgggatgtggacggtcgcccggagaacctgattcggcgcggcaaggagagcgcactggcgctcggcgtggacaccatcgacctgctgtacttccaccgcccggacccgaaggtgccgtacaacgagtccatcgaagccatcaagcagctggtggacgagggcgtggcgcaggaggccggtatctccaacgcctccatcgagcaaatcgacattgcgcgcggcattctgggcgacaagctcgtggccgtgcagaaccagtactcgccgattcacctggagacccaggacacgctcgactactgcgccaaggtcggtctggccttcgtgtgctggagcccgctcggcggctaccgtcacccctatgatgagaccaagttcgacccgttccgcgaggtcgcggcggcccatggcgtgagctaccagcaggtcgtgctggcatgggagctcgccaagggagatcacgtgttcgtgattcccggtgcgcaccgtcccgaaaccatcctcgactccctgaaggccgaccagctcgaactcacccccgaagaactcgccaagctcggctgaactttctcagctcccccttgtcaggggagctgtctcgcgtagcgagactgaggggtagtcgctggagtagtcccgcaaggagataattatgcgtaaaaaactcatcctcgacctcgataccggcatcgatgacgcgctcgccatcgcatatgccctaggcagtgccgacgagatcgatctgatcggtatcacggccacctacggcaatgtcgcggtgcccctggccacgcgcaacgcgctggcggtactgcacttgttcgggcgtgacgatgtcccggtctatcccggagtcgactatcccatcgccccggcaaccttgccgacaatgcgtggcaccacaccggatgagcgggcccaagcctatgcgcgctggcagaacggcggcgcgggcggctggcaaacggacgctccgtggtcaccaactcccggctcggtggcggtccaccatcccaacggcatcggtggcgcaatcatccccgactccccgcgcgctccggaagcaccaggctcggcggtcgatttcatcatcaccgccgcgcacgaatacggcccggatctgaccatcgtacctacgggcgcgatgaccaccatggccaccgtgttccgtaatgccccggatctgaaggattccggcgtgaacgtgacgttgatgggtggttcgctgacactaccgggcaatgtaagtcctgctgccgaagcgaacatctcccaggatcccgaggccgctgattacctgttcaagtgcggtgcccgcaccacgatgattggcctcgacgtgactcatcagaccgtgctcacccgcgagaaagctcatgaatgggacgctctgggaacgccggccggtgacttcctcgtcaccatgaccgattactacatcgatttctacgtaaagaaccagccggaaatccacggctgcggactgcatgacccgctcgctgtggctgccgcgcttgacccatcattgatcaccacgttcggcttcaacctacaggtcgatttggagggcccgttccgtggccgcaccattggtgaccgctcgcggctgcaagatttcgacaagcacactcaggttgcgctcggcgtcgacgtgtcggaattcctcgaccgctttatggctcgcgtcaccgccgcggctcgtgggtaaacgcttatgctttggcggtcgtgtcggttgctgaagcgtcggttagtagtgcggacaatgcggttctagcttccggggtgatccacatggtgtgtggatcaccctgtggataactagcggtacgattcgtcgtcgtgtatatgcgggatggcatcggtcggtatgcatatgtttatacacttcaatatgctggagggtgaatgtttcatgcctgatctacggtgacgggcggcaagcgacgaggtgtatggatggttactgcaagggatgtggcaaagcgcgccggggtgtctcaggccacggtgtcgtatgtgatgagcggtagcaggcccatttccgaagccaccaaaaaacgggtgcgcaaggccatggatgagttggggtatgttcccaatatcaatgcgcgatcgttggcgggtggcaaggtcggtgtcatcggtgtgctggtgcatatggatgagaataccgatttggccgagcttcgcccgttcctggtggtaatcatggaggaggcgagaaagcgggggtctagtgtgatgctcgttccggccgacgaggggattgagggactgtgccgtatggtgcgtcaaggcgtggtcgatggcgtcttggtgttcgacgtcgagtggcatgatgaacgcctgcctgagatagcgcgattggatattcccgttgtgctggtgggtacgccagaaaacgcacatggcctgccgtgcgttgatgtggattatcgtcgagtggcgcagatggccgtcaatcgtttggcggaacgaggggcgcagcggatggtccttgttggggactggggaagaagtctcgaccgttatgcgtttgctaagttcttcgccagcgaatctcgtgtggtggctcaagtgctgggcatggaatatgagatattcatcccgcgtgaaaaaggatggaggggcatctgggcgatgaaggatgaattgaagcgaatggctcaatgccatggtggtattgcggtgcgcacccctcatgcgttagattcgctgctgcagctttgtgtggaaatgcagattcagcctggacgtgatttttccctggtcgcggtgtatgtggatggtcatgacgaagagttgcgcgtgccggtggataatgtggatccagtgccgcagtccgtctccaaagccgccatggggctactgttcgatcggatcgatggacataaaactggtgaaagattgctggtttctccgcatatcaccatccgtagctaaggagtatgtccgattctcggcctcgtatggttcttgacgtcgcgtagtttatgcgcatcaacacgccggtgttgcgtgcgtcggattcaatgatatattcatttatgcgcatcaatattgaagcgtataactaactgaaaggacttagttatgaggggtaatacaaagaagttcgccctaaagtcagccgtggcggtggccgctacggcagccatggtcgtgccgatggccgcatgcggttccggtaccgcaggtggcgggaaaaccaagatttcgttctattcctacttcaaggacaaccagattggtgaggtcgtcaaggggttcgagaagaagaaccccgacattaccctcgacgtgcagtatggccaggatccggcacagtacatctcgacactgcaaacccgtcttgctggtggcaagccgccgaccatcttcaatctgacgatggataaccgtaccgatgtcatgaaatccggtgccgcgttggacatctccggcgaggatttcctcgatggcatcgacgacacaaacttcgccttgttccagcaggatggcaagacctacggcatgccggtttccgcatgggtgggcgcgttcttctacaacaaagacattctcaagaaggccggatacgataaattccccaagacctgggatgaattcatcgagatgggcaagaagatcaactccaacggaagcaccgctttcctggaggacttcaatactcagatcgctggctcgttcaccggcttgctggctagctattacggcgagcagggtaagtccggcgatcttgacgcggacatctggtccggcaagtccactttcaccaaggactggactccggtattcaagagatgggaagctgccgccaaggccggtgtaattcctcagaaatccgttggtctgtcggccgatcaggtcaagcaggaattcgtgagcggcaatcttggcgtcatgcgctccggtccatgggatctgcctgatctgcagaagtcagacatcgacttcggcgtggcaccgttcccggcctacagcaaggaagacggccagtggatcaacggtggccccgaccaaggcttcgccatcgcgtccagggcctccgacaaggagaaggccgcagccaaaaagttccttgcctatctcaacagcgaagagggcctcgaggcgtttacctctgccgctggcaccttgtcgctgtcgagcaagtacaatgccgaacctcctgccgaactgaaggatgtagtggataactacttcaagcagaacaagttctactgggtcaactggccgaagtcccctacggtgatgtccaccgagggtatcgcccagcagcagaagatcgtgcagggccagatttccgccaaggatgctgccaaggctctcgacgccaagtgggcgacgctgaagtaacccatcacaccaccagttcctttctctcctcctgacaaggccgtgccgatcgcccgttcggcggcaggcacggccttgctatgtcaaatcgaccataattctcaaggacttcccatgaccgctgcaaccattgggcatgcttccaaaccaaaatccaagcgtgcatcatccttatgggcggaaaacctctcctcattctggtttcttctgccaatcatcatcatcttcttcatccttaccgtcgtgccgttggcacagtcgttcttctattcactgaccgattacgacggatactccgaaaacttcagcttcgtggccttcagcaactacgctgtgatcttcaaggacccgtcgctgctatccgccctgggcttcaccctgctgtatgccttcggcaccacactgttggtcacctgtttcgccattccgctggccgtgaccctcaacaaagccatgtggggacgtagcttcgcccgttcgctgttcttcttccttggtgtcccggcgcaggccatcattggtctaatttggcagtacatcttctctccactgggttccggcgtgatgaacaaagtcatcgcggtattcggtataccgaatatcccttggctggccgatgacaattgggcccggttctgcgtgattttcgtggccgtatggatgcaggtcggctggcacgccaccctgtacctcgcctatctgcaaaccatcccggcggacctgtacgaacaggctcgtgtcgacggtgccaattcccgtcagcagttcttccatatcactctgccgcagctcatccccggcatcgtcgtctcgatgttcctcttgatgaccggcggactgaaaatctacgatctgccgtacaccttgaccggcggtggccccggatacgccaccaatacgctgtcccaggccatcatcctcaaaggtatcggccaaagtcagtacggactgggctcggcgttgtccgtatgcttcaccatcgcctgcattctcgtcatcgccgcgcagaccggcattgccaacgccgtggaaaagaggttccaatgacaccgtctcagcgtgaactcgttcgcaaaatctttcgcaccatcgtggtgcttggcctggccctgatttgcgccgtgccactgtactatgtgatcgtcagctccttcaagacctcaatcgatatgatcaagaacccattggggcttccggagcagtggacgctggagaactacaaggaggccttcgccgacggcaccatcattcgtgcgttcgtcaacacgctgattgtcaccgtggtggcggtgctgctgcaggttctggtcggttcgatggccgcattcggtgtggtatacaagaaatccaagttcaccgccatcgtcggtggcgtactgatggtcaccttcgccattcctgtgcaggccacaatgctgccgctgtaccgcatggagtccgagaccggacttgtggattcgctgcttggcttgattgtgctgtatatgggctcgtgtgtgttctgctacttcctgatcgtcggctacatgaagtccctgccacaggaattgttcgaagcggccaaaatcgacggtgccggcccatggcgcatctactcgcgcatcgtgttgccgctgatcaccccaatattgaccaccgtcgtcgtattccaaaccatgggcacttggaacgacttcctcctgccgagtgtgttcctcagctccacggataaccagaccgtcgtgctgcaggtatacaacgccgtgcagcagttctccacgaactggcctctgttcatgactatcacggtgcttgccctggttccggtgttcattttcttctgcttctgccagaagtggattgtctccgggttggttgccggctccgttaagggctgaggacgaaatgagatcagtcatgagtgacgtacagaatgctgcacagcaagccgctatcgaacgtgctactgcagaagccggtgcctcaacggatttctctcaattcgctggaagttcgctgccgttcggcaatggccaggttcttctggatcaatccaccggtgctcccatcgcttttgtgaacgaagataatcccaatcgtcattatctgctggacgacagtgtctcttggcacacatcggaccagtattggggcagcggctatgtggtcactaccagtggtggctcgcagtggaacacgccgcaggtatatggcataaccaatggtctggaacagcagacgttcgcactgtgcggtgcgggactcgccctggacgttacccgcagtagcggcgaacggctgaccgagcgttatgaatggcgcaacgtttcgaaccagccggtgaccatcacaggcttgggcatccagaccccattgaacgaccggtatccgggcgctcgcaaagcgttgagggaatgtgtgcatgcgcatatattcgcgggaggcgactggagctgggtgctggccgagccgatggacggccgcggtgcgcgcttggggctgatcgttacggaaggcgcaatcaatgcctatgccatccaatcgcgtaaccaggtcacgtattcggatatccgcgggcacatcgtgctgcaggtcaccgattatgcgctgaatcccgatgcgttcggcgggcagccgaccatcacgctggagccgggggcctcgtatgcgctgacgtgggaactgggatggtatgcggacgaggatgcattcctggccgctacgattgctcctgcatcgttctcctcgttaagcgccactgtgggcgggcatatcgatatcgccacgaatcgtgctgttacggcgctggatgacggtcttaccgtcgaacggactgtgagcggagttcggttgacggccgaacaggcgggtacctaccaactgcagcttgtggatggagaccatcgtgcacataccgaagtactcttccacaagacgttgagggataccgtcaacgaccgtgcgcgatacatcctggagcatcaggtggcgtatgagcgcgtcggcgcgttggctggggccatcgtggctaccgatacccgcaccgggcagcatgtgctggatcccagttgggatgactggtcggatggttccgagcgtatcgccatgccggtattgctacaacgtgcgctgaatcttgggctgcttgacgagtccctacgagagccggcccagcgtgccgccgatgcttggcgcacgttcgccgagtccgcgctcatcgacgccagcggcgcggtacgtcgcggctcggggctgccggaatccaaattcggaggccgtatctatgactgcccgtggattatcagtttcttcaccgaacattatctggccaccaaggatgcgcacgatctcgatatggcggtgaacatcgccgatcgggcggccgaaattggcggcgaacacttcctgagcatcgagttcgccgaatccagtgcggccttggcgcgtgtgcttaagcagaccgggcgaaccgaggagacccaacgtctgctcgatcgtgtggtggtcagtgcggactacttcctgggattgggtatcgacctgccctaccatgaggtgtcttacgaacagtccatcactgcgccgttggtgagtctgctgttggaagcgcatcgcattaccgggcgcgccgaatacctggatggtgccgtggagcgattggattggctattggcgttcagcggcccgcagccggactcgcgtctctacggtgtggcgattcgacattgggatgggtattggttcggcatcaaccgacaattcggtgatgtgttccctcattattggtccacgttgaccgccgaagtgctggcacggttgccgcaagaaaggcgctccgcacgtaccgatgatttggccaaggcgattttcgaggccaatatggcgaactatggcgcggatggttccgccacgtgtgcctatgtgtttccctccaacgtcgatgggcggtccatgcatcaggccgacccattggccaatgatcaggactggcacctcaatatctggatgcgcatgattgccgaagagggcttctctgcgctctgagcccagcggcgctctattcggggcacgccattgcagcggtggcgtgcccttttggggatgctcgaatagggaagtaggcaaggatttttcatttggtgccgtccgagctaattggctataaacgtatcgaacgtgcctgtaaccgatggagaaaacgtaaggaaagaattctcggaactttgtcatctgcctgaactgacctttagcagtcggatgccaatcagctgccgtatgacgtgtcggccacgcagtcatcgcaatcgttgctctccggtgtgaggaccgccgtgactttttaagcgataccagagacataccgaggccggagccacgagacgagtaacagtttgcggtagatccccatcgctctactgcagagcatgaaccgccttatcaaaacgttcggccatcagattgatggaatgcatgtcaatgcggcgcatcgcggctcgagataatgcctgagataaggctgatcgcaatgtcggcaaccaatgatccgcatatttacggcttacaccgaacaaagacagactctcatcggacatcaatttatctatatcgacttcggtgtcacctaataatgacatctggtgtgagtcgggtagcgacggatcgaatggttcaggattcatgtcaaaagcgggtgccaattgccaggaattattcttacgcaaatacccgtggtttcgtagatggtcatcagtgttgccgatggccgcgccaaacattgctctccgccacagctctatggtgtctcctcctgccctacgcgtaaattctgctagatccaaccagtctccgccgtccccatctcttgcttccagcgcggtcattgcggatatataaggtaatcgctccattcgctcaactgatggtgcagacacgcgatcaaaacggtgagtcaatagcacggtccggcttctctcctccgaatcctttattgcaatgacgcgatgttcgggcactttgatgccggccatgttcgcgatttccaaggtgacggcttcccaaccgataacatcccaatcatcgccgttcggtttcggaaatttggccagccacagcgcattacgatccgacaccgaagctttaggtcgtgcgcctccgagtgagccggttgcccgatacaacctgcgtaaggagacatcacttacctcgcggttctgttccaccgcatccgcagtgtccaataactccggcagctttgacagtacgggtactccttcatctcctgccgctggcttgccatcaacaatgaatcgaatggcaccctgtcttgtcagatcgttgacaccgaacaaatattccgactcgctgacacgcgtccgtttaagactgcgggaaaacacctttctgccccaacggtctggggcggaatccgaaaatggaccaagtccagagaagaagaatggggccaacgagcggggcatagatgggaagaggtcgaaggaatcgctgctgattgtgtacgtcgaatcatagcggaacgataggtcgtcgccagtcgcatacaatgtgccggcaggagcttccattccaggccctagcgtaatcagtacagttgattcgatagtttttgccatcagggattcacctccgaacgcgcttcgggagttgttggccagcgcggagacgcccaagatcggtggaataggggtcgcatgcggctacgagtgtgtcagcaagttgcaacacgcgcgcgatggttaacagcgaatctgaccggacagccttgccttgctccagatttgacactgtggtcgggctgacaccagagcggtgtgctacatccgcaaccgtcaacatcagtagtttgcgctgttgcgagaactgttcgcctaggatgcgtaaatcgcgtttggtggtggtgggcacatacttcattgcgatactccgagtgttataacatatagttttccatgaataaaatcatttattcactagtatactattgattatctgctatgcgataccggaatgaggaaggtttagcgtctcgatgtttctgctcatacgcaaaaggactttctgccagcaaatagccagaaagtcctttggtctcacgtgtatatgaggtttacaatcccggaatcaaaccaccgggtgggtcgagcgtgaggtattgctcctccagatcgatgtcgggcaccagttcctccacgaacggcaccaacgcggtcttctcgactacatcctcgcccttggaattctggccggttaccaccggctcggtcaaacgaatcttgagcagtgactgagcgggggagtcgaccacattcaccactttgccgaccacttggccggcgggcagtcccagaccgttgccctcgactagacgggcctcaaggccaataagatccttgggataccattcgtcggcttcgagcatatcttctgcgtcgtcgacctcgccgtagagttcgacaccgtttagggcctcggcggcattgcggtcgtcgacgccctcaagcttgagaatccaacgatccttgaacgtgcgtgagccctcgacgatgtactcggcctcgccatcctggctgtagagcacggagtccggctcgaagcgccactcgggatcatcggtgtacaggcgcacggtgacttcgcccttcaggccctgtgcgcggccaatacgagcgaccctcagcaactcgagctgctgagggtcgtcgtgcatgtcttgctgtgccatgctgtgaatcgttccttatcggttatcgacggacgtccatgatgtcaacgcggaccttgtggtcagacagtgcctgaatcacggtgcgaatcgcgttggcggtgcggccgccacggccgatcacacggccgatgtcttccgggttcacgcgtacacgaagcagttcgccgcgcgcgttctcatgagacttgacggaaacatcgtcgggaaaatcaacgatgttcttgatgaggtgttccacagcctgtgcgagcatagctagcctttcgtttccgctcaggcctcagccggagcttcttcggcggcctcttcagccggggcttcctcagcggcggcagcggcttcggcttcagccttggccttggcagcagcttcggacttggcggccttcagcttctgagcctggttctcaacggccgcgatgcgggcctcggcgtccgggccagcttcaacggtcttcagggtgccttcggcaccttcaaggcccttgtacttctgccagtcgccggtgatgttcagcagcttgaagacgggctcggacggctgagcgccgacgccgagccagtactgagcgcggtcagacttgatctggatggtcgagggctgggtgttggggttgtagataccgatctcctcgatgaccttgccgtcacgcttcttgcgggaatcgacgaccaccacacggtagaaggcgtagaacttcttgccctgtcgcttcagacgaatcttggttgccaaaatggctctccttgtaatgctaggtgtgcgggttctcggtttgccatgtggggcatgaccggccggaatccacgtgtcctcgcggctcggggtgtagagggcgccacgcgcgcgcgaataaccgtactagtgtaacgcggaagccggatattgcgcatcggtccggtcgtgacgcacggaatcgccggacggacggcgtgtcggcggcgcacctaccgtcttcatgactgatagcctgattgatggcagtgcgagacgggaaagggggcgctgatcgatgggtgagtgcgtgatcggccccggtgcccgggcgcgtgtggatgcggatgacggattcttcttcggcatgggggccttcgagaccatcgcggtatccggcggcgcgcccgtgtttctggacgaccatctgacgcgtttgggtgagacgttgcgatacctcggcatcgaggcgcgtcgcgccgatctggagacgatggttctccgcgcatgcgccggactcggcgcatcggacgattcggccctcaagctcacggtcaccgagcgcaaccgcgtcgtctcgttgagacacaacccgtatgccgcgccgggggcgaagcgcgtcttccgctgcgacttcgccgatgtgcgcaggaacgaatcctccccctcgcgcgcatgaagacgctggcgtatgccgaaaacatcatggagaagcgtcgcgcccgtgaccgcgccgtcgacgagccgttgttcctcaatacgcggggcgaggtcgccgaaggggccgtctccaatatctttgccgtcatcgggggagacgtcgtgacgcctcccgtctcctgcggtctgctgcccggggtcatgcgccatgccgtgatcgggttcacgggggccgtcgaacgcccgatcatgcccgacgagctgcttcgggccgacgaggtgttcctcaccaactccctgatgggtgccatgcccgtggccggtatcggcggcgtggaattcgaaccggggagcgtgtcgcgcgacgtgaacgacgcctatgcccgcatggtggcgcggacgcgggcccgggcgcagacgaaggagttccggtgagcgcgcaggtgttcaagctcaggacgttccgaccgcttgccgacatcgtggagcgcgtgcgcggcgaggaacgcttcgcgttcctggactcctcgatgccgggggcgcaggggcgctactcgatcctgggactcttcccctatcttgtgatcgaacatgggcggggcggatgcctcgtcgacggcgttgccgtggagggtgatttcttcgatgtcgtgaagaagcggcttggaccctgcgatggcgcgcgcgatccgcgtctgcccctcacgggaggcgcgatcgggtatctgggatacgatttcggccgcgaatcgtgcggcgtgccgaccaggcacgatcccgtcgcggccacaccggaggcgagcatggtcttctacgacctgctactcatcgaggacgtccggtcgcgggcgttgttctgttgctgccaggggcggacgatgacggccgcccacgccctgacatgggcgcaggacctggtggattcatgccctcccgcccctcatcccgcgcgccgacgttcgctcgccccatgctcctccgatttcacgcgggccgggtacggcgacgccctggcccgtctcgtcgatcatctgcgcgccggcgacgcctacgtcgtcaacatggcgcagcgcctgcgcctggagacgtccgagagcccctatgccatctaccgttatctgcgcacccacaacccggccccgttttccgcctatctgcgcgcgccgggtctcgacgtgtgctgttcgagcatggaacggttcatggagattcgctcggggcatgtggtgacgcggcccatcaaagggacccggccgcgcggcggcacgccggacgaggatcgggcgaaccgcgaggaactcgcccgcagcgagaaggaccacagcgaactgctgatggtcgtggacctcgaacgcaacgacctgtcgatcgtctgcgaaccgggttccgtcggcacggaccccgactttgccatcgagacgtatccttccgtattccatctcgtcgcgaccgtcgaggggacgctgcgcaaggatcgttgcgccgtggacgcggttcgcgccgcgtttcccaccggttcgatcaccggcgccccgaaggttcgcgccatgcagatcatcgacgagctcgaacgcgcgccccggggattgtacacgggcagcatcgggtatttctccgatacgggcgattgcgatttcaacgtcgtgatccgcaccatcgtgagggagggaggcgagacgtcgctcggcgtgggcggaggcatcaccgtggaatccgatttcgacttcgagtacgacgagacgatgcagaaggcccgggcgctgcgtgaggccgcttccgttgacagggggagcgtcggcgagtacaatcgtgggcaaaacgaataactatcttcagggcagggtgcgattccctaccggtggtacagcccacgagccgcaaggcatgatttggtgagattccaaagccgacagtacagtctggatgagagaagatgaaagtacgtttatgcttcgtcgtacgccctgaaatgatgccatatcatttcagggcgttttcgtgttcgcatgaaccttcttttgtatgccttggatagcgtatgggcgcaacatgcttggaggcgtacatggacgatgcgcagtacatgggactcgcgatcgagctggcgaagcgaggggccggatacgtgaaccccaatcccatggtcggcgcggtgatcgtcaaggacgatcggatcatcgggcaggggtatcacgagatgttcggcggattgcacgccgagaggaacgcgttgcggcattgcacgcagtcacccgccggggcgacgttgtacgtcacgcttgagccgtgctgccattacggcaaaacgccgccatgcacggaggcgatcgtggaaagcggcatcgcaagggtcgtcgtcggaaccttggactgcaatcccgtggtgtccggcaagggcgtgcgcatgctcgaagaccacggcatacgggtcgatgtgggggtgctggccgacgagtgccggcatctgatacgggtgttcagcaaatacatcaccacgcatacgccgtatgtcatcatgaaatacgccatgacgatggacgggaagatagcgacccataccaatcaatcacggtggatcagcggcgaggagtcgaggcgtcgggtccatcagctccgtcgatccgtcgcggcggtcatggtgggggtgaacacggtgatcgaggacgacccgttgctgacatgccgcatggcacacggaaggaacccggttcgcgtcgtctgcgatacgcgattgaggacgcccctcacctcgcggatcgtgcagacggcgaatgacgtcaggacctatatcgccaccgcctgcgatgacgaacgcaaggcggaggactaccggcggcacggctgcgaaatactcgccgtcggaaggaagggcgaccacgtcgatctggcggacgtggtgcggcgcctgggggatatgcagatggacagcgtgctgctggaaggcgggagcgcgatgaattggagcgccctcgaacagcggatcgtcgatgaggcgcacgtgtacatcgcgccgaagatattcggcggcaccgcgaaaagcccggtgggcggccaaggggtcgccctgccttccgacgccgtcatgctccggccccgcgcctgctcccgagtgggagaggattatctggtggaaagcgaggtggtgtattcatgttcacgggaatagtggaggaagtcggaacggtggcggacatacggaggagcgccgccaactgcacgctgtcggtcgatgccacgaacgtgatggaggacctccatatcggcgacagcatggcggtgaacggcatctgtctgacggtcgtcgatttcgaccggcggcgcttcaccgtcgacgtgatgaatgagacgtggcgcagaacctcgcttggcgtattgcgccacgggagcggcgtcaacctggaacgggccctgccggtgaacggaaggttcggtggccatatcgtcaccgggcacatcgacggcacgggcagcatatcctccgtgcggcgcgaaggcaatgccgtgtggtaccggatcgcggcgcggaacgagatactcgaaggcatcgtcgagaaaggctcaatcgccgtcgacggcatcagcctgacggtcgcggaggtcacggaaagggacttctcggtatcgatcatcccgcacaccttggcgcagacggtgctgggcgagaaacgggtcggcggcgtggtcaatctcgaaaacgacgtattgggaaaatacgtgcggaacatgatgacgacccggacgggactgacgcaggatctgctgtcccggtgcgggttctgagaaaggatgtatgaatcatgaaccatcagtcggtgcaagcggcgttgcaggcgctgcgggaaggaaaactcgttctggtcatcgatgacgaggaccgggagaacgagggggatctcatctgtgccgcgcagtcggccaccacatggaacgtcaatttcatggcaacccacgccaagggattgatctgcatgcccatgagcgagcaactggcccacaagctgatgcttccgcccatggtcgagcacaacaccgataaccatgaaaccgcttttacggtgtccattgattaccgtggcaccacgaccggcatctccgccgaagaacggggattgacggctcgcatgtgcgtctccgatgacgtggaacccctcgatttccgcagaccggggcatatgttccccctggtggcgaagaagggtggcgttctggaacggaacgggcacacggaggcgaccgtcgacctcatgcggttggcgggattgcgcgaatgcggcctgtgctgcgagatcatggacgacgatggccggatgatgaggacacccgacctgacccggttcgcccaggagcatcagatcccgctcctgaccatcaaggaactgcaggaatacaggaaagcgcacgatacgctcgtcgaatgcgtctcgaccgtggcgatgcccacgcgatacggggaattcacggcgcactgctatgtgaacaggttgaacggcgagcatcatgtcgcgctggtcatgggggatctgggcgacgggaccgatgtgttgtgccgggtgcactcggaatgcctgaccggtgacgtcttcggctcgttgcgttgcgattgcggtcagcagttggacgcggcgatgcgaacgatcgcggagcatggctctggcgtgctgctgtacatgcgtcaggaagggcggggcatcggtctggtcaacaagctgaaggcctaccgtctgcaggacgagggcatggacacgctcgacgccaatctcgcgttggggttccccggtgacgcgagggagtactacatcggagcgcagattctcagggatctggggatacggtctatgctcctgctgaccaacaatcccgacaaagtgtatcaattggaagactatggaatggagatccgcgacagaataccaatcgaaatcgaagccaatgcttacgacagtttctatctcaaaaccaagaaaaaccgcatgggacatatcctgaacatggaggaggaataaatgcacacgttcgaaggcgatctggtagccgaaaacatcacgataggcatcgttgtggcgaggttcaacgagttcatcacctcaaaactgctggcaggggcgctggacaccctgaaaagggagaatgtccgcgaacaggacatagcggtggcctgggtgccgggtgcctttgagatacccctgatcgcgtcgaggatggccaagagcaagcgctacgatgcgatcatctgcctgggcgcggtcattcggggcagcaccagccactacgattacgtgtgcaacgaggtctcgaagggaatcgcgcagaccagcctcgacaccggtgtgccggtgctgttcggcgtgctgacgacggattccatcgaacaggcgatcgaacgggccggcaccaaagcggggaacaagggttccgagtgcgcgcagggcgcgatcgaaatggtgaatctgatccgctccatggacctctgacggcgaaccacccggctgcgggcggggtcttccagacgttcccgcccgcttctcgccacacggccaaggcccgatcgatcgccgcgcccgctaccgcagggtgagcgttgcggccaaagccagatggtcggtgtccggcacttcgaaggacgtcacgccggacggtctgagcccttgggcgaacagaatatggtccagttcgatgcgcggccacttgagccagcgcgggaaggtgagattcgggccggcggcttgagtcagacttgcgtccttgaatccggacttgagcaacgcgcggaagctcgggtggtcggtgctcgagttgagatcgcccataacgacgacgatattgcgattgctgacggattttgcacgggcgagttctcgcagccccagaatgccggccgaccaatccgcgcagccgcgcatcggcgatttcgggtgagccgaacaaagcgtcactgtgcgattaccggaggttttgagggtgatggcgggaacgtcggcggcagggatggagaccacgttgggcaccgctgcgctcggctcgtagcgggaatagatcacgttgaatccgccattatcggtctctttggcgtctccgaactgatggtaggggaggagttcgttgatgtcggcttcggtaagacgtgtgatgaggtcgtcggtgacttcctgcaaggccaatacgctgatattgcgttcgcgaatattgcgaatgatttcagcggcgtcggcgcgtccgtatcgacaattcatcgtcataaccgagaactggggcgagagtgtttcacgcgttgtttcacggtgcccatcggggactgtttcgggtccttccttcggagtgtttgaggtgctcgatgtattgctgttatggctttttgacagcgtcggcgaagttgtttcacgggctgtttcacgatgggattctctgcgtttgccggctgggtcgattgacgtaccccagtagctgatgcgctgtgagctggcaatcagcgcgaccataataagcaacgacatcgcagtccattcatgttgccatgcggcgaccgcggccaggatcatcaaaggaacccacaacagcggagtcagggcaatcatgtacggaagcggcatgcgggcctcgagaccggcgggcagcgcgcttaaggccgtccataacagtgcgatgattgccaccgcgccgaggattgtcgtcatggaagttcctttcgaaatacaaattgaaccgagatataacttggctcccctctgcgaggggagccaagttgtgagatcagcggccgaacagtccgccaaggcctccgccgaggttcggcggcagttcagtgccaccatcgacgttgcccatcatctgttcaaggccggcgggcagggccgggttctgtggcttcttggcgaaggcggaaccgccggtcgaaccggaggacttgccggccagcttgtcgcgcaatgccttttcctcggcctcgcgcttcatcggattgccggatttgccgcccttcttcttgttcttgcccttcttcttgccgccgcccatagccgggccgccgaagccggggatgccgccgcccatgccgccacggttggtcatgcgacgcatcatctttgcggcctgctcgaaacgctgcagcaaagcgttcacctgggagaccgtcacgccggaaccataggcgatgcgggcgcggcgggaaccattgatgatcgacggatcgcggcgctcggccggggtcatcgagcgaataatcgcctcggtgcggtcgatttccttctcatcgaactgctcgagttccttgcggtgctgggccatgcccggaatcatgccgagcagggacttcatcgaccccagcttgcgcacctgctgcagctgatcgaggaaatcgtccaggccgaaggagccatcggagatcttcgcggcggccttgcgggcctcctcctcgtcgaactgcttctgcgcctgttcgatgagcgtcatgatgtcgcccatgtcgaggatgcgcgaagccatacggtccgggtggaagacctcgaagtccttcaacccctcgccattggaggcgaacaggatcggcttgccggtcacggacgccacggacaacgcggcaccaccgcgggcgtcaccatcgagcttggacagcaccacgccggtgaagtccacgccctcgtcaaaggccttggcggtcctgacggcgtcctggccgatcatcgcgtcgatgacgaacaggatctcattcggctgcacggcatcgcgaatgtcgcgggcctgcctcatcagctcctcgtccacgcccagacgaccggcggtatcgatgatcaccgtgtcgtagagcttctgcctcgcgagttcgatggaatcgcgggccaccttcaccgggtcgccggaggtctggcccggagctgcgacggcctcgccgccatcggattggacgcccttttcgggagcatagacgggcacgccggcgcgttcgccgaccacctgcagctgcgtcaccgcgttcggacgctgcaaatcggccgccaccagcagcggcgtgtggccggactccttgagccagtagccgagcttgccggccagcgtggtcttaccggcaccctgaaggccggcgagcatgatgatcgtcggcgggttctttgcgaagttcagcggacgatcgacgccttggccgagcacgtcggtgagctcctcgttgacgattttcaccacctgttgggcggggttgagtgcgtcggacacctcggtgcccagtgcgcgctcacgcaccttgccggtgaaggaacgcaccacgtcgagcgccacgtcggcgtcgagcagcgcgcggcggatttcacggatcgtaccgtcgatatccgcctcggaaagcttgcccttgctcttgagatgcttgaacgcattcgagagtctgtctgtcaaagatgaaaaagctgccataatgggcaacagtctagccgccacgcgggaaattgcggtgttggggacgacgctttccggggaatgtgtcgcgtagtagtcagggatgttgggcattcagacggcaaatgccgtgccgtccgctcgtggcgaagccaatcgagtgcttccgataccatggaaaccgtaaagaatcctgtgttttttggaatgcttacgctgttttgaaaatcgctggacaccgcttatacgcagactgccgtgcgctccgaaccatgacgttcgggccaacgcagacatgccgtgcaataaggaaggcccactgatgcccacccaaaaactactcgaacgcaaagccctgatcgttggcatcgtcatcaacgtgctgcaggtcttagccggcatggccgtgttcttcatgaccggcctcaaggccatgttcctcgacttctccttcaccgcgatttccgtcctgtccggaatggtggcggtgtatctctcgtcgcgcacggtgcgaaccaccgagcgcttccccaatggcatgttcgcactggaacccatctacgcgatctgcaaggccattttcaccatgtcgttgttggtgtattcgctgattgacgtgtgccgagtagcgtacgactacttcgtgttcgggtccggcgaacgcattgaaaccggcccggtggtcatctacgagatcctgaccgtaatcgtgtgcttcagcctatacacgtattaccggcgttccaaccgctccatcggcgattccagcaccatgctcaccgccgagtgcaagagcacgttggtcgacggatcgatgtcgttcggcatcggcgtggttgccatcttcctgatgctgctaccggccggcggtccgcttgacttcctgcactacaccggcgatttcttcatcaccgtggctttggtggcattgaccatcaaggagccgttcagcgtgctcaaagaggcgttcgtggaattggtcggcggcgtgcatgacgacgatgaaaccaacgcctacgtggaggccgaggcacagcgccatctgcctgccaacaccgactacgagcagacgctgatcttcaagaccggcatgaactacaccgttgacgtgtatctgagcggcatcggcgaaaccattgatgtagccgacctcatcgaatgcaagcgctcgctggagaaggagctcatcaagcgcctgcacatcgtggacgtggacttcgtgtttgactgattgatgggtttgaagcggctacttcaggctccaagtggaaccctgcgggccgtcttcgatggcgatgccggcctcggtcagggcgtcgcgaatctggtcggccttgacgaagtccttggccttgcgggcctcggcgcgggcgttgagctgctcggcaatcagtgcctccagcgccgcatgttcgggtgactcggccgtgccatcagcggcaccgccggcaacgccggcggacacccacggttcggccagcgggtcgagacccaaggtgtcgagcatggcacgcacggcgagcagcgcctcacgcacctcggccttggcggtttcggaatcggcgcggtcagccagctgtgaaagcaacgtgttgccggaacggatggcggtgaagatcgcggcggttgcaccagacacattgacgtcgtcattcatggcggccacgaaatcagcgggcaggtcgtcggcggagacggcagcaacctcctcgcgagaaggctgaccgcccagtgccacgccggctcgttcgatgaagttcgagacgcggtcgtatgcggcctgcgcctcgaccagcgcctgatcggaccattcgagcatcgaccggtactgcacggagcccaaagcgtaacgcaccacccaagcggaatgctcggccagcacgctcggcacggacaggccggtgcccagcgacttcgacatcttctcgcccttggcggtcacccatgccgaatgcatccagcgcgcagcagaggggtagccggccgcgcaggtctgcgccatctcgttttcgtggtgggggaagcgcagatccaaaccgccgccgtgaatgtcgaagccatcgcccaggtaacggtgggacatggcggagcattcgatgtgccagccagggcgacccacgccgaacggcgtcgaccaacgggcgtcctcgggatcggtgtccttgggggccttccacagggcgaaatcacgcgggtcgtgcttgtcgggggaggcgtcggccgggtcgaccggattgtacttgtcggcaccggtggcgtccacggacgggcccatgcggtcggccacggcggcggcctcatcgacttcggaggtctgcttctggtgggtgagttcgccgtaatgcggccaggatgccacatcgaagtacacgttgccggtgggcttgccgtccgcatccgtgaccacatagccgtggccgttgtcgagaatgcgctgaatcaggtcgatcatgtccgacatgtggccggtggcgcgaggttccacggtgggcggcagtacgccgagcgtgttgtacgcctcggtgaattcgcgctcgtaataataggcgcgggcccaccaacgctggccggcggccgcggccttatcgaggatcttgtcgtcgatatcggtcacattacgcacaaaagtgactttgtagccgagcttcaaaaaccagcggcgcacgatgtcgaacgccacggcggcacggatatggccgatatgcggtgacgactgcacagtcgcgccacacacataaatgccgacttcgcccggcttgagcggcacgaaatggctgacctggtgcgaggcggtgtcatacagattcaggccttctgcggccttggcaacatgtatcggcgtcaggcttgaaggcatgacggaaatgttgaaatcctgcggttcttggctgtttcccataacactcaagcgtagggtccgaaccagacatgctgaatcgttactcgaagagtttgatgaacgcttcacaggcggggcccgaacgaggtgacagacggatgagaagcaggacaacagtctcgcgagaatacgtctttgaccgctgcggaaactgcgagattcatggatttgccctgcctgttacgcaaacggggaacgctcgtgccacaatagaagtcatggccacaccacaagtgctcattttgcaacatgtcccatgggaacgtccgggacgcatattgtcgaacctcgaagacatcggtcttgagacggtgacgatgaatatcgtcgacaaaaagaaaccggacttgcctgatttcggcgaactggctggcgtggtaatcatgggtggacctatgggcgcgcttgattacgacaagtatccggggctgaaggcggaagccaagttggcgcgtgccgctgtggcttcaggcaagccgattctcggtgtatgcctggggcatcagattatcgccactgcgcttggtgcgcagctgcgcaagggtgatgcgccggagattgggttcgcgccgatcaagcgtgtggacaagcatgacttcttctccatgtgggataagcagctgacggtgctgcactggcataacgacgtggtgggcttgcccgagggaggccagctgctggcacgttcgtcttccaccaaggtgcaggcgttccgactgggatccgcgctgggcatgcagttccatcttgaggtgtgcggctcgctgctggacgaatggctggatgaaccgagcatggtcaaggatctcaaggccgcgggtgggtccaagtcccaattgcgcgagcagttcgcccaatacgatcagctactgcatccgctcgccgagcaagtgttctccggttttgcggcccgctgcaactcctacgctcagacgctgaacaaataacgtttgtgggccgccgctgggcaagcgtggcgctacattggtgagtcatgccgacttatgacattggactggaacacgtttcgctcgctttcgctaccaaaaccatcttcactgatgtgacgcagggtgttttcgagggcgaccgcatcggcatcgtcggcaagaacggcgacggcaaatccacgttgctgcacctgttccgcggcacccaggagccggattccggccgcgtgacgaagcgcggcggactcacgttcggcatgcttgaccagcgcgatccgctcgacgacaacgccaccattcgcgaagccgcacttgaggggcgcgccgactacgaatgggcgtccgacaacacctcccgtgaaatcgtcgaggcattgctcggcggcatgagtctggatgccaaggtcggctccttgtctggcggccagcgtcgccgcgccgatttggcccggcttctgctcaaggattgggatattctcgcgcttgacgagcccaccaaccatctcgacgtggtcactatccactggcttgccgagcatttgaagaaccgctggtccaaaggccagggcgctctgttgctcgtgacccacgatcgctggttcttggacgaggtctgcgaatcgatgtgggaagtccacgatggcgtgatcgagccgttcgagggcgggtattcggcgtatatgctgcagcgcgtggaacgcgatcgccaagcggatgtgcgtgaaacgaagcgccgcaatctggcccgcaaggagctcgcatggctttcgcgcggtgcccgtgcccgttccaccaagcagaaattccatgtcaaggccgcgcgcgagcttattgccgacgtgccgccgatgcgtaacacacttgaactgaagcaaatggccacctcccgtctcggcaaacaggtggtcgatttggtcgacgtgacgcagattttcgaaaaaccgcagggcatggccgatatcgacccggatgtggcggcgctctccgcgtccgcttcccgcgtggatgtggtcaacgccatgtacgccgagccgcagctgcacggttccgttgaggtggcggtcaccgacctgactgacccgcgcctggtggacgccggcgtgccggaagccgtcgaggccgctgaggaagcgcgtaagaaggccgaggctgagagcggcaatccgcagcttgctgacgatcgcgaggttcgtcgcatgaacacgggtggtgaaaccatcggcggtgacactgctgcaacggattcggatgatgacactgctgcagccggtgtcacctcggctgcacgcaaggtgacggtttccggccgcgagattttggatgatgtgacatggctgattggcccgggcgaccgtttcggcatcgtcggtgcgaacggtgccggcaagtccacattgctgaagttgattgacggttcgattactccgaccgtgggccatgtgaacatcggcaaaaccgtgaagttcgccgtactctcgcagcgtcttgatgagctggagaaactgggccagtacaagatcaaggaagtgctttcccgctataagccgagctacattgtggatggcaaggaagtaacgccgggacagttgatggagcgtctcggctttgaatccgcccagttgatgacgccgattcgcgacctctccggcgggcagaagcgccgcatgcagttgctgctcatcctgctcgacgagccgaacgtgctcatcatggacgagcccggcaacgatctggacactgatatgctcgccgtcatggaggatttgctcgatacttggccgggtacgttgatcgtcgtatcccacgaccggtacctgctggagcgcgtcaccgatcagcagttcgcgctgattggcggcaaggtacgccatctgcccggtggtgtgcaggattacctcgatatggttgaggctattaagaacggcaagggattgccggctgacacgcctggcttcgcgggcaccggtagcagctcggcgaagtctggtaggggtaaggcggccgccgtcaatgctgctgcatctctccctcagtccgcttcgcggacagctccctcgtcagagggagccaataacggtgaggactccacctcgaagctcaccggcaaggccttccacgaggcatccaagcgcgtgaatgccatcgagcgcaagcttgccaaactggaagagcggaagaccgaacttgaggcacagatggccgcccatgacccgagcgactacgagggtctcaacaagctcaatgaacaactcaccgccgtcaatactgaaagcgataatctcgaagccgaatggctcgaactctccgaacaattggagtagcgggagaaaccgtaacgttcacaaggcctcggtagtttgccggggcctccctctatgcaaactcccacggattaatcaattccacgtcggtaccttcgaagtccttgatattgcgcgtggctatggccgcatcccaggaacaggcaattgccgcaatcatggcgtcttgaatactggtaggggtgcccctgcgttcgcgttcgacaaggatatgggcataatccgcagctgcctgggtgtcaaatgcgaacgtcctgtcctctaatgtcataagcgccagcttgatggtcgtatctgtgtactttcgtcgtttgccttcaggcatgcgacatattccgaccaacaactcggcgacggtgatggcggtggttgccagattgcttgtatcttggttcctcagccaattggcaacgtgttcgtctggctgtttcttgatgatttcgctgatgacgttggtgtccagaataatcatggccgattcctattcaaaagatactggctgtcgggaatcggcggaatttcgctcggatagtgggagttccccttgtcgagtccctcaaaatccatgttcttcatgaattcgcggatctcgtcgtagaaattggtctttcgtgtgatttcatgcgccaccgtgccggccagccattcttcaagaatgaatcgcacctgagattccatggagcggttgtttttctcagccacttctttgagctgctgaatctgctcatcgggtatttttcggatggtcaatgttgccatgatgcaccgccttgttgctgtcataatgctagcataaggtgctgtcattttgcttgcagtacgggtgatgaggtatgcacgcatgaaaaaggcggatatgcatcatgcacatccgccctttgagcttggactgggtctccccacagtcgccgaatcagcgcccggtaacctcggaaccgacgaccttttcgctcagggcgcgcgggccgcgggtcacggctacggcaccggagcgcaccagctcaatcacgccgtagtgctccaaaagccccagcaacgcatcgatcttgccttcggcaccggtggcctcaatggttagggactcggggtgtacgtccaccacacgcacgcggaagaggcgcacgatctccagcacgtcggaacggttggattcgtcggcggccaccttgatgagcaccagttcgcgttccacggtggagttcgggtcgagttccacgattttgagcacatgcagcagcttgttgagctgcttgatgatctgctccagtggcacggcctccacgtcggcggtcaccgtgacgcgtgagatgtccggacgctcggtgggggagacggacagcgagttgatgttgaacgcacgacgggcgaacaggccggcgatacgcgccagcacgcccgggcggttctccaccagcacggacagcgtatgacgctgggagccgggctgggatgcaggatagttagccatgagtacgctcctttcctcagcgctcgttcgcggcgccgtcatcgggaccggttcccggtgcgggcgcaccgccggccaacggcttgacgccgggcttatacgtcacttcatcgttggaggtgccggcggccaccatcggccacaccatcgcatccttccacacgcggaaatcaatcagtaccgggcggtcgttgatctggttcgccttttcgatggcggcaatcgcctcttcctcggtgaacgcgcggatacccacgcagccgtatgcctcggccaacttgatgaaatcaggcacttcgagcggcgcatcgccgtcgaccagtgccgccgcaccatcggcaccgtgcgcctcgccatcgagcaggttggtctgcgagtagtggtgctcgtagaacagcgtctgccactgacggaccatgccgtacacggagttgttcagaatcgcgatcttcaccggagcgtggtccaggaacgcggcggccagctcctcagaggtcatctggaaggaaccgtcaccatcgatcagccacaccggcttcttgccctcgaactcgcgggccgagcccacggatgcgccgatggcggctggcagaccgtagcccatcgtgccgaggcctccggaggagatccaagcgtgctggttctcgaaatcgatgaactgcgaagcccacatctggtgctgtcccacaccggtcacccagatggtggacggatcggccatctcagagagctttttgatgacccactgcggggccattgatccgtcggtcggctcatcccacgtcatcgggtattcctcgcgccagccgtcgatcgccttccaccaaggggccagattcggcttgccctgaatggcctgcgtgcgctggatttcgggaatcaagtcgtcgagcacggtagccgcatcgcccacgatcggcacgtcgggctgacggttcttgccgatttcagccgggtcgatgtcaatatgaatcacgcgggcggtcggtgcgaaggcgtcgagcttgccggtcacgcggtcgtcgaaacgtgcaccgatggccacaagcaggtcagcgcgctgcacggcaccggttgcggcaatcgtaccgtgcatgcccagcatgccgaggttcttcgggtcggagtcgggaatgatgccgcgtgcgggcagggtcgtgaccacgggggcgccggtcaggtcggccagagccttgacctgtgcgccggcgttggagcgggcggcgccgccacccacatacagcaccgggcggtacgactgagagaacagcttcgccgcgtcggacagcacacggccgtgcgccttggtggtggggttgtagccgggcagaatcatgcgctgcggccatgagtagtacatgtcgccggtctgtgcggtcttggtcagatccacgaccaccgggccggggcggccggtgttggcgatgtagtacgcctcggaaagcacgcgaggaatgtcctgcgcgcgggtcacgaggaaggagtgcttggacaccgggtaggtgatgcccacgatatccgcctcctggaaggcgtcagtgccgatggcctgcacgcccacctgaccggtaatcacgaccatgggcacggagtccatattcgcgtccgcaatggccgtgaccacgttcgtggcacccgggccggaagtcacgatgcacacgcccaccttgccagtggccagtgcgtagccttcggcggcgtggccggcggcctgctcgtggcgcataagcacgaagcggaacttcgtgttgtctttgatctcgtggtagacgggcagaatcgcgccgccaggaatgccgaagacgtcctcgacgccgagatcctccagcgaacgcaccagcgcctgggcgccggtcatcttctctccatcgacgatggtctgctggtcgggtgccgcgttgattttcggcacaccgctgaatgcctgcaaaggcgtgggtaaagccatgattcctctcacctcataggttttgtagcgaacctgaccgaccttgggatggggccgggtgcccgcgtgtctgattccagtcgcttccccgagacttgtggccccgacacgactcgtcgctcatgttggtatcagtctattcgcaaatccgacagcgggcttacttagtccgcgtcttgagcgagtccagtgacttccagcccgcttcggcggccgccagctgcgccttacgcttgctggagcccttaccgatgccgatgatgtcgccgttctcgcccaacgagacgcgcgcggtgaagatctgcgcgtattccgggccggagacctccatatggtagacaggctcctccttgccgaggccgtgcgccttgacggtcagcgaggtcttccagtcgagtgccgggccctcggtggccacttcggcgagcgtgtcgtcaataagccggtgaagcaccttgcgtgcctcgtcgatgccgtgttccaggaaagtcgcgccgatgagcgattccacgatgtcgcacagaatggagttcttctccgcgccgccctgctcggcttccccgtgacccagcagaatgtaggggcccaccttgagcttggttttggcgatggcactcagcgcgtcttcggagacggccttggcgcgcatcttggccagttgcccctcggtcatatccgggtgaatagtgaacagcgtttcagtggagaccagttcgagcaccgcgtctcccaggaattcgaggcgttcgtaattggccacgccggggtgctcatgcgagaaggagcggtgggtgagtgcctgcacgagcagatccgggctaagagtggtgcccaacgcttcaagaagctcgttggccggcgtcggctgctgtggggtttcattactcatgattgttgtatggtccttcacgcgatggtgatgtgttgtgttgtgttgtgttgtgtgcgatgcgatggtgtacgtaatggtgcacttatgcgaaggccccgccacccgtcgatggcagggccttcattcaagccgttatcgcaggactcacttggtgtgagccggctggatggcggagcggtaggtgcggccgcggtagttaccgcagctcgggcaagccatgtgcggcagggccggagcgccacagttcgggcagttcacggtcgcagcagcggtggccttccagttcgcgcgacgcgagtgcgtgttggcgcgcgaggtcttgtacttaggcagtgccatttgagtatcctctatttcgttcgaacaattgagcttaagcgtccgttatcttaacgcacggctcgtacaaactccgttcaggcgcgcgtcactcggcctgctcgccgttctgctcggcctcgagctgggctttgagccccgccaatccggcgaaacggatatccgtcacatcgtgatgatgatcgggatcctcgttcagatcggcaccgcactgcgagcacagacccttgcaatccggtcggcacagtggctgcaacggcagcgattcgaccagcgtgtcgcggatcatcgcctcgatgtccgcgaatgcgccgttctccagcagcggatacgtgtcttccgattcgtcctcgccggcgatgatgtcgatctcgtcgtccttcttgttcttgccacccttgccgttggccttgtcctgacccgactcatacgggaagaacaccgtcacatcaaccggccagtcctcgtcaatcggcttcaggcagcgcgtgcactcgctgacgaatggcgcgaccaggcggccggtgaagatcaggccgtccacaatcgaatcgaactgcccgctcacgtgtacgggctcaccttccttgatgccgacaatgctgtcgccaatgccggaaggtgctgggaaatcggcgtcaatcggcttggattgaccggcgcgcgaagcaatctgcgctaccggaatggcccacggggaatcttcaactcgtgccatggtatgttcttggtgcctttcgtatgttggctggagttattcgttactggcgttattcgcgttactgatgttgccggcgttgctgatgttgccggcgttgctggtgttactgggcttcgggatagtcgttcagcgtcaggtgcggcatccgttctccggccgcgcgctggcgctcttccagcacgttaagaccggcctgcacatcctgactgagtttgccgagctgctgggacagcccttccatcaccgtagtgcagtactggtccgcgccttgggtcagatggtcggctctggtctgtgcctggtcaagaatcgcgcgcgctttctgccgtgcaagctcggtgacgttctcctggccggccaggaactgtgcctgttcgttggcgtccttgatcatgtcggctgcgcggctttgtgcggaggcgacgatggcgttggactgggtctgtgccgattccagacggcgctcggcctcgcgcatgagggcggaggcgcgctccaactgcaccggcagcattttcttcaactcggaaagctggtcggtgaattcgtctcggtcaaccttcaccatgccgggggcgaatatgctggacttcgcttcgcccagtgccacctcgagctggtcgatgatgtcatacaccgtggtgaattcctcgcggctcttgaccgtggccgggtcgtcgtccgtggtttctcgcaggtcgggcatttcgttcatgaacgaggggcgagtgccggcggcctgagcggtctgagcttgtgcccgggtctgctgagctgcttgggcctgcgctttggcctgcatctgtgccggagtaggggtaggcgcggcgggcggcgatccggcgagaacatcggcctcttcggtgggtgccggcgcggcttgcgtagacgcgggcggttccggggcggacggctccggagtggacgatgcggtgtccgcattcggtttggtcagatcgacgtatccagtggggtggtcatcgctcatagtcattagtgcatcagtccttccgctgacgttcctcggccagagcatcggccagcatcggcacgacgcaatcgggcaccatgccggtcacgtcgcccccatggcgggccacgtccttgacgatggaactggagatgtgttcaagaatcggatcggccggcaaaaacagggtttcgatgccagcgagcttgcgattgaccagcgccatgccgagctcggcttcatagtcaccgttctggcgcagacccttgacgataacggtggcgccgaccttcttgcagtagtcggtaatcaggccgtcggtggaagaaacggtgacgttcttgcaaccggctttgtcgagggcgcggcggatcacgtcgactctggtggcgtcggaaaacatcggtgttttcgcggcgttgacggccaccaccacatgcacctcgtcgaaaaaccgcgccgagcgctcgattacgtccaagtgtccggcggtaacggggtcatacgagccggggcatactgcgatagtcatgtcttatagcctaccgctagtggtgtgcttcgtgctgccgagcgtgcattgttgtcgcgtcggcgtatgaggcagtgtgtgcggtgccgtatgtggcgtcgtgtgcggcattgtatgtggcggggtggcgtgatgcgcgacatgggtgtgtggaggtgtgcggattacgcgccaatgggtttcgcgggtaacgacgggaatctatgatggagtgcagtcgaatcgttgaatacgaggaaagaagtgcaccatgacttttgccgagatgttcgttgatgatgcagaaccgctgcgcaacccggaccaaggtgccggcacgtcggtgctggaacgcccggaaaccaaggagtctccggttcgtgacgatggcggcgacgcggatcgattcgcacattatgtttctaaggaccgtatcgccgaatcacgcgcgaccggtcgtccggtggtcgccctgtgcggcaaggtctgggtgcccaagcacgatccgtccaagtacccggtttgccccgattgcaagcgcatctacgaagagatgacgcgctaaaggtggtacttggctcccctcagcgaagggagccgaaatggtcaccgagccgaaatctcgtcgatcagcttgagctcttcgacggtgaagtgggtgttcttgagggcgtcgatgttgtcgagaatctgctgcggcttggaggctccggtcagcacggagatcaccttaccatcgtgcagcagccatgccaggctcatctcggccagcgtctggccgcgttcggcggccagattgttcaggtccacgacctgcttgtgcagtttctcggtcagagcggaatcgttgaggaatcgcggatcgtgagccatgcggctgtcggccggaatgccgttcagataacggttggtcagcaggccctgagccagcgggcagaaggtgataaggcccttgcccagcttgtaagccgtctccttcagaccgttcttttccacggtgcggtcgaggatgttgtacttgttctggttgatgatgaacggcacgtgcaggtcggtgaggatcgcggcggccttctccatcgtcggaccatcgtagttggacagacccacgtacagggccttgccggagttcacggcctgagccagtgcgcccatggtctcctccagcggggtttccgggtccgggtggtgatggtagaagatgtccacataatccaagcccaagcgttcgagcgactggtcgaggctggcgagcaggtacttgcggctgccgaggtcgccatacgggcctgcccacatttcatagccggccttggtggagatgacgagttcgtcgcggtggtgcttgaagtacttggcgagcagcaggccgcagttcttctcggcctggccgggctcggggccgtagttgttggccagatcgaagtgggtgatgccgttgtcgaaggcggtgaagaccagggacttcatctggtcgaatggcgtgatgtcgccgaagttgtgccagaagccgagtgagacggccggcaacttgaggccggaggtgccggcacggttgtaggtcatcgtgtcgtaacggtgcgggttgggagcgtaggtggtggttggctcgaacattgagtctccttacaatgtcatttttgttcttacgaatgctggtctgcgatgggcaaaccgacgccgatcgagtggtattcgtaagtgttcttagatactaaggttccagttcaagtgaacttgaatgcaaacggctgcgacgcttcggcgtgtcgccgcagtaaggagtcatgatgtcctacaccattcgtcaggtggccacgcagttccatatgcagccctctacgctgcgctattacgaggatcagggattgctgaccaacgtggagcgcaccgaaaccggccagcgtatatacgaagactgccatatcgaccgtctgcgcgcgatctgctgcttcaagaacgccggcatgaccattgacgatcttaaaaagttcttcgtgtatgagtccaatgagcccgagcatatcgacgaaatccttgatctgctggaatctcgccgcgaatccttggacgagcagcgccgagccctcaacgaggcggccatgcacgtgcagcgcaagcttcattactatggcgacatcaagcgtgccatcgacgccggtggagactggccggattggcgcgagtacaaaaaccgcgcctattccattgaatgttgaggccatcgaatgttgaggccatcgagtgctgagctggatgccggctgggcacaaagaccgatgcgcgtcgatcgtgggcgcgtctatccgagtaaggccttgctcggcagtgcgcggtcgagcagccagacaacgagcgatatcacgaagaacgccatggccagcttgccgcagctaatgccgaacccttgccagccgagtgcgtcgaggtcgatgaagtcgtacggatacggactgccgccggccgccggtccggaacccggccaaatcgccgcacgggccagcacgaagaccaagtatgcagggaaatacgccagccacgagaacatgtaatgccagcggaaacgccggtgcggatcgaatagcacgaaatcgataaccgccataatcggggcgattttgtgcagcatcgtattggtcatgatgccaataacctgtggcacgtatgccgggtcgtccggaggcatcaggaagaacgccaccagtgcggtgactgtggcgtacacagtcaggcaccccttaagccatgcgggcggctgaatgcctttgagcagtgtggccgcgccggaccacagcatcacgatgcccagcacgaaaccggtctggaacgtgaaatacacccagaactgtggtttggaccatgcctcatatgtgcccacgaagcagaaaccggcgatcgcaaagcgccacaacaccacgatgaatctcatgcatcgagtctaccgcttcgccagtgggctgtatggctttgcccggactacacttaggtgcaacttcaccacttatgtaggaaaggccttgcaatggtcgattattcgccggctctgatgaccgacatgtatgaatacacgatgctcgacgccgctctgaaagacggtaccgccgaccgcaaatgcgtgttcgaggtgttcacgcgtcgcctgcccgaaggccgtcgctatggcgtggtggccggcaccggccgcattctggatgcgctggaacatttccacttggacgaagcggacctgaagttcctggccgaccgtcacgtggtaagccccgagaccattaagtggctggagaacttccacttctccggtacgattcgcggttaccgcgaaggtgagatgttcttcccgaactccccgattttgcaggtcgaaggcacgttcggcgaatgcacgctactggagacgttgattctatccgtgctgaactacgattccgcagtggcctccgccgcctcacgtatggcgtcggcagccaaagatcgcccttgcatggatatgggcggacgccgcactaacgagtgggccgccgtggccgccgctcgagccgccgtagtgggcggattcaagggtaccgccaatctgctggccgcccggctgtatggtctgaaggccattggcaccgccgcgcattgcttcacgttggtgcatgattccgaacgtgacgccttcgaatcgcagatcgaggctttgggcaagaacaccacgctgctggtggacacctacaacatcgaggaagccgtgaaaaccgccgtcgaagtggctggtcccgaactgggtggcgtgcgcatcgactccggcgacctagccgccatggcccagcgtgtgcgcaaccagttggacgccctgggtgccacgaacaccaccattaccgtgaccaacgatttggatgagtacgcgctcgccgcattgcagaccgcgccggtcgactcctatggcgtgggcaccatgctggtcaccggctccggcgctcccacttgtgcgatggtgtacaagctcaccgaacgtgaaggcgctgacggcacgatggttccggtcatgaagaagtccaaggacaaggccacagtgcccggtcgcaagttggcattccgctcctacgaatacgcgctagccgaagccgaacacgtgatttccggctcggaagagaagctggccggtttcacgcccgaaccgacatggaagaacctgctggtcgatttcgtggaccacggccatatcgatgcgcaatggcagggccatgacgccatcatggccgcccacgactaccgcgccaaggcgttgtccgaactgcccatcaccgcacaaagcctgatgaagggcgagcccgtgattccgacggagactcaggttctctgacgagaacttccgtctccataggaatccgtcgcagcatagctgctccccttacctacggacggcccactgggctgtccgcttaacggttcgaccacagagaccaaagtcctctgaccgtatctcactggccgcatccctttggttacattggctactcttccctctgtctgtgcccctctgtctgtgttggccgcactcctgtggtcgccgccgaggcggggagatccaaccccggtcgcacccccgtgtttgcaccccctgtggctgtgtcccggggctgtattggccgcgtcccctcggctgaactgcgtcccggttcgccggacgtggttccagctgagggtggcccccttgtttttttttgggggggggctactgctcaccggggaaatatgtatatgtgcatgctgttgcaatgtacattttgttgtcagttgacaacgtcttgattcagatgaattggcgggaaatggccatttgtcttatccaattgatttgaagaacgttgtcagttgacaacgttttgtacatggtgcggaacgacacatattcctatcctggtcaggatgccgacgaggtggagtgaaaaaccaaaccatttcagaggatattgcaccgagacgttgtgggattgccgtgttgtcggtgatgttacagagatggcgcagtgttgcgtgagggggtgttgcgtgtgatgttgcgtgtgatgttgcgttgggctgattgggaggaatattctgccggtagaatgccgtgatgcgtgcggagcaatcgtttgcggagcaatcgttgaagaatcgtgtgaactgatgcgatacgaatcataccgtctctgaattgtgggatatgacgaatcgtatcatcatgggattgtgggatatgatgattgcggtttgatgaaatgaccgggaaatcggccgaggcaaggtgacttcgatgagtgaaactctcaatgatgagaacgcggcgggcaacgatgacgtatcagagcggcgcgctgtagagcatcgagcgttagaacagtacgatgtcgtgcatcacggtgtggtatctggttgccctgttaattcgtgtgcggctgtgctgaatgaagtgatgtcgcagactggttggaatgcctatgagcttgcacagcgcactggtttggatcggtctgcaattggtcgcgtattgcgtgggcaaagaggtatgttgtttgatgttttggccgaggggcttgagcgggctggttttggtcttcacctagaagccgtggccccctcgcaaacgattccggaagacgaattgcacatgttgttggcgcaactgcgtaggcctcctgatttcgatgcaatagaaagcggagcgacctggtctacgttgaagatgctctgcgtcaatctgattcatgctcggaatgttcaacatcaacgtatatcgttcgtccgagcggttgcacgggtgaacgatgcgtgctggattgcgtttctcgctggtttataccattttctgcgttgggatatcaacccaaggaacagacgcttgacattggttcctccgtaccggtatggcttggatggatggtggtccccactgccgagcgcggcaattatgcacgtgcttcatcgatatgaagagccgttgcatgacatgggctatacatatttgccgttaatcgattacgaactcaacgctatgcagcgcaagcaattcaaccaagatttcatggaatatggcattcttattccagcggacgatctctcccgatcctcatcaggtacgcaggcattgactctgtaagcgagtggtgcataagaaaatagtggcgtgcatccaagtgtcatgggatggatatgtaagcagggaatgacattgcgctggagtttgatgatggttgacgagttgctatccaagcatagagcggatggcgtatgctggggcgcatggttgaaatcaaagacatgcttggcagtcaccaaataattcgtgccgacggccgcaaggtcgacgaactgcgccccgtgcgcatcacccgccacttcaccgacgcccccgaaggctccgtgctcatcgaatgcggtaacacgcgcgtgatgtgcaccgccacttttacccccggtgtgccgcgttggcgcaaggactccggcctcggctgggtcaccgccgaatactcgatgctgccgcgtgccaccgccgaacgcaccgaccgtgaatccgtacgtggcaaaatcggtggccgtacccacgaaatcagccgactgattggccgctgcctgcgtggcgtcatcgatatgaaggcgctcggcgaaaatcagattcagcttgactgcgatgtacttcaggccgatggcggcactcgcacggcttccgtaaccggtgcgtacgtggctttggtcgacgcagtcaattgggcggagaagcaccgccatatcaagtccgccagccgcgtgcttaaggactatgtgtccgccgtatcggtgggcgtgatcaacggcactccgatgcttgacctgccatacattgaagacagtcaggccatgaccgacatgaacgtggccatgaccggttccggcaccttcatcgagattcagggcaccgcagaacaccgtccgttcaaccgtgccgaactcggcaccctgcttgacttggccgaaaagggcaacaaggaactgcaagccgcccagcgtgccgctctgtctttagactaagccagctcccctgccaaggggagccttcttaaaggagaatccatgcaaatcgtcgtcgcaacccataacgaaggcaagcttgtggaaatccgccgcattctcgaagaggatcttggcgtggatgccgaaaacatcgaactggtgtccgctggcagccttcacctgccggacccggtggaaaccggcgtcaccttccaggagaacgcgctgctcaaggcccgcgccgtggccatccgtaccggtctgcccgctgtcgcggatgattcaggtctcatcgtcgatgtgatgggtaacgctccgggcattctgtctgctcgctgggcgggtgctcacggccacgacaaggccaataatgcgctgctgctcgcccaaatcggagatattccggatgacaagcgtaccgcgcgcttccgttgcgccgccgcgctggtggtcccggacaccgaggccggtgccgacgtgaccggtggagtggctgccgacggcatcaccgttcacaccacggctgccgatgggagcactgccccggtgcatgcccggtacgccatcaagtcggagacagtggaactcggcgacatgccgggtcgcatcatccgcgaggctcgtggcgaacacggtttcggttacgatccgctgttcgtcccggacgaccagcctgccggtcgcgtcagcactgaacctgaccatgaaggcgagccgctgaccagcgccgaaatgacttcggccgagaagaatgcgatttcccaccgaggcaaggcgctgaaagccttggtccccgctatcgaggcactgctgcactaagtcgtctaggctgtctaactgcactgagccgcgactaagccacagttaagtcgcggctcagcactcagcccccgaatcgggcgagtgtctagcaagcgcctatgaccgagcaagggcgatacgaaagaaggccggcgcttagtgcgtcggccttcttgatgaacaagagccacccgatagaatcgaactaccgaccttcccacgaacgagggggatgctctaccactgagctaaggtggcgtggcttcaagagccaagtagagaatatagcactgcgtttgattcagtgcaagccagacgttcatcatctttgggccattgttctttggaccatcgtggcggcaatagtgcgaacgatgtgcacacctcatctgctcggacgccattcgtcgtgtgcgcgttatgctagcatggtgagcctgattgactcggaggcaaagggaagcatgcgtgattttgtgctggtgaagttgacagacgaagagttcgatgatttctccgccaggcatccacaaggcaatttccaacagacctcggcgatgggacgccttcgcgccgcgcaggggatcgacgtcgaatatctggccctcaaggagggcgagaagatcgtcgcggcggcactgttcgaaactcaccgctctcgattctctatatttgcggccatccatgatggcccgatgtgcgactatcacgacaccgaagcattgaccttcttcatggatgcgctgaaacgccatgccaaggcagagggtgcttcacagctggagatcacccctgaatccccatatcggcttcgcgacaccaatggagcttctttgccggatgaccagaatggcgctcccgacaataagctgatagaacagctcgaggcgatcggctttactcatggcggtttcaccgtgggctacacggcggttccgcgttggcgctacctcaaggatctggctggtattaccgatgagaaaagtctgctgaagtcctatgataagcgcacccagtggagcgtgaagcgtgcccaatcgatgggtgtgcacgtgcgtgagctgtcggacgacgagctgggggtattcgcacgaatcgagcggcaaaccgccgaacgccgtagcttcgaataccgtggcgaagcgtatttccaccgtttcaaggaagcgttcggcagcaaagcgcattttatggttgccgagatccgcatcgatgaatacatggcggacatgacggccaagcgtgaagcgctttcggccaaggtggcggcattgaccgccaaaaacgccgaacgtcccaccaccaaaaccgaacgtcagctgggggaggagacccgcaatctggcggcagccgaaaaacgcctgaacgaggcggccgagttcgccaaagacggggatgtacttccggctgcggcatcactattcgtggagcatccgcgcgaggtcatctacctgttctccggtagcgtcgagcggtacaagcccttctacgcctccgcgctgattcagcatgacgcgatgctgcatttctgcgtggaacacgggctgtctcgctacaacttctacggcatcgacggcgtctttgatgatcccgatgacgagggtcgtggtgtactggagttcaagcagggcttcaacggatatgtcgaggaacttccgggcgagttcgtgctgccggtcaaaccggttgcctatgccatgaagcaatttgcgcacaagctgctgtcgcggtaaacggacgcagcacacaggccattccagagcccagagtaacgatcagagtaacgacaagtaagaaggttcgattatgacgcaatccgatgcaggcgtcgcctcgctcacccctaccaagatcactcctgccgagctggatgcgttctccgcagctcaagtgcaaggtagtttccagcagacctcgcagatggccgccatgggtgcgttcaacggtccggtggactatgtgggtgtcaagcgcggtgacaagctgattgccgcctgctacgtggtgtacacgcggtcccgtttcggtttggaaggctcggtctggtgcggaccgctgtgcgattatgacaatccacaggtggttgaggcgatgaccgaagccctgcgtcgttcggccaaggcccatcacgccatcagcgtatcctgctggccggccgcagtctaccgtctgcatgatctggacggcaagccgaccagcgacccggacaccacgatgatggacaacatggcccgcttcggttggaaacatggcggcttcaccgtgggctacgaatccgtggtgaaccgctggaacttcgtcaaggggcttgacggcattcataacgagaaggaactgctggcctcgttctccaagtaccgccgtaagaacatccgcatcgcccaggattccggtctgcgcgtgcgccgactggaacgcggcgaactgagcattttcgtcaagctgtgcgatatgagcgccgcacgtcaaggcttcaagagccgcgatctggcctactatgagcgtctgttcgataccttcggcgacctgatcgagttcaaggtggtcgaaacccatttcgacgaatatctggacaccctgcaatccaagctgaatgcggcctccaaagacaagcgcaacctcgaacgcctgctccagcgcgcgcaacagcagccggaaggcacggccaagaagggtgcctccgacccggcaacgctggaaaagcgcatcgccaccgcagacaagaagattgcggcgctggaaaagaccatcggcgaagtcaatggcatcatcgcctcggacggcccggtcattccggtggaagccggtgtctacttctggcatccgaacgaggtcgtctgcctgtccagcggcgaggacgatcgtttcatggattactacccgtcttccctaatccacttcgaggcgatgcttgactgcatcgcccgtggcgtggagcgcttcaacttctatggcatttccggcattttcgacgccaacgatccttcctacggcgtctggcagttcaagactcgcttcggcggattcgtggaagagcttccgggcaagttcacgctgccggtggacggactgcgcttcggtgtatccgaagccgcacacaagctgctgcatcgctgacaaacagtggcgagcacggacacagaaataaggcacaggtgacgacgagatgagcgcgactgtgaatcgaacagatacgacgtatacgtttggcgtgattacgcccgaagagctcgaccggctttccgaagccacaagccagggcagcttccagcaatggtccgggcaggtccgtcttgccaagattcgtgggcatgaagccgaatgcgttggcgtgtgcgacgcatccggcaatctggtaaccggctgcgtgattctgtacctcaatggccgtttcggtgcagatggctccgtatatttcggccccatcggcattagcgatgatccggctctgctatggaccatgaccgaggcgattcgtgaatcggcccgtcgccaccatgctgtttccgtggcatgctggcctaacgtcgcctaccgtctgtattcctcggacggacagcccgacggcgagccgaacgatgcactgctgaccggattcgccgatgcaggctgggcgcatggcggattccataccggttatgacgtggtctgccagtggatgtacgtcaaggatctcacaggcatcaccaacggcaaggaactgctggcatcattcggcaaacgcgctcaatggagcgtcaagcgggcgcagtcgatgggtgtgcacgttcgcgaaatcggccccgacgagttcgacgtgttcgccgatatcgaacggcggaccggtgaacgccgcgggttcgcgacgcgcggcgcggactatttccgccagttcaagcaggcgtatggcgcggatgcgcatttcatgctcgcggaaatccacatcgccgaatatgtggcggatatgaccgccaagcgcgaggcattgcagactaaggtcgcacagctgcaggcgaaatacgatgaacgtccgaccacgcgcatcgaacgtcagctgggggaggaatcgcgcaatctcgcggccgccgacaagcgtctggctgaggtggagggatatgccaagaagggcgatgtgctgccggcagcggcttcaatgttcgtcagtcaccctaatgaggtggtctatcagtattccggttcgttggaggagtacaagccgttctatgcctcggcgctgattcagtacgaagcgatgctgcacctgtgcgtggaacagggtgtgagccgctacaacttctacggcatttccggcgtgttcgacgatccgaacgacgagggccgcggcgtgctggaattcaagcagggctttaacggctacgtcgagcagatggtaggcaaattcacgttgccggtggataagttccgcttcggcgtgagcaatctggcgcacaagctgctgcatcggtagcaactggcggtcgggggcgaacctatgtgggctgcgtctcgtctgaccgtgcgcccgccgtgtgcctacttgcgcatttgctcacacgcccatcagcgcatgagccacagtcatcatcgccagtgaaatcatcgcggtgattgccagtgagaagccagccagtttggcgttgccgagtactttgtcggtgaacagcgtggagaaaatggcgattggagacaacgcgcaaatcaccatcacggcgcgaatcgaagccgagaacggcagcaggaaccacgagatcaacgcgaaggcgacgctgaacggtatacgccaagcgatgacggccatgacttccttcacgtcatgcttggattgaggcaggtccatgagcatacccaccatcagcatcgacaccagcgcgttggcaccgctcaacggttgggtcatagaggcgatccaattgggaatcttcacgttggcgacggtcaacgcaatcatgagcagatacgtgtcgaacggcaccgagccgaagaagctcttgccgatggtgcgcagcaatgcgcggcgggcaggccgtttggcgtcgcgatccttgggcttttcgtacggcaaggtgggcgccgaaccggcgtgttgctcggcaagtgttttgccgggctgaatatgcagcagttgctgggtgagcacattggtgccggcggccaccatcacgcagttgccgatatcgaacatcgcagccggcaccaccgcgcccgcaccccagaatgactggacgaccggaaaagaaaaacagccgagattgaagccggcgccgttgagcatcaggaaggcgcggtcggtcacattgcgcttgcgggtggccagaaagatgaacacgatcgggataaaggcaaacaggaatgcgaataccgaaataagcagcagtgagatgtcatgaggattggtggcgaacgagtatacgatggcaccgggcagcacgatattgaattccgcggtctgcaacacacgataatccttctgcccgaacaggccaaaccgcttgaacagataaccggcgagaacgatcagcaacagaccaaccggcgtaagaatggcggacatacacttctctccttggctcacacaggctcatggcgcacaggctcagacccacaatgctgtgaccattatatttgccgccttggcattgccgtgtgtagaggcgtccgcaagggcttgcaattgtctcacgcatatacgaagagcctcccggaatcgttggcgattcaatgcttccaggaggctcaagccggtgcgcgagatgggacttgaacccacacgtcaaagacacaggaacctaaatcctgcgcgtctaccaattccgccactcgcgcgtgcatatccgcgtttccacaggtgtggaagatatgcaaaaccctaggccggacagccattacagaccagtcagcctagggtatccgagccacttgtcagaatcgaactgacgacctgctcattacgagtgagccgctctaccgactgagctaaagtggcttggctcgcggaaggcatttcgccagccgcgcacaagaaattaagtataagacatctccgcgaaaagtccaatcggcggcttggcggttgtgtcgcgaccgctcggttgaagatgacggttgcgccgcgccatgaactgttcgataatgcaaacgatggcaatccgacatcgctgactgatttttgttctgttcatgtccgaatttgtgagtattctgtttggtgatacggagcgcatccgagccgtgagcgaaggcgctccagtcactgatgaaaggaatggaatcctatggccatcaatccgcccgttgacgccacccagacccctgagtgggctgccctgcagaagcactatgacgagcttcaggccgaaggcgtgagcctcaagaagtggttcgccgaggacgccgagcgcgtcgagaagctgtccttcgacgccggcgacctgcacttcgatctgtccaagaacctgatcaagccggaaaccctccagctgttcgccgaccttgccaaggccgtcaagctcgatgagcgcaccaaggctatgtacaccggtgtgcacatcaacaacaccgaagatcgcgccgtgctgcacaccgcgctgcgccgcccggtcgaggatgaaggcaagtacatcgtcgacggccaggacaccgtcaaggacgtgcgcgaggtgctcgaccgcatctacgccttcgccgacaaggtccgttccggcgagtggaccggtgtgaccggcaagaagatcgagaccgtggtcaacatcggcatcggcggctccgacctgggccccgtcatggtgtacgaagccctcaagccgtacgccgacgccggcatctccgcccgctacatctccaacatcgacccgaacgacctggccgagaagaccaagggcctcgacccggagaccaccctgttcatcatcgtttccaagaccttcaccaccctggagaccctgaccaacgcccgtgaagcccgcacctggctgctcgaagagctcaaggccaagggcgccatcgacggctccgacgagaagaacgccgaagccatcaagaagcacttcgtcgccgtctccaccaacctggagaaggtcgccgaattcggcatcgacccgaacaacgcgttcggcttctggaactgggtcggcggccgttactccgtcgactccgccgtcggcacctccctggccgtggtcttcggcccggctcgtttcgaggagttcctgcacggcttccacgagatcgatgagtacttcgccaacaccccgttcgagaagaacgtcgtggtgctgctcggtatgctgaacgtctggtaccgcaacttcttcaaggtcgcctcccacgccgtgctgccgtacgaccagtatctgcaccgcttcccggcctacctgcagcagctgaccatggaatccaacggcaagtccgtgcgttgggacggcacccccgtcacctccgagaccggcgagatcttctggggcgagcctggcaccaacggccagcacgccttctaccagctgatccaccagggcacccagctcatcccggccgacttcatcgcgttcgtcaacaccccgaacccgaccaaggacggcgaccaggacgtgcacgagctgttcctgggcaactacttcgctcagaccaaggccctggcgttcggcaagaccgctgacgaagtgcgcgccgagggtactccggaggagatcgtcccggcccgcgtgttcaccggcaaccgtccgaccacctccatcttcggcgtggccctgaccccgttcgcagtcggcgagctcatcgccctgtacgagcacatcaccttcgtggaaggcaccgtgtggggcctcgactcctacgatcagtggggcgtcgagctcggcaagcagcttgccaagcagatcaccccggccatctcccaggacgacgacgccctcgccgcccaggacgcctccacccagagcctgatcaagttctaccgcgccaaccgcgagttctgatctccgctcctgcgtcgcttcaatcagaactcgcggttggcgcgccgcgctgtgttgtttgatggtcggtctggcgaccgtccatggcgcgagttctgattcgttcctctggctcccctcgggtgagaggagctgtcagtgtagctgactgaggggagtctctctcacgactagtgcccgacatcttcggatgccgggcactttgcatatacggattgctgtcggtcagatgagtcgaatggtcatattccgcttcggcatctgtttgcagacataaaggcactgtctagccaactcacgtggctgattcgcttattcgcccttattcgcctcatccaagctcagcagatcgtcatcggcatcgtaatcgaagagttcgccgtaacggccccactccacggcgatggcgaactgctgatgcgcctcgtcgttggcgtaacgggcgcgcagcaggtccagcatgagctcgccgcggagcttgccttccgcagacttccgcagtgcatgctcaatgttgtgcaccagcggcgcgtgttccattgccagtgaggcgaacacctgcttggcgcgcagaatgtccgccttatgccaggagtcgcccgcctcggtgatctgcacatggccgtcgcgtaccacgatgacgcgcagcatcgtaccggcatccaccagcgggaacaggtcgtccacctcgaacgaaagagccgaggccaaatctgccaagtcgatgccgtgaggatgctcggcaaccacatccagcagaccggcaagcccgcccggcgtggcgttgggcagcggatgctccttgattttctcgatggtcttggcgggctgaaggtctgatgcgtccgtgacggatgcgtccgtgacgggtgcgttcgtgagcgatgccgatggcgataaagcctcggcttgttgcgtaggctgcgaggcctgtccggtcaaaatcgcgtacagtcggtccaccatcgcctcgaattcgacactgtgacggtcgcgcgggcgcggcagatcaacccgcacatcggcaatcagatgccccgggtgcgagcccaacaccaccactcggtcggccatctccacggcttcctcgatgttatgcgtgaccataagcaccgacttgatgctgcgctgttcgctcgaccacagcttgagcacttcctgacgcaggttttcggcggtcagcacgtccagggcggagaacggttcatccatgaacagcgcgtccggccgcagcaccaaggcgcgtgcaatgcccacgcgctgcctcatgccgccagacagttccttcggatacgccgattcgaagccgtccaggccgatcatgtcgatggcatccagagccagtttggtgcgttccgcacgtggtacgccgcgcgccttcagaccgagttccacattgtcttgcacggtgagccacggcatcagcgcgaaggtctggaacacgagtgcgatgccgggattcggaccggtcagggcctcgccgcgatacttgaccgtgccgctggtcggcttgacaagtccggccagcgcacgcaggaatgtggacttgccggcacccgaacggcccagaatggccacgatctcgccctcgtacaggttgaacgagatgttgtcgaacacggtgagttcggtgccgttgtcggccgtgaagcgctggccgacgtgctgggcttcgatgatggtgttctgcggggtcaccgcccgcagcgaacgaatggtttccattgcaacagtcatattattctccttaagtctttagttcagtgcgaaacggcgctcggccatgcgctgcagcgggttccagaacaggcggttgacggccaccacgaacacgctcatcacggtcacgccgatgatggtcctcacggtgttgccgctttcggtggcctcggcgatatacgcgcccaagccggaggcggtcagcgtatgccgtccataacttacgatttccgagacaatcgaggcattccacgccccaccggccgccgtaatgccgcccgtgacccacgagccgaataccgccggcaaaatcaaatcgcgccaccgctgccagcgccccagctggaagctgcgcgtcatctcacgcagatcgtcgggaatctggctggccccggcgatcacattgaacaggatgtaccactgtgtgcccaacgccatcagcagaatactgccccagttgatatccacgctgcatgccacgaaccagagcgtgacgaacgggaacgtgaagttcgaggggaagctggccagcacctgcacaatcggctgcataaaccgcgaaacgcgcggattcatgccgatcatcgcgccaatcggcacccaaatcgccgagcagacgagcgtaagcagcgccacgcgcaggaacgtcaccatgcccaacacgaacgcctgcccgagctcgccgaatcccgcatcgcgatgaatcaccagcataagctgcaccagtccgaacgcacacgctgccaacaccagtactgtgaataccacgtcaagcgcgcggctgcgtgcggacttcacgtccgccgcccaacgtccaccggtccgacccaacgggcgggtcagcgtgtcgaacaggtcgccgacaggcctgaacagccaggccaccatctcatcgatatgtgactgacgaatgatggtcagcaccacactggtcttgcgcaccgccgactcgctttgcgtaatgcggaacttctccgcccacgcggtcaacggcttccacagcagtacgtcgataagcagcaccaccagcaccatcgtcacgatggcccagcagatggccgcgagattctcctcggccgccgcctgtgccacgaagctgccgatgccgggcaacgcataggtgcgattgttcaccgagatcatctcggaggcggtcaggaagaaccatccgccgcctacgctcatcatgcagttccacagcagcggaatcatcgcgttcggcacgtccagtgtccagaatcgttgccagcgtgtgagctgtagtgagcgggccgcctcgtcgagttcagttggttcgctggtcagggaccgggtgaacgagaacgccatgttccaggcctgactggtgaagattgcgaaaatcgacgcggcctccacgcccagcatcgagccggggaacagcaccatccagatggtgatggtggccgaaagaaagcccagaatcggtaccgactgcagaatatccaacagaggaatcagcacgcggctcaggcggcggcagcgcgcggccgccgtgccgtagatgaacgtgaacaccagtgagaagaacagtgccacgagcatgcggaacaccgagcgcagcgcgtaatacggcaggtcggcgagattcgtactgacttgtgacggcacgcctttcgggccgatcggttcgccgatcgccggcagaatccaagcgatcagaccgaacagcgccagaataccggacgcgaccagtacgtcggaggccaggcgtacggcgaatggttggcggtcggacgcggcggtggaagggttgcgggccgacgcatctggacgcgcgtcgacgcgattgaatgaaaacatggtcatgaaaagacctccctatgcataggaaagacgaattatgcaagggttatccaaggagcactacaggcgagagcccgacttccggataacggaatataagaaaacatggtcctcaccaccgcaactatgactgttgccggcggcggaactactggaataatcaccgtccatcggactctcacctccttcaagccgtgcgctgaaacgccagatcaataccatcgtcggtatccatgcgaccagcaggaggggcggaaagtattcgaatccgccgattcggccatcgttcaagcttcagcatcgcagggcggtggaattgcgttagttcatgccttgatccgacaagaactgctgacctgcgtgcagtgtctccactgttagcggcagcaacccatatccctgcggtagcctcgcctaccgacgctcccaagataaagcccgcccgcaggtctgtcaactacgtcgcagtgccttggtgttggaatgcaatcaggcagccattctgtccgcaataatccgtacaattgacgattgctgtgtcgagaagtgggccgccgcataagcccacgtctccatgggtccagtccgaacggccgcaaggcctgactttcggcggatcggcaggcttcccaagggcaaacccgagggataacgagaacaggccaacgcacgcgatgcgcaatcgcgtggatggccccagatctgtggctgatatgcggcagcactgaaggaaaacaatggttaacgctgttgaggcttttgacgccaagcacatgaagccggccgaggaaatcccggccttccgtcccggcgacaccgtcgacgtgaacgtgaagatccaggaaggcaacaactcccgtatccagaccttcaccggcgtggtgatcgctcgtaagggcgctggcgtgcgtgagaccttcgtggtccgcaagattagcttcggcactggtgtggagcgtcgcttcccggtgcactccccgtccatcgactccatcaagctcgtgcgtaagggccgtgtgcgccgcgccaagctgtactacctgcgcgctctgcgcggtaaggccgctcgtattgccgagcgccgcgacaactccgctaagtgagtcgattcgcgggtgcaatcgtgggcctgatgatgcaggtgcgcgaataaaccgtgaaattcagcccggaaccgtttcggtttcgggctgtttccgtattttccacgtatgatggacgggcgccggcacccctcatatccggcagcatgaatcgcgaggagatggtatgcaggacgatcaggataacggcgaattcccggtttccgacaatccggagagcaaccagacctcgtatgatgacgaggccgatgcccgcgattcccgcacgttccaagtcgccgaccacggcatcgccctgtccccggttcccccggcaccggcgcgccctgcgcacgccgcttcttccgctggcgcgaatgccgcggcagcatcatcgatggatgatgaccacttcaccctacgcgactttttcctgtggtgcggcgttcccgtgcttatcgtgctgctgattcgcattttcgccgtcggcttttacgagattccttcgcgctcgatgatggacaccatggtgcccggcgatcgcgtggcgaccagcaagctcacccccaagatcttcgatctgcagcgcggcgacgtcgtggtattcaaagatcccaacaactggttgaacgaggagcagagcagcgctctcggtggcgggtacctcatcaagcgactgatcggactgcccggtgacgtggtcgaatgcaagggcgcgggccagccggtgaccatcaacggcgtggccatcaatgagacctcctacattcgccccggcgtggatccgagcgccttcccgttctcggtaaccgtgaccgaggaccacgtgttcgtcatgggcgacaatcgcgccaattccgccgactcccgctatcatcaggatgacggcgatcgcggcttggttcccatctccgatgtggtcggagtcggaatcgcgagatactggccgcttgaccggcttggtgcgattgatgactaccacgaagtcttcaaggacgtgcctgacgcttccggctcaaattcctgagtcttcgttgaaccgtgtgagtctttgaactgattgagttccgggccgtctgaatcctgagccatatgaatcctaaccattgtgagacgatgggagccgcgcatgattaccccgacacttgacttggaacgcagccttgcggcccagggctatgaccttattactggattcgatgaagtcggccgcggcgcgctcgccggcccggtgatggtcgggtgcgccgccatctgggcccgtgatttggagccgttggatggcgatgatgccgtcgaactgtccgggcggacctacctcggcgtgccggacggcgtggccgactccaaaatgctcaccgaacataggcgcgaggcgattttcgacgaactgcgcgactggtgcgcggcctacgccgtaggccaggccagcaacaccgagatcgacgaatggggcatcacctacgcgcttggcgtggccgccctgcgcgcgctcagccaagtcgaacgcgaacttggcttacggcttggagggagattggcggcaagaaaggcttcgatggagtctgcgggggagattgtggaaggtcatccgggagactccgtaggggaatccattggaaattgtagggaaagcgttcgcgccctgcccaaagtcgccggaattctcgacgggccgagcgattacatcaccaaggcgctcaacacgttcgacgcgccggacgtgccgattccagccgatataacgaccaaagtcaaaggcgaccagcattgcgccaccgtcgccaccgcggcggtcatcgccaaagtgacccgagaccggctgatggtcgacctcgcgcaaagcaacccatgttacgccgcctacgaatgggctcataacaagggctatggttccgccgcacaccgtaccgccatcgccgaacacgggccgactccgctccaccgtgtctcatggcacctgacctgagccgcctgcgacacgacagtgtgagcgctaacgcaaaactgttgtggacgcgctaaagtcagtattgattaaggtacaagactggccgcgcatgggtgccggccgccagcggggaggttaggcagcatggtgaccggccgcaagccaagcaaacgtccgtccatgttcgaagtggccaagctcgccggagtcagccaccaaaccgtctcccgtgtgatcaatgactcgccggacgtttccgacgccacccgtgcgcgagtccaggccgccattgaccaactcggctaccgcccatccaattccgcgcgcgcactggcttcccgccgttcgcgcaccataggcctgatcgccggaggcctcaaattcttcggcccgatttcctccatctcctccatcgaatccatggcccgcgagcacggtctgttcatgagcgtgatgatggtccacgaggctttgtgcacacaggtcgacttcgacaacctgtgctacaccttcaacgagcagaacgtcgacgccttcatcttcctgactccgaccgacgtgatgttcgccgccgcctgccgtgcgcgagtcactcagccgcgcgtcatcgtcaccgccacccacggccaaatgaccgtgcgtgagggattgggccttatctccaccgaaaacaagcgtcgcactgcgctggtcggtatcgaccagtggggtgcaatggccaaagtggtggccttgctgggcgaatacgggcacaaatcggctctgtattttgccggtcccaacgaatggcgcgacgcccacacccgactggatgcgtggcgcaagctcgccgcctcccgatccatcgattcacagatcgtgcgctgccatacgtgggatgcctctgaggcatatgcgcacatgaatcatctcattgatgagtatgggcgtcggggcatggcgttacccactgcggtcgtcgccgcgaacgacaatcaggccgtcggcgtcatgcgcgcgttgcatgagcatgggcttcggattccgcaagacatcagcgtggtcggattcgacgacatgtctggcgtggataacatgtacccaccgctgaccaccgtgcatcccgatttcgaggggcttggcgtggccgccatgcgcgagacgctgcgtttgctgggggagggcggcgagccgaccttcctgaccacccagcacggcgtgggcctgatccccgccgaagtgcgtgctcggcggtccttgggaccggctccccggcggtaaggctgggcttagcggggcgcttcttcggatgattcgagggtttgcttcgctccccggtcaagattggcatggacgtgatgaccaagcaggagcacgtgcaggtcgactctctcgtgggccatggcggcatcttcaccactccgaaggtggcgcttggggtatggccgtgctcgccaactacctgtggaacaccaacgaggatcacagcaacctcgctgataagtaagcctttctgacctccctttattgagggaagtccttgagattttggaaaaacgtccatccatcacagtggaaaggtcaaaaatttctaacacgggtttgcatatttcttattccggtgtttataatgcagtcaacgtccattacattaaagaactgaggcgatggggaacgtcaccgcagacgtgcaccggttgttgttgccacgggcaacaaccatagtgactcggtccttgtccttcgtccacgttccaaccgaccctatacgcccatagaggagtgaattcccgctgcccgcgtaatcgataacgattgcgcgttgtatggcgaaagacgacgccgtcttccgccgaatagaaaatagaaagaaacgagtctgacaatggcattagatgttggcaaagcgttgaaatccaagaccttggtggtcggcgtcttgtcgatgtcgttgctgatgtccgccagcaatgcagtcagcggcaccataccggcgatgaaggaggcgttctccgactattccgcggcgaacgtcgaactgctgaccacggtgccgacgatcggctcgatggtcggcacggcattgaccggcctattcgccaatgccatcggcaggaagaaaatcgcgatggcgggattcctcatatccgccgtcacaggcgtgattccggcgttcttcccgtactattggccgattctcatatcgcgtatgttcttcggcttcgggtcggcgctgttcgtcaccttgagtgtgtcgtacatcaccgacctgtatgacggcgatatgcaacgcaagctgcttgggtggagacaggcggtcggcaatcttggcgacgtcgtgctgctgttcgtcgccagtctgctgatcaccatcaactggcaatccacgtacctcatcttcttcctgttgttcgtccccatggtgctcgtgggcatgttcattccgaaggagttcgataacttcagcattcgcagcgcgctcgtcgacgatgagggccacgtcgtcgacaagagcgcctcgcagaagcagacgacgaactggcaggtgctgtggctggcgttcatcttcctggtggtctccatgctttacaacgtcatgtccatcaagctcgccagctatgtggtcgatgaaggcatcggttccgcatcgctcgccacattgatcttcagcttcctcgtcgtcgccaccatcctctccggcgtgttgttcgacaaggtcgccaaggtcaccaagcgcctgacggtgaccatctccgaagtggtcatcggcatctgtttcatcgccactgcgctgacgaagaacgtgccgctgatgttcgccctggtgctgattgccggcttcgcatggggcatcatcaaccccgcgctgaccgcacgattcgtggactactcgcccgcgcactcgatgaacctgaccacgtccatcgtgattatcggcatcaacatcggctgtctgatctccccgtacttcttcgcgctgacggcaagcatcttcggcaattcctcggccggattcgccatcatcgtcggtggtgcgctctacctcgtgatggtggtcatcgagctgatcaccctcaaggtggacaagaagctcacggtgtgattcccgcggcgacggagccgtaccggaaccggacgacggcaatcaacgaccagcaaccaacaaccagcaaccaatcagacacacagacaacgaacaaaggagtttcaacatggtgttgttcatggccaatccacagcgtcccaagatgtatgagaagttcgtgcacgatacacccgaatggttcaagggcgccggtctcggcatcttcgcccactggggttcgtattcggtgccggcatgggcggagccgatcggtgcgcttggcacctttgacgatccggtgtactggaacacccactgcccgtatgcggaatggtattggaacacgatgagcatcaagggctcgccggcggccgagcatcagaaggaagtctacggtgacatgccgtatgaggacttcatcgacatgtggaaggccgaggcgttcgaccccgcggacatggccgacctgttcgcacgcgccggtgcccggtacttcgtgccgaccacgaagcatcacgaaggcatcacgctgtggaaggcccccgacaacgatgggtggaataccgtggaccgtggtccgcatcgcgatctggtcaaggaattcgccgacgccatgcgcgacaagggactgaagttcggcgtgtactactcctcgggcctcgactggcacaaggagcccaacatgccgattctcggcgacggggaatacgggccgcagagcgaggactacgcccgctatatgtactcgcatgtgatggacctcatcgacgaataccagccgtccatcctgtggggagatatcgacgtgccgaagatctcggaggaggacaacgatttcagcgtggcccgactgttcgagcattactacgacgtggtgccggatggtgtggtcaacgaccgctggggcctgacccattgggacttccgcaccgtcgaatacgaacagggcaaggagctcatgggcaagggcatgtgggagatgacccgaggcatcggctactccttcggctacaaccagatggaggacgccgactcctacatgaccggtccggaggcggtgaagttgctcgccgacgtggtctccatgggcggcaacctgctgctcgacatcggccccgacgccgccggacgcatccccgaactgcagcgtcagtgcctcgagggcatggccgactggatggacgtgaactcgccgagtatccatgatgtcgaaccggtgccggaagcctcgccttccggagagggggacggcgagccatgggtccgttggaccggagacggcaagagcgtctatgccgtcgtcgatgctgcgggcagggttccgctgcgcatcgccgccgatgctgtggacgcggattccgccgtgacgcttggcggatccgcagtcgccgtggacgccgacggcgacgtgctgaccgccgatgttccggcctcggaagtggcggggccgcaggtcgtgcacttcgtccgtcgctgacggattgcgctgaaggtgccgtattcgatatacagctatattatcggatgcggcaccttgtcatatgcgcgcgtacagggtagaaaatgggcatcgttcctccttggaaaggtatcgaggatttcccctcccgaaaacataattagacaatatgtctaataaaaaattatccgtccggacgcaagttttcaagtcgtcgtcgggcgtgcgattccgtttcctgggacatgaaaaaacattcacggagatcccggttcaaacacttccttccctgatcgcggtccatcatggaagccgtcatgcgcggcgaccacggaaggaagaatcatgacggcaagcaaaccaacgaacgtcctcgaaggcaatctcgcgtcggaaccgaaataccggcaggccaatagcgagaaacaggcgcgactcggaatacgatccgccgaagaacaataaaagaggtgaagcccgtatctcgcaaccactgagattcgaggtcgcttcggctgattccggtggctttctgggcattgcattcggctggacattcgacatcgcatcctgccggcatttcgtcgtggggcaaagtgtacaatcgccacgtttgctttcgcgcccagcgtaaatcgcgtcgccggctccgcgaacggatttccaatcacacagaatgccgtgaacagtcagccatgcctgttgcgcggcgaagagaaaagaagaagcagtggattatcctctctttaccaagctggccgccgagttcttcggcaccgccattctgatgatcttcggcaacggctccgtggccaacgtcgagctcaagaacaccaagggccaccacgccggctggctgaacatcgccatgggctatggcttcggcgtcatgttcccggtgctcatgttcggtggcgtatccggcgctcatatcaacccggccatgacccttgctcaggccatcaacggcctgttcccctggaatgaagtgctgccgtacatcgtcgcccagctgctcggcgccctgcttggccagctcatcgtctacatcacttactacccgcactaccaggagaccgaggacgccgaggcgattctgggcaccttctgcaccactgacgcggacaacaagaaggtcaactacttcctcaacgagatgttcggcacgctcgtgctggtgttcggcgcactgtgctgcctgacgctgccgtggggcaaggccgacgacgccgcatcctccatcgtggtcggcttcattgtgtggggcctcgtgacctccatgggtggcccgaccggccctggcctgaacccggcccgtgatctcatgccgcgactgctgcacgccatcctgccgattccgaacaagggtacgtcccgctggggcgaagcctggatcccggttgtggccccgattgtcggtgccattatcggtgtctggctgtacgtgttcttcttcgccagctgattcgttgattgattcatgcatgcaaatggcctccgctcgttttgggcggaggccattgtcgttgaatcaggtaaacgcagagactactgctccaggaacacctgcggggccttcatgaagttcgtggcgcagtgttcgccgcagaagtaatagggcttgccctcatactcgcgcgtgatcgcgtcggcattcaccgccacggtcatgccgcacaccgggtcggtggcggtttcgccgtcggtcggggtgacgtggtgcatgtgcattcccatatccatagtgttctccttgttggttggattattggattggtcggatacgtgattggttggattcagcgtggtgcgatcgtcgatgatgatggtcggctcgtgaggcgcgttggatgtggtggagccggtgatgttggcggcgttggctgattcggccgatccggctgattcgatatccgccgtgctgttgcccgagccagcggtgctatcggcagcacccacgttgatattcgccccatgcagcctgttcgcgttcagcaccaggcacaccgagctcaacgccatcgccagaccagcgatcatcgggctcaacagccagccggtgaacgggcagagtgcgccggcggccaccggaatgccgatgacgttgtagccgaacgcccaccccagattctcgcggatgttgcgcatcgtggcgttggacaggttgatggtcttgatgacgccgcgcaagtcgccgctcatcaaggtcacgtccgccgactgcatcgccacgtccgtgccggtgccgatggcgatgccgagatccgcctgggccagcgcgggggcgtcgttgatgccgtcgcccaccatcgcaatcagagtgcgggattgcgcggccgtgcgggaggcgccatccgcggacttggcggcggcctcgtcgcgttcgcgctgcagtttggcgatccagtaggccttgccgtccggcttgacctcgcagatcaccgtatcgatgccgacttcgcgggcgatgcgcccggctacctcggccttgtcgcccgatagcatcaccgtgcggatgccgcgtgcgcgcaacgccgcgatggcctcgcgcgagccttccttgactgtgtcctgctcgtagctcggcttgtcccagtcggcggccgcgtccaccacgccgcgcgtgatggtgccggtcttgtcgaacaccacggtgccgatgcgacgcgcctgttccagcgccttggcgctggtgaccagcacgccgttggtggcgcccaagcccagtgagaccgtcaccgacagcggcgtggccagtcccagcgcgcacgggcaggcgatgatcagcacgctgaccgcggtgaccagcgcatgcgccagttgcggcaccgggcccagtgacacccagatggcgaacgtccagatggcgatgatcatcaccgccggcacgaaataccgggcgatcttatcggccagctgctgcaccggcgccttggtcgcctgggcgcgggccaccatcgccgcgatctgcgagagtaccgtgtccgcgccgacctgggtggcgcgcatcacgcagtcgcccttgagcagcacggtggccccggtcaccggatcgccgacggttttggagaccggcttggattcgccggtgatcatcgattcgtcgatatgcgcctcgccggccacgatgatgccgtctgtgggcacgcgctcgccgttcttgacgaccagcaggtcgccggtggcgatggcgtcgatgtcggtgtccgtgaaatacgccggattgcgccattcgatgccgtccacattgtctgcggaagtggcgttgagtttgtgcgcggtgcgcgggcgcagtttgatgagcgactgcaccgccttgccggtgccttcgcgggccttggtttccagaaggcggccgaccagcaccaaggtgatgaccacgccaaccgattcgaaatacggttcgcgcgagccttccgggaacacccacggggcgatgcaggtcaccagcgaatacaggtaggcggccaaagtgcccagtgagaccagcgagttcatgtcgggggagtgatgcgccaacgcggggaagccgaccgtgtggatcggacgcccgcagtagaacatcaccggcgtgatcaggatggcctgcaaccacgggttcaccatccaatgcggcaccagcgtgggattggccatatgcagcatggtgacggcgaataccggcaacgtcagtaccgcgcccacaatcaccagcttcgtcagcgccttgatctcattggcacgttcagtcgcctctcgtcgatcggcctccgccgcatccacggcggtaggtgccgtatacgaagcatcaggatgaggaaggggcgtgttctcatccgagccgtcctctccctcaaccttcaacatcccatgcaccatattcatgccgcacgcaaacggatactcgcccggcggcaacgccggcagttccacgtcggtggtggcgttgcccggcagcatggcgtcaagtcccagatcagcaaacaccacatgcgaggtgcattcgccggtctcctgccggtcgaaggctagtgtgatcggcgtacccgcacgcatgctcaccacggcgggggagtacccgcccttgacggtgattgttgcggattggcgttcgccggaagcgtccatggccccggccgttgccttctgcgttccgaagaagaatcgcaggaccagccatgtcaatgcggccgccactatcagcgccgcgacggtcgagaaaatgctgaactccataactgttccttcccactcctgatgtactgaacaacagtgtataccctataccctagagggtatataatggggtgtgttcagctgacggataagtatcagggggtttgcgatgcatggttatgacgaagacaaggccaaggtcatcgcacgattacgccgtatcgaagggcaggtgcgcgccatcacgcagatggtggaggatgacaaatactgcatcgatattctgacgcagatttcggcgtcgaattcggcgctgaaatccgtggcgttattgctgctggacgatcatctcaaccattgcgtgcggcaggcgtcggtccagggcggcgaggtggccgatgaaaaacttgcggaggcttccgcggccattgcgcgtctcgtcaaatcgtgacgagttctgccgcatgatgacgcgcgctggcaaatcatgaaaggccgtctgacgctcggatacgacacggcataataacggttgatgctcgactgtgataaggccaagcgtccaatgtgggctgctgagcgtccgtttaacggcttgaaatcgtcgagttcggtaaaaatttaccgtcattcaccatcgatgacatactgggtaccatgtttgagcaaataggaaacgtgattatcgtcatcgtcgtgctagtggttggtgcagggcttggcctcttcgccggcttcgtgctggggcgccataagggtcaggagatggctcgaggcgtcaaaagcgaggagctggaggaggccaagacctcgctggagaatgcgcgattcgagaatgctgagctcagtgctcgcaatgctgccgcacaggctcagattgaaggcgtgaaccagcaattggctttcgccaagtcacaacttgcccaggcgcagcaggctgagcaggttcgcattcagcaggaacgtgagcgtgcggctgcggaggcggaacggaagcgtcaggcggatgctcgggacgccgaggccaagcgtgctgaacaggaagcgcgtttgaaagaacagagcaaggtgctcgaggcgcttgcgccagtggccaaaaatcttgataccttgcagaacaaggtcacgcagatcgaagagggccgcaagagggaaatgggcgcattgggagcccaactcaaggggctcaacgaccagcaggcccgtttggacaaggagaccagctccctgtccgccgcattgcgcaataacaaggtgcgtggcgcgtggggcgaggcccagctcaagaacattgtcgaatccgccggattgctggaacatgtcgatttcgatacccaggtggtggtcacggatgccgatgggcgtacgttgcgcccggatatgatcgtgcatctgccgggaggcaagaccattccgattgatgccaaagtgccttatgccgattaccagcgtgcctgcgaaatcccggacaccgccagtcccgaggatattgcccgccgcgatgatttgctgcggtcccatgccaaggcgttgcgcgagcatgtacgtgctctcggcgaaaaggcctattggaatgcctttgatgtggcacccgattttgtggtggccttcatccccaatgaggcactattgcaggccgcgctcgaagccgatcccacactgatggatgatgcgttctctcgcaaagtggcgctcacctcgccggtcacgctgtgggccgtgctgaaatccgtcgcctatgcctggcagcagcagtcgctcaccgatgacgccaagcagctgttcgatctgtcccgagaactgtacgaacggttctccacgttgggtgattatgccatcaaattgggcacccagattactaagacggtcagcgcctacaacaagttcgcgtccagcttggaacgccgtgtgttgcccaccgctcgcaagctgcaaaaaatcgaaccgaccaagatcatcgaggaagtaccgatcatcgaatcagataaaggcaatgtgagcgaactgtccgcccctgaagtggtgccggccgatgagggtgatactcatctgactgcctcaggcgatagtctggagtcatgactgaatctggattccgccccactggtaccccggacctcgccgtcgcgaagagccataatgactttgccatgctggagccgcgtgagcagctagccaccttgctgagggagcatgtggtgggccgtccgttctccgaacttgccgcggtgactttcgaccaccatgccgccaccgtcatgggccatgtgctgattgacgctttggaagatgcgggctattcggttgatgacttcgatgctgttggtgccttgaccgcagcatctgtgcccatggtgtccgccatgatccaggccgcctcctctcgtggcgaggacctagatggattcgtgatggacttcgtctacccgtccatcaagggcccctccatcgaaggccgccgtgtggtgctgttggatgcttggctgtccgaaaagtcgtacgtgcagaccagctcgctggtcaccctgcgcaacggcaatgagctgagcctcgactttggcatagtggagcagttgggtgccaaggtcgtggccatcgcctcgctggtcggtggcggtgccaaagacatcaatgtggtcaacccctccaccggcgacgagcaaacgctccccttcatccaggtcttcgacgaatccgaactgcggtaaatccacctttgacttccctcgcataaagtcagccgggctgagcagcgaagctgactaagaggaaccggtgaatagcgttatcgaggagaaagattgcacgcacccaaccagatttctttggctgccaaggcttcaggtgaaccggaattccgtgaaatcggccttgggccgtggtctgagacccatcccggcgagcctcgtcctgacgatccgacttctccgaattatgacggtcgtttcgactcggtgctgttgaacgacggcgaccgccgcaacgtattggaccgttaccgctactggaccgtcgctgccattaaggccgatcttgacgctcgagggcgtcacgacttcgaagttgcggtggaaaactggacccacgatttcaacatcggttccatggtccgcaccgccaacgccttccaggccaagcgcgtacacattgtcggtccacataagtggaatcgcaagggagcgttgatgaccgaactgtaccagcacgtcgaacaccaccctccatcgccgaactggtggaaagctggcatcatcgcatcgccggtgaaatcgcctatgaacgagccaaggccggtgccgccgccatccatgcgcatgatgtggctgtggatggaaacaacaagcaccttcatgagctgctggccgaaatcgatgcttgtgatgcgcgcatcaaggagcttcaagccgcccgcgtcatcgccctcgacattattcccggcgcagtgccgatggaagcctataccttccccaagcggtgcctgctgctcttcggtgcagaaggccccggattgagcgacaagtctctcgcattggccgacgatgtggtctacatctctcaattcggttccgtgcgctccattaatgcaggcgctgcggcggccgtggccatgcacgcatggattgcccaacacgccgtatcaggcgtgtagccatgcgccgacaatcccgccgcatctgcccaatatgggccacattagaggcatgatctacgccaccaaatccatcgccgcggcattaattcgcatttgccgccggcatcgtcggcatcctgctcgccgcaggcatcagcagctccgcgcagtccacactggccgaagccgttaaaccggactactggattcccgaatggtggcagtccggcctgattctcatcgcctgggctgccgccgcatggatcggcggtctcatcatcaccggaaaagcggatatcagatatcaaataacgcgggttactgctttggcagttctgccggttcggccatgatcctggcagtttgtcatggctatggctttggcggttctgcagtgaccatggttctggtgactctgaccccatggatttgaccaccgtggttcactgcgcttaaccagctcccatcactgttccagcatgaggtatgccggctgcccgcagcttattgagtaaaggatgttgttgcatcacctcctcataggtgaatcggacaatggtgtcgactttggcccggtacagtgccgtctcccgttctttctccgcctgaactgcaccacgaacacccttgcggtcattcatatccgggttcacatatttttcatagccatcgaattcgcccacgataagccgattctcaggtagccgccagaggaaatccacgcgatacagagcaccggtttgcgggtcggtgatgttttgttgcagttctggggctaataggccgcctgcgatgatggtgcctcgtccaagtgactcgccaccattctcactcgccggattggcgtaatgcagtaggcggaatatcggcgtgcaatcacgtcgcatagtgctgcacacattcagaatgtccgtgatggcgacgccgttgcgcagcgccgaatcgataatgggcagtgcaaatcggaagtcgacggacagcccgcaatccaccaccgttctggctttgctggtcaccgggagtccattggcatattctggcgtgctgcttgacgtgaagatgcgtttgacctttgcactgctggcgttggggcctcgtgatgttgtggcgagagtgatggtgccagcatgaagatgccattggtgttcaaaatcgtggatggccgctgccgtgaccccggcgaacacccaatccggatgtctgttatgaagagttcgtgcaatatgtctgatacgttcgtcgggttgcagcgaatcccagtattccgaagcggcgtacatgttggggaatacacgtttgagttcgcgcgcctgcacgcgccgagccagtgccgagcggtgtgccttggttgttccataagcgcactgttgcgttgcttcagccttcgtgatgagtatgtccactgctttgtgatgtttcatgattcgacggtatgccaatggtgaacacggtgtctatctgtctggggttatgtggttctagcttcggtgcctagatgtgtgtttttgcctgattatcaggcatctgaccgtattggactgattatgtggattcttttgggtgggtatgcaaaatgtggataactggcgaggtgcgcagggcgattgtcgttcatatgttcgatgtaggtgtgtttgggctcattgtgagcttattagggtggccatgcagatacttcagtggggcacatttgcggttgggccgtggcgttgcctcgctgcggggcgtctcagcggggcgttttattggttggaccgcggttttgttttgctgggatggctgagcggggcgtttcatcggtcagctcgcggttttgctctgctgcgagtcgtctcagtaaggtgaacttgcggtccggcaacggttttgccccgccgaagaagccagcagcggggcaaatgctcgaccggcttgagcttctgattcgctgaagggctccagtaggcgggaaaatgaggcttcccgacaactgcgtgtcacatacggctcatatagttatggccatgccaacattttcacgcgaagaaatcgtgcatttgggcgatctggcccgaatcgcgctcaccgatgaggaaatcacccgtctgcagggcgaactgaacgtcatcgcagactccatcaacaaggtccaggaagtcgcctccgacgatgtgccgccgaccgccaacccggttccgctggaagcctacctgcgcccggacgtcgccgaaaccccgctcacgcaggaagaggcgctcgccggtggcccgaagaccgaggccggcatgttcgtggcaccgcgaatcctgggaagcgaggagtaatcgatgagcaacgaaaccgcaactcttgtcaaactgtctgctgccgagcaggccgctgccatcaagaagggcgacgtcacctcccgtgagctcgtcgaagcccacctcaaggtgatcgaagccgctgagccgtctatcaaggccttcctgaaggtttccggcgatgtggctctcgagcaggccgacgccttcgacgccaagtccgccgaagacaaggccgccctgcctgagctggctggtgtgccgatcgccatcaaggacatgatcgtcaccaagggcatcgaaaccaccgccgcctccaagatcctcgagggctgggtgccgccgtacgacgccaccgtcatcgaaaagctcaaggccgccggcatgccgattctcggcaagaccaacctcgacgaattcgcccaaggctcctccaccgagcactccgcctaccagaccacccacaacccgtgggataccgagcgcgtgcccggcggttccggtggcggctccgcctccgcagtcgccgcattcgaagcaccgatcgccctcggcaccgacaccggtggctcgattcgccagcccggcgccctgaccggcaccgtgggcgtcaaacccacctacggcggcgtctcccgtttcggagccatcgccatggcctcctcgctcgaccagatcggcccggtctcccgcaccgtgctcgactccgcactgctgcaggagatcatcggtggccacgacaagcgtgactccacctccatccccgaaggcccgcgcccgatggtcgccgccgcccgcgaaggcgccaagcgcgatctgaagggcatgaaggtcggcctcatcaaggaactcggcggcgagggcttccagcccggcgtcgaggcccgtttcggcgaggccgtcgacaagctcaaggacatgggcgccgaagtcgttgaggtctcctgcccgcacatcggatactcgctgggcgcctactacatcatcatgccgtccgaggtcagctccaacctggcccgttacgatggcatgcgctacggtctgcgcgtcatgccgccggccggcgtgccccagaccgccgccaacatgatggcctacacccgtgaggccggcttcggcgacgaggtcaagcgccgcatcatcctcggcacctacgccctgtccgccggctactatgacgcctggtacggctcggctcaaaaggtccgcacgctcatcatcgaggacttcaagaaggccttcgaacaggtcgatgtgctgatctcgcccaccagcccgtccaccgccttcaagttcggcgagaagatggacgatccgctggccatgtacgtcaacgacatcgccacgattccggccaacctcgccggcatgccgccatgtccatcccggccggcctgtccgacgacggcctgcccgtcggcttccagttcatcgccccgcagcagcgcgacgaagtcatgtacaagccggctgcggccctcgaagcagcgctggaggacggctggaacggcccgatctggaacgacctcaagacccatggcttgacggtctgggcaagtgagcatcggaaggaaagaaacacatcatggctgaaaaactgatgaagtacgccgatgccaccaagaagtacgatgtggtcttcggtctggaaacccacgtggagctgtccacgaacaccaagctgttctgcccggcccacatcgagttcgcggcgagccgaacaccgaactgactccggtgagcctcggcctgccgggcagtctgccggtgatcaacaagaccgcggtcgattacgccatcaaactgggtctcgcctgc

SEQ ID NO: 5 - DNA, 13584 bp, Bifidobacterium infantis WBS-01
ggccgtacgggacgcggacgcgtgacgatcatggaagaaaagaggggccgtccatcccgctcgccccgatgggttgcggacggacggccccctcctgcgccggaacggtccgtcatgcgacgggtcgggggttcggccggctccccagtcctcgcgcgattcctcctcgttgacccagtcgcgtctcccacagggaacagccgtccgcgagcgcgtagtccacgccggtcggccgttcggtcggcacacgtgcaacgcgtcctccttgacgcgcaccatgtggcgttctgcgcgtccggctccatgcgccgtccgtgcgtcaagtcggcgtcgtacagccatggcgccgtccgtgtcgcggcgcacccgtatcgacgccgcccttaccgttcaaattcggaccatgttgtctcctttccgtttcaaggtctgaatgttccgaagcccgctatgcgtccccgcgcagcatgcgcgtggattcggcgagcatgagggccgcgcggcggccggccgcgcggatgcgttccaaccgggcgtccagcgtccctccccgtccccgtcggaatcgaggatgaggcggatcagcgttccacgtcgcgggcgagcgtggagtccagccacgcgaacagggcggagcgttccggccggccgtcggccagtccgggcacgtcgggcacgatcggcccatacgccttgcgcgctgccccattggacgcgcagcacgttccagcgcgatcgggcggatgcgttccgcatgcccgtcggcgagcaggccggcgcgggcgaacgtgagcgtcaattgggtgaacccgtatccggcgacgttcgcccggccgttcgaccaggacgggtcgtacggtttgcgttccgtcagcgtcaccccggtctccgccggagccggctccgccgcctccggttccggcttcggcgtggcggccggctccggcttcggttccggcgtcgggttccacggatcctcacccggacccgaacccatccaccggtccatcgtctcacgcccctgcggcgtctcccacggatccggcgccggttcgggcaggccggcgcgcggacgcgccacggccgcgggtttcacctccccggttttcgcctccgcgacgggggcgtccaatccgaacagatccaacatcacaggctccttccccacatgattccaaccgccggtatgcgtccccgcgaacccgacgcgcggatcgtccgggccgacgctcgacaaggcgtcccgctggcccgacggtacgatccgggccagcgggcaggcgcgcgccaccggacaccaggcgcacaggcccgacggcctcaacggcaggacgcccgacccgtccgcgcccgtcgcacgcacgatcccgtcccacgcatgatggaaacgggacacggtgtccgtgcacgccgcatccgacaggtccgccgccgcccacgcatgatgctccacatacacgtcacgcgccgcacgcacctcgcacacgccgtccgcatccagcatcagccggtacaggcgcagctggtccgcatgccgccggcgagcgtcacggtacttcggcgtgccgcccgtcttccaatccaccaccgtgccgtccacgtcgcgatagtccacggcgccacgcaacgggatgccgtcgacatccgcctccaaatcctgctccaacgcggccggctccaacacgcggcccaacgcgtccgtcaaaacaaaacccgacagcttcaacgcggccgcagccacccaatcatcctgcatggcgggcgaaccgtccggcatcgccacgccggacgggatcggctcgtcacccaaccccgcatcctccaccgcccgtactccacgccgacgcctttggcgcacagggcccgccaatccggtgcgacgacgtccggcgtggcgcacgccagctccaacgcggcgtgcacgatgccgcccaggacgagcggactgccccacaaccgcggtttcggcatcagcttctccgccgcccagcgcgccggacacgacatccacttgtccagcatgctgaacgaggcgcggccgggccgcggaagggaagcacgggccacgccgccgccgggtcgaacgtcatcaacggtccatcactcatacgcgcgcttatgcgtcccccatggaaacggaaaaggcccgccacccccagaaaaaaacggggccggcgggcggacgcgtttcagaaggcgagccccacgcatgatccaaacactcccacagccggcagtaccggcgcgacgcccactcgaaccccctgaacgggggaacggtcagccgcggatcgatccgtgcgagctccctgtcgcacaacgggacgcccagacggcgcagccacggcagacgctccatcgccaccctcaccatgcgcgcgtcatacgagccgtccgacaggggcatgggcagcgcatgatgctcggacaaggccccaggaacgattccggcacgtccaaaagacgcgccgtccgggacgcggacagcatgcccggcatcaccatcagaccaaccccctgaccgcatccacatccaggcccggcgcggccgacgccaaagcgtactgcaagtcggtgggcgacgagcccgtcggcttgaccgaacccgcagatccggatccaacgcgagcatgatcctggcggcccgcctgacgcccgccacgtccttctccaacgcctggccgaccaggattgcgcgtcgcagcggatccgtctcgtcatgccatgcgacaagcaggccgaccggcgccgacaggccacccttcaatacggccagggcgagacggtccgcatcgtccgcgtccacgtccacggcggacgcgaccacgcggcgcgtcctcccgtcgtccagcaaggccagcgcctcgcgcgcctgacgcacccgatccgcggtccacgcgaacgcggggcgcgaccgtttcggacgcggcctcgcctccacggccttcggctccgccggccccgcgtcggactgcggttccggcacggccggaacatccggcacgggttccggcgcggccggcacgggttccggctgcgggacgggctgcgggtcgaaaccgttccaaccccgatcaccatcgaacatcgacatgctattgctccttcaatccagagacgggtatcgtcacgccgcccctatgcgcgtgcgacgcatcatgccacgccccgtcgaacagacggcggcgcggcctccggacgtccggcgcaagccgcggacgaaaacgacgaaaaaagaggaaaaagaaaaaagagcaaagaagaaaaacaggagaggaaaaacgatacgacaccatcccatcagccatcagaaaagaaaaaagacaggacaccgacaccaagaacacacgcaacagacaccacaccacggcagacaccacaccaccaaacagcatcacatcaaggggaggaatcatttttccttgcaaaaaaccggatattgggggcgcatagccgcccgccatgactcaggcggctatcacgttcgtgaccggcggatccggcggcatcggcaaaagcaccgccgcccgcatgctcgcccacgcgctcggctccgcccggctgcgcaccgcgctcgtcgacggcaaccccggacagcagtcccaacgcgcctggctgaacatcccgattcgaaggcgttggaatacgcgttcgtcgacggattgcagtccgcgctcgtcaggcccagggatacgggcggcatgttcgcactgctcgccggacccgccgacccgcattccagggacatgacccacgactacctggagtcgatcatcggactgcgggccatgtgcgacatggtcgtcgtggacgcggaccgtgtcgacgggcgcctgtgggacgatcccgtttcgttcgcgggcggcgtcatgcgtcccatggtcgaggccgggggcgcgcgcatcctgttcaggataggccagtccggctcgcagacggacgacgggcttgccgcattggacgcgatccgccgtccggaccggatccgcgcggtggcggtcgcgtctcccggcgtgaagccgtggccggcacgccgttggcgggcattgctcgacgggctcgccgaatacgggggcgtggacgagtgggatgaggcgagccgtcgtctcatcgactcgcatgcgtgcgggtgggcgcatgggatggaaccggattggctgcgcggcgcctgcatttggatgggcgtggatccggatgcatggaacccggcggaggggggacggtcatggctgccatggtcccggatgcgatgagcggcgtccaggcggcacgtgacgcgggactggtccgcgcggaggcgttggtcgcggtgcgcgcgaaggcggagcgcggggatttcacgcacgccctgtccgacctgctgcgcgacgcgttgggatcgaggccgctgctgcgcctgcacatctggcgtgtcgaacaggccgcgttcgacaatcggacggcgacatgcaaacggcatgcgcggatcgcggccgaatggtgcggggtggatgggggcgcgccggatccctgacgctcgcctggctgttggacgagcggacgggcggcgcgaggcttgccgcatggctgctcgccatcagcctggacatgcgtgacgcgcatggcgggcacgcgttccgcctgtccggtcccgacccgttcgcgcatgtacgctcctagtcgctgatcaggcgggcggccatggtgccgagctcggtgatcacgtcgaattcggtgacgttgttggcggcggcgacccgttggacggcgcgtttcaggtcgggctgccagacgcgtcggcggctggtctgtgtcggccagtagaggcggacggcgtcatgcatgccggaccatgggtgcgggtcgtgttcgaggaggggcgccatgtcctgcgggatggggcgagcatgagcgtgcacgcggtgtccgtgtcgagcgtgtcgagcgtgtgatgccacagtcccgtctcgtgtgcgatccggatcgcgtcccgcatgtgccgtcggtcacggcgcgcatcatctgctccctgatccggccgacgggcctggggacgcgtaacgcgggttgcgttcgaacgggcggtgtcacggtgcgcggcaggccgagcatgttcgagaccgaggacgggcataatcccgtatacgacgacgcgtcgagcacgagcgtggccggcggcaccgtgacagccgccccgttgaacgcaacccgcgttacgcgtcccaggcccgtcggccggatcagggagcagatgatgcgcgccgtgaccgacggcacatgcgaggacgcgatccggatcgcacacgagacgggactgtggcatcacacgctcgacacgctcgacacggacaccgcgtgcacgctcatgctcgccccatcccgcaggacatggcgcccctcctcgaacacgacccgcacccatggtccggcatgcatgacgccgtccgcctctactggccgacacagaccagccgccgacgcgtctggcagcccgacctgaaacgcgccgtccaacgggtcgccgccgccaacaacgtcaccgaattcgacgtgatcaccgagctcggcaccatggccgcccgcctgatcagcgactaggagcgtacatgcgcgaacgggtcgggaccggacaggcggaacgcgtgcccgccatgcgcgtcacgcatgtccaggctgatggcgagcagccatgcggcaagcctcgcgccgcccgtccgctcgtccaacagccaggcgagcgtcagggatccggcgcgcgcccatccaccccgcaccattcggccgcgatccgcgcatgccgtttgcatgtcgccgtccgattgtcgaacgcggcctgttcgacacgccagatgtgcaggcgcagcagcggcctcgatcccaacgcgtcgcgcagcaggtcggacagggcgtgcgtgaaatccccgcgctccgccttcgcgcgcaccgcgaccaacgcctccgcgcggaccagtcccgcgtcacgtgccgcctggacgccgctcatcgcatccgggaccatggcagccatgaccgtccccctccgccgggttccatgcatccggatccacgcccatccaaatgcaggcgccgcgcagccaatccggttccatcccatgcgcccacccgcacgcatgcgagtcgatgagacgacggctcgcctcatcccactcgtccacgccccgtattcggcgagcccgtcgagcaatgcccgccaacggcgtgccggccacggcttcacgccgggagacgcgaccgccaccgcgcgatccggtccggacggcggatcgcgtccaatgcggcaagcccgtcgtccgtctgcgagccggactggcctatcctgaacaggatgcgcgcgcccccggcctcgaccatgggacgcatgacgccgcccgcgcgaacggaacggatcgtcccacaggcgcccgtcgacacggtccgcgtccacgacgaccatgtcgcacatggcccgcagtccgatgatcgactccaggtagtcgtgggtcatgtccctggaatgcgggtcggcgggtccggcgagcagtgcgaacatgccgcccgtatccctgggcctgacgagcgcggactgcaatccgtcgacgaacgcgtattccaacgccttcgaatcggggatgttcagccaggcgcgttgggactgctgtccggggttgccgtcgacgagcgcggtgcgcagccgggcggagccgagcgcgtgggcgagcatgcgggcggcggtgcttttgccgatgccgccggatccgccggtcacgaacgtgatagccgcctgagtcatggcgggcggctatgcgcccccaatatccggttttttgcaaggaaaaatgattcctcccttgatgtgatgctgtttggtggtgtggtgtctgccgtggtgtggtgtctgttgcgtgtgttcttggtgtcggtgtcctgtctttttttcttttctgatggctgatgggatggtgtcgtatcgtgttttcctctcctgtttttcttcttttgctcttttttctttttcctcttttttcgtcgttttcgtccgcggcttgcgccggacgtccggaggccgcgccgccgtctgttcgacggggcgtggcatgatgcgtcgcacgcgcataggggcggcgtgacgatacccgtctctggattgaaggagcaatagcatgtcgatgttcgatggtgatcggggttggaacggtttcgacccgcagcccgtcccgcagccggaacccgtgccggccgcgccggaacccgtgccggatgttccggccgtgccggaaccgcagtccgacgcgggccggcggagccgaaggccgtggaggcgaggccgcgtccgaaacggtcgcgccccgcgttcgcgtggaccgcgatcgggtgcgtcaggcgcgcgaggcgctggccttgctggacgacgggaggacgcgccgcgtggtcgcgtccgccgtggacgtggacgcggacgatgcggaccgtctcgccctggccgtattgaagggtggcctgtcggcgccggtcggcctgcttgtcgcatggcatgacgagacggatccgctgcgacgcgcaatcctggtcggccaggcgttggagaaggacgtggcgggcgtcaggcgggccgccaggatcatgctcgcgttggatccggatctggcgggttcggtcaagccgacgggctcgtcgcccaccgacttgcagtacgctttggcgtcggccgcgccgggcctggatgtggatgcggtcagggggttggtctgatggtgatgccgggcatgctgtccgcgtcccggacggcgcgtcttttggacgtgccggaatcgttcctgggggccttgtccgagcatcatgcgctgcccatgcccctgtcggacggctcgtatgacgcgcgcatggtgagggtggcgatggagcgtctgccgtggctgcgccgtctgggcgtcccgttgtgcgacagggagctcgcacggatcgatccgcggctgaccgttccccgttcagggggttcgagtgggcgtcgcgccggtactgccggctgtgggagtgtttggatcatgcgtgggggctcgccttctgaaacgcgtccgcccgccggcccgtttttttctggggtggcgggccttttccgtttccatgggggacgcataagcgcgcgtatgagtgatggaccgttgatgacgttcgacccggcggcgggcgtggcccgtgcttcccttccgcggcccggccgcgcctcgttcagcatgctggacaagtggatgtcgtgtccggcgcgctgggcggcggagaagctgatgccgaaaccgcggttgtggggcagtccgctcgtcctgggcggcatcgtgcacgccgcgttggagctggcgtgcgccacgccggacgtcgtcgcaccggattggcgggccctgtgcgccaaaggcgtcggcgtggagtacgggcggtggaggatgcggggttggggtgacgagccgatcccgtccggcgtggcgatgccggacggttcgcccgccatgcaggatgattgggtggctgcggccgcgttgaagctgtcgggttttgttttgacggacgcgttgggccgcgtgttggagccggccgcgttggagcaggatttggaggcggatgtcgacggcatcccgttgcgtggcgccgtggactatcgcgacgtggacggcacggtggtggattggaagacgggcggcacgccgaagtaccgtgacgctcgccggcggcatgcggaccagctgcgcctgtaccggctgatgctggatgcggacggcgtgtgcgaggtgcgtgcggcgcgtgacgtgtatgtggagcatcatgcgtgggcggcggcggacctgtcggatgcggcgtgcacggacaccgtgtcccgtttccatcatgcgtgggacgggatcgtgcgtgcgacgggcgcggacgggtcgggcgtcctgccgttgaggccgtcgggcctgtgcgcctggtgtccggtggcgcgcgctgcccgctggcccggatcgtaccgtcgggccagcgggacgccttgtcgagcgtcggcccggacgatccgcgcgtcgggttcgcggggacgcataccggcggttggaatcatgtggggaaggagcctgtgatgttggatctgttcggattggacgccccgtcgcggaggcgaaaaccggggaggtgaaacccgcggccgtggcgcgtccgcgcgccggcctgcccgaaccggcgccggatccgtgggagacgccgcaggggcgtgagacgatggaccggtggatgggttcgggtccgggtgaggatccgtggaacccgacgccggaaccgaagccggagccggccgccacgccgaagccggaaccggaggcggcggagccggctccggcggagaccggggtgacgctgacggaacgcaaaccgtacgacccgtcctggtcgaacggccgggcgaacgtcgccggatacgggttcacccaattgacgctcacgttcgcccgcgccggcctgctcgccgacgggcatgcggaacgcatccgcccgatcgcgctggaactgctgcgcgtccaatgggcggcagcgcgcaaggcgtatgggccgatcgtgcccgacgtgcccggactggccgacggccggccggaacgctccgccctgttcgcgtggctggactccacgctcgcccgcgacgtggaacgcgtgatccgcctcatcctcgattccgacggggacggggaggggacgctggacgcccggttggaacgcatccgcgcggccggccgccgcgcggccctcatgctcgccgaatccacgcgcatgctgcgcggggacgcatagcgggcttcggaacattacagaccttgaacggaaaggaagacaacatggtccgattgaacggtaagggcggcgtcgaatacgcggtgcgccgcgacacggacggcgcctggctgtacgacgccgaccttgacggcacggacggcgcatgggaccggacgcgcagaacgccacatggtgcgcgtccaaggaggacgcgttgcacgtggccgacctgaacggcctgaccggcgtggactacgcgctcgcggacggctgttccctgtgggagcgcgactgggtcaacgaggaggagatcggcgaggactgggagccggccgaaccccgacccgtcgcatgacggaccgttccggcgcaggaagggggccgtccggtcccgcaaccccatcggggcgagcggggatcggacggcccctcttttcttccatgatcgtcacgcgtccgcgtcccgtacggcccggtactcgtcgacctcacggtcggggatctggtagaccgcgtggatgaacgcgcgcatctcggtgagccgtttcggcttcacgtcctccatgagccccgtctgcctgctgcgacggcggcgcgtgtactgggtgtgcgcgcgccgcgcgtccatggcgtccatggcgaggaaacggacggccgcgtcacggctcatgcacttcctgtaggcgagcatgcgcgccgcgttgccctgaccgcctttgcgccggctgtacgcgtcgagcagcagggcgccctccctgtccgtcctcttctggccgatcagcccgatctcgaagttcacgtcgtcccaccggtcgtccgggttcgcgttgccgtggcacaggttccagaagccctggcctggatgtccggatcgtccatgcgggcgaacacgtgggccatgcggtcgcactcctgcttcgaggggacgccgtcggtcggctggtagagcatcctgaggtcgcgggcgcggcgcccttcggttcgggcatgatccgctcttgcgcttcccgtcccggtcggtccattcgccgtgcaccggtttgccgtccttgtcccttttgatcttcgtgtagttgatgaacttgaacgcgctcgccttgtcgtccgggtagccagcgcggatcacgttcgcgctcgcgttcgcgtcctcgtaatgcagttcgcgcaggatccggtccgccgtgtcccggtcggcgcgccgggcgaggctcgacgcgatcgtggatgcgggcagatacctgcggttcgggctcgagtcgatggcctgcggcgtgaatacgcgttcgcatgacggttcatgttgcggatgaggcgacgccggtcggcagccgggattcgcccaggtccgtctggaaggcggcgcgcaccgcggcctgcgttttcggatcgtggcgcatcaccgtcgagtcgagtccgggcacggacggatcctcacggaacaggatgttcccgtccccgtcgtacaggatcgcgccgtccggcccgtattcgacatggtcggccatgtcgagcaggccccgcgtctccgacgcgcttttcacctgtgtatggtcggtcagcgcgcgcatgcgcatgctttcgctcgccatggcgatcagcgggtcgggcggggccacgtcgccgcccgcatccccgcccgtcctgtcgaacgtgcccgcatacccctgcggcagtccgctcggcctgtggctccgcccgttcctgtccacgcccatgatggctcctttccgtggtcgcttgcggggacgcctatgcgcgggccggcataggcgcgcgcatggcataccgtcggaacggccggtcgcggccgaaaacgaaacgggacgaaccgtccagcccgcacgcgttcgtccgtgtcctcacgctcgccgtcgcgctcatgctgaccgcgttccgcctgccgggcatgaccgtctggtgtctgggctggctggcggcccgtctgacggcccggcgtcccgtcctgtccggcaagggtttgaacggccggccggcgcccggggacgagagggagcggcgcatggaggcgtcatggcgtcgcgcctcccggtggctcgacggcgggctgtctcccctgtatgcggatgcgatgcccgccatggcgatcgcatgcctcgactacgggtggatatcgtctgcgtccggcgcgtggcgtccgatcatggcgggcgtggacatgctggcctgctggctggccgtcatgggcgtcggccagcagcggcgtgacatgacctgcaccgtgcgcggcctggattcgaacatgcggcgcatgcgcgtcagatgggcgaggaaacgactgccgtggatactcacgggactgggcgcgggactcgtctcgcgcgtcctccaatccgcttggacgggcgtctggtggcccatcccctgctcatgtgccgggcgccgccgccccatgtggcccgcatggagggcgaaccggaaacgcttccatacggattacgagagccgtctcatggtcggccggtggatcgcgggcctgaacaagccgccgttcgacgcgctgccggggcgcgcacgacacgcgtgtcggcgcggacgggtcgcgcgtcttctcattggacgtgtcgaacgccgtccaatgggcgaacgattcgaccgtgaagacgttcacgcccgtcacccaggcggacggcatgctcgcgggcttcgcctacatgggtcgcgacaggacacgggtcacggtcgccgtctgccccgcggacgcgcccgacccggcggacctgctcgccgaccggacgatgctcgaagcgcgtctcacggtcgacgagacgcgcatgggcgccatgtacggcgcgttccccggacgcgtcacggacgtgaggaccgtcgccacgagggacggcaggcccgcggtccgttcgttccgcatcgacggtcgaacgccgactgggacatgatctcccgcgactggctgaaaggggccgcgcccggcgcgttcggcgactggatgaacacggagaacatactggtgaccgcggatcctggcggcgggcacggctgggcgagcgtggacgcggactgggactcctatgaatgggacgtggagacgatgcggacgctcatgtccgacacgctgaccgccgccatgacgatccgggccgctacatgcggctgatcggcgaggacaaacggttgaaatcgatcatgtcgggcggcctggaacccgtgaaactgcccgcccccgaaacgatcttccacgacaacacggaaaccatcgccgatccggccggctggcggatcatgtcgtatgcgatggcgataggccgcgcgtacacggccgccgactacatgcgttcgaacctgcgcgcgcgttctcggaaagcccgatcgcggacttcctgccctggctggaaggagaccggccccgcgcccgtctcctccagttcgtgcacgcgcccaacacggacgacaaccgggggctgccggacacgctgcgcgctttgaccggcgattcgagggcgcgcagcctcctggcgcgcgtcatcgtgtcgcacgcgtgcgcgcaggtgttgaaaacgcctccgacggtggcgccgccacacagttgggcgtcggccggaacacggtgtggcggatcccgatccgtctggagggcggtctgaccgcgtcggatctgcgccgcgtgcaggagcggctgaaaagcgtgatggcgcggacgagacgctttgggaatggcgggaccagggatgcgatcgtgtgggcgggcggtcggatgagcatggacgcgcgcgactggcgtcgccgatcggatctggatcggatgatccggctccggttggacgaggcgtgggccgcgtc
